US008519225B2

(12) United States Patent
Boukharov et al.

(10) Patent No.: US 8,519,225 B2
(45) Date of Patent: Aug. 27, 2013

(54) IDENTIFICATION AND USE OF TARGET GENES FOR CONTROL OF PLANT PARASITIC NEMATODES

(75) Inventors: Andrey A. Boukharov, Chesterfield, MO (US); Zijin Du, Chesterfield, MO (US); Liang Guo, St. Louis, MO (US); Michelle C. Hresko, Chesterfield, MO (US); David K. Kovalic, Clayton, MO (US); Zhaolong Li, St. Louis, MO (US); Maolong Lu, St. Louis, MO (US); James P. McCarter, St. Louis, MO (US); Nancy M. Miller, Fenton, MO (US); Mark Vaudin, Comberton (GB); Deryck J. Williams, University City, MO (US); Wei Wu, St. Louis, MO (US)

(73) Assignee: Monsanto Technology LLC, St. Louis, MO (US)

( * ) Notice: Subject to any disclaimer, the term of this patent is extended or adjusted under 35 U.S.C. 154(b) by 1265 days.

(21) Appl. No.: 11/673,351

(22) Filed: Feb. 9, 2007

(65) Prior Publication Data
US 2007/0250947 A1 Oct. 25, 2007

Related U.S. Application Data

(60) Provisional application No. 60/772,265, filed on Feb. 10, 2006.

(51) Int. Cl.
*C12N 15/82* (2006.01)
*C12N 15/87* (2006.01)
*A01H 1/00* (2006.01)

(52) U.S. Cl.
USPC ................................ 800/285; 800/286; 800/279

(58) Field of Classification Search
None
See application file for complete search history.

(56) References Cited

U.S. PATENT DOCUMENTS

| | | | |
|---|---|---|---|
| 6,506,559 B1 | 1/2003 | Fire et al. ........................ 435/6 |
| 7,576,261 B2 * | 8/2009 | Hussey et al. ................ 800/279 |
| 7,622,301 B2 | 11/2009 | Ren et al. ...................... 800/286 |
| 7,659,444 B2 | 2/2010 | Ren et al. ...................... 800/279 |
| 7,803,984 B2 | 9/2010 | Trick et al. .................... 800/279 |
| 2003/0061626 A1 | 3/2003 | Plaetinck et al. ............... 514/44 |
| 2003/0150017 A1 | 8/2003 | Mesa et al. .................... 800/279 |
| 2004/0098761 A1 | 5/2004 | Trick et al. .................... 800/279 |
| 2004/0133943 A1 | 7/2004 | Plaetinck et al. ................ 435/6 |
| 2005/0188438 A1 | 8/2005 | Ren et al. ...................... 800/286 |
| 2006/0037101 A1 | 2/2006 | Ren et al. ...................... 800/279 |
| 2007/0271630 A1 | 11/2007 | Boukharov et al. ........... 800/285 |
| 2009/0188005 A1 | 7/2009 | Boukharov et al. ........... 800/279 |

FOREIGN PATENT DOCUMENTS

| | | |
|---|---|---|
| WO | WO 01/37654 | 5/2001 |
| WO | WO 03/052110 | 6/2003 |
| WO | WO 2005/019408 | 3/2005 |

OTHER PUBLICATIONS

Thomas et al. 2001, The Plant Journal 25(4):417-425.*
GenBank Accession No. CB374546, dated Mar. 13, 2008.
Lee et al., "Regulation of gene expression, cellular localization, and in vivo function of *Caenorhabditis elegans* DNA topoisomerase I," *Genes to Cells*, 6:303-312, 2001.
Aboobaker et al., "Medical significance of *Caenorhabditis elegans*," *Annals of Medicine*, 32:23-30, 2000.
Aboobaker et al., "Use of RNA interference to investigate gene function in the human filarial nematode parasite *Brugio malayi*," *Mol. Biochem. Parasitol.*, 129:41-51, 2003.
U.S. Appl. No. 12/101,830, filed Apr. 11, 2008, Boukharov et al.
U.S. Appl. No. 60/395,153, filed Jul. 10, 2002, Trick et al.
Altschul et al., "Basic local alignment search tool," *J. Mol. Biol.*, 215:403-410, 1990.
Ashrafi et al., "Genome-wide RNAi analysis of *Caenorhabditis elegans* fat regulatory genes," *Nature*, 421:268-272, 2003.
Bargmann, "Neurobiology of the *Caenorhabditis elegans* genome," *Science*, 282:2028-2033, 1998.
Barker et al., "Plant and soil nematodes: societal impact and focus for the future," The Committee on National Needs and Priorities in Nematology, Cooperative State Research Service, U.S. Department of Agriculture and Society of Nematologists, 1994.
Burglin et al., "*Caenorhabditis elegans* as a model for parasitic nematodes," *Intl. J. for Parasitology*, 28:395-411, 1998.
Davis et al., "Nematode parasitism genes," *Annu. Rev. Phytopathol.*, 38:365-396, 2000.
Dong et al., "Genetic analysis of parasitism in the soybean cyst nematode *Heterodera glycines*," *Genetics*, 146:1311-1318, 1997.
Elbashir et al., "RNA interference is mediated by 21- and 22-nucleotide RNAs," *Genes Dev.*, 5(2):188-200, 2001.
EST Accession No. CB278684, dated Feb. 26, 2003.
EST Accession No. CB281513, dated Feb. 27, 2003.
EST Accession No. CB374668, dated Mar. 18, 2003.
EST Accession No. CB375671, dated Mar. 18, 2003.
Fairbairn et al., "Plant delivered RNAi (PD-RNAi): a novel strategy to control plant parasitic nematodes by inactivating nematode genes in planta," (Annual Meeting Abstract #372), American Society for Plant Biology, 2005.

(Continued)

*Primary Examiner* — Li Zheng
(74) *Attorney, Agent, or Firm* — Dentons US LLP; Timothy K. Ball, Esq.

(57) ABSTRACT

The invention relates to identifying and evaluating target coding sequences for control of plant parasitic nematodes by inhibiting one or more biological functions, and their use. The invention provides methods and compositions for identification of such sequences and for the control of a plant-parasitic nematode population. By feeding one or more recombinant double stranded RNA molecules provided by the invention to the nematode, a reduction in disease may be obtained through suppression of nematode gene expression. The invention is also directed to methods for making transgenic plants that express the double stranded RNA molecules, and the plant cells and plants obtained thereby.

17 Claims, 6 Drawing Sheets

(56) References Cited

OTHER PUBLICATIONS

Fire et al. "Potent and specific genetic interference by double-strnaded RNA in *Caenorhabditis elegans*," *Nature*, 391:806-811, 1998.
Foster et al., "Wolbachia genome of *Brugia malayi*: endosymbiont evolution within a human pathogenic nematode," *PLOIS Biol.*, 3(4):599-614, 2005.
Fraser et al., "Functional genomic analysis of *C. elegans* chromosome I by systematic RNA interference," *Nature*, 408:325-330, 2000.
Geary et al., "*Caenorhabditis elegans*: how good a model for veterinary parasites," *Veterinary Parasitology*, 101:371-386, 2001.
Gonczy et al., "Functional genomic analysis of cell division in *C. elegans* using RNAi of genes on chromosome III," *Nature*, 408(16):331-336, 2000.
Hamilton et al., "A species of small antisense RNA in post-transcriptional gene silencing in plants," *Science*, 286:950-952, 1999.
Harris et al., "Wormbase: a multi-species resource for nematode biology and genomics," *Nucleic Acids Research*, 32:D411-D417, 2004.
Hussein et al., "Suppression of secreted acetylcholinesterase expression in *Nippostrongylus brasiliensis* by RNA interference," *Mol. Biochem. Parasitol.*, 122:91-94, 2002.
Imhof et al., "Fitness effects of advantageous mutations in evolving *Escherichia coli* populations," *Proc. Natl Acad. Sci. USA*, 98:1113-1117, 2001.
Kamath et al., "Effectiveness of specific RNA-mediated interference through ingested double-stranded RNA in *Caenorhabditis elegans*," *Genome Biol.* 2(1):Reserach 0002.1-0002-10, 2001.
Kamath et al., "Systematic functional analysis of the *Caenorhabditis elegans* genome using RNAi," *Nature*, 421:231-237, 2003.
Kwa et al., "Beta-tubulin genes from the parasitic nematode *Haemonchus contortus* modulate drug resistance in *Caenorhabditis elegans*," *J. Mol. Biol.*, 246:500-510, 1995.
Lustigman et al., "RNA interference targeting cathepsin L and Z-like cysteine proteases of *Onchocerca volvulus* confirming their essential function during L3 molting," *Mol. Biochem. Parasitol.*, 138:165-170, 2004.
Maeda et al., "Large-scale analysis of gene function in *Caenorhabditis elegans* by high-throughput RNAi," *Curr. Biol.*, 11(3):171-176, 2001.
Martin, "Modes of action of anthelmintic drugs," *Vet J.*, 154:11-34, 1997.
Martinez et al., "Single-stranded antisense siRNAs guide target RNA cleavage in RNAi," *Cell*, 110:563-574, 2002.
McCarter et al., "Analysis and functional classification of transcripts from the nematode *Meloidogyne incognita*," *Genome Biology*, 4:R26.1-R26.19, 2003.
McCarter et al., Nematode gene sequences: update for Dec. 2003, *J. of Nematology*, 35(4):465-469, 2003.
McCarter, "Genomic filtering: an approach to discovering novel antiparasitics," *Trends in Parasitology*, 20(10):462-468, 2004.
McManus et al., "Gene silencing in mammals by small interfering RNAs," *Nature Reviews*, 3:737-747, 2002.
Mitreva et al., "A survey of SL1-spliced transcripts from the root-lesion nematode *Pratylenchus penetrans*," *Mol. Gen. Genomics*, 272:138-148, 2004.
Mitreva et al., "Comparative genomics of gene expression in the parasitic and free-living nematodes *Strongyloides stercoralis* and *Caenorhabditis elegans*," *Genome Research*, 14:209-220, 2004.
Montgomery et al., "RNA as a target of double-stranded RNBA-mediated genetic interference in *Caenorhabditis elegans*," *Proc. Natl. Acad. Sci. USA*, 95:15502-15507, 1998.
Omura et al., "An anthelmintic compound, naffiredin, shows selective inhibition of complex I in helminth mitochondria," *Proc. Natl. Acad. Sci. USA*, 98:60-62, 2001.
Papp et al., "Dosage sensitivity and the evolution of gene families in yeast," *Nature*, 424:194-197, 2003.

Papp et al., "Metabolic network analysis of the causes and evolution of enzyme dispensability in yeast," *Nature*, 429:661-664, 2004.
Parkinson et al., "A transcriptomic analysis of the phylum nematoda," *Nature Genetics*, 36:1259-1267, 2004.
Piano et al., "Gene clustering based on RNAi phenotypes of ovary-enriched genes in *C. elegans*," *Curr. Biol.*, 12:1959-1964, 2002.
Piano et al., "RNAi analysis of genes expressed in the ovary of *Caenorhabditis elegans*," *Curr. Biol.*, 10:1619-1622, 2000.
Redmond et al., "Expression of *Haemonchus contortus* pepsinogen in *Caenorhabditis elegans*," *Mol. Biochem. Parasitol.*, 112:125-131, 2001.
Ruvkun, "The taxonomy of developmental control in *Caenorhabditis elegans*," *Science*, 282:2033-2041, 1998.
Scholl et al., "Horizontally transferred genes in plant parasitic nematodes: a high-throughput genomic approach," *Genome Biology*, 4:R39.1-R39.12, 2003.
Simmer et al., "Genome-wide RNAi of *C. elegans* using the hypersensitive rrf-3 strain reveals novel gene functions," *PLOS Biol.*, 1(1):77-84, 2003.
Sonnichsen et al., "Full-genome RNAi profiling of early embryogenesis in *Caenorhabditis elegans*," *Nature*, 434:462-469, 2005.
Urwin et al., "Ingestion of double-stranded RNA by preparasitic juvenile cyst nematodes leads to RNA interference," *Mol. Plant Microbe Interact.*, 15:747-752, 2002.
Winston et al., "Systemic RNAi in *C. elegans* requires the putative transmembrane protein SID-1," *Science*, 295:2456-2459, 2002.
Winzeler et al., "Functional characterization of the *S. cerevisiae* genome by gene deletion and parallel analysis," *Science*, 285:901-906, 1999.
Zheng et al., "Conservation and diversification of Wnt signaling function during the evolution of nematode vulva development," *Natl. Genet.*, 37:300-304, 2005.
Davy et al., "A protein-protein interaction map of the *Caenoryhabditis elegans* 26S proteasome," *EMBO Reports*, 21(9):821-828, 2001.
Eisen, "Phylogenomics: improving functional predictions for uncharacterized genes by evolutionary analysis," *Genome Research*, 8:163-167, 1998.
Hamilton et al., "Two classes of short interfering RNA in RNA silencing," *The EMBO J.*, 21(17):4671-4679, 2002.
Schwarz et al., "Asymmetry in the assembly of the RNAi enzyme complex," *Cell*, 115:199-208, 2003.
Silhavy et al., "A viral protein suppresses RNA silencing and binds silencing-generated, 21- to 25-nucleotide double-stranded," *The EMBO J.*, 21(12):3070-3080, 2002.
Qiu et al., "A computational study of off-target effects of RNA interference," *Nucleic Acids Res.*, 33(6):1834-1847, 2005.
GenBank Accession No. CB351902, dated Dec. 22, 2003.
GenBank Accession No. CB351909, dated Dec. 22, 2003.
GenBank Accession No. CB376018, dated Mar. 18, 2003.
GenBank Accession No. CB825016, dated Apr. 16, 2003.
Nucleotide Sequence Alignment between SEQ ID No. 1289 and GenBank Accession No. CB351902, dated Dec. 22, 2003.
Nucleotide Sequence Alignment between SEQ ID No. 1289 and GenBank Accession No. CB351909, dated Dec. 22, 2003.
Nucleotide Sequence Alignment between SEQ ID No. 1289 and GenBank Accession No. CB376018, dated Mar. 18, 2003.
Nucleotide Sequence Alignment between SEQ ID No. 1289 and GenBank Accession No. CB825016, dated Apr. 16, 2003.
Nucleotide Sequence Alignment between SEQ ID No. 1513 and GenBank Accession No. CB351902, dated Dec. 22, 2003.
Nucleotide Sequence Alignment between SEQ ID No. 1513 and GenBank Accession No. CB351909, dated Dec. 22, 2003.
Nucleotide Sequence Alignment between SEQ ID No. 1513 and GenBank Accession No. CB376018, dated Mar. 18, 2003.
Nucleotide Sequence Alignment between SEQ ID No. 1513 and GenBank Accession No. CB825016, dated Apr. 16, 2003.

\* cited by examiner

| Locus | Description | N2 egg start | N2 L4 start | Outcome |
|---|---|---|---|---|
| control | actin | mobile adults, sterile | P0-WT, few progeny | positive control |
| control | GFP | WT, >200 progeny<br>WT, >200 progeny | WT, >200 progeny<br>WT, >200 progeny | negative control |
| R03E1.2 | VAC1 | WT, 20e | P0-WT, few progeny | Phenotype, not Po lethal |
| Y57E12AL.a | | WT, 75e | P0-WT, red. brood | Phenotype, not Po lethal |
| C34G6.6 | PAN1 | dead, 0e | mobile adult, LVL | Po Lethal From Egg Start |
| F52B11.3 | PAN2 | dead, 0e | mobile adult, LVL | Po Lethal From Egg Start |
| F54D11.1 | MT | P0-WT, LVA<br>P0-WT, LVA<br>P0-WT, LVA | P0-WT, LVA<br>P0-WT, LVA<br>P0-WT, LVA | Phenotype, not Po lethal |
| T25C8.2 | act-5 | P0 very sick, sterile<br>P0 sick, sterile or few F1s all LVA<br>dead, 0e | P0-WT, LVL-LVA<br>P0 sick, sterile or few F1s all LVA<br>P0 WT, F1 LVL/LVA | Po Lethal From Egg Start |
| Y57G11C.15 | Transport protein Sec61 | very sick, sterile<br>very sick, sterile, dead | mobile adult, sterile<br>RUP, dead | Po Lethal From Egg & L4 Start |
| C47E12.5 | uba-1 | dead, 0e<br>dead, 0e | P0-WT, LVL<br>P0 WT, F1 LVL | Po Lethal From Egg Start |
| Y41E3.1** | | WT<br>WT<br>30% reduced brood | WT<br>WT<br>WT | No Effect yet |
| Y57E12AL.6 | | bag-o-worms I larvae<br>P0 red brood, sick F1 LVA | mobile adult, F1 LVA<br>mobile adult, F1 LVA | In progress |
| C32E12.4 | | mobile adults, sterile<br>WT | WT<br>WT | In progress |
| Y48B6A.1* | | WT<br>WT<br>WT | WT<br>WT<br>WT | No Effect yet |
| Y48B6A.1* | | | | In Progress |
| R07F4.6* | kin-2 | Very DPY, sick, sterile<br>Very DPY, sterile, dead<br>Very DPY, sterile, dead | P0 DPY, red brood, F1 25% DPY<br>P0 DPY, red brood, F1 75% DPY<br>P0 DPY, red brood, F1 90% DPY | Po Lethal/Dpy From Egg & L4 Start |
| K11D9.2a | sca-1 | P0 WT, red. brood - F1 LVA<br>P0 sterile, gro, sick | P0 WT, red. brood - F1 LVA<br>P0 mobile, red eggs, F1 LVA | Po Sick From Egg Start? |
| ZK20.3** | | WT<br>WT | WT<br>WT | No Effect yet |
| K07B1.7** | | WT<br>WT | WT<br>WT | No Effect yet |
| C38D4.6 | | P0 WT, F1 LVL | P0 WT, F1 LVL | Phenotype, not Po lethal |
| T02E1.5** | dhs-3 | WT<br>WT | WT<br>WT | No Effect yet |
| F17E9.5*** | | WT | WT | In Progress |
| C25D7.2*** | | WT | WT | In Progress |
| K06B4.1 | | WT | WT | In Progress |
| F08B1.1a | | 85% reduced brood | WT | Phenotype, not Po lethal |
| C34F11.6 | | WT | WT | In Progress |
| T14G10.5 | | | | In Progress |
| F28D9.8 | | to be done | to be done | In Progress |
| W09G12.7 | | | | In Progress |
| C37C3.2 | | to be done | to be done | In Progress |

FIG. 2

| Rank SCN Targets v2.0, 4/15/05 | locus | gene name | Brief Identification | top % ID | top bit | min e-val | RNAi Phenotype Rank | LET LVL LVA | MLT BLI RUP | STE EMB | GRO SCK UNC PRL PRZ | WT | WT % of Weighted Reports | Divergence PO RNAi Phenotype | Divergence Intestinal RNAi Phenotype | total H.g ESTs | J2, J3, J4 H.g ESTs | Total ESTs Other Species |
|---|---|---|---|---|---|---|---|---|---|---|---|---|---|---|---|---|---|---|
| 1 | C02C6.1 | dyn-1 | dynamin | 75.32 | 339 | 1.00E-92 | 3 | 2.3 | 1 | 2.6 | 1.6 | 0 | 0.0% | | | 1 | 1 | 0 |
| 2 | Y57G11C.15 | sec61 alph | protein transport protein | 95.04 | 499.2 | 3.00E-142 | >44 | 0 | 0 | 3 | 1 | 0 | 0.0% | PO leth 80% Red | ND | ND | ND | ND |
| 3 | C47E12.5 | ube-1 | ubiquitin-activating enz | 56.28 | 329 | 1.00E-124 | >44 | 0 | 0 | 4.7 | 2 | 0 | 0.0% | PO leth 40-100% R | ND | ND | ND | ND |
| 4 | R07E4.6 | kin-2 | regulatory subunit of a | 85.05 | 328.2 | 7.60E-91 | 34 | 2.2 | 0 | 0 | 1.6 | 0 | 0.0% | PO lethal, egg & L4 | | 1 | 0 | 0 |
| 5 | ZK1151.1 | vab-10 | spectraplakins (VAB-1C | 58.85 | 547.7 | 9.00E-161 | 6 | 4 | 1.8 | 1.2 | 4 | 1 | 8.3% | | | 3 | 3 | 106 |
| 6 | T14F9.1 | vha-15 | ATPase subunit | 61.68 | 213.4 | 3.50E-56 | 3 | 3 | 1 | 2.6 | 1 | 0.3 | 3.8% | | | 2 | 2 | 3 |
| 7 | C34G6.6 | C34G6.6 | Zona pellucida-like don | 57.58 | 217.6 | 2.40E-75 | 10 | 3.2 | 0 | 3.2 | 1 | 0 | 0.0% | Po lethal, egg start | | 1 | 1 | 1 |
| 8 | Y48B6A.3 | Y48B6A.3 | XRN 5'-3' exonuclease | 73.27 | 482.3 | 8.00E-137 | 3 | 3.6 | 1 | 2.6 | 2 | 0 | 0.0% | | | 2 | 0 | 6 |
| 9 | Y23H5A.7 | crs-1 | aminoacyl-tRNA synthe | 40.15 | 178.7 | 9.90E-66 | 6 | 2.2 | 1 | 1 | 1 | 0 | 0.0% | | | 1 | 0 | 0 |
| 10 | F20B6.2 | vha-12 | vacuolar ATP synthase | 77.8 | 521 | 3.00E-150 | 10 | 2.3 | 0 | 2.6 | 2 | 0 | 0.0% | | | 5 | 3 | 1 |
| 11 | K07D4.3 | rpn-11 | non-ATPase subunit of | 91.93 | 407.9 | 6.00E-115 | 10 | 2 | 0 | 2.6 | 1 | 0 | 0.0% | | | 1 | 0 | 0 |
| 12 | F25H5.4 | eft-2 | Elongation factor Tu fa | 85.47 | 1016.5 | 0.00E+00 | 39 | 1.2 | 0 | 2.8 | 0 | 0 | 0.0% | | | 8 | 4 | 0 |
| 13 | C36B1.4 | pas-4 | proteasome A-type sub | 74.29 | 320.9 | 7.40E-89 | 10 | 2.3 | 0 | 2.8 | 1.6 | 0 | 0.0% | | | 1 | 1 | 32 |
| 14 | F25H2.9 | pas-5 | proteasome zeta chain | 64.54 | 319.3 | 2.10E-88 | 10 | 2.9 | 0 | 2.6 | 1.6 | 0 | 0.0% | | | 0 | 0 | 11 |
| 15 | F56C11.1 | bli-3 | large homolog of dual c | 68.6 | 129 | 1.50E-29 | 5 | 5.4 | 6.5 | 1 | 0.6 | 0 | 0.0% | | | 3 | 3 | 0 |
| 16 | C07H6.5 | cgh-1 | ATP-dependent RNA h | 80.2 | 326.2 | 3.40E-90 | 25 | 1 | 1 | 7 | 0 | 0.3 | 3.2% | | | 2 | 1 | 0 |
| 17 | F49D11.1 | F49D11.1 | WD domain, G-beta re| | 64.04 | 790.4 | 0.00E+00 | 26 | 1.2 | 0 | 3.2 | 1.6 | 0 | 0.0% | | | 1 | 0 | 0 |
| 18 | C56G2.6 | let-767 | short-chain dehydroger | 52.17 | 294.3 | 9.90E-81 | 10 | 2.3 | 0 | 2 | 2.6 | 0 | 0.0% | | | 11 | 11 | 0 |
| 19 | CD4.6 | pas-6 | protease | 58.18 | 271.6 | 5.40E-74 | 26 | 1.2 | 0 | 3.6 | 1.6 | 0 | 0.0% | | | 2 | 2 | 1 |
| 20 | K01G5.4 | ran-1 | GTP-binding protein | 94.19 | 344 | 6.00E-107 | 10 | 2 | 0 | 5.6 | 2 | 0 | 0.0% | | | 0 | 0 | 49 |
| 21 | T25C8.2 | act-5 | Actins | 92.51 | 713.8 | 0.00E+00 | >44 | 0 | 0 | 3.7 | 1 | 0 | 0.0% | PO leth 70-90% Re | | 2 | 2 | 1034 |
| 22 | C54G4.8 | cyc-1 | cytochrome C1, heme | 58.54 | 120.9 | 5.70E-28 | 10 | 2.2 | 0 | 3.2 | 1 | 0 | 0.0% | | 50-80% Re | 0 | 0 | 7 |
| 23 | C52E4.4 | rpt-1 | 26S protease regulator | 75.23 | 679.5 | 0.00E+00 | 26 | 1 | 0 | 3.6 | 1 | 0 | 0.0% | | | 0 | 0 | 32 |
| 24 | H06I04.4 | ubl-1 | ubiquitin | 51.46 | 167.9 | 4.20E-43 | 10 | 3.1 | 0 | 7.6 | 2 | 0 | 0.0% | | | 0 | 0 | 31 |
| 25 | Y49A3A.2 | vha-13 | ATP synthase alpha en | 86.95 | 1006.1 | 0.00E+00 | 26 | 1 | 0 | 3.2 | 2 | 0 | 0.0% | | | 11 | 2 | 6 |
| 26 | M01E5.5 | top-1 | DNA topoisomerase I | 72.57 | 333.6 | 4.20E-92 | 20 | 1.2 | 2 | 0 | 1.8 | 0.3 | 5.7% | | | 1 | 0 | 1 |
| 27 | ZK1127.5 | ZK1127.5 | RNA 3'-terminal phosp | 54.62 | 406.8 | 2.00E-114 | 10 | 2.6 | 0 | 3.6 | 3 | 0 | 0.0% | | | 3 | 2 | 0 |
| 28 | C26E6.4 | C26E6.4 | DNA-directed RNA poly | 82.78 | 627.5 | 0.00E+00 | 26 | 1 | 0 | 4.6 | 1 | 0 | 0.0% | | | 8 | 6 | 0 |
| 29 | F43D9.3 | F43D9.3 | Sly1, vesicle trafficking | 57.79 | 218 | 2.00E-57 | 10 | 2 | 0 | 3 | 3 | 0 | 0.0% | | | 1 | 0 | 0 |
| 30 | F52B11.3 | F52B11.3 | PAN domain;Zona pell | 66.67 | 103.6 | 3.10E-22 | 15 | 2.3 | 0 | 1.6 | 1.6 | 0 | 0.0% | PO lethal, egg start | | 1 | 0 | 2 |
| 31 | C30C11.4 | C30C11.4 | Mal3p | 49.09 | 221 | 2.00E-58 | 3 | 2 | 1.6 | 3 | 4.2 | 0 | 0.0% | | | 53 | 20 | 81 |
| 32 | F01G10.1 | F01G10.1 | transketolase | 82.83 | 542.3 | 5.00E-155 | 26 | 1 | 0 | 2.7 | 2 | 0 | 0.0% | | | 5 | 5 | 88 |
| 33 | C23H3.4 | C23H3.4 | aminotransferase | 56 | 111.3 | 6.00E-102 | 15 | 2.6 | 0 | 1.6 | 2.6 | 0 | 0.0% | | 80% Red | 1 | 1 | 0 |
| 34 | K01C8.10 | cct-4 | T-complex protein | 74.59 | 623.2 | 2.00E-179 | 42 | 0.8 | 1 | 4.2 | 0 | 0 | 0.0% | | | 17 | 10 | 11 |
| 35 | F54B3.3 | F54B3.3 | ATPases associated w | 61.9 | 129 | 4.80E-47 | 10 | 2.6 | 0 | 3.6 | 1 | 0 | 0.0% | | | 0 | 0 | 0 |
| 36 | T08B2.9 | frs-1 | phenylalanyl-tRNA synt | 68.91 | 425.2 | 9.00E-124 | 26 | 1.2 | 0 | 8.5 | 1 | 0 | 0.0% | | | 2 | 2 | 49 |
| 37 | F53G12.3 | F53G12.3 | partial homolog of dual | 69.77 | 130.6 | 5.00E-30 | 9 | 3.4 | 3.8 | 0 | 3.4 | 0 | 0.0% | | | 3 | 3 | 1 |
| 38 | C01H6.5 | nhr-23 | nuclear hormone recep | 83.58 | 121.7 | 1.20E-41 | 14 | 4.2 | 1 | 0 | 2.2 | 1 | 11.9% | | | 2 | 2 | 0 |
| 39 | ZK792.6 | let-60 | LET-60 RAS protein | 77.17 | 294.3 | 4.70E-81 | 10 | 3.4 | 0 | 2 | 1.2 | 1 | 13.2% | | | 1 | 0 | 0 |
| 40 | W02F12.5 | W02F12.5 | dihydrolipoamide succi | 67.5 | 156.4 | 2.30E-38 | 26 | 1.3 | 0 | 2.6 | 1 | 0 | 0.0% | | | 1 | 0 | 3 |
| 41 | Y32F6A.3 | pap-1 | POLY(A) POLYMERAS | 60.44 | 404.4 | 2.00E-113 | 26 | 1.6 | 0 | 3.3 | 2 | 0 | 0.0% | | | 3 | 1 | 0 |
| 42 | M28.5 | M28.5 | ribosomal protein (L7A | 93.33 | 218.4 | 1.70E-58 | 10 | 2.6 | 0 | 2.6 | 1 | 0 | 0.0% | | | 2 | 2 | 64 |
| 43 | Y105E8A.9 | apt-1 | gamma subunit of adap | 74.11 | 342.8 | 2.00E-105 | 10 | 2.2 | 0 | 3.2 | 2 | 0 | 0.0% | | | 1 | 0 | 4 |
| 44 | C54D1.5 | C54D1.5 | Laminin EGF-like (Dom | 62.22 | 213 | 2.00E-149 | 26 | 1.6 | 0 | 3.6 | 1 | 0 | 0.0% | | | 3 | 3 | 16 |
| 45 | T20H4.3 | prs-1 | Prolyl-tRNA synthetase | 73.26 | 300.4 | 2.00E-106 | 10 | 3.3 | 0 | 4.6 | 2 | 0 | 0.0% | | | 2 | 0 | 1 |
| 46 | F40F8.10 | rps-9 | ribosomal protein S9 | 79.57 | 297.4 | 5.80E-82 | 10 | 2.3 | 0 | 4.2 | 1 | 0 | 0.0% | | | 1 | 0 | 4 |
| 47 | K04G7.4 | K04G7.4 | NADH dehydrogenase | 63.16 | 225.7 | 6.40E-60 | 10 | 2.6 | 0 | 2.6 | 1 | 0 | 0.0% | | | 5 | 3 | 2 |
| 48 | Y55H10A.1 | Y55H10A.1 | cadherin | 53.73 | 96.67 | 4.60E-21 | 33 | 1 | 0 | 1.6 | 1 | 0 | 0.0% | | 80% Red | 6 | 5 | 0 |
| 49 | F29G9.3 | apt-2 | clathrin coat assembly | 89.55 | 266.9 | 6.10E-73 | 10 | 2.9 | 0 | 2.6 | 1.6 | 0 | 0.0% | | | 0 | 0 | 2 |
| 50 | F27C1.7 | F27C1.7 | ATPase | 55.36 | 214.2 | 5.00E-57 | 24 | 2.3 | 0 | 2.8 | 0 | 0 | 0.0% | | | 2 | 2 | 0 |
| 51 | Y55F3AR.3 | Y55F3AR.3 | TCP-1/cpn60 chaperon | 52 | 204.1 | 7.00E-147 | 26 | 1.3 | 0 | 2.6 | 3.8 | 0 | 0.0% | | | 17 | 10 | 0 |
| 52 | F10C1.2 | ifb-1 | Intermediate filament p | 60.14 | 593.6 | 2.00E-170 | 12 | 1.9 | 2 | 1.6 | 1.6 | 0 | 0.0% | | | 1 | 0 | 3 |
| 53 | F26H11.3 | ars-2 | aminoacyl-tRNA synthe | 49.58 | 307 | 2.00E-140 | 26 | 1.3 | 0 | 3.8 | 1.6 | 0 | 0.0% | | | 1 | 1 | 2 |
| 54 | C52E4.6 | cyl-1 | Cyclin, N-terminal dom | 56 | 226.1 | 5.40E-80 | 10 | 2.6 | 0 | 2.6 | 2 | 0 | 0.0% | | | 1 | 1 | 0 |
| 55 | T01C3.7 | fib-1 | fibrillarin | 79.73 | 221.5 | 9.30E-59 | 10 | 2.6 | 0 | 3.6 | 2 | 0 | 0.0% | | | 1 | 1 | 0 |
| 56 | T05H4.6 | T05H4.6 | eukaryotic peptide chai | 74.75 | 298.5 | 3.00E-116 | 26 | 1.3 | 0 | 2.6 | 1.3 | 0 | 0.0% | | | 1 | 1 | 11 |
| 57 | K08B4.1 | lag-1 | DNA-binding protein | 62 | 104.4 | 3.50E-23 | 17 | 1.6 | 2 | 2.6 | 0 | 0 | 0.0% | | | 1 | 1 | 0 |
| 58 | C29F9.7 | pat-4 | Integrin-linked kinase | 66.42 | 110.2 | 2.10E-37 | 10 | 3.2 | 0 | 4.3 | 2.7 | 0 | 0.0% | | | 4 | 3 | 0 |
| 59 | T01H3.1 | T01H3.1 | proteolipid protein PPA | 75.81 | 180.6 | 5.20E-76 | 26 | 1 | 0 | 2.2 | 1 | 0 | 0.0% | | 60% Red | 0 | 0 | 0 |
| 60 | B0361.10 | B0361.10 | synaptobrevin | 80 | 97.44 | 1.00E-35 | 15 | 3.2 | 0 | 1.6 | 2.6 | 0 | 0.0% | | | 1 | 0 | 4 |
| 61 | F25B4.6 | F25B4.6 | hydroxymethylglutaryl-C | 57.98 | 276.9 | 2.60E-75 | 10 | 2.9 | 0 | 2.6 | 2.6 | 0 | 0.0% | | | 1 | 0 | 6 |
| 62 | C04H5.6 | mog-4 | Helicases conserved C | 80.25 | 270 | 7.20E-73 | 10 | 2 | 0 | 3 | 1 | 0 | 0.0% | | | 1 | 0 | 0 |
| 63 | T10F2.1 | grs-1 | Glycyl-tRNA synthetase | 70.38 | 565 | 1.00E-168 | 39 | 1.6 | 0 | 5.6 | 0 | 0.3 | 4.0% | | | 2 | 2 | 0 |
| 64 | R74.1 | lrs-1 | leucyl-tRNA synthetase | 62.5 | 267.3 | 2.00E-74 | 10 | 2.3 | 0 | 3 | 1 | 0 | 0.5% | | | 1 | 0 | 3 |
| 65 | T10E9.7 | T10E9.7 | NADH-ubiquinone oxid | 74.19 | 249.2 | 5.50E-67 | 10 | 2.2 | 0 | 2.6 | 1 | 0 | 0.0% | | | 1 | 1 | 0 |
| 66 | C50F2.3 | C50F2.3 | HAT (Half-A-TPR) repe | 66.96 | 231.9 | 6.00E-69 | 10 | 2 | 0 | 5.2 | 1 | 0 | 0.0% | | | 2 | 2 | 1 |
| 67 | T25G3.3 | T25G3.3 | Yeast nonsense-media | 61.63 | 120 | 2.00E-60 | 10 | 2.2 | 0 | 3.6 | 2.6 | 0.3 | 3.4% | | | 1 | 0 | 0 |
| 68 | R06A4.4 | imb-2 | Importin beta, nuclear t | 56.63 | 108 | 2.60E-23 | 10 | 2 | 0 | 2.3 | 2.2 | 0 | 0.0% | | | 1 | 0 | 9 |
| 69 | F19B5.2 | ufd-1 | Ubiquitin fusion degrad | 55.15 | 209.9 | 2.70E-55 | 10 | 2.9 | 0 | 2.6 | 2.6 | 0 | 0.0% | | | 4 | 2 | 0 |
| 70 | F48E8.5 | paa-1 | Protein phosphatase 2/ | 73.68 | 560.8 | 1.00E-160 | 16 | 1 | 1 | 5.3 | 1 | 0 | 0.0% | | | 3 | 1 | 0 |

FIG. 3A

| | | | | | | | | | | | | | | | |
|---|---|---|---|---|---|---|---|---|---|---|---|---|---|---|---|
| 71 | F18C12.2 | mes-8 | DNA-J like domain;Dna | 62.44 | 305.4 | 4.00E-149 | 16 | 1.8 | 1 | 3.2 | 2.2 | 0 | 0.0% | | 1 | 0 | 0 |
| 72 | F49C12.13 | vha-17 | ATP synthase subunit I | 72.34 | 124.8 | 1.40E-30 | 33 | 1.2 | 0 | 1.8 | 1 | 0 | 0.0% | 55% Red | 3 | 3 | 22 |
| 73 | F55A12.7 | apm-1 | clathrin coat assembly | 80.28 | 185 | 1.60E-47 | 34 | 3.2 | 0 | 0 | 3.6 | 0 | 0.0% | 50-60% Re | 1 | 0 | 0 |
| 74 | W01B11.3 | W01B11.3 | Putative snoRNA bindir | 69.18 | 217 | 8.00E-66 | 10 | 3.2 | 0 | 3 | 1 | 0 | 0.0% | | 2 | 0 | 1 |
| 75 | C37C3.6 | | unknown function | 81.69 | 142 | 5.00E-33 | 11 | 1.6 | 2 | 2 | 3.6 | 0 | 0.0% | | 1 | 1 | 3 |
| 76 | R13A5.12 | lpd-7 | BRCA1 C Terminus (BI | 56.67 | 199.9 | 4.60E-52 | 10 | 5.2 | 0 | 3.7 | 2 | 0 | 0.0% | | 1 | 0 | 1 |
| 77 | C42D4.8 | rpc-1 | DNA-directed RNA poly | 88.06 | 207.2 | 7.90E-54 | 10 | 2.6 | 0 | 3 | 1 | 0 | 0.0% | | 3 | 0 | 0 |
| 78 | F39B2.6 | rps-26 | 40S ribosomal protein | 85.09 | 204.9 | 1.60E-54 | 10 | 2.9 | 0 | 4.2 | 1 | 0 | 0.0% | | 4 | 2 | 0 |
| 79 | F28C6.3 | cpf-1 | cpf-1, mRNA cleavage | 66.38 | 308 | 9.00E-84 | 18 | 1 | 1 | 1 | 2 | 0 | 0.0% | | 3 | 1 | 4 |
| 80 | T17E9.2 | T17E9.2 | Myristoyl-CoA:protein N | 64.15 | 144.4 | 8.00E-60 | 10 | 2 | 0 | 4.6 | 2.2 | 0 | 0.0% | | 1 | 0 | 0 |
| 81 | K07A1.12 | lin-53 | chromatin assembly fa | 69.04 | 297 | 4.90E-86 | 24 | 2.3 | 0 | 3.2 | 0 | 0 | 0.0% | | 1 | 0 | 0 |
| 82 | D2085.1 | pyr-1 | glutamine-dependent c | 55.48 | 160 | 2.00E-40 | 18 | 1 | 1 | 1 | 2 | 0 | 0.0% | | 1 | 0 | 90 |
| 83 | Y52B11A.9 | Y52B11A.9 | Zinc finger, C2H2 type; | 81.97 | 113.2 | 1.30E-27 | 18 | 1 | 1.8 | 1.7 | 2.4 | 0 | 0.0% | | 1 | 1 | 0 |
| 84 | C30C11.2 | rpn-3 | Diphenol oxidase A2 | 43.81 | 220.3 | 3.20E-58 | 10 | 2 | 0 | 6.6 | 1 | 0 | 0.0% | | 0 | 0 | 0 |
| 85 | R160.1 | dpy-23 | clathrin coat assembly | 87.55 | 416.4 | 3.00E-117 | 14 | 2.6 | 1 | 0 | 1.6 | 0 | 0.0% | | 1 | 0 | 1 |
| 86 | F53G12.10 | rpl-7 | ribosomal protein | 76.79 | 339.3 | 1.90E-94 | 26 | 1.2 | 0 | 4.8 | 1 | 0 | 0.0% | | 15 | 11 | 10 |
| 87 | F55F8.5 | F55F8.5 | WD domain, G-beta rej | 51.11 | 143.7 | 3.20E-35 | 10 | 2.2 | 1 | 2 | 2.7 | 0 | 0.0% | | 1 | 0 | 2 |
| 88 | T27F2.1 | skp-1 | Drosophila puff specific | 76.36 | 88.2 | 1.30E-60 | 16 | 1.7 | 1 | 4.6 | 1 | 0 | 0.0% | | 1 | 0 | 0 |
| 89 | C47B2.4 | pbs-2 | Proteasome A-type and | 50.36 | 135.6 | 5.00E-33 | 10 | 2.2 | 0 | 2.8 | 2.2 | 0 | 0.0% | | 1 | 0 | 12 |
| 90 | B0303.15 | B0303.15 | Ribosomal protein L11 | 60.23 | 201.6 | 3.50E-53 | 10 | 2.3 | 0 | 2 | 2 | 0 | 0.0% | | 2 | 2 | 146 |
| 91 | W10G6.3 | mua-6 | Intermediate filament p | 68.92 | 772.7 | 0.00E+00 | 14 | 4.4 | 1 | 0 | 4.4 | 2 | 16.9% | | 1 | 0 | 0 |
| 92 | C39F7.4 | rab-1 | RAS-related protein | 87.88 | 346.7 | 9.40E-97 | 15 | 2 | 0 | 1.6 | 1 | 0 | 0.0% | | 7 | 4 | 146 |
| 93 | T26A5.7 | set-1 | SET domain;Nuclear p | 48.59 | 179.9 | 1.90E-48 | 10 | 2 | 0 | 2 | 3.6 | 1 | 11.6% | | 1 | 1 | 0 |
| 94 | F14B4.3 | F14B4.3 | DNA-directed RNA poly | 76.12 | 327.4 | 3.00E-137 | 15 | 3.8 | 0 | 1 | 1 | 0 | 0.0% | | 2 | 1 | 2 |
| 95 | Y43F4B.5 | Y43F4B.5 | Phosphoglucomutase a | 61.85 | 444.5 | 1.00E-125 | 15 | 2.6 | 0 | 1 | 1 | 0.3 | 6.1% | | 0 | 0 | 0 |
| 96 | D1054.15 | tag-135 | beta transducin like pro | 67.47 | 120.9 | 4.00E-53 | 24 | 2 | 0 | 2.6 | 0 | 0 | 0.0% | | 1 | 0 | 0 |
| 97 | Y37D8A.10 | Y37D8A.10 | Microsomal signal pept | 50.41 | 124 | 8.20E-30 | 10 | 2.9 | 0 | 5.6 | 1.6 | 0 | 0.0% | | 2 | 2 | 0 |
| 98 | K02F2.2 | K02F2.2 | S-adenosylhomocystei | 82.67 | 339.3 | 4.00E-94 | 15 | 3.9 | 0 | 1 | 3.2 | 0 | 0.0% | | 2 | 2 | 27 |
| 99 | M57.2 | M57.2 | Protein prenyltransfera | 47.03 | 192.6 | 8.20E-50 | 18 | 1.2 | 1 | 1 | 2.6 | 0.3 | 4.9% | | 2 | 0 | 0 |
| 100 | T01D1.2 | etr-1 | RNA-binding protein | 58.76 | 238.4 | 1.30E-63 | 26 | 1 | 0 | 2.3 | 1 | 0 | 0.0% | | 2 | 2 | 0 |
| 101 | R06C7.8 | bub-1 | Eukaryotic protein kina | 41.26 | 146 | 1.50E-35 | 25 | 1 | 1 | 4.2 | 0.6 | 0 | 0.0% | | 1 | 0 | 0 |
| 102 | Y47D3A.26 | smc-3 | SMC proteins Flexible I | 57.03 | 263.5 | 5.90E-73 | 22 | 0 | 2 | 3 | 2.2 | 0 | 0.0% | | 1 | 0 | 0 |
| 103 | F22B5.1 | evl-20 | GTP-binding ADP-ribos | 45.51 | 157.9 | 5.20E-40 | 28 | 0 | 1.6 | 2.3 | 1.6 | 0 | 0.0% | | 9 | 7 | 57 |
| 104 | F25B5.4 | ubq-1 | Ubiquitin family;Ubiquit | 95.44 | 567.8 | 1.00E-162 | 24 | 2 | 0 | 3.6 | 0 | 0 | 0.0% | | 6 | 3 | 0 |
| 105 | F42C5.8 | rps-8 | 40S ribosomal protein | 72.97 | 300.8 | 6.00E-83 | 26 | 1.9 | 0 | 5.2 | 2 | 0 | 0.0% | | 19 | 15 | 7 |
| 106 | C17H12.14 | vha-8 | ATPase | 74.07 | 318.5 | 3.10E-66 | 15 | 2.3 | 0 | 1.6 | 1 | 0 | 0.0% | | 3 | 3 | 0 |
| 107 | B0564.1 | B0564.1 | ribonuclease PH like | 51.05 | 256.9 | 1.20E-69 | 15 | 2.6 | 0 | 1 | 2 | 0 | 0.0% | | 5 | 2 | 8 |
| 108 | R03G5.1 | eft-4 | elongation factor EF-1- | 89.76 | 847.4 | 0.00E+00 | 26 | 1.3 | 0 | 6.3 | 1.6 | 0 | 0.0% | | 0 | 0 | 16 |
| 109 | C47D12.6 | trs-1 | threonyl-tRNA synthetas | 73.08 | 482 | 8.00E-136 | 24 | 2.6 | 0 | 2.6 | 0 | 0.3 | 5.5% | | 2 | 2 | 126 |
| 110 | Y47G6A.10 | spg-7 | ATPase | 66.14 | 466.1 | 5.00E-132 | 24 | 2.6 | 0 | 7.7 | 0.6 | 0 | 0.0% | | 2 | 2 | 0 |
| 111 | K07C5.6 | K07C5.6 | Zinc finger, CCHC clas | 62.21 | 290.8 | 2.50E-79 | 16 | 1 | 1 | 3.3 | 1 | 0 | 0.0% | | 1 | 0 | 0 |
| 112 | B0511.10 | eif-3.E | PCI domain;Proteasom | 73.53 | 196.8 | 2.50E-60 | 39 | 1.8 | 0 | 3.9 | 0 | 0 | 0.0% | | 1 | 1 | 8 |
| 113 | T02H6.11 | T02H6.11 | ubiquinol-cytochrome c | 45.53 | 120.6 | 5.00E-29 | 10 | 2.6 | 0 | 3.3 | 1 | 0 | 0.0% | | 17 | 6 | 10 |
| 114 | F13B10.2 | rpl-3 | 60S ribosomal protein I | 77.02 | 384.8 | 7.00E-108 | 26 | 1.6 | 0 | 7.2 | 1 | 0 | 0.0% | | 73 | 72 | 0 |
| 115 | K12H4.3 | K12H4.3 | Brix domain;Brix | 65.52 | 82.8 | 2.10E-25 | 10 | 2.6 | 0 | 3 | 3 | 0 | 0.0% | | 0 | 0 | 5 |
| 116 | C01G8.5 | erm-1 | membrane protein | 72.13 | 167.2 | 3.60E-42 | 15 | 2.9 | 0 | 1.2 | 3.2 | 0 | 0.0% | | 1 | 0 | 0 |
| 117 | F36A2.6 | rps-15 | 40S ribosomal protein | 87.5 | 208 | 3.20E-55 | 15 | 3.2 | 0 | 1.6 | 1 | 0 | 0.0% | | 17 | 15 | 18 |
| 118 | W07E6.4 | prp-21 | splicing factor | 64.2 | 234.6 | 2.10E-62 | 22 | 0 | 2 | 3.6 | 1 | 0 | 0.0% | | 2 | 1 | 12 |
| 119 | C41G7.1 | smn-1 | Human muscular atropl | 57.5 | 110.9 | 8.80E-28 | 10 | 2.2 | 0 | 2 | 3.2 | 0 | 0.0% | | 0 | 0 | 0 |
| 120 | C34C12.8 | C34C12.8 | GRPE protein | 50.32 | 163.7 | 1.40E-41 | 15 | 2.6 | 0 | 1 | 1 | 0 | 0.0% | | 1 | 0 | 0 |
| 121 | C45G9.5 | C45G9.5 | unknown function | 39.78 | 160.6 | 1.70E-40 | 15 | 3.6 | 0 | 1.6 | 1 | 0 | 0.0% | | 1 | 1 | 0 |
| 122 | W08E3.1 | snr-2 | small nuclear ribonucle | 64.63 | 200.7 | 5.60E-53 | 25 | 1.9 | 1 | 3.6 | 0 | 0 | 0.0% | | 8 | 6 | 0 |
| 123 | JC8.3 | rpl-12 | Ribosomal protein L11 | 86.06 | 297.7 | 3.60E-82 | 26 | 1 | 0 | 3.6 | 2 | 0 | 0.0% | | 8 | 5 | 10 |
| 124 | F22D6.3 | nrs-1 | asparaginyl-tRNA synth | 65.61 | 290 | 3.50E-79 | 24 | 2.2 | 0 | 4.2 | 0 | 0.3 | 4.5% | | 3 | 2 | 0 |
| 125 | B0491.5 | B0491.5 | unknown function | 45.12 | 120.6 | 2.00E-28 | 24 | 3.3 | 0 | 2.3 | 0 | 0 | 0.0% | | 2 | 2 | 12 |
| 126 | F57B10.10 | dad-1 | DAD family;Defender a | 86.36 | 106 | 3.30E-24 | 10 | 2.2 | 0 | 2.2 | 1.6 | 0 | 0.0% | | 1 | 1 | 0 |
| 127 | H28O16.1 | | unknown function | 84.62 | 720.3 | 0.00E+00 | 26 | 1.3 | 0 | 2.2 | 1 | 0 | 0.0% | | 0 | 0 | 0 |
| 128 | T23F6.4 | rbd-1 | RNA recognition motif. | 50.57 | 109.8 | 1.10E-24 | 15 | 2.2 | 0 | 1 | 1 | 0 | 0.0% | | 1 | 1 | 1 |
| 129 | F23F12.6 | rpt-3 | rpt-3 encodes a triple A | 87.06 | 443.4 | 2.00E-125 | 26 | 1 | 0 | 3.6 | 1 | 0 | 0.0% | | 4 | 3 | 1 |
| 130 | Y39G10AR.8 | Y39G10AR | Elongation factor Tu do | 81.44 | 344 | 1.70E-95 | 24 | 2.2 | 0 | 2.2 | 0 | 0 | 0.0% | | 1 | 0 | 0 |
| 131 | R12E2.3 | rpn-8 | Mov34/MPN/PAD-1 fan | 69.05 | 241.1 | 1.20E-64 | 24 | 2.3 | 0 | 4.8 | 0 | 0 | 0.0% | | 2 | 1 | 13 |
| 132 | K10B2.1 | lin-23 | Transducin beta chain | 90.2 | 559.3 | 4.00E-160 | 33 | 1.6 | 0 | 1.6 | 2 | 0 | 0.0% | | 1 | 0 | 16 |
| 133 | F01F1.8 | cct-6 | TCP-1/cpn60 chaperon | 74.06 | 397.5 | 2.00E-111 | 26 | 1.6 | 0 | 5.2 | 1.6 | 0 | 0.0% | | 9 | 0 | 94 |
| 134 | F08D12.1 | F08D12.1 | signal recognition partic | 45.3 | 86.7 | 1.60E-21 | 15 | 2.2 | 0 | 1.6 | 2.6 | 0 | 0.0% | | 1 | 0 | 0 |
| 135 | C47E12.1 | srs-2 | seryl-tRNA synthetase | 87.5 | 381.7 | 8.00E-107 | 26 | 1.3 | 0 | 2.2 | 1.6 | 0 | 0.0% | | 1 | 0 | 0 |
| 136 | C47E12.4 | C47E12.4 | Inorganic pyrophosphat | 61.27 | 370.5 | 1.00E-103 | 26 | 1.6 | 0 | 4.3 | 1 | 0 | 0.0% | | 5 | 2 | 0 |
| 137 | F56F3.5 | rps-1 | Ribosomal protein S3e | 69.23 | 367.5 | 7.00E-103 | 26 | 1.3 | 0 | 6.2 | 1 | 0 | 0.0% | | 10 | 4 | 41 |
| 138 | C06E1.10 | C06E1.10 | ATP-dependent RNA h | 60.59 | 394.8 | 2.00E-110 | 33 | 1.6 | 0 | 1 | 1 | 0 | 0.0% | | 9 | 7 | 3 |
| 139 | F10G8.3 | npp-17 | npp-17, mRNA export p | 59.16 | 408 | 3.00E-114 | 36 | 0 | 2 | 0 | 10 | 0 | 0.0% | | 5 | 2 | 6 |
| 140 | C17G10.2 | C17G10.2 | TPR domain | 53.49 | 92.62 | 6.00E-24 | 10 | 2 | 0 | 2.6 | 2.2 | 0 | 0.0% | | 1 | 0 | 4 |
| 141 | K07C5.4 | K07C5.4 | yeast protein L8187.9-I | 57.47 | 110 | 1.30E-24 | 10 | 2.6 | 0 | 2.7 | 2 | 0 | 0.0% | | 1 | 1 | 0 |
| 142 | R13G10.1 | dpy-27 | chromosome segregati | 54.14 | 130.6 | 2.10E-43 | 26 | 1 | 0 | 2 | 1.6 | 1 | 17.9% | | 1 | 1 | 0 |
| 143 | B0432.3 | B0432.3 | unknown function | 55.38 | 174.5 | 5.30E-45 | 15 | 2.6 | 0 | 1 | 2 | 0.3 | 5.1% | | 4 | 4 | 0 |
| 144 | K04G7.11 | K04G7.11 | unknown function | 56.78 | 261.2 | 5.50E-71 | 16 | 1 | 1.2 | 2 | 3.4 | 1 | 11.6% | | 3 | 2 | 0 |
| 145 | E04A4.8 | rpl-20 | ribosomal protein | 69.44 | 270.8 | 5.40E-74 | 26 | 1.2 | 0 | 5.2 | 2.6 | 0 | 0.0% | | 29 | 23 | 3 |
| 146 | T12A2.7 | T12A2.7 | Breast carcinoma empl | 38.28 | 161 | 9.00E-41 | 10 | 2 | 0 | 2 | 2.3 | 1 | 13.7% | | 7 | 7 | 16 |
| 147 | C09D4.5 | rpl-19 | 60S ribosomal protein I | 79.27 | 315.1 | 2.80E-87 | 24 | 3.9 | 0 | 3.6 | 0 | 0 | 0.0% | | 7 | 5 | 0 |
| 148 | C14B9.4 | plk-1 | Protein kinase | 57.07 | 208.8 | 7.00E-90 | 24 | 2 | 0 | 9.2 | 0 | 0 | 0.0% | | 2 | 2 | 0 |
| 149 | F25B3.6 | F25B3.6 | Plus-3 domain;Plus-3 | 38.06 | 140.6 | 3.90E-34 | 10 | 2.2 | 0 | 2.3 | 1.6 | 0 | 0.0% | | 3 | 2 | 0 |

FIG. 3B

| # | ID | Gene | Description | Val1 | Val2 | E-value | V1 | V2 | V3 | V4 | V5 | V6 | V7 | Note | C1 | C2 | C3 |
|---|---|---|---|---|---|---|---|---|---|---|---|---|---|---|---|---|---|
| 150 | ZK622.3 | ZK622.3 | Generic methyltransfer | 49.74 | 169.1 | 7.40E-49 | 26 | 1.6 | 0 | 2 | 1.6 | 0 | 0.0% | | 1 | 1 | 0 |
| 151 | D1014.3 | D1014.3 | alpha-SNAP protein | 66.67 | 100 | 4.00E-21 | 26 | 1 | 0 | 5.2 | 3 | 0 | 0.0% | 30-80% Re | 4 | 1 | 5 |
| 152 | F26F4.10 | rrt-1 | arginyl tRNA synthetas | 36.65 | 159.1 | 9.60E-57 | 26 | 1.6 | 0 | 8.3 | 2 | 0 | 0.0% | | 2 | 1 | 1 |
| 153 | K04G2.1 | K04G2.1 | translational initiation f | 65.71 | 211.5 | 6.20E-56 | 24 | 2.2 | 0 | 2.9 | 0 | 0 | 0.0% | | 1 | 1 | 1 |
| 154 | C47E8.4 | C47E8.4 | XAP5 protein | 53.36 | 208 | 1.10E-54 | 15 | 2 | 0 | 1 | 1 | 1 | 20.0% | | 1 | 1 | 16 |
| 155 | R03E1.2 | R03E1.2 | unknown function | 39.05 | 74.71 | 1.30E-14 | 37 | 2.2 | 0 | 0.6 | 0.6 | 0 | 0.0% | 75% Red | 1 | 0 | 3 |
| 156 | F38E11.5 | F38E11.5 | beta'-coat protein like | 82.5 | 150 | 4.00E-80 | 33 | 1 | 0 | 1.6 | 1 | 0 | 0.0% | | 1 | 0 | 1 |
| 157 | T09A5.11 | T09A5.11 | N-oligosaccharyl transf | 53.95 | 226 | 3.00E-76 | 33 | 1.6 | 0 | 1.6 | 2 | 0 | 0.0% | | 1 | 0 | 1 |
| 158 | F36A2.7 | F36A2.7 | unknown function | 46.82 | 129.6 | 1.30E-31 | 26 | 1.2 | 0 | 2.9 | 1.7 | 0 | 0.0% | | 0 | 0 | 3 |
| 159 | M88.2 | M88.2 | unknown function | 61.4 | 227.6 | 7.40E-61 | 10 | 2 | 0 | 2 | 1.6 | 1.3 | 16.6% | | 1 | 1 | 1 |
| 160 | ZC434.2 | rps-7 | 40S ribosomal protein | 60.11 | 244.2 | 6.10E-68 | 24 | 2.9 | 0 | 2.6 | 0 | 0 | 0.0% | | 15 | 14 | 50 |
| 161 | H15N14.2 | nsf-1 | vesicular-fusion protein | 52.94 | 243.8 | 2.10E-64 | 24 | 3 | 0 | 5.6 | 0 | 0 | 0.0% | | 1 | 0 | 0 |
| 162 | F59C6.5 | F59C6.5 | NADH ubiquinone oxid | 49.03 | 220.3 | 1.40E-58 | 24 | 2.2 | 0 | 3.2 | 0 | 0 | 0.0% | | 2 | 1 | 0 |
| 163 | LLC1.3 | LLC1.3 | dihydrolipoamide dehy | 72.66 | 193 | 4.00E-49 | 24 | 3.2 | 0 | 3.2 | 0 | 1 | 13.5% | | 3 | 1 | 1 |
| 164 | C10H11.9 | let-502 | Rho-associated kinase | 47.8 | 181.4 | 1.10E-55 | 24 | 2.2 | 0 | 3.6 | 0 | 0 | 0.0% | | 3 | 1 | 8 |
| 165 | F59A3.3 | F59A3.3 | KOW motif | 40.85 | 178.3 | 6.70E-48 | 24 | 2.2 | 0 | 2.7 | 0 | 0 | 0.0% | | 4 | 1 | 1 |
| 166 | D1007.12 | rpl-24.1 | 60S ribosomal protein | 55.28 | 177.9 | 3.60E-46 | 24 | 2.9 | 0 | 3.6 | 0 | 0 | 0.0% | | 16 | 12 | 0 |
| 167 | F26H9.6 | rab-5 | RAS-related protein | 94.32 | 171 | 3.00E-43 | 24 | 2.9 | 0 | 2.2 | 0 | 0 | 0.0% | | 1 | 0 | 1 |
| 168 | Y71G12B.11 | Y71G12B. | FERM domain (Band 4 | 55.49 | 165.3 | 4.00E-70 | 10 | 4.2 | 0.6 | 2.6 | 4.6 | 2 | 13.9% | | 1 | 1 | 0 |
| 169 | C37A2.4 | cye-1 | cyclin | 39.74 | 137.5 | 2.60E-33 | 24 | 4.2 | 0 | 6.2 | 0 | 0 | 0.0% | | 2 | 1 | 2 |
| 170 | B0511.8 | B0511.8 | Mitochondrial 28S ribo | 40.77 | 336.7 | 3.20E-93 | 24 | 3.2 | 0 | 2.6 | 0 | 0 | 0.0% | | 0 | 0 | 3 |
| 171 | T22D1.10 | ruvb-2 | TIP49 C-terminus;AAA | 63.41 | 513.8 | 1.00E-148 | 26 | 1.6 | 0 | 3.6 | 3 | 0 | 0.0% | | 4 | 2 | 0 |
| 172 | F10B5.1 | rpl-10 | ribosomal protein L10 ( | 79.91 | 385.5 | 2.00E-102 | 26 | 1.3 | 0 | 5.6 | 1 | 0 | 0.0% | | 21 | 9 | 14 |
| 173 | F23F1.8 | | unknown function | 82.41 | 362.5 | 2.00E-128 | 26 | 1 | 0 | 4.2 | 3 | 0 | 0.0% | | 1 | 1 | 7 |
| 174 | F55F8.4 | F55F8.4 | unknown function | 79.88 | 285 | 1.20E-77 | 24 | 2 | 0 | 5.2 | 0 | 0 | 0.0% | | 2 | 0 | 0 |
| 175 | Y48G8AL.6 | rpl-17 | Ribosomal protein L22 | 76.47 | 292.4 | 1.80E-80 | 26 | 1.2 | 0 | 3.2 | 1 | 0 | 0.0% | | 4 | 2 | 0 |
| 176 | K08E4.1 | spt-5 | translation initiation pro | 46.32 | 242.3 | 1.00E-176 | 26 | 1 | 0 | 2.6 | 1 | 0 | 0.0% | | 1 | 1 | 0 |
| 177 | C06B11.3 | C06B11.3 | Zinc finger, C2H2 type | 39.15 | 147.1 | 8.70E-36 | 24 | 2 | 0 | 3.6 | 0 | 0 | 0.0% | | 1 | 0 | 0 |
| 178 | Y51H7C.6 | Y51H7C.6 | unknown function | 42.86 | 136.7 | 3.60E-32 | 12 | 1.6 | 3 | 1 | 9.6 | 3 | 16.1% | | 1 | 0 | 1 |
| 179 | C26D10.2 | hel-1 | translation initiation fac | 77.23 | 315.5 | 5.90E-87 | 26 | 1 | 0 | 3.6 | 1 | 0 | 0.0% | | 2 | 1 | 5 |
| 180 | D1054.14 | D1054.14 | PRP38 family;PRP38 | 65.79 | 312.8 | 2.70E-88 | 26 | 1 | 0 | 4.3 | 2 | 0 | 0.0% | | 1 | 1 | 0 |
| 181 | T14G10.5 | T14G10.5 | protein transport protei | 72.55 | 298.5 | 1.60E-81 | 26 | 1 | 0 | 2.6 | 3.2 | 0 | 0.0% | | 1 | 0 | 0 |
| 182 | F53G12.1 | rab-11.1 | RAS-related protein | 96.23 | 342.4 | 1.90E-95 | 24 | 2 | 0 | 2 | 0 | 1 | 20.0% | | 1 | 1 | 2 |
| 183 | D2013.5 | eat-3 | GTP-binding protein | 65.45 | 393 | 8.00E-109 | 26 | 1.6 | 0 | 3.6 | 1 | 0.3 | 4.6% | | 4 | 3 | 0 |
| 184 | R13A5.8 | rpl-9 | Ribosomal protein L9 | 61.54 | 260.8 | 5.60E-77 | 26 | 1.3 | 0 | 5 | 1 | 0 | 0.0% | | 15 | 10 | 0 |
| 185 | F09F7.3 | F09F7.3 | RNA polymerase beta | 65.69 | 352.6 | 0.00E+00 | 26 | 1.6 | 0 | 2.6 | 1 | 1 | 16.1% | | 1 | 0 | 1 |
| 186 | F36H4.9 | let-92 | serine/threonine proteir | 64.36 | 292.7 | 2.90E-80 | 26 | 1.7 | 0 | 3.6 | 1 | 0 | 0.0% | | 1 | 1 | 1 |
| 187 | F01G12.5 | let-2 | alpha-2 type IV collage | 60.3 | 342.6 | 1.50E-94 | 26 | 1.6 | 0 | 2 | 1.2 | 1 | 17.2% | | 1 | 1 | 6 |
| 188 | B0464.1 | drs-1 | Aspartyl-tRNA synthet | 59.34 | 276.9 | 3.00E-75 | 26 | 1 | 0 | 5.6 | 1 | 0 | 0.0% | | 2 | 2 | 12 |
| 189 | B0336.2 | arf-1.2 | ARF | 95 | 351.7 | 2.40E-98 | 26 | 0 | 0 | 6.3 | 2.2 | 0 | 0.0% | | 9 | 7 | 0 |
| 190 | F29B9.6 | ubc-9 | ubiquitin-conjugating er | 76.97 | 279.6 | 1.00E-76 | 26 | 0 | 1 | 2.6 | 2.2 | 0 | 0.0% | | 4 | 2 | 0 |
| 191 | C53H9.2 | C53H9.2 | GTPase of unknown fu | 39.84 | 171 | 1.70E-42 | 26 | 1.2 | 0 | 3.2 | 1 | 0 | 0.0% | | 0 | 0 | 8 |
| 192 | C37C3.2 | C37C3.2 | eIF4-gamma/eIF5/eIF2 | 86.3 | 216.9 | 1.40E-81 | 26 | 1.3 | 0 | 4.2 | 2 | 0 | 0.0% | | 1 | 0 | 1 |
| 193 | C35B1.1 | ubc-1 | ubiquitin conjugating-pi | 72.12 | 253 | 2.00E-67 | 34 | 2 | 0 | 0 | 1 | 1 | 25.0% | | 1 | 1 | 0 |
| 194 | C35C3.5 | unc-60 | actin depolymerizing fa | 67.7 | 217.2 | 9.10E-58 | 34 | 2.4 | 0 | 1 | 0 | 0 | 0.0% | | 5 | 3 | 0 |
| 195 | C46B6.2 | C46B6.2 | ribosomal protein | 58.62 | 191 | 5.50E-50 | 34 | 3.1 | 0 | 0 | 1 | 0 | 0.0% | | 2 | 2 | 0 |
| 196 | T09B4.9 | T09B4.9 | Tim44-like domain;Mitc | 56.25 | 253.8 | 2.10E-68 | 26 | 1.9 | 0 | 3.2 | 1 | 0 | 0.0% | | 1 | 1 | 5 |
| 197 | T26G10.1 | T26G10.1 | RNA helicase | 66.67 | 279.3 | 5.50E-76 | 10 | 2.6 | 0 | 3.7 | 1 | 2 | 21.5% | | 1 | 0 | 36 |
| 198 | F54C9.5 | rpl-5 | 60S ribosomal protein | 65.66 | 277.7 | 8.70E-76 | 26 | 1.3 | 0 | 4.6 | 1 | 0 | 0.0% | | 1 | 0 | 3 |
| 199 | H06104.3 | H06104.3 | FtsJ-like methyltransfer | 48.9 | 149.8 | 2.20E-60 | 10 | 4.8 | 0 | 2 | 1 | 2.3 | 22.8% | | 1 | 1 | 1 |
| 200 | T19A6.2 | ngp-1 | AUTOANTIGEN NGP- | 74.85 | 108.7 | 8.00E-48 | 26 | 1.6 | 0 | 2 | 1 | 0 | 0.0% | | 4 | 2 | 11 |
| 201 | M106.1 | mix-1 | mitotic chromosome ar | 49.07 | 99.8 | 2.00E-36 | 26 | 1 | 0 | 4 | 1 | 0 | 0.0% | | 2 | 0 | 64 |
| 202 | W08D2.7 | W08D2.7 | Human myeloid cell line | 55.68 | 265.6 | 5.00E-76 | 26 | 1.6 | 0 | 2.6 | 3.6 | 0 | 0.0% | | 0 | 0 | 44 |
| 203 | C27H6.2 | ruvb-1 | Yeast hypothetical 50. | 67.62 | 276.2 | 4.40E-75 | 26 | 1.6 | 0 | 2.6 | 2 | 0.3 | 4.6% | | 4 | 2 | 0 |
| 204 | T04A8.11 | T04A8.11 | 50S ribosomal protein | 56.74 | 273.1 | 1.40E-74 | 26 | 1.6 | 0 | 2.3 | 1 | 0 | 0.0% | | 6 | 6 | 66 |
| 205 | R10E11.6 | vha-1 | ATP synthase subunit | 61.16 | 255.4 | 2.10E-69 | 26 | 1 | 0 | 4.2 | 1 | 0 | 0.0% | | 7 | 5 | 12 |
| 206 | K08E5.3 | mua-3 | LDL receptor related pr | 63.36 | 192 | 9.00E-48 | 15 | 4.2 | 0 | 1 | 3.2 | 2 | 19.2% | | 1 | 1 | 46 |
| 207 | F43G9.10 | F43G9.10 | MICROFIBRILLAR-AS | 69.88 | 129.4 | 3.10E-30 | 26 | 1 | 0 | 4.9 | 1 | 0 | 0.0% | | 1 | 0 | 2 |
| 208 | R144.2 | R144.2 | Regulation of nuclear p | 52.21 | 124 | 1.00E-30 | 26 | 1 | 0 | 3.6 | 1 | 0 | 0.0% | | 1 | 0 | 4 |
| 209 | Y54E2A.11 | eif-3.B | Translation initiation fac | 55.79 | 160.6 | 4.40E-40 | 26 | 1.6 | 0 | 2.6 | 2 | 0 | 0.0% | | 1 | 1 | 38 |
| 210 | F39H11.5 | pbs-7 | Yeast NIP60 protein lik | 42.63 | 142.9 | 3.20E-35 | 26 | 1.2 | 0 | 4.6 | 2.2 | 0 | 0.0% | | 2 | 1 | 0 |
| 211 | T02G5.9 | krs-1 | lysyl-tRNA synthetase | 61.97 | 109 | 6.40E-33 | 26 | 1.3 | 0 | 2.6 | 1.7 | 0 | 0.0% | | 1 | 1 | 1 |
| 212 | C34E10.2 | gop-2 | Conserved hypothetica | 79.25 | 292 | 5.70E-80 | 26 | 1 | 0 | 4.6 | 1.6 | 0.3 | 4.0% | | 2 | 1 | 3 |
| 213 | C25F6.2 | dlg-1 | guanylate kinase | 56.64 | 334.3 | 3.00E-92 | 31 | 2 | 0 | 1 | 0 | 0 | 0.0% | WT | 2 | 2 | 46 |
| 214 | F43E2.8 | hsp-4 | heat shock protein | 79.24 | 1031.6 | 0.00E+00 | 33 | 1.6 | 1 | 0 | 0 | 0 | 0.0% | | 1 | 0 | 0 |
| 215 | Y39E4B.1 | Y39E4B.1 | Possible metal-binding | 79.17 | 272.5 | 8.50E-74 | 26 | 1 | 0 | 3 | 2.2 | 0 | 0.0% | | 1 | 1 | 29 |
| 216 | F18H3.5 | cdk-4 | cdk-4, cyclin-dependen | 47.03 | 213 | 1.00E-55 | 29 | 1 | 1 | 0 | 9 | 1 | 8.3% | | 3 | 3 | 12 |
| 217 | C41C4.8 | C41C4.8 | P97 protein | 86.16 | 415.2 | 1.00E-116 | 33 | 1 | 0 | 1 | 1.2 | 0 | 0.0% | | 1 | 0 | 1 |
| 218 | R09B3.5 | mag-1 | MAGO NASHI PROTE | 80.82 | 251.1 | 3.30E-68 | 26 | 1.9 | 0 | 2.9 | 1 | 0 | 0.0% | | 1 | 1 | 0 |
| 219 | F13D11.2 | hbl-1 | C2H2-type zinc finger | 66.67 | 114 | 5.90E-48 | 31 | 2.2 | 0 | 1.6 | 0.6 | 0 | 0.0% | | 1 | 1 | 146 |
| 220 | Y53G8AL.2 | Y53G8AL. | unknown function | 60.29 | 241.9 | 8.40E-65 | 26 | 1.2 | 0 | 3.2 | 4 | 0 | 0.0% | | 1 | 0 | 6 |
| 221 | Y53F4B.22 | Y53F4B.22 | actin-like protein | 53.66 | 412.5 | 3.00E-116 | 33 | 1.9 | 0.6 | 1.6 | 2.6 | 0 | 0.0% | | 367 | 10 | 0 |
| 222 | Y71F9AL.17 | Y71F9AL.1 | coatomer, alpha chain | 64.06 | 260.6 | 5.30E-70 | 26 | 1 | 0 | 2.6 | 1.6 | 0 | 0.0% | | 3 | 3 | 1 |
| 223 | W09C5.8 | W09C5.8 | Cytochrome c oxidase | 76.36 | 176.8 | 1.00E-45 | 26 | 1.2 | 0 | 2.2 | 2 | 0.3 | 5.3% | | 7 | 5 | 0 |
| 224 | C47E8.7 | unc-112 | mitogen inducible MIG- | 58.9 | 383.3 | 4.00E-107 | 33 | 1 | 0 | 1.6 | 3 | 0 | 0.0% | | 3 | 1 | 10 |
| 225 | C53D5.6 | imb-3 | importin beta, nuclear t | 48.48 | 152.9 | 1.40E-37 | 26 | 1.2 | 0 | 1.2 | 2 | 0.3 | 3.2% | | 3 | 1 | 0 |
| 226 | Y47G6A.8 | cm-1 | endonuclease | 46.34 | 116.7 | 1.60E-28 | 28 | 0 | 1.3 | 4.2 | 1.9 | 0 | 0.0% | | 1 | 1 | 37 |
| 227 | C47B2.5 | eif-6 | eIF-6, Translation initia | 73.33 | 279 | 1.00E-75 | 34 | 3 | 0 | 1 | 1 | 0 | 0.0% | | 2 | 1 | 63 |
| 228 | E02H1.1 | E02H1.1 | rRNA methyltransferas | 73.47 | 342 | 4.00E-95 | 33 | 1.3 | 0 | 1 | 1 | 0 | 0.0% | | 3 | 2 | 1 |
| 229 | C32E8.2 | rpl-13 | ribosomal protein L13 | 70 | 231.1 | 5.60E-62 | 26 | 1.3 | 0 | 2.2 | 1 | 0 | 0.0% | | 6 | 2 | 0 |

FIG. 3C

| # | ID | Gene | Description | Col5 | Col6 | Col7 | Col8 | Col9 | Col10 | Col11 | Col12 | Col13 | Col14 | Notes | Col16 | Col17 | Col18 |
|---|---|---|---|---|---|---|---|---|---|---|---|---|---|---|---|---|---|
| 230 | F53A3.3 | rps-22 | 40S ribosomal protein | 66.24 | 230.7 | 3.40E-62 | 26 | 1.3 | 0 | 3 | 2 | 0 | 0.0% | | 12 | 12 | 0 |
| 231 | C28E8.8 | ula-1 | component of the enzy | 56.47 | 101.3 | 3.00E-38 | 30 | 0 | 1.6 | 1.7 | 1 | 1 | 18.9% | | 1 | 0 | 1 |
| 232 | ZK742.1 | imb-4 | importin beta, nuclear t | 93.59 | 179 | 5.60E-99 | 33 | 1.6 | 0 | 1.6 | 1.6 | 0 | 0.0% | | 1 | 0 | 4 |
| 233 | F33D4.5 | F33D4.5 | Ribosomal protein L1p/ | 48.12 | 250 | 2.60E-67 | 26 | 1.3 | 0 | 2.3 | 1 | 0 | 0.0% | | 0 | 0 | 1 |
| 234 | H37A05.1 | H37A05.1 | lipin, N-terminal conser | 71.88 | 236.9 | 1.90E-72 | 26 | 1 | 0 | 2 | 1 | 0 | 0.0% | | 1 | 0 | 0 |
| 235 | ZK909.2 | kin-1 | Protein kinase C termir | 80.87 | 191 | 4.00E-131 | 36 | 1 | 1 | 0 | 0 | 0 | 0.0% | | 1 | 0 | 0 |
| 236 | C05A1.1 | C05A1.1 | transitional endoplasmi | 89.47 | 417.5 | 2.00E-117 | 27 | 1 | 1 | 1 | 0 | 0 | 0.0% | | 1 | 0 | 54 |
| 237 | F26D1.10 | gex-3 | Drosophila dhem transi | 45.95 | 105.1 | 1.70E-22 | 26 | 1.6 | 0 | 2.6 | 1.6 | 0 | 0.0% | | 1 | 0 | 0 |
| 238 | F49C12.8 | rpn-7 | PCI domain;Proteasom | 57.07 | 230.7 | 1.90E-61 | 26 | 1 | 0 | 6.2 | 1 | 0 | 0.0% | | 1 | 1 | 59 |
| 239 | ZC518.2 | sec-24.2 | Yeast YIK0 like | 51.83 | 224.6 | 3.40E-59 | 26 | 1 | 0 | 2.6 | 2.2 | 0 | 0.0% | | 1 | 0 | 18 |
| 240 | F26A3.2 | F26A3.2 | Cap binding protein | 66.63 | 232.6 | 1.20E-62 | 39 | 1.6 | 0 | 2 | 0 | 0 | 0.0% | | 5 | 2 | 1 |
| 241 | Y110A2AL.8 | ptc-3 | Patched family;Patche | 46.96 | 196.7 | 1.00E-74 | 34 | 5.4 | 0 | 0.6 | 7.8 | 1 | 6.8% | | 3 | 3 | 27 |
| 242 | T23F2.1 | T23F2.1 | glycosyltransferase | 51.66 | 142.9 | 2.50E-34 | 29 | 1 | 1 | 0 | 1.6 | 0 | 0.0% | | 0 | 0 | 0 |
| 243 | C26D10.1 | ran-3 | regulator of chromosor | 62.75 | 196.4 | 1.50E-51 | 26 | 1 | 0 | 3 | 1 | 0 | 0.0% | | 4 | 1 | 0 |
| 244 | Y38A8.2 | pbs-3 | Proteasome A-type sur | 43.14 | 189.1 | 2.50E-49 | 26 | 1 | 0 | 2.6 | 1 | 0 | 0.0% | | 12 | 7 | 92 |
| 245 | F55A12.8 | F55A12.8 | Putative ATPase (DUF | 61.4 | 244.6 | 3.30E-65 | 33 | 1.2 | 0 | 1.2 | 2 | 0 | 0.0% | 20% Red | 2 | 0 | 0 |
| 246 | D2013.7 | eif-3.F | MOV-34 protein | 45.53 | 222.6 | 3.30E-59 | 26 | 1.6 | 0 | 1.6 | 1 | 0 | 0.0% | | 4 | 2 | 0 |
| 247 | F29D11.1 | lrp-1 | low density lipid recept | 73.56 | 147.1 | 1.60E-34 | 34 | 2.8 | 0 | 0 | 4.2 | 0 | 0.0% | | 1 | 0 | 0 |
| 248 | F56H1.4 | rpt-5 | ATPase | 83.61 | 686.8 | 0.00E+00 | 39 | 1 | 0 | 6.8 | 0 | 0 | 0.0% | | 8 | 6 | 146 |
| 249 | K08E3.5 | K08E3.5 | UTP--GLUCOSE-1-PH | 57.45 | 188.7 | 1.10E-48 | 26 | 1.3 | 0 | 4.3 | 1 | 0 | 0.0% | | 3 | 2 | 0 |
| 250 | D2024.6 | cap-1 | F-actin capping protein | 52.94 | 185.3 | 5.60E-48 | 26 | 1 | 0 | 3.7 | 1 | 0 | 0.0% | | 1 | 0 | 0 |
| 251 | T27B1.2 | T27B1.2 | zinc finger | 50 | 149.8 | 3.00E-36 | 31 | 2.2 | 0 | 1.6 | 0.6 | 0 | 0.0% | | 1 | 1 | 4 |
| 252 | C03C10.3 | mr-2 | Ribonuclease-diphosph | 76.19 | 366.7 | 2.00E-105 | 42 | 0 | 1 | 4.6 | 0 | 0 | 0.0% | WT | 1 | 0 | 8 |
| 253 | C04F12.4 | rpl-14 | ribosomal protein L14 | 85.93 | 179.9 | 7.40E-47 | 28 | 1.9 | 0 | 2.2 | 1 | 0 | 0.0% | | 9 | 5 | 0 |
| 254 | K02A11.1 | gfi-2 | ankyrin motifs | 55.19 | 185 | 7.00E-78 | 42 | 0.6 | 1 | 1.2 | 0.6 | 0.3 | 8.1% | | 1 | 0 | 0 |
| 255 | T28D9.10 | snr-3 | small nuclear ribonucle | 77.27 | 175.3 | 1.60E-45 | 26 | 1.3 | 0 | 2.3 | 1 | 0 | 0.0% | | 5 | 2 | 10 |
| 256 | Y56A3A.32 | wah-1 | Pyridine nucleotide-dist | 50 | 86.3 | 1.20E-26 | 28 | 1 | 0 | 2 | 1.6 | 1 | 17.9% | | 1 | 0 | 3 |
| 257 | F55A11.2 | syn-3 | epimorphin protein | 85.45 | 174.5 | 1.60E-44 | 26 | 1.6 | 0 | 2.3 | 2.3 | 0 | 0.0% | 10-15% Re | 2 | 1 | 0 |
| 258 | W09G12.5 | W09G12.5 | GTP-binding protein | 68.75 | 147 | 9.40E-36 | 33 | 1.2 | 0 | 1.6 | 1 | 0 | 0.0% | | 2 | 2 | 1 |
| 259 | R05D11.3 | ran-4 | nuclear transport factor | 61.54 | 172.2 | 1.50E-44 | 28 | 1.2 | 0 | 3.2 | 1.6 | 0 | 0.0% | | 3 | 1 | 0 |
| 260 | C18D1.1 | die-1 | Zinc finger, C2H2 type | 72.22 | 112.1 | 3.00E-30 | 33 | 1 | 0 | 1.6 | 1 | 0.3 | 7.7% | | 1 | 0 | 5 |
| 261 | M03F4.7 | M03F4.7 | calcium binding proteir | 78.46 | 115.9 | 2.10E-26 | 29 | 1.2 | 1 | 0 | 1.6 | 0.3 | 7.3% | | 3 | 3 | 2 |
| 262 | C09H10.3 | nuo-1 | NADH-ubiquinone oxid | 80 | 207.2 | 2.00E-53 | 41 | 1.6 | 0 | 1.6 | 0 | 0 | 0.0% | | 1 | 0 | 14 |
| 263 | C56C10.3 | C56C10.3 | SNF7 | 58.82 | 82.8 | 4.90E-30 | 33 | 1.6 | 0 | 1.6 | 1 | 0 | 0.0% | | 3 | 0 | 0 |
| 264 | H19M22.2 | let-805 | Fibronectin type III dorr | 55.02 | 241.5 | 1.10E-63 | 26 | 1.6 | 0 | 2.8 | 2 | 2 | 23.8% | 45-55% Re | 2 | 0 | 1 |
| 265 | C41D11.2 | eif-3.H | PF01398 (Mov34/MPN | 53.92 | 218.8 | 6.30E-58 | 33 | 1 | 0 | 1.6 | 2.8 | 0 | 0.0% | | 6 | 5 | 6 |
| 266 | F26E5.9 | cco-1 | cytochrome C oxidase | 57.85 | 164.9 | 2.30E-42 | 26 | 1.2 | 0 | 3.2 | 2 | 0 | 0.0% | | 1 | 0 | 1 |
| 267 | F37E3.1 | F37E3.1 | CAP-binding protein | 34.86 | 79.34 | 6.70E-15 | 3 | 2.8 | 1 | 3 | 3.6 | 0 | 0.0% | | 1 | 0 | 0 |
| 268 | F12F6.6 | sec-24.1 | Yeast hypothetical YIK | 44.59 | 118.2 | 1.90E-26 | 15 | 2 | 0 | 1.6 | 1 | 0 | 0.0% | | 0 | 0 | 27 |
| 269 | R09B3.4 | ubc-12 | Ubiquitin-conjugating e | 62.78 | 239.6 | 1.30E-64 | 28 | 0 | 1 | 2.2 | 2.2 | 0.3 | 5.3% | | 8 | 8 | 0 |
| 270 | Y65B4BR.5 | Y65B4BR.5 | UBA/TS-N domain;NA( | 63.68 | 236.9 | 9.90E-64 | 28 | 0.6 | 1 | 3.6 | 4.4 | 0 | 0.0% | | 13 | 11 | 4 |
| 271 | R07E5.10 | R07E5.10 | Apoptosis protein RP-8 | 35.37 | 105.9 | 5.60E-24 | 10 | 2 | 0 | 3 | 1.6 | 0 | 0.0% | | 1 | 0 | 0 |
| 272 | F32H2.1 | gel-11 | protooncogene C-MYB | 36.59 | 91.3 | 4.00E-33 | 10 | 2 | 0 | 2.7 | 1 | 0 | 0.0% | | 1 | 0 | 0 |
| 273 | ZC513.4 | vrs-1 | valyl-tRNA synthetase | 77.78 | 149.1 | 1.70E-36 | 28 | 1.3 | 0 | 2.6 | 1 | 0 | 0.0% | | 2 | 2 | 0 |
| 274 | C27A2.6 | dsh-2 | DIX domain, a DEP dor | 43.56 | 86.27 | 9.40E-18 | 16 | 1 | 1.6 | 2.7 | 2 | 0 | 0.0% | | 1 | 1 | 7 |
| 275 | Y110A7A.13 | chp-1 | two CHORD domains, | 62.79 | 162.5 | 4.60E-41 | 26 | 1 | 0 | 2.2 | 1 | 0 | 0.0% | | 1 | 0 | 0 |
| 276 | T08G11.4 | T08G11.4 | SAM binding motif | 64.71 | 86.66 | 6.20E-18 | 10 | 2.2 | 0 | 2.2 | 2.2 | 0 | 0.0% | | 1 | 1 | 2 |
| 277 | C17E4.5 | pab-3 | RNA binding protein (R | 55.7 | 85.11 | 5.10E-18 | 10 | 3.9 | 0 | 3.9 | 4.2 | 0 | 0.0% | | 1 | 0 | 36 |
| 278 | C16H11.9 | C16H11.9 | Human HA0609 proteir | 54.6 | 179.5 | 3.80E-46 | 26 | 1.6 | 0 | 3 | 2 | 0.3 | 4.3% | | 5 | 3 | 0 |
| 279 | T01C3.1 | T01C3.1 | WD domain, G-beta rej | 36.51 | 130.6 | 4.90E-31 | 30 | 0 | 1.6 | 1.3 | 0.3 | 0 | 0.0% | | 3 | 1 | 3 |
| 280 | Y47D3B.1 | Y47D3B.1 | DUF23;Rhodopsin-like | 41.57 | 114 | 4.70E-73 | 37 | 2 | 0 | 0 | 0 | 1 | 33.3% | | 4 | 2 | 0 |
| 281 | ZK430.1 | ZK430.1 | unknown function | 30 | 109.4 | 1.30E-23 | 15 | 2.2 | 0 | 1.6 | 3 | 0 | 0.0% | | 1 | 0 | 1 |
| 282 | T23D8.3 | T23D8.3 | domain - Low temperat | 36.23 | 96.29 | 5.40E-21 | 15 | 3.5 | 0 | 1 | 1 | 0 | 0.0% | | 1 | 1 | 1 |
| 283 | C27A2.2 | rpl-22 | ribosomal protein L22 | 67.24 | 160.6 | 4.40E-41 | 28 | 1.3 | 0 | 3.3 | 1 | 0 | 0.0% | | 4 | 4 | 46 |
| 284 | K02D10.5 | K02D10.5 | synaptosomal associat | 47.24 | 158.3 | 7.20E-40 | 28 | 1.7 | 0 | 4.2 | 1 | 0 | 0.0% | | 1 | 0 | 2 |
| 285 | W01G7.3 | W01G7.3 | RNA polymerases L / 1 | 75.56 | 156.4 | 7.20E-40 | 26 | 1 | 0 | 5.3 | 1.6 | 0 | 0.0% | | 12 | 10 | 0 |
| 286 | T26A5.9 | dlc-1 | Dynein light chain type | 94.59 | 176 | 5.10E-45 | 28 | 0 | 1 | 4.6 | 1.2 | 0 | 0.0% | | 7 | 7 | 22 |
| 287 | F55C5.8 | F55C5.8 | signal recognition parti | 45.45 | 141.4 | 2.30E-34 | 28 | 0.6 | 1 | 2.9 | 1 | 0 | 0.0% | | 0 | 0 | 0 |
| 288 | C14A4.14 | C14A4.14 | unknown function | 75 | 251.1 | 1.30E-67 | 31 | 2.6 | 0 | 1.6 | 0 | 0 | 0.0% | | 4 | 4 | 0 |
| 289 | B0035.11 | B0035.11 | Yeast LEO1 protein like | 55.88 | 75.9 | 1.00E-13 | 10 | 2.7 | 0 | 3.3 | 3.2 | 0 | 0.0% | | 1 | 0 | 1 |
| 290 | T10F2.4 | T10F2.4 | WD domain, G-beta re | 45.68 | 326.6 | 6.30E-91 | 35 | 0 | 2 | 4.3 | 0 | 0 | 0.0% | | 7 | 4 | 0 |
| 291 | W06E11.1 | W06E11.1 | Sin-like protein consen | 41.46 | 72.4 | 1.00E-13 | 10 | 3.6 | 0 | 2 | 3 | 0.3 | 3.4% | | 1 | 0 | 0 |
| 292 | F57B10.1 | F57B10.1 | bZIP transcription facto | 73.33 | 70.9 | 1.40E-19 | 10 | 4.1 | 0 | 2.2 | 1.6 | 1 | 11.2% | | 1 | 1 | 10 |
| 293 | K09H9.6 | ipd-6 | Brix domain;Brix | 51.2 | 197.6 | 2.50E-51 | 34 | 3.9 | 0 | 0 | 2 | 0 | 0.0% | | 1 | 0 | 0 |
| 294 | M04B2.1 | mep-1 | zinc-finger protein | 73.81 | 97.1 | 3.40E-20 | 15 | 2 | 0 | 1 | 1.6 | 0.3 | 6.1% | | 1 | 0 | 0 |
| 295 | C53A5.1 | C53A5.1 | unknown function | 57.14 | 75.48 | 2.10E-15 | 33 | 1.3 | 0 | 1.6 | 1 | 0 | 0.0% | | 3 | 2 | 0 |
| 296 | Y71F9AM.4 | Y71F9AM.4 | Sec34-like family;Sec3 | 52.31 | 95.52 | 1.90E-20 | 16 | 1.2 | 1 | 2 | 2.2 | 0 | 0.0% | | 1 | 0 | 7 |
| 297 | T05H4.12 | T05H4.12 | Mitochondrial ATP syn | 34.62 | 72.79 | 1.20E-14 | 28 | 1 | 0 | 2.6 | 1 | 0 | 0.0% | | 18 | 17 | 7 |
| 298 | H43I07.2 | H43I07.2 | RNA polymerase Rpb3 | 39.83 | 85.5 | 3.80E-17 | 15 | 2.6 | 0 | 1 | 1 | 0 | 0.0% | | 1 | 1 | 1 |
| 299 | F57H12.1 | arf-3 | GTP-binding protein | 87.57 | 319.3 | 1.30E-86 | 3 | 2.3 | 1 | 2.2 | 2.6 | 0 | 0.0% | | 2 | 2 | 39 |
| 300 | C32F10.5 | hmg-3 | single-strand recognitic | 54.55 | 145.2 | 8.50E-35 | 10 | 3.2 | 0 | 3.6 | 1 | 0 | 0.0% | | 19 | 17 | 1 |

FIG. 3D

IDENTIFICATION AND USE OF TARGET GENES FOR CONTROL OF PLANT PARASITIC NEMATODES

This application claims benefit of and priority to U.S. Provisional Patent Application 60/772,265, filed Feb. 10, 2006, which is herein incorporated by reference in its entirety.

BACKGROUND OF THE INVENTION

1. Field of the Invention

The present invention relates generally to genetic control of plant disease caused by plant-parasitic nematodes. More specifically, the present invention relates to identification of target coding sequences, and to use of recombinant DNA technologies for post-transcriptionally repressing or inhibiting expression of target coding sequences in the cells of a plant-parasitic nematode to provide a plant protective effect.

2. Description of Related Art

Plants are subject to multiple potential disease causing agents, including plant-parasitic nematodes, which are active, flexible, elongate, organisms that live on moist surfaces or in liquid environments, including films of water within soil and moist tissues within other organisms. There are numerous plant-parasitic nematode species, including various cyst nematodes (e.g. *Heterodera* sp.), root knot nematodes (e.g. *Meloidogyne* sp.), lesion nematodes (e.g. *Pratylenchus* sp.), dagger nematodes (e.g. *Xiphinema* sp.) and stem and bulb nematodes (e.g. *Ditylenchus* sp.), among others. Tylenchid nematodes (members of the order *Tylenchida*), including the families Heteroderidae, Meloidogynidae, and Pratylenchidae, are the largest and most economically important group of plant-parasitic nematodes. Other important plant-parasitic nematodes include Dorylaimid nematodes (e.g. *Xiphinema* sp.), among others. Nematode species grow through a series of lifecycle stages and molts. Typically, there are five stages and four molts: egg stage; J1 (i.e. first juvenile stage); M1 (i.e. first molt); J2 (second juvenile stage; sometimes hatch from egg); M2; J3; M3; J4; M4; A (adult). Juvenile ("J") stages are also sometimes referred to as larval ("L") stages. Gene expression may be specific to one or more lifecycle stages.

Some species of nematodes have evolved as very successful parasites of both plants and animals and are responsible for significant economic losses in agriculture and livestock and for morbidity and mortality in humans. Nematode parasites of plants can inhabit all parts of plants, including roots, developing flower buds, leaves, and stems. Plant parasites are classified on the basis of their feeding habits into the broad categories migratory ectoparasites, migratory endoparasites, and sedentary endoparasites. Sedentary endoparasites, which include the root knot nematodes (*Meloidogyne*) and cyst nematodes (*Globodera* and *Heterodera*) induce feeding sites ("syncytia") and establish long-term infections within roots that are often very damaging to crops. It is estimated that parasitic nematodes cost the horticulture and agriculture industries in excess of $78 billion worldwide a year, based on an estimated average 12% annual loss spread across all major crops. For example, it is estimated that nematodes cause soybean losses of approximately $3.2 billion annually worldwide (Barker et al., 1994).

Compositions, methods, and agents for controlling infestations by nematodes have been provided in several forms. Biological and cultural control methods, including plant quarantines, have been attempted in numerous instances. In some crops, plant resistance genes have been identified that allow nematode resistance or tolerance. Chemical compositions such as nematocides have typically been applied to soil in which plant parasitic nematodes are present. However, there is an urgent need for safe and effective nematode controls. Factors relating to the disadvantages of current control strategies include heightened concern for the sustainability of agriculture, and new government regulations that may prevent or severely restrict the use of many available agricultural chemical antihelminthic agents.

Chemical agents are often not selective, and exert their effects on non-target organisms, effectively disrupting populations of beneficial microorganisms, for a period of time following application of the agent. Chemical agents may persist in the environment and only be slowly metabolized. Nematocidal soil fumigants such as chloropicrin and methyl bromide and related compounds are highly toxic, and methyl bromide has been identified as an ozone-depleting compound. Thus its registration for use in the United States is not being renewed. These agents may also accumulate in the water table or the food chain, and in higher trophic level species. These agents may also act as mutagens and/or carcinogens to cause irreversible and deleterious genetic modifications. Thus, alternative methods for nematode control, such as genetic methods, are increasingly being studied.

The organism *Caenorhabditis elegans*, a bacteriovorous nematode, is the most widely studied nematode genetic model. Public and private databases hold a wealth of information on its genetics and development, but practically applying this information for control of plant-parasitic nematodes remains a challenge (McCarter et al. 2003; McCarter 2004). It has previously been impractical to routinely identify a large number of target genes in nematodes other than *C. elegans*, such as plant-parasitic nematodes, for subsequent functional analysis e.g. by RNAi analysis. Therefore, there has existed a need for improved methods of identifying target genes, suppression of expression of which leads to control of nematode infestation.

Many genes in *C. elegans* have orthologs in metazoan animals including insects and vertebrates as well as other nematodes. In recent years, a greatly expanded expressed sequence tag (EST) collection has been generated from over 30 parasitic nematode species of plants and animals (Parkinson et al., 2004). As of 2005 there were approximately 560,874 nucleotide sequences in Genbank from nematodes other than *Caenorhabditis* species and public projects are underway to generate draft sequences of *Meloidogyne hapla* (root knot nematode), *Haemonchus contortus* (parasite of sheep), *Trichinella spiralis* (parasite of humans and other mammals) (430,000 sequence traces submitted), and *Pristionchus pacificus* (free living nematode) (149,000 sequence traces submitted). 20,109 ESTs are available from *Heterodera glycines* representing portions of approximately 9,000 genes (see, e.g., U.S. patent application Ser. No. 11/360,355, filed Feb. 23, 2006). Conserved genes are expected to often retain the same or very similar functions in different nematodes. This functional equivalence has been demonstrated in some cases by transforming *C. elegans* with homologous genes from other nematodes (Kwa et al., 1995; Redmond et al. 2001). Such equivalence has been shown in cross phyla comparisons for conserved genes and is expected to be more robust among species within a phylum.

RNA interference (RNAi) is a process utilizing endogenous cellular pathways whereby a double stranded RNA (dsRNA) specific target gene results in the degradation of the mRNA of interest. In recent years, RNAi has been used to perform gene "knockdown" in a number of species and experimental systems, from the nematode *C. elegans*, to plants, to insect embryos and cells in tissue culture (Fire et al., 1998; Martinez et al., 2002; McManus and Sharp, 2002). RNAi works through an endogenous pathway including the Dicer protein complex that generates ~21-nucleotide small interfering RNAs (siRNAs) from the original dsRNA and the RNA-induced silencing complex (RISC) that uses siRNA guides to recognize and degrade the corresponding mRNAs. Only transcripts complementary to the siRNA are cleaved and degraded, and thus the knock-down of mRNA expression is usually sequence specific. The gene silencing effect of RNAi persists for days and, under experimental conditions, can lead to a decline in abundance of the targeted transcript of 90% or more, with consequent decline in levels of the corresponding protein.

dsRNA-mediated gene suppression by RNAi can be achieved in *C. elegans* by feeding, by soaking the nematodes in solutions containing double stranded or small interfering RNA molecules, and by injection of the dsRNA molecules (Kamath et al., 2001; Maeda et al., 2001. Several large-scale surveys of *C. elegans* genes by RNAi have been performed so that RNAi knockdown information is available for >90% of *C. elegans* genes (Gonczy et al., 2000; Fraser et al., 2000; Piano et al., 2000; Maeda et al., 2001; Kamath et al., 2003; Simmer et al., 2003; Ashrafi et al., 2003; Sonnichsen et al., 2005).

To date, only limited published technical or patent information exists on RNAi-mediated gene suppression in plant parasitic nematodes, wherein the double-stranded (dsRNA) or small interfering (siRNA) molecules are taken up from artificial growth media (in vitro) or from plant tissue (in planta). RNAi has been observed to function in several parasitic nematodes including the plant parasites *Heterodera glycines* and *Globodera pallida* (Urwin et al., 2002; US Publication US2004/0098761; US Publication US2003/0150017; US Publication US2003/0061626; US Publication US2004/0133943; Fairbaim et al. 2005), *Meloidogyne javanica* (WO2005/019408), and the mammalian parasites *Nippostrongylus brasiliensis* (Hussein et al., 2002), *Brugia malayi* (Aboobaker et al., 2003), and *Onchocerca volvulus* (Lustigman et al., 2004). Production of parasite-specific dsRNA in plant cells has been suggested as a direct strategy for control of plant parasitic nematodes including the soybean cyst nematode, *Heterodera glycines* (e.g. Fire et al., 1998; US Publication US2004/0098761; WO 03/052110 A2; US Publication US2005/0188438). US Publication US2006/0037101 describes use of *H. glycines* sequences, such as from pas5, to modulate SCN gene expression. However, no systematic method for identifying target nematode genes for use in such strategies has been reported, and only a limited number of plant-parasitic nematode genes have been proposed as potential targets for RNAi-mediated gene suppression studies.

BRIEF DESCRIPTION OF THE FIGURES

FIG. 2: Results of *C. elegans* P0 RNAi feeding studies
FIG. 3A-3D: Top 300 List of *H. glycines* Gene Targets Based on *C. elegans* orthologs

SUMMARY OF THE INVENTION

Figure 1:
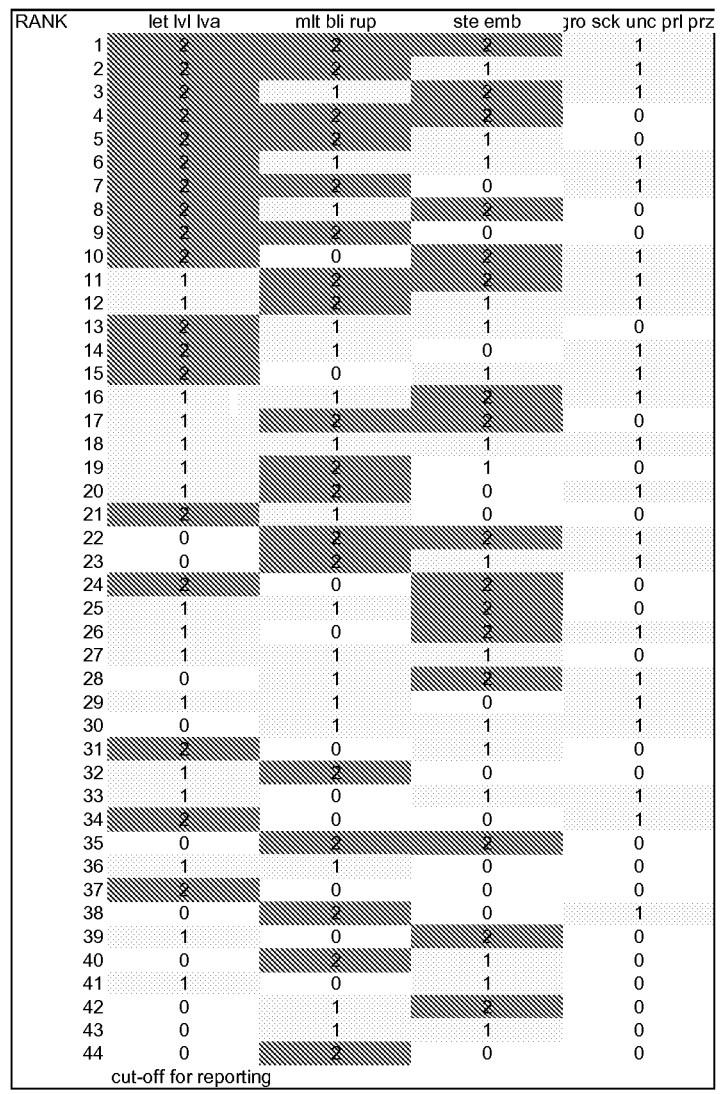
FIG. 1: *C. elegans* RNAi Phenotype Ranking System

The present invention is directed toward compositions and methods for controlling diseases caused by plant-parasitic nematodes. The present invention provides exemplary nucleic acid compositions that are homologous to at least a portion of one or more native nucleic acid sequences in a target plant-parasitic nematode. In certain embodiments, the nematode is selected from *Heterodera* sp., *Meloidogyne* sp., *Globodera* sp., *Helicotylenchus* sp., *Ditylenchus* sp., *Pratylenchus* sp., *Paratylenchus* sp., *Rotylenchus* sp., *Tylenchulus* sp., *Tylenchorhynchus* sp., *Hoplolaimus* sp., *Belonolaimus* sp., *Anguina* sp., *Subanguina* sp. and *Nacobbus* sp. In particular, the nematode may be a *Heterodera* sp., such as *H. glycines*. Specific examples of such nucleic acids provided by the invention are given in the attached sequence listing as SEQ ID NOs:301-1026, SEQ ID NOs:1269-1702, and SEQ ID NOs:1920-1929. However, in certain embodiments, the invention does not comprise SEQ ID NOs:525, 569, 797, 1293 or 1516.

Thus, in one aspect, the invention provides an isolated polynucleotide selected from the group consisting of: (a) a fragment of at least 21 contiguous nucleotides of a nucleic acid sequence of any of SEQ ID NOs:301-1026, SEQ ID NOs:1269-1702, and SEQ ID NOs:1920-1929, as set forth in the sequence listing, wherein uptake by a plant-parasitic nematode of a double stranded ribonucleotide sequence comprising at least one strand that is complementary to said fragment inhibits the growth of said nematode; and (b) a complement of the sequence of (a). In another aspect, the invention provides this isolated polynucleotide, further defined as operably linked to a heterologous promoter. However, in certain embodiments, the invention does not comprise SEQ ID NOs:525, 569, 797, 1293 or 1516. In yet another aspect, the invention provides this isolated polynucleotide further defined as comprised on a plant transformation vector. As used herein uptake by a plant-parasitic nematode includes ingestion of one or more sequences by the nematode, for example, by feeding. In specific non-limiting embodiments, uptake may be achieved by contacting a plant-parasitic nematode with a composition comprising one or more nucleic acid(s) according to the invention. For instance, uptake may also be achieved by soaking of plant-parasitic nematodes with a solution comprising the nucleic acid(s).

The invention is also directed to a double stranded ribonucleotide sequence produced from the expression of the above polynucleotide, wherein the taking up of said ribonucleotide sequence by a plant-parasitic nematode inhibits the growth of said nematode. The invention further provides a double stranded ribonucleotide sequence produced by preparing a recombinant polynucleotide sequence comprising a first, a second and a third polynucleotide sequence, wherein the first polynucleotide sequence comprises an isolated polynucleotide, uptake of which by a plant-parasitic nematode inhibits the growth, feeding, or development of said nematode, wherein the third polynucleotide sequence is linked to the first polynucleotide sequence by the second polynucleotide sequence, and wherein the third polynucleotide sequence is substantially the reverse complement of the first polynucleotide sequence such that the first and the third polynucleotide sequences hybridize when transcribed into a ribonucleic acid to form the double stranded ribonucleotide molecule stabilized by the linked second ribonucleotide sequence. Inhibition of nematode growth, feeding, or development may be accomplished by inhibiting expression of a nucleotide sequence in the plant-parasitic nematode that is substantially complementary to the sequence of the first polynucleotide.

The invention further provides a plant transformation vector comprising the above mentioned nucleotide sequence, wherein the sequence is operably linked to a heterologous promoter functional in a plant cell, and to cells transformed with the vector. The cells may be prokaryotic or eukaryotic. In particular, they may be plant cells. Plants and seeds derived from such transformed plant cells are also contemplated. The invention further provides a commodity product produced from such a plant, wherein said commodity product comprises a detectable amount of the polynucleotide of claim 1 or a ribonucleotide expressed therefrom. Methods to produce such a commodity product are also contemplated, by obtaining such transformed plants and preparing food or feed from them. In particular, the food or feed is defined as oil, meal, protein, starch, flour or silage.

The invention also relates to methods for controlling a population of a plant-parasitic nematode, such as *H. glycines*, comprising providing an agent comprising a double stranded ribonucleotide sequence that functions upon being taken up by the nematode to inhibit a biological function within said nematode, wherein the agent comprises a nucleotide sequence selected from the group consisting of SEQ ID NOs: 301-1026, SEQ ID NOs:1269-1702, and SEQ ID NOs: 1920-1929, and complements thereof. However, in certain embodiments, the invention does not relate to use of SEQ ID NOs: 525, 569, 797, 1293 or 1516. The polynucleotide sequence may exhibit from about 95 to about 100% nucleotide sequence identity along at least from about 19 to about 25 contiguous nucleotides to a target coding sequence derived from said nematode. The target sequence may encode a protein, the predicted function of which is selected from the group consisting of: DNA replication, cell cycle control, transcription, RNA processing, translation, ribosome function, tRNA synthesis, tRNA function, protein trafficking, secretion, protein modification, protein stability, protein degradation, energy production, mitochondrial function, intermediary metabolism, cell structure, signal transduction, endocytosis, ion regulation and transport.

The invention further provides a method for reducing the number of *Heterodera* feeding sites established in the root tissue of a host plant, comprising providing in the host plant of a *Heterodera* sp. a transformed plant cell expressing a polynucleotide sequence of any of SEQ ID NOs:301-1026, SEQ ID NOs:1269-1702, and SEQ ID NOs:1920-1929, wherein the polynucleotide is expressed to produce a double stranded ribonucleic acid that functions upon being taken up by the *Heterodera* sp. to inhibit the expression of a target sequence within said nematode and results in a decrease in the number of feeding sites established, relative to growth on a host lacking the transformed plant cell.

The present invention also relates to a method for improving the yield of a crop produced from a crop plant subjected to plant-parasitic nematode infection, said method comprising the steps of: a) introducing a polynucleotide selected from SEQ ID NOs:301-1026, SEQ ID NOs:1269-1702, and SEQ ID NOs:1920-1929, into said crop plant; b) cultivating the crop plant to allow the expression of said polynucleotide, wherein expression of the polynucleotide inhibits plant-parasitic nematode infection or growth and loss of yield due to plant-parasitic nematode infection. However, in certain embodiments, the invention does not comprise use of a polynucleotide selected from the group consisting of SEQ ID NOs:525, 569, 797, 1293 or 1516. In particular, the crop plant may be soybean (*Glycine max*), and the plant-parasitic nematode is a Tylenchid nematode such as *H. glycines*.

The invention additionally provides a method for modulating the expression of a target gene in a plant-parasitic nematode cell, the method comprising: (a) transforming a plant cell with a vector comprising a nucleic acid sequence encoding a dsRNA selected from the group consisting of SEQ ID NOs: 301-1026, SEQ ID NOs:1269-1702, and SEQ ID NOs:1920-1929, operatively linked to a promoter and a transcription termination sequence; (b) culturing the transformed plant cell under conditions sufficient to allow for development of a plant cell culture comprising a plurality of transformed plant cells; (c) selecting for transformed plant cells that have integrated the nucleic acid sequence into their genomes; (d) screening the transformed plant cells for expression of the dsRNA encoded by the nucleic acid sequence; and (e) selecting a plant cell that expresses the dsRNA. However, in certain embodiments, the invention does not relate to use of SEQ ID NOs:525, 569, 797, 1293 or 1516. Plants may also be regenerated from such plant cells. In particular, "modulating expression" may comprise inhibiting expression.

The invention also contemplates a method of identifying genes likely to be essential in the lifecycle of a target nematode, comprising: (a) ranking a *Caenorhabditis elegans* gene according to one or more criteria selected from the group consisting of: potency of reported RNAi phenotype; level of confidence in the reported phenotype; and likelihood of effect of RNAi at multiple stages in a nematode's lifecycle, such that a phenotype score is obtained, wherein a high rank indicates a *C. elegans* gene with a higher likelihood of demonstrating a detectable RNAi phenotype compared to the likelihood of such a phenotype in a lower ranked gene; (b) identifying possible orthologs of a *C. elegans* gene in the genome of the target nematode by performing a sequence similarity search in a protein or nucleic acid database such that a protein or nucleic acid sequence from a nematode other than *C. elegans* that has a threshold BLAST e-value of $e^{-10}$ when compared with a *C. elegans* sequence is deemed a possible ortholog of the *C. elegans* sequence; (c) identifying, among the possible orthologs of step (b), those genes from a nematode other than *C. elegans* that demonstrate a phenotype score in step (a) among the top 3.5% of all *C. elegans* genes. However, in certain embodiments, the invention does not comprise identification of SEQ ID NOs:525, 569, 797, 1293 or 1516.

DETAILED DESCRIPTION OF THE INVENTION

The following is a detailed description of the invention provided to aid those skilled in the art in practicing the present invention. Those of ordinary skill in the art may make modifications and variations in the embodiments described herein without departing from the spirit or scope of the present invention.

The present invention provides methods and compositions for genetic control of plant-parasitic nematode infestations. Methods for identifying genes essential to the lifecycle of a plant-parasitic nematode for use as a target for dsRNA-mediated control of a nematode population are also provided. DNA plasmid vectors encoding dsRNA molecules are designed to suppress nematode genes essential for growth and development. For example, the present invention provides methods and recombinant DNA technologies for post-transcriptionally repressing or inhibiting expression of a target coding sequence in a plant-parasitic nematode to provide a protective effect by allowing the plant-parasitic nematode to ingest one or more double stranded or small interfering ribonucleic acid (RNA) molecules transcribed from all or a portion of a target coding sequence, thereby controlling the infection. Therefore, the present invention relates to sequence-specific inhibition of expression of coding sequences using double-stranded RNA (dsRNA), including small interfering RNA (siRNA), to achieve the intended levels of nematode control.

In another aspect, the invention provides a method for evaluating the likelihood that a gene is useful as a target for dsRNA-mediated gene suppression for the purpose of controlling a nematode population. One challenge of achieving parasite control via RNAi is the selection of appropriate gene targets which will result in the disruption of the parasite's lifecycle following transcript knockdown. Since the throughput of systems to test candidate genes in *Heterodera glycines* is limited, prioritization of targets prior to testing is important. RNAi-based functional genomic screens are highly effective filters that can narrow target choices by an order of magnitude or more. In certain embodiments the nematode is a plant parasitic nematode. In another embodiment, the nematode is a Tylenchid plant-parasitic nematode. In another embodiment the nematode is a *Heterodera* sp. In yet another embodiment, the nematode is the soybean cyst nematode (*Heterodera glycines*).

A method for inhibiting target gene function within the plant pathogen soybean cyst nematode, *Heterodera glycines*, is also provided by the present invention, and can be accomplished by RNA interference, resulting in disruption of the pathogen's lifecycle. Optimal target genes for disruption include life-cycle essential genes where disruption results in high penetrance death of the parasite populations or "genetic death" by blocking of reproduction with minimal feeding damage to the plant, reduction in number of established feeding sites, and minimal viable escaping worms reaching the next generation. Another aspect of the present invention provides the nucleic acids of each of the 300 target genes predicted to be essential to *H. glycines* growth and/or development (FIG. 3). Features used to predict such targets include orthology to known *C. elegans* genes with strong and reproducible RNA interference phenotypes, and expression pattern in *H. glycines*.

In yet another aspect of the present invention, a set of isolated and purified nucleotide sequences as set forth in SEQ ID NOs:301-1026, SEQ ID NOs:1269-1702, and SEQ ID NOs:1920-1929, is provided. However, in certain embodiments, the invention does not comprise SEQ ID NOs:525, 569, 797, 1293 or 1516. The present invention provides a stabilized dsRNA molecule for the expression of one or more RNAs for inhibition of expression of a target gene in a plant-parasitic nematode, expressed from these sequences and fragments thereof. A stabilized dsRNA, including a dsRNA or siRNA molecule can comprise at least two coding sequences that are arranged in a sense and an antisense orientation relative to at least one promoter, wherein the nucleotide sequence that comprises a sense strand and an antisense strand are linked or connected by a spacer sequence of at least from about five to about one thousand nucleotides, wherein the sense strand and the antisense strand may be a different length, and wherein each of the two coding sequences shares at least 80% sequence identity, at least 90%, at least 95%, at least 98%, or 100% sequence identity, to any one or more nucleotide sequence(s) set forth in SEQ ID NOs:301-1026, SEQ ID NOs:1269-1702, and SEQ ID NOs:1920-1929.

In yet another aspect, the invention provides recombinant DNA constructs comprising a nucleic acid molecule encoding a dsRNA molecule described herein. The dsRNA may be formed by transcription of one strand of the dsRNA molecule from a nucleotide sequence which is at least from about 80% to about 100% identical to a nucleotide sequence selected from the group consisting of SEQ ID NOs:301-1026, SEQ ID NOs:1269-1702, and SEQ ID NOs:1920-1929. Such recombinant DNA constructs may be defined as producing dsRNA molecules capable of inhibiting the expression of endogenous target gene(s) in a plant-parasitic nematode cell upon ingestion. The construct may comprise a nucleotide sequence of the invention operably linked to a promoter sequence that functions in the host cell such as a plant cell. Such a promoter may be tissue-specific and may, for example, be specific to a tissue type which is the subject of plant-parasitic nematode attack. In the case of a root or foliar pathogen, respectively for example, it may be desired to use a promoter providing root or leaf-preferred expression, respectively.

Nucleic acid constructs in accordance with the invention may comprise at least one non-naturally occurring nucleotide sequence that can be transcribed into a single stranded RNA capable of forming a dsRNA molecule in vivo through intermolecular hybridization. Such dsRNA sequences self assemble and can be provided in the nutrition source of a plant-parasitic nematode to achieve the desired inhibition.

A recombinant DNA construct may comprise two different non-naturally occurring sequences which, when expressed in vivo as dsRNA sequences and provided in the tissues of the host plant of a plant-parasitic nematode, inhibit the expression of at least two different target genes in the plant-parasitic nematode. In certain embodiments, at least 2, 3, 4, 5, 6, 8 or 10 or more different dsRNAs are produced in a cell, or plant comprising the cell, that have a nematode-inhibitory effect. The dsRNAs may be expressed from multiple constructs introduced in different transformation events or could be introduced on a single nucleic acid molecule. The dsRNAs may be expressed using a single promoter or multiple promoters. In one embodiment of the invention, single dsRNAs are produced that comprise nucleic acids homologous to multiple loci within a plant-parasitic nematode.

In still yet another aspect, the invention provides a recombinant host cell having in its genome at least one recombinant DNA sequence that is transcribed to produce at least one dsRNA molecule that functions when ingested by a plant-parasitic nematode to inhibit the expression of a target gene in the nematode. The dsRNA molecule may be encoded by any of the nucleic acids described herein and as set forth in the sequence listing. The present invention also provides a transformed plant cell having in its genome at least one recombinant DNA sequence described herein. Transgenic plants comprising such a transformed plant cell are also provided, including progeny plants of any generation, seeds, and plant products, each comprising the recombinant DNA. The dsRNA molecules of the present invention may be found in the transgenic plant cell, for instance in the cytoplasm. They may also be found in an apoplastic space.

The invention also provides one or more stabilization sequences, or "clamps", which may be unrelated to the gene of interest. A clamp preferably comprises a GC rich region that serves to thermodynamically stabilize the dsRNA molecule, and may increase gene silencing.

Further provided by the invention is a fragment of a nucleic acid sequence selected from the group consisting of SEQ ID NOs:301-1026, SEQ ID NOs:1269-1702, and SEQ ID NOs:1920-1929. The fragment may be defined as causing the death, growth inhibition, or cessation of infection or feeding by a plant-parasitic nematode, when expressed as a dsRNA and taken up by the nematode. The fragment may, for example, comprise at least about 19, 21, 23, 25, 40, 60, 80, 100, 125 or more contiguous nucleotides of any one or more of the sequences in SEQ ID NOs:301-1026, SEQ ID NOs:1269-1702, and SEQ ID NOs:1920-1929, or a complement thereof. However, in certain embodiments, the invention does not comprise a fragment or complement of SEQ ID NOs:525, 569, 797, 1293 or 1516. One beneficial DNA segment for use in the present invention is at least from about 19 to about 23, or about 23 to about 100 nucleotides, but less than about 2000 nucleotides, in length. Particularly useful will be dsRNA sequences including about 23 to about 300 nucleotides homologous to a nematode target sequence. The invention also provides a ribonucleic acid expressed from any of such sequences including a dsRNA. A sequence selected for use in expression of a gene suppression agent can be constructed from a single sequence derived from one or more target plant-parasitic nematode species and intended for use in expression of an RNA that functions in the suppression of a single gene or gene family in the one or more target pathogens, or that the DNA sequence can be constructed as a chimera from a plurality of DNA sequences.

In another embodiment, the invention provides a method for modulating expression of a target gene in a nematode cell, the method comprising: (a) transforming a plant cell with a vector comprising a nucleic acid sequence encoding a dsRNA operatively linked to a promoter and a transcription termination sequence; (b) culturing the transformed plant cell under conditions sufficient to allow for development of a plant cell culture comprising a plurality of transformed plant cells; (c) selecting for transformed plant cells that have integrated the vector into their genomes; (d) screening the transformed plant cells for expression of the dsRNA encoded by the vector; (e) selecting a plant cell that expresses the dsRNA; (f) optionally regenerating a plant from the plant cell that expresses the dsRNA; whereby expression of the gene in the plant is sufficient to modulate the expression of a target gene in a cell of a plant parasitic nematode that contacts the transformed plant or plant cell. Modulation of gene expression may include partial or complete suppression of such expression.

In yet another aspect, the invention provides a method for suppression of gene expression in a plant-parasitic nematode, comprising the provision in the tissue of the host of the nematode a gene-suppressive amount of at least one dsRNA molecule transcribed from a nucleotide sequence as described herein, at least one segment of which is complementary to an mRNA sequence within the cells of the plant-parasitic nematode. The method may further comprise observing the death or growth inhibition of the plant-parasitic nematode, and the degree of host symptomatology. A dsRNA molecule, including its modified form such as an siRNA molecule, ingested by a pathogenic microorganism in accordance with the invention may be at least from about 80, 81, 82, 83, 84, 85, 86, 87, 88 89, 90, 91, 92, 93, 94, 95, 96, 97, 98, 99, or about 100% identical to a RNA molecule transcribed from a nucleotide sequence selected from the group consisting of SEQ ID NOs:301-1026, SEQ ID NOs:1269-1702, and SEQ ID NOs:1920-1929.

Isolated and substantially purified nucleic acid molecules including, but not limited to, non-naturally occurring nucleotide sequences and recombinant DNA constructs for transcribing dsRNA molecules of the present invention are therefore provided, which suppress or inhibit the expression of an endogenous coding sequence or a target coding sequence in the plant-parasitic nematode when introduced thereto. Transgenic plants that (a) contain nucleotide sequences encoding the isolated and substantially purified nucleic acid molecules and the non-naturally occurring recombinant DNA constructs for transcribing the dsRNA molecules for controlling plant-parasitic nematode infections, and (b) display resistance and/or enhanced tolerance to the infections, are also contemplated. Compositions containing the dsRNA nucleotide sequences of the present invention for use in topical applications onto plants or onto animals or into the environment of an animal to achieve the elimination or reduction of plant-parasitic nematode infection are also included.

cDNA sequences encoding proteins or parts of proteins essential for survival, such as amino acid sequences involved in various metabolic or catabolic biochemical pathways, cell division, reproduction, energy metabolism, digestion, and the like may be selected for use in preparing double stranded RNA molecules to be provided in the host plant of a plant-parasitic nematode. As described herein, ingestion of compositions by a target organism containing one or more dsRNAs, at least one segment of which corresponds to at least a substantially identical segment of RNA produced in the cells of the target pathogen, can result in the death or other inhibition of the target. These results indicate that a nucleotide sequence, either DNA or RNA, derived from a plant-parasitic nematode can be used to construct plant cells resistant to infestation by the nematode. The host plant of the nematode, for example, can be transformed to contain one or more of the nucleotide sequences derived from the nematode as provided herein. The nucleotide sequence transformed into the host may encode one or more RNAs that form into a dsRNA sequence in the cells or biological fluids within the transformed host, thus making the dsRNA available if/when the plant-parasitic nematode forms a nutritional relationship with the transgenic host. This may result in the suppression of expression of one or more genes in the cells of the plant-parasitic nematode and ultimately death or inhibition of its growth or development.

The present invention relates generally to genetic control of plant-parasitic nematodes in host organisms. More particularly, the present invention includes methods for delivery of nematode control agents to plant-parasitic nematodes. Such control agents cause, directly or indirectly, an impairment in the ability of the plant-parasitic nematode to feed, grow or otherwise cause disease in a target host. The present invention provides in one embodiment a method comprising delivery of stabilized dsRNA molecules to plant-parasitic nematodes as a means for suppression of targeted genes in the plant-parasitic nematode, thus achieving desired control of plant disease in the nematode host.

In accomplishing the foregoing, the present invention provides a method of inhibiting expression of a target gene in a plant-parasitic nematode, resulting in the cessation of growth, development, reproduction, and/or feeding, and eventually may result in the death of the plant-parasitic nematode. The method comprises in one embodiment introducing partial or fully stabilized double-stranded RNA (dsRNA) nucleotide molecules, including its modified forms such as small interfereing RNA (siRNA) sequences, into a nutritional composition for the plant-parasitic nematode, and making the nutritional composition or food source available to the plant-parasitic nematode. Ingestion of the nutritional composition containing the double stranded or siRNA molecules results in the uptake of the molecules by the cells of the nematode, resulting in the inhibition of expression of at least one target gene in the cells of the nematode. Inhibition of the target gene exerts a deleterious effect upon the nematode. The methods and associated compositions may be used for limiting or eliminating infection or parasitization of a plant or plant cell by a nematode, in or on any host tissue or environment in which a the nematode is present by providing one or more compositions comprising the dsRNA molecules described herein in the host of the nematode.

In certain embodiments, dsRNA molecules provided by the invention comprise nucleotide sequences complementary to a sequence as set forth in any of SEQ ID NOs:301-1026, SEQ ID NOs:1269-1702, and SEQ ID NOs:1920-1929, the inhibition of which in a plant-parasitic nematode results in the reduction or removal of a protein or nucleotide sequence agent that is essential for the nematode's growth and development or other biological function. The nucleotide sequence selected may exhibit from about 80% to about 100% sequence identity to one of the nucleotide sequences as set forth in SEQ ID NOs:301-1026, SEQ ID NOs:1269-1702, and SEQ ID NOs:1920-1929, including the complement thereof. However, in certain embodiments, the invention does not comprise a sequence that exhibits 80-100% identity to SEQ ID NOs:525, 569, 797, 1293 or 1516. Such inhibition can be described as specific in that a nucleotide sequence from a portion of the target gene is chosen from which the inhibitory dsRNA or siRNA is transcribed. The method is effective in inhibiting the expression of at least one target gene and can be used to inhibit many different types of target genes in the plant-parasitic nematode.

The sequences identified as having a nematode-protective effect may be readily expressed as dsRNA molecules through the creation of appropriate expression constructs. For example, such sequences can be expressed as a hairpin and stem and loop structure by taking a first segment corresponding to a sequence selected from SEQ ID NOs:301-1026, SEQ ID NOs: 1269-1702, and SEQ ID NOs: 1920-1929, or a fragment thereof, linking this sequence to a second segment spacer region that is not homologous or complementary to the first segment, and linking this to a third segment that transcribes an RNA, wherein at least a portion of the third segment is substantially complementary to the first segment. Such a construct forms a stem and loop structure by hybridization of the first segment with the third segment and a loop structure forms comprising the second segment (WO94/01550, WO98/05770, US 2002/0048814A1, and US 2003/0018993A1. dsRNA may be generated for instance in the form of a double stranded structure such as a stem loop structure (e.g. hairpin), whereby production of siRNA targeted for a nematode sequence is enhanced by co-expression of a fragment of the targeted gene, for instance on an additional plant expressible cassette, that leads to enhanced siRNA production, or reduces methylation to prevent transcriptional gene silencing of the dsRNA hairpin promoter (e.g. WO05/019408).

The methods and compositions of the present invention may be applied to any monocot and dicot plant, depending on the pathogen (e.g. nematode) control desired. Examples of such plants include, without limitation, alfalfa, artichoke, asparagus, barley, beans, beet, broccoli, cabbage, canola, carrot, cassava, cauliflower, corn, cotton, cucumber, grape, oat, onion, pea, peanut, potato, rice, rye, sorghum, soybean, spinach, squash, sugarbeet, sugarcane, sunflower, tobacco, tomato, turfgrass, and wheat plants.

Exemplary plant-parasitic nematodes from which plants may be protected by the present invention, and their corresponding plants, include, but are not limited to: alfalfa: *Ditylenchus dipsaci, Meloidogyne hapla, Meloidogyne incognita, Meloidogyne javanica, Pratylenchus* spp., *Paratylenchus* spp., *Xiphinema* spp.; banana: *Radopholus similis, Helicotylenchus multicinctus, M. incognita, M. arenaria, M. javanica, Pratylenchus coffeae, Rotylenchulus reniformis;* beans and peas: *Meloidogyne* spp., *Heterodera* spp., *Belonolaimus* spp., *Helicotylenchus* spp., *Rotylenchulus reniformis, Paratrichodorus anemones, Trichodorus* spp.; cassava: *Rotylenchulus reniformis, Meloidogyne* spp.; cereals: *Anguina tritici* (Emmer, rye, spelt wheat), *Bidera avenae* (oat, wheat), *Ditylenchus dipsaci* (rye, oat), *Subanguina radicicola* (oat, barley, wheat, rye), *Meloidogyne naasi* (barley, wheat, rye), *Pratylenchus* spp. (oat, wheat, barley, rye), *Paratylenchus* spp. (wheat), *Tylenchorhynchus* spp. (wheat, oat); chickpea: *Heterodera cajani, Rotylenchulus reniformis, Hoplolaimus seinhorsti, Meloidogyne* spp., *Pratylenchus* spp.; citrus: *Tylenchulus semipenetrans, Radopholus similis, Radopholus citrophilus, Hemicycliophora arenaria, Pratylenchus* spp., *Meloidogyne* spp., *Bolonolaimus longicaudatus, Trichodorus* spp., *Paratrichodorus* spp., *Xiphinema* spp.; clover: *Meloidogyne* spp., *Heterodera trifolii* corn: *Pratylenchus* spp., *Paratrichodorus minor, Longidorus* spp., *Hoplolaimus columbus;* cotton: *Meloidogyne incognita, Belonolaimus longicaudatus, Rotylenchulus reniformis, Hoplolaimus galeatus, Pratylenchus* spp., *Tylenchorhynchus* spp., *Paratrichodorus minor;* grapes: *Xiphinema* spp., *Pratylenchus vulnus, Meloidogyne* spp., *Tylenchulus semipenetrans, Rotylenchulus reniformis;* grasses: *Pratylenchus* spp., *Longidorus* spp., *Paratrichodorus christiei, Xiphinema* spp., *Ditylenchus* spp.; peanut: *Pratylenchus* spp., *Meloidogyne hapla., Meloidogyne arenaria, Criconemella* spp., *Belonolaimus longicaudatus;* pigeon pea: *Heterodera cajani, Rotylenchulus reniformis, Hoplolaimus seinhorsti, Meloidogyne* spp., *Pratylenchus* spp.; potato: *Globodera rostochiensis, Globodera pallida, Meloidogyne* spp., *Pratylenchus* spp., *Trichodorus primitivus, Ditylenchus* spp., *Paratrichodorus* spp., *Nacobbus aberrans;* rice: *Aphelenchiodes besseyi, Ditylenchus angustus, Hirchmanniella* spp., *Heterodera oryzae, Meloidogyne* spp.; small fruits: *Meloidogyne* spp.; *Pratylenchus* spp., *Xiphinema* spp., *Longidorus* spp., *Paratrichodorus christiei, Aphelenchoides* spp.; soybean: *Heterodera glycines, Meloidogyne incognita, Meloidogyne javanica, Belonolaimus* spp., *Hoplolaimus columbus;* sugar beet: *Heterodera schachtii, Ditylenchus dipsaci, Meloidogyne* spp., *Nacobbus aberrans, Trichodorus* spp., *Longidorus* spp., *Paratrichodorus* spp.; sugar cane: *Meloidogyne* spp., *Pratylenchus* spp., *Radopholus* spp., *Heterodera* spp., *Hoplolaimus* spp., *Helicotylenchus* spp., *Scutellonema* spp., *Belonolaimus* spp., *Tylenchorhynchus* spp., *Xiphinema* spp., *Longidorus* spp., *Paratrichodorus* spp.; tobacco: *Meloidogyne* spp., *Pratylenchus* spp., *Tylenchorhynchus claytoni, Globodera tabacum, Trichodorus* spp., *Xiphinema americanum, Ditylenchus dipsaci, Paratrichodorus* spp.; and tomato: *Pratylenchus* spp., *Meloidogyne* spp.

The invention also provides combinations of methods and compositions for controlling infection by plant-parasitic nematodes. One means provides a dsRNA method as described herein for protecting plants from plant-parasitic nematodes along with one or more chemical agents that exhibit features different from those exhibited by the dsRNA methods and compositions, and can interfere with nematode growth or development.

A. Nucleic Acid Compositions and Constructs

The invention provides recombinant DNA constructs for use in achieving stable transformation of particular host targets. Transformed host targets may express effective levels of preferred dsRNA or siRNA molecules from the recombinant DNA constructs. Pairs of isolated and purified nucleotide sequences may be provided from cDNA library and/or genomic library information. The pairs of nucleotide sequences may be derived from any nematode for use as thermal amplification primers to generate the dsRNA and siRNA molecules of the present invention.

As used herein, the term "nucleic acid" refers to a single or double-stranded polymer of deoxyribonucleotide or ribonucleotide bases read from the 5' to the 3' end. The "nucleic acid" may also optionally contain non-naturally occurring or altered nucleotide bases that permit correct read through by a polymerase and do not reduce expression of a polypeptide encoded by that nucleic acid. The term "nucleotide sequence" or "nucleic acid sequence" refers to both the sense and antisense strands of a nucleic acid as either individual single strands or in the duplex. The term "ribonucleic acid" (RNA) is inclusive of RNAi (inhibitory RNA), dsRNA (double stranded RNA), siRNA (small interfering RNA), mRNA (messenger RNA), miRNA (micro-RNA), tRNA (transfer RNA, whether charged or discharged with a corresponding acylated amino acid), and cRNA (complementary RNA) and the term "deoxyribonucleic acid" (DNA) is inclusive of cDNA and genomic DNA and DNA-RNA hybrids. The words "nucleic acid segment", "nucleotide sequence segment", or more generally "segment" will be understood by those in the art as a functional term that includes both genomic sequences, ribosomal RNA sequences, transfer RNA sequences, messenger RNA sequences, operon sequences and smaller engineered nucleotide sequences that express or may be adapted to express, proteins, polypeptides or peptides.

Provided according to the invention are nucleotide sequences, the expression of which results in an RNA sequence which is substantially homologous to all or part of an RNA molecule of a targeted gene in a plant-parasitic nematode that comprises an RNA sequence encoded by a nucleotide sequence within the genome of the nematode. Thus, after ingestion of the stabilized RNA sequence downregulation of the nucleotide sequence of the target gene in the cells of the plant-parasitic nematode may be obtained resulting in a deleterious effect on the growth, viability, proliferation, or reproduction of the nematode.

As used herein, the term "substantially homologous" or "substantial homology", with reference to a nucleic acid sequence, includes a nucleotide sequence that hybridizes under stringent conditions to the coding sequence of any of SEQ ID NOs:301-1026, SEQ ID NOs:1269-1702, and SEQ ID NOs:1920-1929, as set forth in the sequence listing, or the complements thereof. Sequences that hybridize under stringent conditions to any of SEQ ID NOs:301-1026, SEQ ID NOs:1269-1702, and SEQ ID NOs:1920-1929, or the complements thereof, are those that allow an antiparallel alignment to take place between the two sequences, and the two sequences are then able, under stringent conditions, to form hydrogen bonds with corresponding bases on the opposite strand to form a duplex molecule that is sufficiently stable under the stringent conditions to be detectable using methods well known in the art. Substantially homologous sequences have preferably from about 70% to about 80% sequence identity, or more preferably from about 80% to about 85% sequence identity, or most preferable from about 90% to about 95% sequence identity, to about 99% sequence identity, to the referent nucleotide sequences as set forth in any of SEQ ID NOs:301-1026, SEQ ID NOs:1269-1702, and SEQ ID NOs: 1920-1929, in the sequence listing, or the complements thereof.

As used herein, the term "ortholog" refers to a gene in two or more species that has evolved from a common ancestral nucleotide sequence, and may retain the same function in the two or more species.

As used herein, the term "sequence identity", "sequence similarity" or "homology" is used to describe sequence relationships between two or more nucleotide sequences. The percentage of "sequence identity" between two sequences is determined by comparing two optimally aligned sequences over a comparison window, wherein the portion of the sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison, and multiplying the result by 100 to yield the percentage of sequence identity. A sequence that is identical at every position in comparison to a reference sequence is said to be identical to the reference sequence and vice-versa. A first nucleotide sequence when observed in the 5' to 3' direction is said to be a "complement" of, or complementary to, a second or reference nucleotide sequence observed in the 3' to 5' direction if the first nucleotide sequence exhibits complete complementarity with the second or reference sequence. As used herein, nucleic acid sequence molecules are said to exhibit "complete complementarity" when every nucleotide of one of the sequences read 5' to 3' is complementary to every nucleotide of the other sequence when read 3' to 5'. A nucleotide sequence that is complementary to a reference nucleotide sequence will exhibit a sequence identical to the reverse complement sequence of the reference nucleotide sequence. These terms and descriptions are well defined in the art and are easily understood by those of ordinary skill in the art.

As used herein, a "comparison window" refers to a conceptual segment of at least 6 contiguous positions, usually about 50 to about 100, more usually about 100 to about 150, in which a sequence is compared to a reference sequence of the same number of contiguous positions after the two sequences are optimally aligned. The comparison window may comprise additions or deletions (i.e. gaps) of about 20% or less as compared to the reference sequence (which does not comprise additions or deletions) for optimal alignment of the two sequences Those skilled in the art should refer to the detailed methods used for sequence alignment in the Wisconsin Genetics Software Package Release 7.0, Genetics Computer Group, 575 Science Drive Madison, Wis., USA) or refer to Ausubel et al. (1998) for a detailed discussion of sequence analysis.

The present invention provides DNA sequences capable of being expressed as an RNA in a cell or microorganism to inhibit target gene expression in a cell, tissue or organ of a plant-parasitic nematode. The sequences comprise a DNA molecule coding for one or more different nucleotide sequences, wherein each of the different nucleotide sequences comprises a sense nucleotide sequence and an antisense nucleotide sequence. The sequences may be connected by a spacer sequence coding for a dsRNA molecule of the present invention. The spacer sequence can constitute part of the sense nucleotide sequence or the antisense nucleotide sequence and forms within the dsRNA molecule between the sense and antisense sequences. The sense nucleotide sequence or the antisense nucleotide sequence is substantially identical to the nucleotide sequence of the target gene or a derivative thereof or a complementary sequence thereto. The dsDNA molecule may be placed operably under the control of a promoter sequence that functions in the cell, tissue or organ of the host expressing the dsDNA to produce dsRNA molecules. In one embodiment, the DNA sequence may be derived from a nucleotide sequence as set forth in SEQ ID NOs:301-1026, SEQ ID NOs:1269-1702, and SEQ ID NOs: 1920-1929, in the sequence listing.

The invention also provides a DNA sequence for expression in a cell of a plant that, upon expression of the DNA to RNA and ingestion by a plant-parasitic nematode achieves suppression of a target gene in a cell, tissue or organ of a plant-parasitic nematode. The dsRNA may comprise one or multiple structural gene sequences, wherein each of the structural gene sequences comprises a sense nucleotide sequence and an antisense nucleotide sequence that may be connected by a spacer sequence that forms a loop within the complementary and antisense sequences. The sense nucleotide sequence or the antisense nucleotide sequence is substantially identical to the nucleotide sequence of the target gene, derivative thereof, or sequence complementary thereto. The one or more structural gene sequences may be placed operably under the control of one or more promoter sequences, at least one of which is operable in the cell, tissue or organ of a prokaryotic or eukaryotic organism, particularly a plant cell. Methods to express a gene suppression molecule in plants are known (e.g. WO06073727 A2; US Publication 2006/0200878 A1), and may be used to express a nucleotide sequence of the present invention.

A gene sequence or fragment for plant-parasitic nematode control according to the invention may be cloned between two tissue specific promoters, such as two root specific promoters which are operable in a transgenic plant cell and therein expressed to produce mRNA in the transgenic plant cell that form dsRNA molecules thereto. Examples of root specific promoters are known in the art (e.g. the nematode-induced RB7 promoter; U.S. Pat. No. 5,459,252; Opperman et al. 1994). The dsRNA molecules contained in plant tissues are ingested by a plant-parasitic nematode so that the intended suppression of the target gene expression is achieved.

The cauliflower mosaic virus 35S promoter, an archetypal strong promoter common in transgenic plant applications, or a related promoter such as the E35S or the FMV promoter, may be employed for driving nematode resistance genes, particularly for cyst nematodes (see Example 8). Promoters have also been identified that direct gene expression at nematode-induced feeding structures within a plant (e.g. Gheysen and Fenoll, 2002). Thus, a promoter identified from among genes that are reproducibly expressed in feeding sites may be utilized. Examples of genes up-regulated in feeding sites (syncytia) formed by nematodes include Hs1pro-1 (Thurau et al. 2003), AtSUC2 normally expressed in companion cells (Juergensen et al. 2003), At17.1 expressed in vascular tissues and root tips (Mazarei et al. 2004), FGAM synthase (phosphoribosylformyl-glycinamidine synthase) (Vaghchhipawala et al. 2004), and ABI3 (De Meutter et al. 2005), among others. Syncytia formed in response to cyst nematodes have been described as symplastically isolated lacking plasmodesmata to surrounding tissues (Bockenhoff and Grundler 1994; Bockenhoff et al. 1996), however, it has been shown that macromolecules up to 30 kD can move from phloem companion cells into the syncytium (Hoth et al. 2005). Therefore, gene expression in the phloem may also be suited for delivery of effector molecules into feeding sites.

A nucleotide sequence provided by the present invention may comprise an inverted repeat separated by a "spacer sequence." The spacer sequence may be a region comprising any sequence of nucleotides that facilitates secondary structure formation between each repeat, where this is required. In one embodiment of the present invention, the spacer sequence is part of the sense or antisense coding sequence for mRNA. The spacer sequence may alternatively comprise any combination of nucleotides or homologues thereof that are capable of being linked covalently to a nucleic acid molecule. The spacer sequence may comprise, for example, a sequence of nucleotides of at least about 10-100 nucleotides in length, or alternatively at least about 100-200 nucleotides in length, at least 200-400 about nucleotides in length, or at least about 400-500 nucleotides in length.

The nucleic acid molecules or fragments of the nucleic acid molecules or other nucleic acid molecules in the sequence listing are capable of specifically hybridizing to other nucleic acid molecules under certain circumstances. As used herein, two nucleic acid molecules are said to be capable of specifically hybridizing to one another if the two molecules are capable of forming an anti-parallel, double-stranded nucleic acid structure. A nucleic acid molecule is said to be the complement of another nucleic acid molecule if they exhibit complete complementarity. Two molecules are said to be "minimally complementary" if they can hybridize to one another with sufficient stability to permit them to remain annealed to one another under at least conventional "low-stringency" conditions. Similarly, the molecules are said to be complementary if they can hybridize to one another with sufficient stability to permit them to remain annealed to one another under conventional "high-stringency" conditions. Conventional stringency conditions are described by Sambrook, et al. (1989), and by Haymes et al. (1985).

Departures from complete complementarity are therefore permissible, as long as such departures do not completely preclude the capacity of the molecules to form a double-stranded structure. Thus, in order for a nucleic acid molecule or a fragment of the nucleic acid molecule to serve as a primer or probe it needs only be sufficiently complementary in sequence to be able to form a stable double-stranded structure under the particular solvent and salt concentrations employed.

Appropriate stringency conditions which promote DNA hybridization are, for example, 6.0× sodium chloride/sodium citrate (SSC) at about 45° C., followed by a wash of 2.0×SSC at 50° C., are known to those skilled in the art or can be found in Current Protocols in Molecular Biology (1989). For example, the salt concentration in the wash step can be selected from a low stringency of about 2.0×SSC at 50° C. to a high stringency of about 0.2×SSC at 50° C. In addition, the temperature in the wash step can be increased from low stringency conditions at room temperature, about 22° C., to high stringency conditions at about 65° C. Both temperature and salt may be varied, or either the temperature or the salt concentration may be held constant while the other variable is changed. A nucleic acid for use in the present invention may specifically hybridize to one or more of nucleic acid molecules from a nematode or complements thereof under such conditions. Preferably, a nucleic acid for use in the present invention will exhibit at least from about 80%, or at least from about 90%, or at least from about 95%, or at least from about 98% or even about 100% sequence identity with one or more nucleic acid molecules as set forth in SEQ ID NOs:301-1026, SEQ ID NOs:1269-1702, and SEQ ID NOs: 1920-1929, in the sequence listing.

Nucleic acids of the present invention may also be synthesized, either completely or in part, especially where it is desirable to provide plant-preferred sequences, by methods known in the art. Thus, all or a portion of the nucleic acids of the present invention may be synthesized using codons preferred by a selected host. Species-preferred codons may be determined, for example, from the codons used most frequently in the proteins expressed in a particular host species. Other modifications of the nucleotide sequences may result in mutants having slightly altered activity.

dsRNA or siRNA nucleotide sequences comprise double strands of polymerized ribonucleotide and may include modifications to either the phosphate-sugar backbone or the nucleoside. Modifications in RNA structure may be tailored to allow specific genetic inhibition. In one embodiment, the dsRNA molecules may be modified through an enzymatic process so that siRNA molecules may be generated. The siRNA can efficiently mediate the down-regulation effect for some target genes in some pathogens. This enzymatic process may be accomplished by utilizing an RNAse III enzyme or a DICER enzyme, present in the cells of an insect, a vertebrate animal, a fungus or a plant in the eukaryotic RNAi pathway (Elbashir et al., 2001; Hamilton and Baulcombe, 1999). This process may also utilize a recombinant DICER or RNAse III introduced into the cells of a target insect through recombinant DNA techniques that are readily known to the skilled in the art. Both the DICER enzyme and RNAse III, being naturally occurring in a pathogen or being made through recombinant DNA techniques, cleave larger dsRNA strands into smaller oligonucleotides. The DICER enzymes specifically cut the dsRNA molecules into siRNA pieces each of which is about 19-25 nucleotides in length while the RNAse III enzymes normally cleave the dsRNA molecules into 12-15 base-pair siRNA. The siRNA molecules produced by the either of the enzymes have 2 to 3 nucleotide 3' overhangs, and 5' phosphate and 3' hydroxyl termini. The siRNA molecules generated by RNAse III enzyme are the same as those produced by Dicer enzymes in the eukaryotic RNAi pathway and are hence then targeted and degraded by an inherent cellular RNA-degrading mechanism after they are subsequently unwound, separated into single-stranded RNA and hybridize with the RNA sequences transcribed by the target gene. This process results in the effective degradation or removal of the RNA sequence encoded by the nucleotide sequence of the target gene in the pathogen. The outcome is the silencing of a particularly targeted nucleotide sequence within the pathogen. Detailed descriptions of enzymatic processes can be found in Hannon (2002).

A nucleotide sequence of the present invention can be recorded on computer readable media. As used herein, "computer readable media" refers to any tangible medium of expression that can be read and accessed directly by a computer. Such media include, but are not limited to: magnetic storage media, such as floppy discs, hard disc, storage medium, and magnetic tape: optical storage media such as CD-ROM; electrical storage media such as RAM and ROM; optical character recognition formatted computer files, and hybrids of these categories such as magnetic/optical storage media. A skilled artisan can readily appreciate that any of the presently known computer readable mediums can be used to create a manufacture comprising computer readable medium having recorded thereon a nucleotide sequence of the present invention.

As used herein, "recorded" refers to a process for storing information on computer readable medium. A skilled artisan can readily adopt any of the presently known methods for recording information on computer readable medium to generate media comprising the nucleotide sequence information of the present invention. A variety of data storage structures are available to a skilled artisan for creating a computer readable medium having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable medium. The sequence information can be represented in a word processing text file, formatted in commercially-available software such as WordPerfect and Microsoft Word, or represented in the form of an ASCII text file, stored in a database application, such as DB2, Sybase, Oracle, or the like. The skilled artisan can readily adapt any number of data processor structuring formats (e.g. text file or database) in order to obtain computer readable medium having recorded thereon the nucleotide sequence information of the present invention.

Computer software is publicly available which allows a skilled artisan to access sequence information provided in a computer readable medium. Software that implements the BLAST (Altschul et al., 1990) and BLAZE (Brutlag, et al., 1993) search algorithms on a Sybase system can be used to identify open reading frames (ORFs) within sequences such as the Unigenes and EST's that are provided herein and that contain homology to ORFs or proteins from other organisms. Such ORFs are protein-encoding fragments within the sequences of the present invention and are useful in producing commercially important proteins such as enzymes used in amino acid biosynthesis, metabolism, transcription, translation, RNA processing, nucleic acid and a protein degradation, protein modification, and DNA replication, restriction, modification, recombination, and repair.

The present invention further provides systems, particularly computer-based systems, which contain the sequence information described herein. Such systems are designed to identify commercially important fragments of the nucleic acid molecule of the present invention. As used herein, "a computer-based system" refers to the hardware means, software means, and data storage means used to analyze the nucleotide sequence information of the present invention. The minimum hardware means of the computer-based systems of the present invention comprises a central processing unit (CPU), input means, output means, and data storage means. A skilled artisan can readily appreciate that any one of the currently available computer-based system are suitable for use in the present invention.

As used herein, "a target structural motif," or "target motif," refers to any rationally selected sequence or combination of sequences in which the sequences or sequence(s) are chosen based on a three-dimensional configuration that is formed upon the folding of the target motif. There are a variety of target motifs known in the art. Protein target motifs include, but are not limited to, enzymatic active sites and signal sequences. Nucleic acid target motifs include, but are not limited to, promoter sequences, cis elements, hairpin structures and inducible expression elements (protein binding sequences).

B. Recombinant Vectors and Host Cell Transformation

A recombinant DNA vector may, for example, be a linear or a closed circular plasmid. The vector system may be a single vector or plasmid or two or more vectors or plasmids that together contain the total DNA to be introduced into the genome of the bacterial host. In addition, a bacterial vector may be an expression vector. Nucleic acid molecules as set forth in SEQ ID NOs:301-1026 SEQ ID NOs:1269-1702, and SEQ ID NOs:1920-1929, or fragments thereof, can, for example, be suitably inserted into a vector under the control of a suitable promoter that functions in one or more microbial hosts to drive expression of a linked coding sequence or other DNA sequence. Many vectors are available for this purpose, and selection of the appropriate vector will depend mainly on the size of the nucleic acid to be inserted into the vector and the particular host cell to be transformed with the vector. Each vector contains various components depending on its function (amplification of DNA or expression of DNA) and the particular host cell with which it is compatible. The vector components for bacterial transformation generally include, but are not limited to, one or more of the following: a signal sequence, an origin of replication, one or more selectable marker genes, and an inducible promoter allowing the expression of exogenous DNA.

Expression and cloning vectors generally contain a selection gene, also referred to as a selectable marker. This gene encodes a protein necessary for the survival or growth of transformed host cells grown in a selective culture medium. Typical selection genes encode proteins that (a) confer resistance to antibiotics or other toxins, e.g., ampicillin, neomycin, methotrexate, or tetracycline, (b) complement auxotrophic deficiencies, or (c) supply critical nutrients not available from complex media, e.g., the gene encoding D-alanine racemase for Bacilli. Those cells that are successfully transformed with a heterologous protein or fragment thereof produce a protein conferring drug resistance and thus survive the selection regimen.

An expression vector for producing a mRNA can also contain an inducible promoter that is recognized by a host bacterial organism and is operably linked to the nucleic acid. Inducible promoters suitable for use with bacterial hosts include β-lactamase promoter, E. coli λ phage PL and PR promoters, and E. coli galactose promoter, arabinose promoter, alkaline phosphatase promoter, tryptophan (trp) promoter, and the lactose operon promoter and variations thereof and hybrid promoters such as the tac promoter. However, other known bacterial inducible promoters are suitable.

The term "operably linked", as used in reference to a regulatory sequence and a structural nucleotide sequence, means that the regulatory sequence causes regulated expression of the linked structural nucleotide sequence. "Regulatory sequences" or "control elements" refer to nucleotide sequences located upstream (5' noncoding sequences), within, or downstream (3' non-translated sequences) of a structural nucleotide sequence, and which influence the timing and level or amount of transcription, RNA processing or stability, or translation of the associated structural nucleotide sequence. Regulatory sequences may include promoters, translation leader sequences, introns, enhancers, stem-loop structures, repressor binding sequences, and polyadenylation recognition sequences and the like.

Construction of suitable vectors containing one or more of the above-listed components employs standard recombinant DNA techniques. Isolated plasmids or DNA fragments are cleaved, tailored, and re-ligated in the form desired to generate the plasmids required. Examples of available bacterial expression vectors include, but are not limited to, the multifunctional E. coli cloning and expression vectors such as Bluescript™ (Stratagene, La Jolla, Calif.), in which, for example, a nucleic acid, or fragment thereof, shown in FIG. 3 may be ligated into the vector in frame with sequences for the amino-terminal Met and the subsequent 7 residues of β-galactosidase so that a hybrid protein is produced; pIN vectors (Van Heeke and Schuster, 1989); and the like.

The present invention also contemplates transformation of a nucleotide sequence of the present invention into a plant to achieve nematode-inhibitory levels of expression of one or more dsRNA molecules. A transformation vector can be readily prepared using methods available in the art. The transformation vector comprises one or more nucleotide sequences that is/are capable of being transcribed to an RNA molecule and that is/are substantially homologous and/or complementary to one or more nucleotide sequences encoded by the genome of the target nematode, such that upon uptake of the RNA transcribed from the one or more nucleotide sequences by the target plant-parasitic nematode, there is down-regulation of expression of at least one of the respective nucleotide sequences of the genome of the nematode.

The transformation vector may be termed a dsDNA construct and may also be defined as a recombinant molecule, a disease control agent, a genetic molecule or a chimeric genetic construct. A chimeric genetic construct of the present invention may comprise, for example, nucleotide sequences encoding one or more antisense transcripts, one or more sense transcripts, one or more of each of the aforementioned, wherein all or part of a transcript there from is homologous to all or part of an RNA molecule comprising an RNA sequence encoded by a nucleotide sequence within the genome of a pathogen.

In one embodiment a plant transformation vector comprises an isolated and purified DNA molecule comprising a heterologous promoter operatively linked to one or more nucleotide sequences of the present invention. The nucleotide sequence is selected from the group consisting of SEQ ID NOs:301-1026, SEQ ID NOs:1269-1702, and SEQ ID NOs: 1920-1929, as set forth in the sequence listing. The nucleotide sequence includes a segment coding all or part of an RNA present within a targeted nematode RNA transcript and may comprise inverted repeats of all or a part of a targeted nematode RNA. The DNA molecule comprising the expression vector may also contain a functional intron sequence positioned either upstream of the coding sequence or even within the coding sequence, and may also contain a five prime (5') untranslated leader sequence (i.e., a UTR or 5'-UTR) positioned between the promoter and the point of translation initiation.

A plant transformation vector may contain sequences from more than one gene, thus allowing production of more than one dsRNA for inhibiting expression of two or more genes in cells of a target nematode. One skilled in the art will readily appreciate that segments of DNA whose sequence corresponds to that present in different genes can be combined into a single composite DNA segment for expression in a transgenic plant. Alternatively, a plasmid of the present invention already containing at least one DNA segment can be modified by the sequential insertion of additional DNA segments between the enhancer and promoter and terminator sequences. In the disease control agent of the present invention designed for the inhibition of multiple genes, the genes to be inhibited can be obtained from the same plant-parasitic nematode species in order to enhance the effectiveness of the control agent. In certain embodiments, the genes can be derived from different plant-parasitic nematodes in order to broaden the range of nematodes against which the agent(s) is/are effective. When multiple genes are targeted for suppression or a combination of expression and suppression, a polycistronic DNA element can be fabricated as illustrated and disclosed in US Publication No. US 2004-0029283.

Promoters that function in different plant species are also well known in the art. Promoters useful for expression of polypeptides in plants include those that are inducible, viral, synthetic, or constitutive as described in Odell et al. (1985), and/or promoters that are temporally regulated, spatially regulated, and spatio-temporally regulated. Preferred promoters include the enhanced CaMV35S promoters, and the FMV35S promoter. A fragment of the CaMV35S promoter exhibiting root-specificity may also be preferred. For the purpose of the present invention, it may be preferable to achieve the highest levels of expression of these genes within the root tissues of plants. A number of root-specific promoters have been identified and are known in the art (e.g. U.S. Pat. Nos. 5,110,732; 5,837,848; 5,459,252; Hirel et al. 1992).

A recombinant DNA vector or construct of the present invention may comprise a selectable marker that confers a selectable phenotype on plant cells. Selectable markers may also be used to select for plants or plant cells that contain the exogenous nucleic acids encoding polypeptides or proteins of the present invention. The marker may encode biocide resistance, antibiotic resistance (e.g., kanamycin, G418 bleomycin, hygromycin, etc.), or herbicide resistance (e.g., glyphosate, etc.). Examples of selectable markers include, but are not limited to, a neo gene which codes for kanamycin resistance and can be selected for using kanamycin, G418, etc., a bar gene which codes for bialaphos resistance; a mutant EPSP synthase gene which encodes glyphosate resistance; a nitrilase gene which confers resistance to bromoxynil; a mutant acetolactate synthase gene (ALS) which confers imidazolinone or sulfonylurea resistance; and a methotrexate resistant DHFR gene. Multiple selectable markers are available that confer resistance to ampicillin, bleomycin, chloramphenicol, gentamycin, hygromycin, kanamycin, lincomycin, methotrexate, phosphinothricin, puromycin, spectinomycin, rifampicin, and tetracycline, and the like. Examples of such selectable markers are illustrated in U.S. Pat. Nos. 5,550,318; 5,633,435; 5,780,708 and 6,118,047.

A recombinant vector or construct of the present invention may also include a screenable marker. Screenable markers may be used to monitor expression. Exemplary screenable markers include a β-glucuronidase or uidA gene (GUS) which encodes an enzyme for which various chromogenic substrates are known (Jefferson et al., 1987); an R-locus gene, which encodes a product that regulates the production of anthocyanin pigments (red color) in plant tissues (Dellaporta et al., 1988); a β-lactamase gene (Sutcliffe et al., 1978), a gene which encodes an enzyme for which various chromogenic substrates are known (e.g., PADAC, a chromogenic cephalosporin); a luciferase gene (Ow et al., 1986) a xylE gene (Zukowski et al., 1983) which encodes a catechol dioxygenase that can convert chromogenic catechols; an α-amylase gene (Ikatu et al., 1990); a tyrosinase gene (Katz et al., 1983) which encodes an enzyme capable of oxidizing tyrosine to DOPA and dopaquinone which in turn condenses to melanin; an α-galactosidase, which catalyzes a chromogenic α-galactose substrate.

Preferred plant transformation vectors include those derived from a Ti plasmid of *Agrobacterium tumefaciens* (e.g. U.S. Pat. Nos. 4,536,475, 4,693,977, 4,886,937, 5,501,967 and EP 0 122 791). *Agrobacterium rhizogenes* plasmids (or "Ri") are also useful and known in the art. Other preferred plant transformation vectors include those disclosed, e.g., by Herrera-Estrella (1983); Bevan (1983), Klee (1985) and EP 0 120 516.

In general it may be preferred to introduce a functional recombinant DNA at a non-specific location in a plant genome. In special cases it may be useful to insert a recombinant DNA construct by site-specific integration. Several site-specific recombination systems exist which are known to function implants include cre-lox as disclosed in U.S. Pat. No. 4,959,317 and FLP-FRT as disclosed in U.S. Pat. No. 5,527, 695.

Suitable methods for transformation of host cells for use with the current invention are believed to include virtually any method by which DNA can be introduced into a cell (see, for example, Miki et al., 1993), such as by transformation of protoplasts (U.S. Pat. No. 5,508,184; Omirulleh et al., 1993), by desiccation/inhibition-mediated DNA uptake (Potrykus et al, 1985), by electroporation (U.S. Pat. No. 5,384,253), by agitation with silicon carbide fibers (Kaeppler et al., 1990; U.S. Pat. Nos. 5,302,523; and 5,464,765), by *Agrobacterium*-mediated transformation (U.S. Pat. Nos. 5,563,055; 5,591, 616; 5,693,512; 5,824,877; 5,981,840; 6,384,301) and by acceleration of DNA coated particles (U.S. Pat. Nos. 5,015, 580; 5,550,318; 5,538,880; 6,160,208; 6,399,861; 6,403,865; Padgette et al. 1995), etc. Through the application of techniques such as these, the cells of virtually any species may be stably transformed. In the case of multicellular species, the transgenic cells may be regenerated into transgenic organisms.

The most widely utilized method for introducing an expression vector into plants is based on the natural transformation system of *Agrobacterium* (for example, Horsch et al., 1985). *A. tumefaciens* and *A. rhizogenes* are plant pathogenic soil bacteria which genetically transform plant cells. The Ti and Ri plasmids of *A. tumefaciens* and *A. rhizogenes*, respectively, carry genes responsible for genetic transformation of the plant. Descriptions of *Agrobacterium* vector systems and methods for *Agrobacterium*-mediated gene transfer are provided by numerous references, including Gruber et al. 1993; Miki et al., 1993, Moloney et al., 1989, and U.S. Pat. Nos. 4,940,838 and 5,464,763. Other bacteria such as *Sinorhizobium, Rhizobium*, and *Mesorhizobium* that interact with plants naturally can be modified to mediate gene transfer to a number of diverse plants. These plant-associated symbiotic bacteria can be made competent for gene transfer by acquisition of both a disarmed Ti plasmid and a suitable binary vector (Broothaerts et al. 2005).

Methods for the creation of transgenic plants and expression of heterologous nucleic acids in plants in particular are known and may be used with the nucleic acids provided herein to prepare transgenic plants that exhibit reduced susceptibility to feeding by a target nematode. Plant transformation vectors can be prepared, for example, by inserting the dsRNA producing nucleic acids disclosed herein into plant transformation vectors and introducing these into plants. One known vector system has been derived by modifying the natural gene transfer system of *Agrobacterium tumefaciens*. The natural system comprises large Ti (tumor-inducing)-plasmids containing a large segment, known as T-DNA, which is transferred to transformed plants. Another segment of the Ti plasmid, the vir region, is responsible for T-DNA transfer. The T-DNA region is bordered by terminal repeats. In the modified binary vectors the tumor-inducing genes have been deleted and the functions of the vir region are utilized to transfer foreign DNA bordered by the T-DNA border sequences. The T-region may also contain a selectable marker for efficient recovery of transgenic plants and cells, and a multiple cloning site for inserting sequences for transfer such as a dsRNA encoding nucleic acid.

A transgenic plant formed using *Agrobacterium* transformation methods typically contains a single simple recombinant DNA sequence inserted into one chromosome and is referred to as a transgenic event. Such transgenic plants can be referred to as being heterozygous for the inserted exogenous sequence. A transgenic plant homozygous with respect to a transgene can be obtained by sexually mating (selfing) an independent segregant transgenic plant that contains a single exogenous gene sequence to itself, for example an F0 plant, to produce F1 seed. One fourth of the F1 seed produced will be homozygous with respect to the transgene. Germinating F1 seed results in plants that can be tested for heterozygosity, typically using a SNP assay or a thermal amplification assay that allows for the distinction between heterozygotes and homozygotes (i.e., a zygosity assay). Crossing a heterozygous plant with itself or another heterozygous plant results in only heterozygous progeny.

C. Nucleic Acid Expression and Target Gene Suppression

The present invention provides, as an example, a transformed host plant of a pathogenic target organism, transformed plant cells and transformed plants and their progeny. The transformed plant cells and transformed plants may be engineered to express one or more of the dsRNA or siRNA sequences, under the control of a heterologous promoter, described herein to provide a pathogen-protective effect. These sequences may be used for gene suppression in a pathogen, thereby reducing the level or incidence of disease caused by the pathogen on a protected transformed host organism. As used herein the words "gene suppression" are intended to refer to any of the well-known methods for reducing the levels of protein produced as a result of gene transcription to mRNA and subsequent translation of the mRNA.

Gene suppression is also intended to mean the reduction of protein expression from a gene or a coding sequence including posttranscriptional gene suppression and transcriptional suppression. Posttranscriptional gene suppression is mediated by the homology between of all or a part of a mRNA transcribed from a gene or coding sequence targeted for suppression and the corresponding double stranded RNA used for suppression, and refers to the substantial and measurable reduction of the amount of available mRNA available in the cell for binding by ribosomes. The transcribed RNA can be in the sense orientation to effect what is called co-suppression, in the anti-sense orientation to effect what is called anti-sense suppression, or in both orientations producing a dsRNA to effect what is called RNA interference (RNAi).

Transcriptional suppression is mediated by the presence in the cell of a dsRNA gene suppression agent exhibiting substantial sequence identity to a promoter DNA sequence or the complement thereof to effect what is referred to as promoter trans suppression. Gene suppression may be effective against a native plant gene associated with a trait, e.g., to provide plants with reduced levels of a protein encoded by the native gene or with enhanced or reduced levels of an affected metabolite. Gene suppression can also be effective against target genes in a plant-parasitic nematode that may ingest or contact plant material containing gene suppression agents, specifically designed to inhibit or suppress the expression of one or more homologous or complementary sequences in the cells of the nematode. Post-transcriptional gene suppression by anti-sense or sense oriented RNA to regulate gene expression in plant cells is disclosed in U.S. Pat. Nos. 5,107,065, 5,759,829, 5,283,184, and 5,231,020. The use of dsRNA to suppress genes in plants is disclosed in WO 99/53050, WO 99/49029, U.S. Publication No. 2003/0175965, and 2003/0061626, U.S. patent application Ser. No. 10/465,800, and U.S. Pat. Nos. 6,506,559, and 6,326,193.

A beneficial method of post transcriptional gene suppression versus a plant-parasitic nematode employs both sense-oriented and anti-sense-oriented, transcribed RNA which is stabilized, e.g., as a hairpin and stem and loop structure. A preferred DNA construct for effecting post transcriptional gene suppression is one in which a first segment encodes an RNA exhibiting an anti-sense orientation exhibiting substantial identity to a segment of a gene targeted for suppression, which is linked to a second segment encoding an RNA exhibiting substantial complementarity to the first segment. Such a construct forms a stem and loop structure by hybridization of the first segment with the second segment and a loop structure from the nucleotide sequences linking the two segments (see WO94/01550, WO98/05770, US 2002/0048814, and US 2003/0018993). Co-expression with an additional target gene segment may also be employed, as noted above (e.g. WO05/019408).

According to one embodiment of the present invention, there is provided a nucleotide sequence, for which in vitro expression results in transcription of a stabilized RNA sequence that is substantially homologous to an RNA molecule of a targeted gene in a plant-parasitic nematode that comprises an RNA sequence encoded by a nucleotide sequence within the genome of the nematode. Thus, after the plant-parasitic nematode ingests the stabilized RNA sequence, a down-regulation of the nucleotide sequence corresponding to the target gene in the cells of a target nematode is effected.

In certain embodiments of the invention, expression of a fragment of at least 21 contiguous nucleotides of a nucleic acid sequence of any of SEQ ID NOs:301-1026, SEQ ID NOs:1269-1702, and SEQ ID NOs:1920-1929 may be utilized, including expression of a fragment of up to 21, 36, 60, 100, 550, or 1000 contiguous nucleotides, or sequences displaying 90-100% identity with such seqences, or their complements. In specific embodiments, a nucleotide provided by the invention may comprise a sequence selected from the group described in Table 4, including a location on such sequence spanning nucleotides as described in Table 4. In yet other embodiments, a nucleotide provided by the invention may be described as comprising one or more of nucleotides 1-21, 22-50, 51-100, 101-150, 151-200, 201-250, 251-300, 301-350, 351-400, 401-450, 451-500, 501-550, 551-600, 601-650, 651-700, 701-750, 751-800, 801-850, 851-900, 901-950, 951-1000, 1001-1050, 1051-1100, 1101-1150, 1151-1200, 1201-1250, 1251-1300, 1301-1350, 1351-1400, 1401-1450, 1451-1500, 1501-1550, 1551-1600, 1601-1650, 1651-1700, 1701-1750, 1751-1800, 1801-1850, 1851-1900, 1901-1950, 1951-2000, 2001-2050, 2051-2100, 23-75, 76-125, 126-175, 176-225, 226-275, 276-325, 326-375, 376-425, 426-475, 476-525, 526-575, 576-625, 626-675, 676-725, 726-775, 776-825, 826-875, 876-925, 926-975, 976-1025, 1026-1075, 1076-1125, 1126-1175, 1176-1225, 1226-1275, 1276-1325, 1326-1375, 1376-1425, 1426-1475, 1476-1525, 1526-1575, 1576-1625, 1626-1675, 1676-1725, 1726-1775, 1776-1825, 1826-1875, 1876-1925, 1926-1975, 1976-2025, 2026-2075, 2076-2125, 1-550, 200-750, 300-850, 400-950, 500-1050, 600-1150, 700-1250, 800-1350, 900-1450, 1000-1550, 1100-1650, 1200-1750, 1300-1850, 1400-1950, 1500-2050, up to the full length of the sequence, of one or more of SEQ ID NOs:301-1026, SEQ ID NOs:1269-1702, and SEQ ID NOs:1920-1929. However, in certain embodiments, the invention does not comprise SEQ ID NOs:525, 569, 797, 1293 or 1516, or fragments thereof. Methods for selecting specific sub-sequences as targets for siRNA-mediated gene suppression are known in the art (e.g. Reynolds et al. 2004).

Inhibition of a target gene using the stabilized dsRNA technology of the present invention is sequence-specific in that nucleotide sequences corresponding to the duplex region of the RNA are targeted for genetic inhibition. RNA containing a nucleotide sequences identical to a portion of the target gene is preferred for inhibition. RNA sequences with insertions, deletions, and single point mutations relative to the target sequence have also been found to be effective for inhibition. In performance of the present invention, it is preferred that the inhibitory dsRNA and the portion of the target gene share at least from about 80% sequence identity, or from about 90% sequence identity, or from about 95% sequence identity, or from about 99% sequence identity, or even about 100% sequence identity. Alternatively, the duplex region of the RNA may be defined functionally as a nucleotide sequence that is capable of hybridizing with a portion of the target gene transcript. A less than full length sequence exhibiting a greater homology compensates for a longer less homologous sequence. The length of the identical nucleotide sequences may be at least about 25, 50, 100, 200, 300, 400, 500 or at least about 1000 bases. Normally, a sequence of greater than 20-100 nucleotides should be used, though a sequence of greater than about 200-300 nucleotides would be preferred, and a sequence of greater than about 500-1000 nucleotides would be especially preferred depending on the size of the target gene. The invention has the advantage of being able to tolerate sequence variations that might be expected due to genetic mutation, strain polymorphism, or evolutionary divergence. The introduced nucleic acid molecule may not need to be absolute homology, may not need to be full length, relative to either the primary transcription product or fully processed mRNA of the target gene. Therefore, those skilled in the art need to realize that, as disclosed herein, 100% sequence identity between the RNA and the target gene is not required to practice the present invention.

Inhibition of target gene expression may be quantified by measuring either the endogenous target RNA or the protein produced by translation of the target RNA and the consequences of inhibition can be confirmed by examination of the outward properties of the cell or organism. Techniques for quantifying RNA and proteins are well known to one of ordinary skill in the art.

In certain embodiments gene expression is inhibited by at least 10%, preferably by at least 33%, more preferably by at least 50%, and yet more preferably by at least 80%. In particularly preferred embodiments of the invention gene expression is inhibited by at least 80%, more preferably by at least 90%, more preferably by at least 95%, or by at least 99% within cells in the pathogen so a significant inhibition takes place. Significant inhibition is intended to refer to sufficient inhibition that results in a detectable phenotype (e.g., cessation of growth, feeding, development, mortality, etc.) or a detectable decrease in RNA and/or protein corresponding to the target gene being inhibited. Although in certain embodiments of the invention inhibition occurs in substantially all cells of the plant-parasitic nematode, in other preferred embodiments inhibition occurs in only a subset of cells expressing the gene.

dsRNA molecules may be synthesized either in vivo or in vitro. The dsRNA may be formed by a single self-complementary RNA strand or from two complementary RNA strands. Endogenous RNA polymerase of the cell may mediate transcription in vivo, or cloned RNA polymerase can be used for transcription in vivo or in vitro. Inhibition may be targeted by specific transcription in an organ, tissue, or cell type; stimulation of an environmental condition (e.g., infection, stress, temperature, chemical inducers); and/or engineering transcription at a developmental stage or age. The RNA strands may or may not be polyadenylated; the RNA strands may or may not be capable of being translated into a polypeptide by a cell's translational apparatus.

A RNA, dsRNA, siRNA, or miRNA of the present invention may be produced chemically or enzymatically by one skilled in the art through manual or automated reactions or in vivo in another organism. RNA may also be produced by partial or total organic synthesis; any modified ribonucleotide can be introduced by in vitro enzymatic or organic synthesis. The RNA may be synthesized by a cellular RNA polymerase or a bacteriophage RNA polymerase (e.g., T3, T7, SP6). The use and production of an expression construct are known in the art (see, for example, WO 97/32016; U.S. Pat. Nos. 5,593,874, 5,698,425, 5,712,135, 5,789,214, and 5,804,693). If synthesized chemically or by in vitro enzymatic synthesis, the RNA may be purified prior to introduction into the cell. For example, RNA can be purified from a mixture by extraction with a solvent or resin, precipitation, electrophoresis, chromatography, or a combination thereof Alternatively, the RNA may be used with no or a minimum of purification to avoid losses due to sample processing. The RNA may be dried for storage or dissolved in an aqueous solution. The solution may contain buffers or salts to promote annealing, and/or stabilization of the duplex strands.

For transcription from a transgene in vivo or an expression construct, a regulatory region (e.g., promoter, enhancer, silencer, and polyadenylation) may be used to transcribe the RNA strand (or strands). Therefore, in one embodiment, the nucleotide sequences for use in producing RNA molecules may be operably linked to one or more promoter sequences functional in a microorganism, a fungus or a plant host cell. Ideally, the nucleotide sequences are placed under the control of an endogenous promoter, normally resident in the host genome. The nucleotide sequence of the present invention, under the control of an operably linked promoter sequence, may further be flanked by additional sequences that advantageously affect its transcription and/or the stability of a resulting transcript. Such sequences are generally located upstream of the operably linked promoter and/or downstream of the 3' end of the expression construct and may occur both upstream of the promoter and downstream of the 3' end of the expression construct, although such an upstream sequence only is also contemplated.

As used herein, the term "disease control agent", or "gene suppression agent" refers to a particular RNA molecule consisting of a first RNA segment and a second RNA segment linked by a third RNA segment. The first and the second RNA segments lie within the length of the RNA molecule and are substantially inverted repeats of each other and are linked together by the third RNA segment. The complementarity between the first and the second RNA segments results in the ability of the two segments to hybridize in vivo and in vitro to form a double stranded molecule, i.e., a stem, linked together at one end of each of the first and second segments by the third segment which forms a loop, so that the entire structure forms into a stem and loop structure, or even more tightly hybridizing structures may form into a stem-loop knotted structure. The first and the second segments correspond invariably and not respectively to a sense and an antisense sequence with respect to the target RNA transcribed from the target gene in the target pathogen that is suppressed by the ingestion of the dsRNA molecule. The control agent can also be a substantially purified (or isolated) nucleic acid molecule and more specifically nucleic acid molecules or nucleic acid fragment molecules thereof from a genomic DNA (gDNA) or cDNA library. Alternatively, the fragments may comprise smaller oligonucleotides having from about 15 to about 250 nucleotide residues, and more preferably, about 15 to about 30 nucleotide residues.

As used herein, the term "genome" as it applies to cells of a plant-parasitic nematode or a host encompasses not only chromosomal DNA found within the nucleus, but organelle DNA found within subcellular components of the cell. The DNA's of the present invention introduced into plant cells can therefore be either chromosomally integrated or organelle-localized. The term "genome" as it applies to bacteria encompasses both the chromosome and plasmids within a bacterial host cell. The DNA's of the present invention introduced into bacterial host cells can therefore be either chromosomally integrated or plasmid-localized.

As used herein, the term "plant-parasitic nematode" refers to those nematodes that may infect, colonize, parasitize, or cause disease on host plant material transformed to express or coated with a double stranded gene suppression agent. As used herein, a "nematode resistance" trait is a characteristic of a transgenic plant, transgenic animal, or other transgenic host that causes the host to be resistant to attack from a nematode that typically is capable of inflicting damage or loss to the host. Such resistance can arise from a natural mutation or more typically from incorporation of recombinant DNA that confers plant-parasitic nematode resistance. To impart nematode resistance to a transgenic plant a recombinant DNA can, for example, be transcribed into a RNA molecule that forms a dsRNA molecule within the tissues or fluids of the recombinant plant. The dsRNA molecule is comprised in part of a segment of RNA that is identical to a corresponding RNA segment encoded from a DNA sequence within a plant-parasitic nematode that prefers to cause disease on the host plant. Expression of the gene within the target plant-parasitic nematode is suppressed by the dsRNA, and the suppression of expression of the gene in the target plant-parasitic nematode results in the plant being resistant to the nematode. Fire et al. (U.S. Pat. No. 6,506,599) generically describes inhibition of pest infestation, providing specifics only about several nucleotide sequences that were effective for inhibition of gene function in the nematode species *Caenorhabditis elegans*. Similarly, US 2003/0061626 describes the use of dsRNA for inhibiting gene function in a variety of nematode pests. US 2003/0150017 describes using dsDNA sequences to transform host cells to express corresponding dsRNA sequences that are substantially identical to target sequences in specific pests, and particularly describe constructing recombinant plants expressing such dsRNA sequences for ingestion by various plant-parasitic nematode, facilitating down-regulation of a gene in the genome of the target organism and improving the resistance of the plant to the plant-parasitic nematode.

The modulatory effect of dsRNA is applicable to a variety of genes expressed in the plant-parasitic nematode including, for example, endogenous genes responsible for cellular metabolism or cellular transformation, including house keeping genes, transcription factors, molting-related genes, and other genes which encode polypeptides involved in cellular metabolism or normal growth and development.

As used herein, the phrase "inhibition of gene expression" or "inhibiting expression of a target gene in the cell of a plant-parasitic nematode" refers to the absence (or observable decrease) in the level of protein and/or mRNA product from the target gene. Specificity refers to the ability to inhibit the target gene without manifest effects on other genes of the cell and without any effects on any gene within the cell that is producing the dsRNA molecule. The inhibition of gene expression of the target gene in the plant-parasitic nematode may result in novel phenotypic traits in the nematode.

The present invention provides in part a delivery system for the delivery of the nematode control agents by ingestion of host cells or the contents of the cells. In accordance with another embodiment, the present invention involves generating a transgenic plant cell or a plant that contains a recombinant DNA construct transcribing the stabilized dsRNA molecules of the present invention. As used herein, "taking up" refers to the process of an agent coming in contact with cells of a target organism, such as a nematode. This may occur, for instance, by nematode feeding, by soaking, or by injection. As used herein, the phrase "generating a transgenic plant cell or a plant" refers to the methods of employing the recombinant DNA technologies readily available in the art (e.g., by Sambrook, et al., 1989) to construct a plant transformation vector transcribing the stabilized dsRNA molecules of the present invention, to transform the plant cell or the plant and to generate the transgenic plant cell or the transgenic plant that contain the transcribed, stabilized dsRNA molecules.

It is envisioned that the compositions of the present invention can be incorporated within the seeds of a plant species either as a product of expression from a recombinant gene incorporated into a genome of the plant cells, or incorporated into a coating or seed treatment that is applied to the seed before planting. The plant cell containing a recombinant gene is considered herein to be a transgenic event.

The present invention provides in part a delivery system for the delivery of disease control agents to plant-parasitic nematodes. The stabilized dsRNA or siRNA molecules of the present invention may be directly introduced into the cells of a plant-parasitic nematode. Methods for introduction may include direct mixing of RNA with host tissue for the plant-parasitic nematode, as well as engineered approaches in which a species that is a host is engineered to express the dsRNA or siRNA. In one embodiment, the RNA may be sprayed onto a plant surface. In still another embodiment, the dsRNA or siRNA may be expressed by microorganisms and the microorganisms may be applied onto a plant surface or introduced into a root, stem by a physical means such as an injection. In still another embodiment, a plant may be genetically engineered to express the dsRNA or siRNA in an amount sufficient to kill the plant-parasitic nematodes known to infest the plant.

It is also anticipated that dsRNAs produced by chemical or enzymatic synthesis may be formulated in a manner consistent with common agricultural practices and used as spray-on products for controlling plant disease. The formulations may include the appropriate stickers and wetters required for efficient foliar coverage as well as UV protectants to protect dsRNAs from UV damage. Such additives are commonly used in the bioinsecticide industry and are well known to those skilled in the art. Such applications could be combined with other spray-on insecticide applications, biologically based or not, to enhance plant protection from plant-parasitic nematodes The present invention also relates to recombinant DNA constructs for expression in a microorganism. Exogenous nucleic acids from which an RNA of interest is transcribed can be introduced into a microbial host cell, such as a bacterial cell or a fungal cell, using methods known in the art.

The nucleotide sequences of the present invention may be introduced into a wide variety of prokaryotic and eukaryotic microorganism hosts to produce the stabilized dsRNA or siRNA molecules. The term "microorganism" includes prokaryotic and eukaryotic species such as bacteria and fungi, as well as nematodes. Fungi include yeasts and filamentous fungi, among others. Illustrative prokaryotes, both Gram-negative and Gram-positive, include *Enterobacteriaceae*, such as *Escherichia, Erwinia*, and *Serratia; Bacillaceae; Rhizobiaceae*, such as *Rhizobium; Spirillaceae*, such as photobacterium, *Zymomonas; Lactobacillaceae; Pseudomonadaceae*, such as *Pseudomonas* and *Acetobacter; Azotobacteraceae, Actinomycetales,* and *Nitrobacteraceae*. Among eukaryotes are fungi, such as *Phycomycetes* and *Ascomycetes*, including *Saccharomyces* and *Schizosaccharomyces;* and *Basidiomycetes*, such as *Rhodotorula, Aureobasidium*, and the like.

D. Transgenic Plants

The present invention provides seeds and plants having one or more transgenic event. Combinations of events are referred to as "stacked" transgenic events. These stacked transgenic events can be events that are directed at the same target organism, or they can be directed at different target pathogens or pests. In one embodiment, a seed having the ability to express a nucleic acid provided herein also has the ability to express at least one other agent, including, but not limited to, an RNA molecule the sequence of which is derived from the sequence of an RNA expressed in a target pathogen such as a nematode and that forms a double stranded RNA structure upon expressing in the seed or cells of a plant grown from the seed, wherein the ingestion of one or more cells of the plant by the target results in the suppression of expression of the RNA in the cells of the target.

In certain embodiments, a seed having the ability to express a dsRNA the sequence of which is derived from a target plant-parasitic nematode also has a transgenic event that provides herbicide tolerance. One beneficial example of a herbicide tolerance gene provides resistance to glyphosate, N-(phosphonomethyl)glycine, including the isopropylamine salt form of such herbicide.

Benefits provided by the present invention may include, but are not limited to: the ease of introducing dsRNA into the plant-parasitic nematode cells, the low concentration of dsRNA which can be used, the stability of dsRNA, and the effectiveness of the inhibition. The ability to use a low concentration of a stabilized dsRNA avoids several disadvantages of anti-sense interference. The present invention is not limited to in vitro use or to specific sequence compositions, to a particular set of target genes, a particular portion of the target gene's nucleotide sequence, or a particular transgene or to a particular delivery method, as opposed to the some of the available techniques known in the art, such as antisense and co-suppression. Furthermore, genetic manipulation becomes possible in organisms that are not classical genetic models.

In order to achieve inhibition of a target gene selectively within a plant-parasitic nematode species that it is desired to control, the target gene should preferably exhibit a low degree of sequence identity with corresponding genes in a plant or a vertebrate animal. Preferably the degree of the sequence identity is less than approximately 80%. More preferably the degree of the sequence identity is less than approximately 70%. Most preferably the degree of the sequence identity is less than approximately 60%.

In addition to direct transformation of a plant with a recombinant DNA construct, transgenic plants can be prepared by crossing a first plant having a recombinant DNA construct with a second plant lacking the construct. For example, recombinant DNA for gene suppression can be introduced into first plant line that is amenable to transformation to produce a transgenic plant that can be crossed with a second plant line to introgress the recombinant DNA for gene suppression into the second plant line.

The present invention can be, in practice, combined with other disease control traits in a plant to achieve desired traits for enhanced control of plant disease. Combining disease control traits that employ distinct modes-of-action can provide protected transgenic plants with superior durability over plants harboring a single control trait because of the reduced probability that resistance will develop in the field.

The invention also relates to commodity products containing one or more of the sequences of the present invention, and produced from a recombinant plant or seed containing one or more of the nucleotide sequences of the present invention are specifically contemplated as embodiments of the present invention. A commodity product containing one or more of the sequences of the present invention is intended to include, but not be limited to, meals, oils, crushed or whole grains or seeds of a plant, or any food product comprising any meal, oil, or crushed or whole grain of a recombinant plant or seed containing one or more of the sequences of the present invention. The detection of one or more of the sequences of the present invention in one or more commodity or commodity products contemplated herein is defacto evidence that the commodity or commodity product is composed of a transgenic plant designed to express one or more of the nucleotides sequences of the present invention for the purpose of controlling plant disease using dsRNA mediated gene suppression methods.

E. Obtaining Nucleic Acids

The present invention provides methods for obtaining a nucleic acid comprising a nucleotide sequence for producing a dsRNA or siRNA. In one embodiment, such a method comprises: (a) analyzing one or more target gene(s) for their expression, function, and phenotype upon dsRNA-mediated gene suppression in a nematode; (b) probing a cDNA or gDNA library with a hybridization probe comprising all or a portion of a nucleotide sequence or a homolog thereof from a targeted nematode that displays an altered, e.g. reduced, nematode growth or development phenotype in a dsRNA-mediated suppression analysis; (c) identifying a DNA clone that hybridizes with the hybridization probe; (d) isolating the DNA clone identified in step (b); and (e) sequencing the cDNA or gDNA fragment that comprises the clone isolated in step (d) wherein the sequenced nucleic acid molecule transcribes all or a substantial portion of the RNA nucleotide acid sequence or a homolog thereof.

In another embodiment, a method of the present invention for obtaining a nucleic acid fragment comprising a nucleotide sequence for producing a substantial portion of a dsRNA or siRNA comprises: (a) synthesizing first and a second oligonucleotide primers corresponding to a portion of one of the nucleotide sequences from a targeted pathogen; and (b) amplifying a cDNA or gDNA insert present in a cloning vector using the first and second oligonucleotide primers of step (a) wherein the amplified nucleic acid molecule transcribes a substantial portion of the a substantial portion of a dsRNA or siRNA of the present invention.

In practicing the present invention, a target gene may be derived from *H. glycines* or another nematode. It is contemplated that several criteria may be employed in the selection of preferred target genes. The *H. glycines* gene may be one which has a *C. elegans* ortholog with a likelihood for a strong phenotype upon RNAi knockdown of expression, including a P0 phenotype. Such targets are often those with protein products involved in core cellular processes such as DNA replication, cell cycle, transcription, RNA processing, translation, protein trafficking, secretion, protein modification, protein stability and degradation, energy production, intermediary metabolism, cell structure, signal transduction, channels and transporters, and endocytosis. In certain embodiments it is advantageous to select a gene for which a small drop in expression level results in deleterious effects for the pathogen.

As used herein, the term "derived from" refers to a specified nucleotide sequence that may be obtained from a particular specified source or species, albeit not necessarily directly from that specified source or species.

In one embodiment, a gene is selected that is essentially involved in the growth and development, of a plant-parasitic nematode. Other target genes for use in the present invention may include, for example, those that play important roles in nematode viability, growth, development, infectivity, and establishment of feeding sites. These target genes may be one of the house keeping genes, transcription factors and the like. Additionally, the nucleotide sequences for use in the present invention may also be derived from homologs, including orthologs, of plant, viral, bacterial or insect genes whose functions have been established from literature and the nucleotide sequences of which share substantial similarity with the target genes in the genome of a target nematode. According to one aspect of the present invention for nematode control, the target sequences may essentially be derived from the targeted plant-parasitic nematode. Some of the exemplary target sequences cloned from a nematode that encode proteins or fragments thereof which are homologues of known proteins may be found in the Sequence Listing, for instance SEQ ID NOs:301-1026, SEQ ID NOs:1269-1702, and SEQ ID NOs: 1920-1929.

For the purpose of the present invention, the dsRNA or siRNA molecules may be obtained by polymerase chain (PCR™) amplification of a target gene sequences derived from a gDNA or cDNA library or portions thereof. The DNA library may be prepared using methods known to the ordinary skilled in the art and DNA/RNA may be extracted. Genomic DNA or cDNA libraries generated from a target organism may be used for PCR™ amplification for production of the dsRNA or siRNA.

The target genes may be then be PCR™ amplified and sequenced using the methods readily available in the art. One skilled in the art may be able to modify the PCR™ conditions to ensure optimal PCR™ product formation. The confirmed PCR™ product may be used as a template for in vitro transcription to generate sense and antisense RNA with the included minimal promoters. In one embodiment, the present invention comprises isolated and purified nucleotide sequences that may be used as plant-parasitic nematode control agents. The isolated and purified nucleotide sequences may comprise those as set forth in the sequence listing.

As used herein, the phrase "coding sequence", "structural nucleotide sequence" or "structural nucleic acid molecule" refers to a nucleotide sequence that is translated into a polypeptide, usually via mRNA, when placed under the control of appropriate regulatory sequences. The boundaries of the coding sequence are determined by a translation start codon at the 5'-terminus and a translation stop codon at the 3'-terminus. A coding sequence can include, but is not limited to, genomic DNA, cDNA, EST and recombinant nucleotide sequences.

The term "recombinant DNA" or "recombinant nucleotide sequence" refers to DNA that contains a genetically engineered modification through manipulation via mutagenesis, restriction enzymes, and the like.

For many of the plant-parasitic nematodes that are potential targets for control by the present invention, there may be limited information regarding the sequences of most genes or the phenotype resulting from mutation of particular genes. Therefore, it is contemplated that selection of appropriate genes for use in the present invention may be accomplished through use of information available from study of the corresponding genes in a model organism such in *C. elegans*, in which the genes have been characterized, according to the analysis described in Examples 1-8. In some cases it will be possible to obtain the sequence of a corresponding gene from a target nematode by searching databases such as GenBank using either the name of the gene or the sequence from, for example, a nematode from which the gene has been cloned. Once the sequence is obtained, PCR™ may be used to amplify an appropriately selected segment of the gene in the target nematode for use in the present invention. PCR™ primers may be designed based on the sequence as found in another organism from which the gene has been cloned. The primers are designed to amplify a DNA segment of sufficient length for use in the present invention. DNA (either genomic DNA or cDNA) is prepared from the target plant-parasitic nematode, and the PCR™ primers are used to amplify the DNA segment. Amplification conditions are selected so that amplification will occur even if the primers do not exactly match the target sequence. Alternately, the gene (or a portion thereof) may be cloned from a gDNA or cDNA library prepared from a plant-parasitic nematode species, using the known gene as a probe. Techniques for performing PCR™ and cloning from libraries are known. Further details of the process by which DNA segments from target plant-parasitic nematodes species may be isolated based on the sequence of genes previously cloned from other species are provided in the Examples. One of ordinary skill in the art will recognize that a variety of techniques may be used to isolate gene segments from plant-parasitic nematodes that correspond to genes previously isolated from other species.

EXAMPLES

The inventors herein have identified a means for controlling plant-parasitic nematodes by providing double stranded ribonucleic acid molecules to plant-parasitic nematodes, and a means to select sequences that encode these double stranded ribonucleic acid molecules. Double stranded ribonucleic acid molecules that function upon ingestion to inhibit a biological function in a nematode may result, for example, in one or more of the following attributes: reduction in growth of a nematode, inhibition of development of a nematode, or reduction of viability. Any one or any combination of these attributes can result in an effective inhibition of plant infection or colonization, and in the case of a plant pathogenic nematode, inhibition of plant disease, and/or reduction in severity of disease symptoms.

Example 1

Criteria for Target Gene Selection

To rank genes by likely essentiality of function in the nematode lifecycle, information from *C. elegans* RNA interference (RNAi) experiments available at wormbase.org was combined with additional experimental information. Using the >40,000 phenotype data points in wormbase, all ~20,000 *C. elegans* genes were ranked for their potency of phenotype, level of confidence in phenotype, and likelihood of effects at multiple stages in the lifecycle. 715 *C. elegans* genes with BLAST amino acid homology to *H. glycines* of at least e-10 (see orthology determination below) had scores in this phenotype scoring system of 44 or better, where 1 is best. Below, phenotype statistics are provided for just the targets eventually making the top 300 list (using all criteria). As the phenotype ranking is dependent upon currently available information, it is not meant to be all inclusive capturing every gene that could be a good target, but rather to provide a list of high quality targets likely to be successful in *H. glycines* RNAi based on information in hand.

The following analysis of phenotypes evident following RNAi treatment was performed prior to the recent publication of Sonnichsen et al. *C. elegans* genome RNAi survey (Sonnichsen et al., 2005). This group tested 19,075 genes by injection of dsRNA into the gonads of *C. elegans* wild type strain N2 hermaphrodites and looked for effects on that animal and its progeny. They found effects for just 1,668 genes (8.7%). Providing additional support to the robustness of the top 300 list (FIG. 3), 293 were among the genes tested by Sonnichsen et al. and 257 had phenotypes (87.7%) including 176 Emb (embryonic lethal), 34 Lva (larval arrest), 34 Ste (sterile), 8 Lvl (larval lethal), 2 Stp (sterile progeny), 1 Bmd (body morphological defect), 1 Dpy (dumpy), 1 Egl (egg laying abnormal). 36 had wild type (WT) reports. Wild type reports increased toward the bottom of the list: 7 WT reports in 1-100, 13 WT in 101-200, 16 WT in 201-300.

RNAi phenotype reports were categorized into four groups. First, reports of lethality in the larval stages (lethal=let, larval lethal=lvl, larval arrest=lva) were placed together and given greatest weight. Such phenotypes if mimicked in *H. glycines* would be advantageous as dsRNA delivery from the plant to the nematode would begin as the second stage juvenile worm, a stage analogous to the dauer larva, enters the plant. Delivery would continue through development of J2, J3, and J4 juvenile or larval stages at the feeding site. Disrupting nematode physiology during these larval stages could prevent feeding site formation in the plant roots in the P0 (primary) generation.

Second, reports of molting (mlt), blistering (bli), and rupture (rup) defects were placed together and given second greatest weight. Such phenotypes are rare relative to other more commonly observed effects such as lethality or sterility.

Nematodes, including both *C. elegans* and *H. glycines* are covered by a cuticle of collagen. Molting defects could block shedding and reformation of the cuticle between larval stages (J2→J3, J3→J4, J4→A) and therefore developmental progression. Blister phenotypes often also involve defects in the cuticle. Rupture phenotypes in *C. elegans* are not well understood but may involve loss of body integrity or osmotic shifts. Rupture phenotypes are particularly attractive for SCN control as they are likely irreversible with no opportunity for the worm to recover as may be the case for temporary blocks to metabolism or development.

Third, sterile (ste) and embryonic (emb) lethality phenotypes were placed together and given third greatest weight. In *C. elegans*, the germ line tissue, where many genes involved in fertility and embryonic development are active (maternal factors), is particularly sensitive to RNAi. In the context of an SCN infection, a sterile or embryonic lethal block to the lifecycle alone could prevent formation of a second generation but would allow initial feeding site formation and plant root system damage. Fourth, other major defects in the physiology including growth defective (gro), sick (sck), uncoordinated (unc), paralyzed (prl, prz) phenotypes were placed together and given fourth greatest weight. In the female *H. glycines*, once a feeding site is formed the worm discontinues moving and body wall musculature plays a limited role in survival. However, male worms become mobile as adults so that they can seek, find, and fertilize females. Therefore, blocking of muscle and nervous system structures important for normal movement could interfere with fertilization and formation of a second generation. For the purposes of this ranking, other non-lethal RNAi phenotypes (dumpy, short, long, body morphology defect, etc.) were not included. Phenotypes observed by genetic mutation were also not used in this ranking system.

To rank genes based on wormbase RNAi information, genes with multiple phenotypic reports and multiple different phenotypes were favored over genes with single phenotypic reports and single phenotypes. Multiple reports of phenotypes are helpful as they add confidence to the assignment of phenotype to a gene. Based on experiments from multiple groups, *C. elegans* RNAi experiments have a false negative and false positive rate of ~10-15%. Evidence of phenotypes from more than one report decreases the likelihood of inclusion of false positives in the list. Because *C. elegans* RNAi does not result in complete transcript elimination (knockdown is estimated at 90%) and is often non-uniform through the population, single gene RNAi experiments often result in the observation of multiple phenotypes over the course of the life cycle. Therefore, reporting of the phenotype of a given gene as "ste, emb, lvl" may mean that it is required throughout the lifecycle whereas a phenotype of "emb" alone may mean that the gene is only required for one step in embryonic development. For the purposes of parasite control, genes required for multiple steps and multiple processes in the lifecycle are more attractive targets than those required at just one stage as this provides more opportunities for a dsRNA to interfere with the lifecycle and block infection.

In each of these four categories, *C. elegans* RNAi reports were totaled and weighted. The first report of a phenotype in an N2 (wild type) background for a gene from a given laboratory was given a weight of 1. The second, third, etc. report of a phenotype from that same laboratory was given a discounted weight of 0.7. Therefore, independent reports from two laboratories (score=2) would be favored over two reports from the same laboratory (score=1.7) that might be vulnerable to a systematic error (e.g. wrong clone selected and used twice). Reports of phenotypes in the rrf-3(−/−) genetic background which is more sensitive to RNAi than N2 were given a discounted score of 0.6.

With these categories and weightings, targets were ranked on a scale from a score of 1 to 44 or higher based on their tally in the matrix shown in FIG. 1. For instance, to receive a score of 3, targets had to have a let lvl lva score of $\geq 2$, a mlt bli rup score of $X \geq 1$, a ste emb score of $\geq 2$, and an other phenotype score of $\geq 1$. Most genes in *C. elegans* have a score worse than 44. 715 genes had a score of 44 or better and a potential homolog in *H. glycines*. For the top 300 targets, following ranking on all criteria, the average phenotype score was 22±9. The top score was a 3 (6 targets) and only 10 targets had a score less than 10. The most common categories were scores of 10 (61 targets with a let lvl lva score of $\geq 2$, a mlt bli rup score of 0, a ste emb score of $\geq 2$ and an other phenotype score of $\geq 1$), 15 (23 targets), 24 (26 targets), 26 (93 targets), and 33 (19 targets). Averages and standard deviations for tallies in each category were let lvl lva score=1.9±1, mlt bli rup score=0.3±0.7, ste emb score=2.8±1.7, and an other phenotype score=1.6±1.3. mlt bli rup were the most rare phenotypes with only 56 targets having a score $\geq 0$. Totals of targets with scores $\geq 0$ in the other categories were 284 for let lvl lva, 281 for ste emb score of $\geq 2$, and 258 for other phenotype.

In addition to reports of visible phenotypes from wormbase, reports of wild type (i.e. no phenotype) for each target were also recorded. Wild type findings were viewed as a negative for target ranking and most targets with high numbers of wild type reports were removed from consideration for the top 300 list. All wild type reports were given a score of 1 except those from Vidal et al. which were given a score of 0.3 since this group's methodology seems to have resulted in a higher percentage of wild type reports than all other reporting groups. In addition to total wild type tally, % wild type relative to all other reports was also calculated. For the top 300 targets, the averages and standard deviations for wild type tally and wild type percent were 0.14±0.41 and 1.9±5.1%. 250 of the 300 targets had no wild type reports. For the 50 targets with wild type reports, the wild type tally and percentages were 0.85±0.65 and 11.3±7.3%. In only 24 cases were wild type reports >10% of all reports with the highest being 33%.

Next, RNAi data was compared to that available in wormbase. RNAi experiments have been performed on more than 1,500 *C. elegans* genes of interest in feeding assays with N2, rrf-3, and other strains. Of the 715 *C. elegans* genes under consideration with BLAST amino acid homology to the *H. glycines* and wormbase phenotype scores of 44 or better (FIG. 1), information was available for about 75. Additionally, 3 genes with P0 (first generation) effects in assays not on the list of 715 were added to the list. 10 target genes of the original 715 showed no phenotype in an assay (multiple replicates with sequence confirmation of constructs) and were therefore excluded from the top 300. Phenotypes were observed for 39 target genes in the top 300 including lvl, lva, rup, ste, emb, unc, sck and additional phenotypes not included in the ranking system such as growth defective (gro), sterile progeny (stp), dumpy (dpy), and body morphology defect (bmd).

Example 2

*C. elegans* P-zero (P0) RNAi screens

In addition to the standard RNAi assay, additional *C. elegans* RNAi screens were performed. One of these was a P0 lethal screen.

P-zero (P0) or Rapid Onset RNAi Effects in *C. elegans*

To control *Heterodera glycines* by providing dsRNA from a transgenic soy plant, finding genes that are sensitive to rapid onset RNAi effects could be useful. Such genes might block mature feeding site formation by the J2 while slow onset genes might not show an effect until the next generation. *C. elegans* genes where effects are seen in the exposed animal, so called P0 (P-zero) generation effects, might predict *H. glycines* orthologs with high and rapid sensitivity to RNAi.

All large scale screens for RNAi effects in *C. elegans* have exposed initial worms as L4s or adults (the genetic P0 (P-zero) generation) to dsRNA and looked for phenotypes in their progeny, the F1 and F2 generation. Sterility of the initial P0 animal was also observed in many cases. None of the microinjection screens (Gonczy et al., 2000; Piano et al 2000; Piano et al., 2002) or feeding screens (Fraser et al., 2000; Kamath et al., 2003) note effects on the P0 animals other than sterility. Likewise, in a screen of over 1,200 *C. elegans* genes by feeding from L4 start, P0 phenotypes other than sterility were not observed. Wormbase (www.wormbase.org) records of RNAi phenotypes do not even note the generation in which an effect is observed (P0, F1, F2, etc.) so finding P0 candidates from these records is not possible. Maeda et al. 2000 performed RNAi on 2,500 *C. elegans* genes by soaking of L4s. Interestingly, in the supplementary online material accompanying the publication, Maeda et al. note 26 cases where P0 effects other than sterility were observed ranging from unhealthy to slow growing to lethality. These targets were investigated experimentally to see if any of the genes were actually legitimate P0 effects (FIG. 2).

Of the 26 Maeda et al. entries 21 corresponded to wormbase.org entries while 5 were clones of unclear origin. 19 genes have been successfully cloned into RNAi *E. coli* feeding constructs and sequence verified while 2 had cloning difficulties. 17 of the 19 completed clones have so far been tested for P0 phenotypes. Experiments are in progress to finish testing of two more clones and repeat test six others that have only been tested once to confirm results. Additionally, 7 targets of interest were tested in the same assay for a total of 24. Data was collected from two life-cycle starting points. First, a P0 L4 start was performed to mimic both the Maeda assay and the standard *E. coli* feeding assay. Second, a P0 egg start was performed to expose the P0 animal to dsRNA throughout development, a similar situation to that which may be encountered by a *Heterodera glycines* nematode upon infection of a plant producing a dsRNA. For the egg start, the assumption is that the first dsRNA exposure occurs as the L1 larva hatches and begins to feed.

From the 17 tested Maeda et al. (2001) candidates and 7 additional targets, 6 were found to have P0 phenotypes other than sterility from an egg start in the feeding assay (3 from Maeda and 3 from the additional list). These were Y57G11C.15 (sec61 alpha), C47E12.5 (uba-1), and R07E4.6 (kin-2) from Maeda and C34G6.6 (pan-1), F52B11.3 (pan-2), and T25C8.2 (act-5) from the additional list. For the L4 start, only three genes showed a P0 phenotypes other than sterility. The genes with L4 start phenotypes were a subset of the 6 showing an egg start phenotype: Y57G11C.15 (sec61 alpha) and R07E4.6 (kin-2) from Maeda and T25C8.2 (act-5) from the additional list. Of the remaining genes tested to date from the Maeda candidates, 4 had less severe phenotypes such as sterility and F1 larval arrest while 9 are fully wild type and were likely false positives in the Maeda screen. It remains possible however that genes lacking a phenotype in a bacterial feeding assay would have a phenotype in a soaking assay.

In addition to studies with N2 *C. elegans* worms (laboratory standard strain), studies were also performed for 22 of the genes in afog-2(q71) mutant background. fog-2(q71) is a mutant that feminizes the germ line of the hermaphrodite and is maintained as a male/female strain. Female worms were picked away from males as larva prior to fertilization. Such virgin female worms are easy to maintain for many days as they age since there is no F1 generation present to overgrow the plate and may therefore aid in seeing late onset effects in the P0 adult worm. P0 results observed in fog-2(q71) were identical to those seen in N2 and no additional phenotypes were detected. fog-2 tests on subsequent genes were therefore discontinued.

The studies showed that in *C. elegans* obtaining a P0 phenotype other than sterility from an L4 start is a very rare event but that examples do exist such as Y57G11C.15 (sec61 alpha), R07E4.6 (kin-2), and T25C8.2 (act-5) (FIG. 2). Evidence suggests that most of the P0 phenotypes other than sterility recorded by Maeda et al. in their supplementary materials were false positives. This is supported by other evidence: in addition to the present data at least six genes had been tested by other laboratories and found to have only wild type phenotypes in all generations (P0, F1, etc.). P0 phenotypes other than sterility from an L4 start are presumably rare as the adult already has many of the proteins necessary for survival and the slow kinetics of RNAi takes time to degrade all transcripts. Genes showing an effect under such conditions may be ones where the worm is especially sensitive to their disruption and therefore ranked highly among targets for consideration. P0 phenotypes other than sterility from an egg start are less rare and are seen in several of the targets of interest known to have severe phenotypes (e.g. pan-1, pan-2). Presumably, a larger survey of targets with strong phenotypes would find more.

Of the six targets in which a P0 lethal phenotype was confirmed, all have reasonably strong orthologs among the *H. glycines* sequences. kin-2 was already confirmed as having a P0 phenotype and was therefore ranked in the top 10. pan-1 and pan-2 are both already among the top 100 using our wormbase RNAi phenotype ranking system (FIG. 1) and additional *H. glycines* sequence information and will also be considered. Pan-1, which was missing from the ESTs, is newly identified in *H. glycines* based on Genome Survey sequencing. act-5, uba-1, and sec61 alpha were not yet among the top several hundred targets using the wormbase RNAi phenotype ranking system because they lacked let, lvl, lva, mlt, bli, and rup phenotype reports in wormbase. Final rank positions of these six targets among the top 300 are Y57G11C.15 (sec61 alpha)=#2, C47E12.5 (uba-1)=#3, and R07E4.6 (kin-2)=#4, C34G6.6 (pan-1)=#7, F52B11.3 (pan-2)=#30, and T25C8.2 (act-5)=#21.

Example 3

*C. elegans* Intestine-Specific RNAi Screen

A second additional screen was also performed to aid in the selection of target genes (Table 1). A strain of *C. elegans* that is sensitive to RNAi only in the intestine was previously generated. This strain can be used to rapidly screen the set of genes previously shown to be essential to viability and development by RNAi to identify those that are essential specifically in the intestine. Such genes may be advantageous targets with plant-delivered *H. glycines* RNAi as the intestine is believed to be the first tissue to come in contact with the entering dsRNA. Further, genes encoding secreted and transmembrane proteins may be vulnerable to disruption by the expression in the plant of nematocidal proteins that disrupt the function of these gene products.

The *C. elegans* intestine-specific RNAi strain was generated by introducing a transgene that drives expression of the wild-type sid-1 gene under the control of an intestine specific-promoter in an otherwise sid-1 minus background (Strain HC75). sid-1 is essential for systemic RNAi in *C. elegans* and encodes a transmembrane protein that is a putative dsRNA transporter (Winston, et al., 2002). Three lines, each driving expression from a different intestinal promoter, have been tested for sensitivity to RNAi. The promoters used are 5' regions of elt-2, ges-1, and ile-1. Feeding dsRNA from unc-54 (body wall muscle), dpy-7 (hypodermis), and act-1 (multiple tissues) showed no phenotype in these strains although all three dsRNAs produced the expected phenotype in wild-type (N2) worm controls. On the other hand, feeding dsRNA from act-5, an intestine-specific actin, and ile-1, a gene with intestinal localization, in these strains resulted in sterility. These observations support the conclusion that these strains are sensitive to RNAi in the intestine but not in a number of other tissues. The ges-1::sid-1 strain was selected for screening. Phenotypes in this strain are weaker than in N2 even for genes that only have roles in the intestine, probably because ges-1 expression is non-uniform or weaker than endogenous SID-1 intestinal expression such that SID-1 is not always present at the levels it would be in N2. However, phenotypes, such as 50% sterility are easily scored relative to controls and are reproducible. 130 genes have been examined to date in the intestinal-RNAi strain, with a focus on secreted and transmembrane targets and 57 have been observed to have phenotypes (Table 1). Of the 715 gene targets under consideration for the top 300 list, 24 had phenotypes in the intestinal RNAi strain whereas 3 were wild type. In ranking otherwise equally weighted targets preference was given to genes showing intestinal RNAi strain phenotypes and 14 such genes made the top 300 list. The 10 that did not either had weak intestinal RNAi phenotypes (e.g. 25% sterile) or other drawbacks (weak homology, non-orthology, etc.).

TABLE 1

*C. elegans* Intestinal RNAi Strain Phenotypes

| Gene | Intestinal RNAi Phenotype | Gene | Intestinal RNAi Phenotype |
|---|---|---|---|
| act-5 | 80% sterile | C01G8.5 | 40% sterile |
| Ile-1 | 80% sterile | R13H4.4 | 30% sterile |
| C16A3.3 | 20-70% sterile | C25A11.4 | 40% sterile |
| C47E12.5 | 40-99% sterile | T26E3.3 | 15% sterile |
| C48E7.6 | 20-40% sterile | F54G8.3 | 20% sterile |
| D1014.3 | 30-80% sterile | ZK1058.2 | 50-80% sterile |
| D1069.3 | 15-50% sterile | K07D8.1 | 25% sterile |
| T10H9.3 | 20-40% sterile | H19M22.2 | 45% sterile |
| T24H7.1 | 15-35% sterile | F42C5.10 | 65% sterile |
| ZK973.6 | 20-30% sterile | T03E6.7 | EMB |
| C01F1.2 | 15-40% sterile | R03E1.2 | 75% sterile |
| C54G4.8 | 50-80% sterile | Y55H10A.1 | LVA, 80% sterile |
| F10D7.5 | 15-40% sterile | C23H3.4 | 80% sterile |
| F11G11.5 | 15-50% sterile | F43D9.3 | 55% sterile |
| F32B5.8 | 20-25% sterile | Y57G11C.15 | 80% sterile |
| F33A8.1 | 60-97% sterile | F49C12.13 | 55% sterile |
| F34D10.2 | 20-30% sterile | T01H3.1 | 60% sterile |
| F39B2.11 | 20-25% sterile | T04A8.9 | 20-80% sterile |
| F54C9.2 | 15-25% sterile | H19M22.2 | 45-55% sterile |
| F55A11.2 | 10-15% sterile | K02B12.3 | 20-50% sterile |
| F55A12.7 | 50-60% sterile | W04A4.5 | 25-50% sterile |
| F55A12.8 | 20% sterile | Y47G6A.23 | 25-50% sterile |
| F55F10.1 | 20-25% sterile | C16D9.2 | 30-35% sterile |
| K07A12.3 | 15-25% sterile | F52C6.3 | 35% sterile |
| K07B1.5 | 25-30% sterile | F53B8.1 | 65% sterile |
| K07D8.1 | 25% sterile | C49C3.11 | 35% sterile |
| K12D12.2 | 40-70% sterile | F41G3.4 | 35% sterile |
| R04F11.2 | 40-70% sterile | Y57G11C.31 | 25% sterile |
| T01B11.3 | 10-30% sterile | | |

Example 4

Information on the *C. elegans* Gene Orthologs—Putative Molecular Function

Besides phenotype, additional information extracted from wormbase included gene name, wormpep protein ID, expression pattern, subcellular localization, prominent motifs, brief identification, concise description, and gene ontology terms. Preference for ranking was given to target genes with known molecular function over those with completely unknown function. We observed that genes with strong phenotypes were in general those with protein products involved in core cellular processes such as DNA replication, cell cycle, transcription, RNA processing, translation including ribosome and tRNA function, protein trafficking, secretion, protein modification, protein stability and degradation, energy production including mitochondrial function, intermediary metabolism, cell structure, signal transduction, channels and transporters, and endocytosis. Of the 300 selected targets, 275 belong to one of these categories (Table 2). Of the top 100, 98 belonged to one of these categories. The most frequently observed categories among targets with strong phenotypes were translation/ribosome/tRNAs, transcription/RNA processing, and Protein stability/degradation/proteosome.

TABLE 2

Categorization of *C. elegans* 300 Top Targets by Putative Cellular Function

| | DNA replication, repair, modify, cell cycle, chromatin | Transcription/ RNA processing | Translation/ ribosome/ tRNAs | Protein trafficking/ secretion/ nuclear import/ export | Protein modification | Protein stability/ degradation/ proteosome | Energy production/ mitochondria |
|---|---|---|---|---|---|---|---|
| totals 1-300 | 22 | 41 | 65 | 22 | 3 | 31 | 14 |
| % | 7% | 14% | 22% | 7% | 1% | 10% | 5% |
| 1-100 | 7 | 13 | 14 | 4 | 2 | 13 | 8 |
| 101-200 | 5 | 14 | 34 | 6 | 0 | 11 | 3 |
| 201-300 | 10 | 14 | 17 | 12 | 1 | 7 | 3 |

TABLE 2-continued

Categorization of C. elegans 300 Top Targets by Putative Cellular Function

|  | Metabolism/ Other Enzymes | Cell structure/ extracellular matrix | Receptors/ Signal transduction/ kinases | Channels/ Transporters | Endocytosis | Other/ Unknown |
|---|---|---|---|---|---|---|
| totals 1-300 | 28 | 21 | 20 | 1 | 8 | 25 |
| % | 9% | 7% | 7% | 0% | 3% | 8% |
| 1-100 | 13 | 8 | 11 | 0 | 6 | 2 |
| 101-200 | 8 | 6 | 4 | 0 | 1 | 8 |
| 201-300 | 7 | 7 | 5 | 1 | 1 | 15 |

Tracking of putative cellular function insures that suitable diversity is maintained in the top targets list and that the target list does not become too dependent upon one or a few processes which might function differently in *H. glycines* than *C. elegans*. In conception, low priority is given to developmental processes believed to be rapidly evolving in nematodes such as sex determination since such processes are less likely to be conserved between *H. glycines* and *C. elegans*. In practice, few such genes scores well enough in RNAI phenotype to come into consideration for the top 300 list. Interestingly, considering strength of *C. elegans* phenotype alone (score from 1-44 and wild type reports) even prior to inclusion of information on sequence conservation, highly ranked targets greatly over represent core cellular processes involving large multi-subunit complexes such as the ribosome and proteosome. This may result simply from the importance of translation and protein degradation to cellular survival. One additional interpretation of this finding is that subunits of large complexes tend to have strong phenotype following RNAi knockdown as they are more dosage sensitive than proteins not acting in complexes. For example, while a monomer enzyme may retain adequate flux through a metabolic pathway with only 10% of its normal protein dose, imbalance between subunit doses in a large protein complex may result in complex misassembly or other functional failure. Recent findings in *S. cerevisiae* support this interpretation (Papp et al., 2003).

Example 5

Sequence Homology, Identity, and Orthology Assignment

To identify *Heterodera glycines* orthologs of characterized *C. elegans* genes, homology searches were performed using the BLAST suite of programs (Altschul et al., 1990). Using predicted protein sequences for *C. elegans* genes (Wormpep) TBLASTN was used to search both *H. glycines* clustered ESTs and other sequences available from Genbank as well as recently generated proprietary genome survey sequences. Bitscore, e-value, and % identity were tracked. For consideration as a target, a *C. elegans* gene had to have a TBLASTN match to an ortholog or homolog in *H. glycines* with an e-value of at least e-10 or better. 715 *C. elegans* genes with RNAi phenotypes ranking from 1-44 (FIG. 1) met this minimal criterion. For these 715 genes, *H. glycines* matches were:

| BLAST | Mean ± SD | Range |
|---|---|---|
| % ID | 56 ± 18 | 96-22 |
| Bitscore | 184 ± 141 | 1031-52 |
| E-value | e−48 (median) | 0-e−11 |

To build the top 300 list (FIG. 3), favorable amino acid level sequence similar between *C. elegans* and *H. glycines* was the second most important factor in ranking after RNAi phenotype. Targets features of % ID, bitscore, and e-value were divided into quartiles. Top ranking targets in addition to having strong RNAi phenotypes also had favorable homology features indicative of orthology: bitscore (>100), e-value (<e−20), and percentage identity (>40%). To insure orthology assignment, targets were also tested for reciprocal BLAST matching so that when the selected *H. glycines* sequence was checked by BLAST back to the *C. elegans* wormpep list (BLASTX), the original starting sequence was identified. 25 genes that would otherwise have made the top 300 failed this reciprocal BLAST test indicating that the genes in *C. elegans* and *H. glycines* were unlikely to be orthologs. Of the final 300, 296 appeared to be clear orthologs with reciprocal BLAST top matches in both directions, 1 was tied for top match (2 close homologs in *C. elegans*), and 3 were within 5% of the top bitscore (these were kept because of strong phenotypes among all the top *C. elegans* homologs). For the top 300 genes, *H. glycines* matches were:

| BLAST | Mean ± SD | Range |
|---|---|---|
| % ID | 65 ± 15 | 96-30 |
| Bitscore | 253 ± 158 | 1031-71 |
| E-value | e−61 (median) | 0-e−13 |

Of the top 300 targets, 63 appear to have been identified specifically due to Genome Survey sequencing. Matches in the ESTs or other publicly available sequences are either missing or of substantially weaker scores (mostly paralogs). The rank of these genes among the top 300 is as follows:

23 in top 100: 1, 5, 7, 9, 15, 33, 35, 37, 38, 40, 44, 51, 53, 58, 60, 67, 68, 75, 80, 82, 83, 88, 96

15 in 2 nd 100: 102, 115, 134, 142, 148, 151, 152, 156, 163, 164, 191, 193, 199, 200

26 in 3 rd 100: 206, 208, 211, 219, 226, 231, 237, 241, 242, 247, 251, 254, 256, 258, 260, 261, 263, 267, 271, 272, 280, 281, 289, 292, 298, 300.

Example 6

Gene Expression in *H. glycines* and other Tylenchids

The expression of target genes in *H. glycines* and other Tylenchid plant parasitic nematodes was also monitored. Even within *H. glycines*, this process was imprecise since the identified transcript from the top 300 list may be the actual gene of interest in the cases where the top hit was an EST (237 out of 300) or a related homolog where the top match was to the genomic sequence (63 out of 300). Likewise, matches in related Tylenchids may be orthologs or homologs. Nevertheless, this information provides a starting point for looking at stage of expression. Expression in J2, J3, and J4 is particularly attractive as double stranded RNA delivery should be possible from the plant at these stages through the feeding site while the cyst is forming. Of genes with EST representation in *H. glycines,* 47% were represented by a single EST. 53% of genes were represented by two or more ESTs. 64% had representation in stages J2, J3, or J4. 165 of the 300 targets had orthologs or homologs among ESTs and other sequencing available from other *Tylenchid* plant parasitic nematodes including *Heterodera schachtii, Globodera rostochiensis, Globodera pallida, Meloidogyne incognita, Meloidogyne javanica, Meloidogyne arenaria, Meloidogyne hapla, Meloidogyne chitwoodi, Meloidogyne paranaensis, Pratylenchus vulnus, Pratylenchus penetrans, Radopholus similis* (Table 3).

TABLE 3

Evidence of Expression of Top 300 Targets in *H. glycines* and other Tylenchid species.

|  | total H. g ESTs | J2, J3, J4 H. g ESTs | Total ESTs Other Species |
|---|---|---|---|
| mean | 4.7 | 2.3 | 14.0 |
| sd | 22.0 | 5.3 | 64.3 |
| median | 1 | 1 | 1 |
| zeros | 22 | 122 | 135 |
| ones | 131 | 66 | 38 |
| twos | 43 | 46 | 12 |
| three or more | 102 | 64 | 113 |

Example 7

Target List for *H. glycines* RNAi

Disruption of target gene function within the plant pathogen soybean cyst nematode, *Heterodera glycines,* can be accomplished by RNA interference and can result in disruption of the pathogen's lifecycle. Optimal target genes for disruption include life-cycle essential genes where disruption results in high penetrance death of the parasite populations or "genetic death" by blocking of reproduction with minimal damage to the plant and minimal viable escaping worms reaching the next generation. The inventors have provided a process for selecting RNAi targets and a list of 300 target genes predicted to be essential to *H. glycines* reproduction. Key features used to predict targets include orthology to *C. elegans* known genes with strong and reproducible RNA interference phenotypes. The complete top 300 target list is provided in FIG. 3. Table 4 lists selected gene targets for assaying in plant tissues. Table 4: Selected Gene Targets for Soybean Hairy Root and in planta Assays

TABLE 4

Selected Gene Targets for Soybean Hairy Root and in *planta* Assays

| Gene Name | Matching Nucleotide Sequence | Location on Nucleotide Sequence | Peptide Sequence |
|---|---|---|---|
| Bli-3 | SeqID_1304 | 12-552 | SeqID_1889 |
| Bli-3 | SeqID_1487 | 12-552 | SeqID_1889 |
| C23H3.4 | SeqID_510 | 925-735 | SeqID_1056 |
| C23H3.4 | SeqID_814 | 586-776 | SeqID_1056 |
| C26E6.4 | SeqID_539 | 2836-3029 | SeqID_1051 |
| C34G6.6 | SeqID_511 | 3917-3429 | SeqID_1233 |

TABLE 4-continued

Selected Gene Targets for Soybean Hairy Root and in *planta* Assays

| Gene Name | Matching Nucleotide Sequence | Location on Nucleotide Sequence | Peptide Sequence |
|---|---|---|---|
| C34G6.6 | SeqID_790 | 244-732 | SeqID_1233 |
| Cct-4 | SeqID_1318 | 193-568 | SeqID_1741 |
| Cct-4 | SeqID_1537 | 193-568 | SeqID_1741 |
| Cgh-1 | SeqID_1289 | 319-795 | SeqID_1722 |
| Cgh-1 | SeqID_1513 | 280-756 | SeqID_1722 |
| Cgh-1 | SeqID_1289 | 1587-1761 | SeqID_1722 |
| Crs-1 | SeqID_535 | 1783-1487 | SeqID_1035 |
| Crs-1 | SeqID_792 | 1353-1649 | SeqID_1035 |
| Cyc-1 | SeqID_513 | 1375-1154 | SeqID_1046 |
| Cyc-1 | SeqID_804 | 529-750 | SeqID_1046 |
| F01G10.1 | SeqID_509 | 3122-3454 | SeqID_1055 |
| F01G10.1 | SeqID_813 | 690-1022 | SeqID_1055 |
| F52B11.3 | SeqID_508 | 3280-3088 | SeqID_1053 |
| F52B11.3 | SeqID_811 | 1036-1228 | SeqID_1053 |
| F54B3.3 | SeqID_524 | 2457-2222 | SeqID_1058 |
| F54B3.3 | SeqID_816 | 266-501 | SeqID_1058 |
| Kin-2 | SeqID_506 | 1310-1023 | SeqID_1032 |
| Kin-2 | SeqID_787 | 79-366 | SeqID_1032 |
| Kin-2 | SeqID_1921 | 15-464 | SeqID_1931 |
| Kin-2 | SeqID_1921 | 465-714 | SeqID_1931 |
| Kin-2 | SeqID_1926 | 211-460 | SeqID_1931 |
| Kin-2 | SeqID_787 | 265-514 | SeqID_1032 |
| Kin-2 | SeqID_787 | 514-663 | SeqID_1032 |
| Kin-2 | SeqID_1921 | 340-586 | SeqID_1931 |
| Kin-2 | SeqID_1926 | 86-332 | SeqID_1931 |
| Kin-2 | SeqID_787 | 140-386 | SeqID_1032 |
| Let-767 | SeqID_1306 | 328-687 | SeqID_1735 |
| Let-767 | SeqID_1528 | 295-654 | SeqID_1735 |
| Pas-4 | SeqID_1292 | 564-894 | SeqID_1724 |
| Pas-6 | SeqID_1290 | 314-859 | SeqID_1723 |
| Ran-1 | SeqID_1307 | 550-777 | SeqID_1736 |
| Rpt-1 | SeqID_1310 | 328-581 | SeqID_1737 |
| Rpt-1 | SeqID_1531 | 328-581 | SeqID_1737 |
| Rpt-1 | SeqID_523 | 1356-1609 | SeqID_1047 |
| Rpt-1 | SeqID_805 | 668-921 | SeqID_1047 |
| Sec61 alpha | SeqID_1330 | 93-488 | SeqID_1751 |
| Sec61 alpha | SeqID_1548 | 93-488 | SeqID_1751 |
| Top-1 | SeqID_1298 | 1-449 | SeqID_1729 |
| Top-1 | SeqID_1521 | 1-449 | SeqID_1729 |
| Top-1 | SeqID_1920 | 1569-2017 | SeqID_1930 |
| Top-1 | SeqID_1925 | 1565-2013 | SeqID_1930 |
| Uba-1 | SeqID_1923 | 1977-2184 | SeqID_1933 |
| Uba-1 | SeqID_1928 | 1715-1922 | SeqID_1933 |
| Uba-1 | SeqID_505 | 2500-2708 | SeqID_1031 |
| Uba-1 | SeqID_786 | 1562-1770 | SeqID_1031 |
| Vab-10 | SeqID_542 | 2871-3759 | SeqID_1028 |
| Vab-10 | SeqID_788 | 444-1332 | SeqID_1028 |
| Vha-12 | SeqID_1303 | 44-496 | SeqID_1733 |
| Vha-12 | SeqID_1526 | 1-453 | SeqID_1733 |
| Vha-12 | SeqID_793 | 1-453 | SeqID_1036 |
| Vha-13 | SeqID_1312 | 16-255 | SeqID_1906 |
| Vha-13 | SeqID_1533 | 16-255 | SeqID_1906 |
| Vha-13 | SeqID_514 | 1979-2218 | SeqID_1048 |
| Vha-13 | SeqID_806 | 707-946 | SeqID_1048 |
| Vha-15 | SeqID_519 | 1318-1137 | SeqID_1033 |
| Vha-15 | SeqID_789 | 997-1178 | SeqID_1033 |
| Y48B6A.3 | SeqID_1302 | 1755-2384 | SeqID_1732 |
| Y48B6A.3 | SeqID_1525 | 1697-2326 | SeqID_1732 |
| Y55H10A.1 | SeqID_1327 | 524-830 | SeqID_1748 |
| Y55H10A.1 | SeqID_1545 | 524-830 | SeqID_1748 |
| ZK1127.5 | SeqID_538 | 285-535 | SeqID_1050 |
| ZK1127.5 | SeqID_808 | 50-300 | SeqID_1050 |

Example 8

Selected *H. glycines* Genes Showing Efficacy in Blocking Soybean Cyst nematode Infection of Soybean Results from soaking assays show that orthologs (and fragments of such orthologs) of pas-4 (e.g. found at nucleotides 1-544 of SEQ ID NO:1292), pas-5 (e.g. found in SEQ ID NOs:525, 569, 797, nucleotides 1-672 of SEQ ID NO:1293, or in SEQ ID NO:1516), pas-6 (e.g. found at nucleotides 314-859 of SEQ ID NO:1290), and cgh-1 (e.g. found at nucleotides 931-1567 of SEQ ID NO:1289), among others, demonstrate efficacy in blocking soybean cyst nematode (SCN) reproduction. Each of these genes are found among the top 16 entries in FIG. 3.

Selected genes or gene fragments were also tested in a soybean hairy root assay (e.g. Narayanan et al., 1999), and plant tissues demonstrated resistance to SCN as shown in Table 5:

TABLE 5

Hairy root assay results demonstrating SCN resistance activity.

| Gene Name | Locus | Class I | Class II | Class III | Class IV | Total Exp |
|---|---|---|---|---|---|---|
| Sec61 alpha | Y57G11C.15 | 2 | 1 | 2 | 0 | 7 |
| Uba-1 | C47E12.5 | 8 | 2 | 2 | 0 | 16 |
| Kin-2 | R07E4.6 | 20 | 8 | 3 | 4 | 32 |
| Vab-10 | ZK1151.1 | 1 | 1 | 2 | 0 | 7 |
| Vha-15 | T14F9.1 | 4 | 2 | 1 | 0 | 8 |
| C34G6.6 | C34G6.6 | 1 | 2 | 0 | 1 | 7 |
| Y48B6A.3 | Y48B6A.3 | 0 | 1 | 0 | 0 | 2 |

TABLE 5-continued

Hairy root assay results demonstrating SCN resistance activity.

| Gene Name | Locus | Class I | Class II | Class III | Class IV | Total Exp |
|---|---|---|---|---|---|---|
| Crs-1 | Y23H5A.7 | 1 | 0 | 0 | 0 | 2 |
| Vha-12 | F20B6.2 | 0 | 1 | 0 | 0 | 4 |
| Pas-4 | C36B1.4 | 2 | 0 | 0 | 0 | 6 |
| Bli-3 | F56C11.1 | 3 | 0 | 0 | 0 | 3 |
| Cgh-1 | C07H6.5 | 1 | 0 | 0 | 1 | 9 |
| Let-767 | C56G2.6 | 3 | 0 | 1 | 0 | 4 |
| Pas-6 | CD4.6 | 2 | 5 | 0 | 1 | 7 |
| Ran-1 | K01G5.4 | 2 | 2 | 0 | 0 | 5 |
| Cyc-1 | C54G4.8 | 1 | 0 | 0 | 0 | 2 |
| Rpt-1 | C52E4.4 | 2 | 0 | 0 | 0 | 6 |
| Vha-13 | Y49A3A.2 | 3 | 2 | 1 | 0 | 8 |
| Top-1 | M01E5.5 | 18 | 8 | 2 | 4 | 26 |
| ZK1127.5 | ZK1127.5 | 0 | 2 | 0 | 0 | 2 |
| C26E6.4 | C26E6.4 | 1 | 1 | 1 | 0 | 3 |
| F52B11.3 | F52B11.3 | 2 | 1 | 1 | 0 | 3 |
| F01G10.1 | F01G10.1 | 6 | 1 | 3 | 1 | 10 |
| C23H3.4 | C23H3.4 | 2 | 1 | 0 | 0 | 5 |
| Cct-4 | K01C8.10 | 3 | 1 | 0 | 0 | 4 |
| F54B3.3 | F54B3.3 | 0 | 1 | 0 | 0 | 2 |
| Y55H10A.1 | Y55H10A.1 | 3 | 1 | 1 | 0 | 6 |

Classification of Efficacy for Table 5
Class IV: greater than or equal to 50% reduction in mean cyst number relative to mean cyst number for transgenic empty vector wild type control;
Class III: 35-49% reduction in mean cyst number relative to mean cyst number for transgenic empty vector wild type control;
Class II: 20-34% reduction in mean cyst number relative to mean cyst number for transgenic empty vector wild type control
Class I: having individual transformation events with greater efficacy than highest event efficacy seen with transgenic empty vector wild type control Transgenic soybean plants were prepared expressing fragments of genes encoding, for instance, Pas-4, Pas-5, Cgh-1, or Pas-6, and these plants were tested for SCN resistance. Results are shown in Table 6, demonstrating efficacy in reducing SCN infection and/or reproduction.

TABLE 6

Transgenic plant analysis for SCN resistance

| Gene Name | Locus | Promoter | Soy line | Class I | Class II | Class III | Class IV | Total Events tested |
|---|---|---|---|---|---|---|---|---|
| Pas-4 | C36B1.4 | FMV | Lee 74 | 6 | 3 | 1 | 0 | 12 |
| | | | A3244 | 6 | 2 | 0 | 0 | |
| Pas-5 | F25H2.9 | FMV | Lee 74 | 4 | 5 | 5 | 1 | 18 |
| | | | A3244 | 0 | 1 | 0 | 0 | |
| Pas-5 | F25H2.9 | E35S | Lee 74 | 2 | 4 | 4 | 2 | 16 |
| | | | A3244 | 1 | 1 | 1 | 0 | |
| Cgh-1 | C07H6.5 | FMV | Lee 74 | 4 | 2 | 2 | 2 | 11 |
| | | | A3244 | 0 | 2 | 1 | 1 | |
| Cgh-1 | C07H6.5 | E35S | Lee 74 | 5 | 13 | 2 | 2 | 27 |
| | | | A3244 | 6 | 2 | 0 | 2 | |
| Pas-6 | CD4.6 | FMV | Lee 74 | 5 | 1 | 2 | 1 | 14 |
| | | | A3244 | 1 | 1 | 2 | 0 | |
| Pas-6 | CD4.6 | E35S | Lee 74 | 7 | 5 | 0 | 0 | 20 |
| | | | A3244 | 3 | 1 | 0 | 0 | |

Classification of Efficacy for Table 6:
Class I: 10-20% reduction in mean cyst number relative to mean cyst number for Lee 74 or A3244;
Class II: 20-35% reduction in mean cyst number relative to mean cyst number for Lee 74 or A3244;
Class III: 36-50% reduction in mean cyst number relative to mean cyst number for Lee 74 or A3244;
Class IV: >50% reduction in mean cyst number relative to mean cyst number for Lee 74 or A3244

All of the compositions and methods disclosed and claimed herein can be made and executed without undue experimentation in light of the present disclosure. While the compositions and methods of this invention have been described in terms of the foregoing illustrative embodiments, it will be apparent to those of skill in the art that variations, changes, modifications, and alterations may be applied to the composition, methods, and in the steps or in the sequence of steps of the methods described herein, without departing from the true concept, spirit, and scope of the invention. More specifically, it will be apparent that certain agents that are both chemically and physiologically related may be substituted for the agents described herein while the same or similar results would be achieved. All such similar substitutes and modifications apparent to those skilled in the art are deemed to be within the spirit, scope, and concept of the invention as defined by the appended claims.

REFERENCES

The following references are incorporated herein by reference:

U.S. Pat. Nos. 4,536,475; 4,693,977; 4,886,937; 4,940,838; 4,959,317; 5,015,580; 5,107,065; 5,110,732; 5,231,020; 5,283,184; 5,302,523; 5,384,253; 5,464,763; 5,464,765; 5,501,967; 5,508,184; 5,527,695; 5,538,880; 5,459,252; 5,550,318; 5,563,055; 5,591,616; 5,593,874; 5,633,435; 5,693,512; 5,698,425; 5,712,135; 5,759,829; 5,780,708; 5,789,214; 5,804,693; 5,824,877; 5,837,848; 5,981,840; 6,118,047; 6,160,208; 6,326,193; 6,384,301; 6,399,861; 6,403,865; 6,506,559

U.S. patent application Ser. Nos. 10/465,800; 11/360,355

U.S. Pub. 2002/0048814; U.S. Pub. 2003/0018993; U.S. Pub. 2003/0061626; U.S. Pub. 2003/0150017; U.S. Pub. 2003/0175965; U.S. Pub. 2004-0029283; U.S. Pub. 2004/0098761; U.S. Pub. 2004/0133943; U.S. Pub. 2005/0188438; U.S. Pub. 2006/0037101; US Pub. 2006/0200878 A1

Aboobaker and Blaxter, *Mol. Biochem. Parasitol,* 129:41-51, 2003.
Altschul et al., *J. Mol. Biol.,* 215:403-410, 1990.
Ashrafi et al., *Nature,* 421:268-72, 2003.
Ausubel et al., In: *Current Protocols in Molecular Biology,* John, Wiley & Sons, Inc, New York, 1998.
Barker et al., In: *Plant and Soil Nematodes: Societal Impact and Focus for the Future,* Comm. Natl. Needs Priorities Nematol., Cooperative State Research Service, US Dept. Arig. Soc. Nematologists, 1994.
Bevan et al., *Nature,* 304:184-187, 1983.
Böckenhoff and Grundler *Parasitology* 109: 249-254, 1994.
Böckenhoff et al. *Plant Physiol* 112:1421-7, 1996.
Broothaerts et al., *Nature,* 433:629-633, 2005.
Brutlag et al., *Computers and Chemistry,* 17:203-207, 1993.
De Meutter et al. *Mol Plant Path* 6:321-325, 2005.
Dellaporta et al., In: *Chromosome Structure and Function: Impact of New Concepts,* 18th Stadler Genetics Symposium, 11:263-282, 1988.
Elbashir et al., *Genes Dev.,* 5(2):188-200, 2001.
EP 0 120516
EP 0 122 791
Fairbairn et al., "Plant Delivered RNAi (PD-RNAi): A novel strategy to control plant parasitic nematodes by inactivating nematode genes in planta", (Annual Meeting Abstract #372) American Society for Plant Biology, 2005.
Fire et al., *Nature,* 391(6669):806-811, 1998.
Fraser et al., *Nature,* 408:325-330, 2000.
Gheysen and Fenoll, *Annu. Rev. Phytopathol.* 40:191-219, 2002.
Gonczy et al., *Nature,* 408:331-336, 2000.
Gruber et al., In: *Vectors for Plant Transformation,* Methods in Plant Molecular Biology and Biotechnology, Glick and Thompson (Eds.), CRC Press, Inc., Boca Raton, 89-119, 1993.
Hamilton and Baulcombe, *Science,* 286:950-952, 1999.
Hannon, *Nature,* 418:244-251, 2002
Haymes et al., In: *Nucleic acid hybridization, a practical approach,* IRL Press, Washington, D.C., 1985.
Herrera-Estrella et al., *Nature,* 303:209-213, 1983.
Hirel et al., *Plant Molecular Biology,* 20:207-218, 1992.
Horsch et al., *Science,* 227:1229, 1985.
Hoth et al. *Plant Physiol* 138:383-392, 2005.
Hussein et al., *Mol. Biochem. Parasitol.,* 122:91-94, 2002.
Ikatu et al., *Bio/Technol.,* 8:241-242, 1990.
Jefferson et al., *EMBO J.,* 6:3901-3907, 1987.
Juergensen et al. *Plant Physiol* 131:61-69, 2003.
Kaeppler et al., *Plant Cell Rep.,* 8:415-418, 1990.
Kamath et al., *Genome Biol.,* 2:R02, 2001.
Kamath et al., *Nature,* 421:231-237, 2003.
Katz et al., *J. Gen Microbiol.,* 129:2703-2714, 1983.
Klee et al., *Bio/Technol.,* 3:637-642, 1985.
Kwa et al, *J. Mol. Biol.,* 3:246:500-510, 1995.
Lustigman et al., *Mol. Biochem. Parasitol.,* 138:165-70, 2004.
Maeda et al., *Curr. Biol,* 11:171-176, 2001.
Mazarei et al. *Mol Plant Path* 5:409-423, 2004.
Martinez et al., *Cell,* 110:563-574, 2002.
McCarter et al., *Genome Biology,* 4:R26,1-19, 2003.
McCarter, *Trends in Parasitology,* 20:462-468, 2004.
McManus and Sharp, *Nat. Rev. Genet.,* 3:737-47, 2002.
Miki et al., In: *Procedures for Introducing Foreign DNA into Plants,* Methods in Plant Molecular Biology and Biotechnology, Glick and Thompson (Eds.), CRC Press, Inc., Boca Raton, 67-88, 1993.
Moloney et al., *Plant Cell Reports,* 8:238, 1989.
Narayanan et al., *Crop Sci.* 39:1680-1686, 1999.
Odell et al., *Nature,* 313:810-812, 1985.
Omirulleh et al., *Plant Mol. Biol,* 21:415-428, 1993.
Opperman et al., *Science* 263:221-223, 1994.
Ow et al., *Science,* 234:856-859, 1986.
Padgette et al., *Crop Sci.,* 35:1451-1461, 1995.
Papp et al., *Nature,* 424:194-197, 2003.
Parkinson et al., *Nature Genetics,* 36:1259-1267, 2004.
PCT Appln. WO 06/073727
PCT Appln. WO 05/019408
PCT Appln. WO 03/052110 A2.
PCT Appln. WO 97/32016
PCT Appln. WO 99/49029
PCT Appln. WO 99/53050
PCT Appln. WO 94/01550
PCT Appln. WO98/05770
Piano et al., *Curr Biol.,* 10: 1619-1622, 2000.
Piano et al., *Curr Biol.,* 12:1959-64, 2002.
Potrykus et al., *Mol. Gen. Genet.,* 199:183-188, 1985.
Redmond et al., *Mol. Biochem. Parasitol.,* 112:125-31, 2001.
Reynolds et al., *Nat Biotechnol.* 22:326-330, 2004.
Sambrook et al, (ed.), *Molecular Cloning,* Cold Spring Harbor Laboratory Press, Cold Spring Harbor, N.Y., 1989.
Simmer et al., *PLoSBiol,* 1:E12, 2003.
Sonnichsen et al., *Nature,* 434:462-469, 2005.
Sutcliffe, *Proc. Natl. Acad. Sci. USA,* 75:3737-3741, 1978.
Thurau et al. *Plant Mol Biol* 52:643-660, 2003.
Urwin et al., *Mol. Plant Microbe. Interact.,* 15:747-752, 2002.
Vaghchhipawala et al. *Genome* 47:404-413, 2004.
Van Heeke and Schuster, *J. Biol. Chem.,* 264:5503-5509, 1989.
Winston et al., *Science,* 295:2456-2459, 2002.
Zukowski et al., *Proc. Natl Acad. Sci. USA,* 80:1101-1105, 1983.

SEQUENCE LISTING (1934 sequences)

SEQ ID NO: 1 - protein, 1487 aa, Caenorhabditis elegans
  C elegans public gene name=C37C3.6
  genomic DNA homolog sequence=SeqID_302
MRLLLFSAALLLCSVPTWAFSLSSFFGSDVAQKPYLHPNSPPERDPASSRMKRQAYQVYVDGDVSVTVDKSGQKETGNWGPWVPENECSRSCGGGVQLEKRQCSGDCTGASVRYISCNLNACESGTDFRAEQCSKFNDEALDGNYHKWTPYKGKNKCELVCKPESGNFYYKWADKVVDGTKCDSKSNDICVDGECLPVGCDGKLGSSLKFDKCGKCDGDGSTCKTIEGRFDERNLSPGYHDIIKLPEGATNIKIQEARKSTNNLALKNGSDHFYLNGNGLIQVEKEVEVGGTIFVYDDAEPETLSAQGPLSEELTVALLFRKGSRDTAIKYEFSIPLEEEVDYMYKFDNWTPCSVSCGKGVQTRNLYCIDGKNKGRVEDDLCEENNATKPEFEKSCETVDCEAEWFTGDWESCSSTCGDQGQQYRVVYCHQVFANGRRVTVEDGNCTVERPPVKQTCNRFACPEWQAGPWSACSEKCGDAFQYRSVTCRSEKEGEEGKLLAADACPADEQEKFDTERTCNLGPCEGLTFVTGEWNLCTRCNDTEETREVTCKDSQGRAYPLEKCLVDNSTEIPTDTRSCATQPPCEYEWTVSEWSKCTTECGHGHKTRRVICAIHQNGGLEVVDEGHCQAEKPEGKTNCTNEEKCTGTWYTSSWSECTAECGGGSQDRVAVCLNYDKKPVPEWCDEAVKPSEKQDCNVDDCPTCVDSEFGCCPDNSTFATGEFNFGCSNCSETEFGCCADNVTVATGPNSKGCEEFVESPLNLEADVANADAEASGDAPELCSVTNENGEAVDVECATIAPITALLGDGELIGNDTDASNETIHCSKTEFGCCPDWYTAASGKGNEGCPSFTLGGCNETQFGCCHDDVTLARGANLEGCGEPSCAASLYGCCKDRKTIAFGPHYSGCERSSFPCELSDFGCCPDGETAALGKNGTGCGENCLTTKFGCCPDGKTTAKGSHNEGCGCEFAQYGCCPDGKSVAKGAGFYGCPESCAQSQFGCCPDGKTRARGENKEGCPCQYTRYGCCPDGETTALGPRNDGCDNCRYAKHGCCPDGETKALGPDGAGCPPTTTPPFLMGGTVAPHKIAACNQTQESGTVCGAGYKLAWHYDTTEGRCNQFWYGGCGGNDNNFASQDMCETICVEPPGKGRCYLPRVDGPLRCDQLQPRYYYDHSKKHCVAFWWRGCLGNANNFNSFEECSMFCKDVGPYDAPTTAAPPPPPQQNAQQYLPTPEVQQIEIQSAEQPQPQQPQQQQQQQQQQPQQPRQSMEDICRSRQDAGPCETYSDQWFYNAFSQECETFTYGGCGGNLNRFRSKDECEQRCFFVHGAQPSAARQEQAQPAAQPAQPAQPSNIVSPPQQSASPVVVPYGAAGINSVCDEAKDTGPCTNFVTKWYYNKADGTCNRFHYGGCQGTNNRFDNEQQCKAACQNHKDACQLPKVQGPCSGKHSYYYYNTASHQCETFTYGGCLGNTNRFATIEECQARCPSKF

SEQ ID NO: 2 - protein, 240 aa, Caenorhabditis elegans
  C elegans public gene name=B0564.1
  genomic DNA homolog sequence=SeqID_412
  cDNA homolog sequence=SeqID_1420
MNIISEHGFRIDGRRPAQIRNINTRLGLNRNAEGSCYLEHGNTKVLCAVYGPYEGKSSKRIEDKCAIVCQYSATKFSGLERKNRTRGDRKSTEISRLLEKAFESVILTEAFPRSQLDIFCEVIQGDGSNLAACVNATSLALADAGIPMKGIASAATCGVVDGKPIVDLTSREETDLLPRVTLATICGRDEVILVELQNRLHIDHLSTVMDAAKATCADVYECLAVVAQQHLKACAPILGN

SEQ ID NO: 3 - protein, 538 aa, Caenorhabditis elegans
  C elegans public gene name=H28O16.1
  genomic DNA homolog sequence=SeqID_400
  cDNA homolog sequence=SeqID_1342
MLSKRIVTALNTAVKVQNAGIATTARGMAGASGSEVSKILEERILGTETGINLEETGKVLSIGDGIARVYGLKNIQAEEMVEFDSGIKGMAMNLDVDNVGVVVFGNDKVIREGDIVKRTGAIVDVPVGDGLLGRVVDALGNPIDGKGPIANARRSRVEVKAPGIIPRLSVREPMVTGVKAVDSLVPIGRGQRELIIGDRQTGKTAIAIDTIINQKRFNDAGDDKKKLFCIYVAVGQKRSTVAQIVKRLTDAGAMDYTIVVSATASDAAPLQFLAPYSGCAMGEHFRDNGKHALIIFDDLSKQAVAYRQMSLLLRRPPGREAYPGDVFYLHSRLLERAAKMNNSLGGGSLTALPVIETQAGDVSAYIPTNVISITDGQIFLETELFYKGVRPAINVGLSVSRVGSAAQTKAMKQVAGSMKLELAQYREVAAFAQFGSDLDASTQQLLNRGVRLTELLKQGQYVPMGIEEQVGVIYAGVKGYLDKVDPSAITKFEKEFLAHLRSSQQALLKTIREEGQISPQTDAQLKDVVVNFLATFKP

SEQ ID NO: 4 - protein, 406 aa, Caenorhabditis elegans
  C elegans public gene name=F23F1.8
  genomic DNA homolog sequence=SeqID_317
  cDNA homolog sequence=SeqID_1413
MLLLQFSNMVEPTGPAIVEDERTKALNSYRRKLAECRDIEQKLKDLRKKESEMTKQFDKSENDIKSLQSVGQIVGEVLKQLSEEKFIVKATNGPRYVVGCRRSINKEELKQGTRVSLDMTTLTIMRQLPREVDPLVYKMSHEDPGNISYSDVGGLAEQIRELREVVELPLINPELFKRVGITPPKGCLLFGPPGTGKTLLARAVASQLDCNFLKVVSSAIVDKYIGESARMIREMFNYARDHQPCIVFMDEIDAIGGRRFSEGTSADREIQRTLMELLNQLDGFDSLGKVKVIMATNRPDTLDPALLRPGRLDRKIEIGLPNEQSRLEILKIHSNKITKHGEIDFEAVVKLSDGFSAADLRNVCTEAGMFAIRAEREFVIDEDFMKAVRKVGDAKRLETKLDYKPV

SEQ ID NO: 5 - protein, 830 aa, Caenorhabditis elegans
  C elegans public gene name=C02C6.1
  genomic DNA homolog sequence=SeqID_504
  cDNA homolog sequence=SeqID_1329
MSWQNQGMQALIPVINRVQDAFSQLGTSVSFELPQIAVVGGQSAGKSSVLENFVGKDFLPRGSGIVTRRPLILQLIQDRNEYAEFLHKKGHRFVDFDAVRKEIEDETDRVTGQNKGISPHPINLRVFSPNVLNLTLIDLPGLTKVPVGDQPADIEQQIRDMILTFINRETCLILAVTPANSDLATSDALKLAKEVDPQGLRTIGVLTKLDLMDEGTDAREILENKLFTLRRGYVGVVNRGQKDIVGRKDIRAALDAERKFFISHPSYRHMADRLGTSYLQHTLNQQLTNHIRDTLPTLRDSLQKKMFAMEKDVAEYKNYQPNDPGRKTKALLQMVTQFNADIERSIEGSSAKLVSTNELSGGARINRLFHERFPFEIVKMEIDEKEMRKEIQYAIRNIHGIRVGLFTPDMAFEAIAKKQITRLKEPSLKCVDLVVNELANVIRQCADTMARYPRLRDELERIVVSHMREREQIAKQQIGLIVDYELAYMNTNHEDFIGFSNAEAKASQGQSAKKNLGNQVIRKGWLSLSNVSFVRGSKDNWFVLMSDSLSWYKDDEEKEKKYMLPLDGVKLKDIEGGFMSRNHKFALFYPDGKNIYKDYKQLELGCTNLDEIDAWKASFLRAGVYPEKQKAQEDESQQEMEDTSIDPQLERQVETIRNLVDSYMRIITKTIKDLVPKAVMHLIVNQTGEFMKDELLAHLYQCGDTDALMEESQIEAQKREEMLRMYHACKEALRIISEVNMSTLGDQPPPLPMSDYRPHPSGPSPVPRPAPAPPGGRQAPMPPRGGPGAPPPPGMRPPPGAPGGGGGMYPPLIPTRPGPGGPPPNMAPPR

SEQ ID NO: 6 - protein, 473 aa, Caenorhabditis elegans
  C elegans public gene name=Y57G11C.15
  cDNA homolog sequence=SeqID_1330
MGIKFLEFVKPFCGFVPEVSKPERKIQFREKMLWTAITLFVFLVCCQIPLFGIMSTDSADPFYWLRVIMASNRGTLMELGISPIVTSGLIMQLLAGAKIIEVGDTPKDRALFNGAQKLFGMVITVGQAIVYVMSGLYGEPSEIGAGICLLIVVQLVIAGLIVLLLDELLQKGYGLGSGISLFIATNICETIVWKAFSPATMNTGRGTEFEGAVIALFHLLATRSDKVRALREAFYRQNLPNLMNLMATFLVFAVVIYFQGFRVDLPIKSARYRGQYSSYPIKLFYTSNIPIILQSALVSNLYVISQMLAGKFGGNFFINLLGTWSDNTGYRSYPTGGLCYYLSPPESLGHIFEDPIHCIIYIVFMLGSCAFFSKTWIDVSGSSAKDVAKQLKEQQMVMRGHREKSMIHELNRYIPTAAAFGGLCIGALSVTADFMGAIGSGTGILLAVTIIYQYFEIFVKEQQEMGGVSAMFF

SEQ ID NO: 7 - protein, 1113 aa, Caenorhabditis elegans
  C elegans public gene name=C47E12.5
  genomic DNA homolog sequence=SeqID_505
  cDNA homolog sequence=SeqID_1923
MTTILELTSANKTNNKATNNKLQREGENEYPPAKRSKTDDEEEPTVVGNGTIVGAPKQQTLSGVNQSGNVNVETTKNTEGQDGEKMDTSNNAGGVGGNSDELLDKNLYSRQIYTLGESAMVNLRTASVLISGLGSVGVEIAKNLILGGVRHVTIHDTKLAKWSDLSAQYYLRDADVGHNRATSCYERLAELNDSVNVQVSTDELTEEFVKTFDLVVLTDAARTAQRQIAAWTRAHNRRILITDARGVFSYIFNDFGDNFRIDDATGEQVREFFIEHIDKTTGEVTTLENLFHGLEDGDHVTFSEVKGLTEINGCEPLKITVKNASKFNIGDFAVSFSDYKEGGRCRQVKVPTSVSHVPFEKSLVEPEFGIWDYAKFEYPSQLHALWTALYAFEEKYGRSPAPRSTQDAALLKELIPSGTEEIPEKLIELFSFSASGNLVTVSSVVGGIAAQEAMKGVTHHMTPLKQWLHLDHVEVLPGDWTSFDNSKLSETDCQPRQSRYDGQAAVFGWPYQECLFRQRWFVVGAGAIGCELLKNLSMMGVACGEGGLIKITDMDQIEISNLNRQFLFRRRDVGGKKSECAARAVTAFNSDVRIEALAERVGLETEHIFNDEFFGELNGVANALDNVDARRYMDRRCVYYRLPLLESGTMGTKGNTQVVYPYLTESYSSSVDPPEKEIPVCTLKNFPNEIQHTIQWAREQFETFFAQPGEMANKFLSDERGFNEHVDKLISGQQIDILQKVKDALIDARPSSAEDCIRWARNQFQELYHNNIAQMLHSFPPDQLTDSGAKFWSGAKRCPHVLNFDPSKEEHFNFVFAASILIAELYGVQPILDREEVIRVALSVNPEPFEPKSGVKIAVTDAEAKEQNERGASSMIVDDDAAIEALKLKLATLNVKSTSKLNCVDFEKDDDSNHHMEFITAASNLRAENYDILPADRMRTKQIAGKIIPAIATTTAAVAGLVCIELYKVVDANGIPKTPMERFKNTFLNLSMPFFSSAEPIGAPKKTYMDREFTLWDRIDVQGPLTLQEFIDNVQNQTGGCEVSMLSAGACLLFSFFMNAGKKQERLKTEVKAVYEELLKKSLHPSVHALVLEPMMSDPDGEDVEVPYIRYSF

SEQ ID NO: 8 - protein, 334 aa, Caenorhabditis elegans
  C elegans public gene name=R07E4.6
  genomic DNA homolog sequence=SeqID_506
  cDNA homolog sequence=SeqID_1921
MGQQLSNRRNSQSVGATKNAKTPKPKEGGNPDAADDDDIIVEPPKRSGGRRTGISAEPIKEDDTEYKKVVIPKDDATRRSLESAMRKNLLFAHLEEDEQKTMYDAMFPVEKSAGETIIEQGEEGDNFYVIDKGTVDVYVNHEYVLTINEGGSFGELALIYGTPRAATVIAKTDVKLWAIDRLTYRRILMGSVTKKRKMYDEFLSKVQILADLDQWERANVADALERCDFEPGTHVVEQGQPGDEFFIILEGEANVLQKRSDDAPFDVVGHLGMSDYFGEIALLLDRPRAATVVAKTHLKCIKLDRNRFERVMGPVREILKRDVSNYNSYVKLMT

SEQ ID NO: 9 - protein, 3323 aa, Caenorhabditis elegans
  C elegans public gene name=ZK1151.1
  genomic DNA homolog sequence=SeqID_542
  cDNA homolog sequence=SeqID_1301
MVGERYRSHHAVDPSDAQEKEVLDHYELNREKYNDERDNVQKKTFTKWVNKHLSKTDHKIDDLFVDLRDGYALIALLEALTGERIQKENGYTRFHRIQNVQYCLDFLKKKNIKLVNIRPEDIVEGNGKLTLGLIWTIILNFQVSVIRQRLLLESSQHEQMSAKHTTTNSQVSLHGSDATSARDALLQWARRVTAGYPRVNVNNFSSSWRDGLAFNAILHRYRSSAIDWNKISSDSVSNTERLNNAFAAADREFGVERLLDAEDVDTNNPDEKSIITYVSSLYNALPHEPEMSRGNSNDLLSRLARGIGITNEKLDLILKRIEDVEARVDTSPPAAVERTVSEIVDDLNALESPIARFFEDVEELKSMQHPEANDFYKQVYGLHQRRTTYLDRLTNQILVRLGVRTDSLHKENQQRLENMRKTSFSRVEECIEWVRVRMEKLTTMEFLEDLETLEHVFEQHKFDNRDIQDFRQNVDECIARQAEVSAEDTYEYCELLRVLESEYQQLRDLSAGRMLDLDSLIAFVRAAQLELIWVSERESIEVTRNWSDIKQLDLPMLTNYYKQLLHEMELREKQYNDVHNQGAALLNQGHPAIRVIEVYLRQMQSQWDWLLALSKCLEEHLRDALNLKSFMEEASDAEAWIQEQSVRLENNYNRTDFSLEEGERFLRELDEIKEILNKYHQVLMALTERCASISPLWQRGERIPHPIKVTALCDYSDENVTIKAGDDVYLLDNSDLIKWTIRDISGAEGQVPSVVFRIPPTDARLTALLNRLLQQFEKLKKLWDKKHRMVRFNMVLNTMRTIQGWDLDTFNSIDPDQRDAIMKALNDDANKLLSELDPNDPLALRLREELRRTNEHFWNLLNASQKPPEPDWASQYDQKMAELLKKLEEAWRELNDAVGKPISRSPEDLERVIHAHKRFEDALQALDSDVANVKELFRQLPNPTPTQRVNHDRLNGLWDDLWDLSRMYVERIKVLESVLNGMVEVADIVRQHEITLNSFDDLPAALDKLRGHHSQLLEINMVLKVSKLGAQNEHFSQQQTVIDQLNRNVALLRQHVSRTRINEGHHPDVDAIEDEVQKLNVRWENVNSQIASRLLAVESALQIQMVYRSEYETEMSWLDTVEETINRLRKPEELRPEQYQQQLDMLIAEYTNLQEHTQAIEHVNKEGGRFIHEAKIFDAKLGQYSDGIVGIHGPGIKSEFRRTKPQPKNGSQIVTEELELLNRRFAQLSSLILERRNTMQVLIQNWKRQKQEEEDRRRAEEEEKRRAFEAARLKALEDAERLRREREDAEARRRAKDDADRARRMAEDAERARREAEEAERRRREEEERRRREAEDRKRRQDEEDRRRREEEERRRREEEEKRRKKPDFDLKIQKPTMNIEPVVTSAGDEWEIVDPIGDRAKISEVEDEMQTFAEETITNTQFYEMEGNLNKKTGEVLTFIEAIRQGNLTAAGQFFDIPSASVMSLEEAAKYGLVEQDLPTVLNTTWGIHHPETRQPITLSEAIRIGLYDSNIRQFRDIHTGEILSQSDLMSKGIANWETVLKLIKEKIMKLPPTSLANALEKRMVDPQTGVFKGRTTDMELQLWAAIYHGYLSIENPEHVTTIGTSLTDAIENGFINANNAEFNDRNSNDSFKLRDAVSKRTGLINNDVVEIVQMTDDEKKRVPLGAALVRNVIGVKDGKYTNLASRQSMSLKEAHQDGLIGKALTLEEAAQNKLVDSSGYFVDRGILGQRYTLLEAIVAGLIDAEVRHIVDPNENDVISISEAMERGLLLPNGKIVLEKDEKEFTIPEAVHEGLLTKRVRHSIFNIRGIRNTETSQNLSFNEAVEAGVIIPNAERVVDLQTQESFLITDDRAKNLIEVALHELLTTPVGIKNDRGAYELNLVRAVSSGIIDPVKGVFFNKNTKHELSTKEAYEQGFITLRGALKVFGLLNVPPALVTPAKKLDRTRRIGRPGQEGGADGNHVTVTLQDAMRQGLVGNQRYVHGKVDLSLEEALNRGLLDPNSQWIMPDQSKGDGPTIEEKTTETMTETGQQLAPKYFPDKNIEESVTTVKRVRTTETTALGGPGGVSVYRSIAGGKGALEVPSRGYHIYEAERKGLIDLTNGKISAPNVDRVLSFAEGIELGIIDATTIQVSTGGRSVSVKEALEKKIMESDGSVNGRNIEQAVEAKTIVIDAEPLVPYNNQSKNIIQIPSGNGPIISFRQVGQPVVEESTQSWEFDTQQGVFVDNLTGEKLSLERALATGKVAPEDISVRDGLTGREMPLEEAEKWGIIDSKNRYYFDKSQNKRMSYTEAAQQHLMYLTGGVPENASDAVHTTVKVQTRTAVAKKEALSSGLPLSDYSLGKALSLGWYDQSAGTFTHPETQKQLTLKEAIMKGLFDPYDTTIVDKKAGKEISLLEAIREEIVDDNAGTVKDTQTGRVHNFLEAGNLGLVKGKNFGDTLDSSLFSGRLDLGSGSYTRPSGGSSMPIHEAINRNYVDRSSVSVRDPSSGQQYSYQEAVDRRIVDADRGLIHGGGDSTSFSQGLTSGHLVSSGSSRPTSGNQSRLVEQRLQLTPFAPNGGAGRSRDGRHELVDLGGGQQVQVKVVRGEGGVEKGEYTDPKSGMKFTIQMHGDPVVTETKTSVKSTSQVHSVELEPHAEFVGIDRVRDKRNNHVYSLEEARRLGLAKVDKKGKQMTRSYQAFRSNIDNAVNNGVVDSHNQKISLENAIHARIIDIRNLSYHHPTHGSVDLKTAASQGLVDVTLSEVLPKGIIHPGTGERIDIKRGIELRIIDAATGKVRDPRDNKTITWIDILKPVYQAIASEGVFDPTKGHHVPVTTALNDGLINASTGNYRNSITGEDVPLSDTVDRGLIDRSTYETITKPFFTDYRSNRKLNLVEAVRERLIDPKNRTIQLSRQSIVPIAKAVQDGRIPMEIGEKLRKVDKLNFAEALGKGLIDSKQNVFTDPDTGRQMSIAQAIQEGFIDTGSVQGIEGNDESNLFNVLQSSDFDETSGRIYDKKSSLHLTFNDAVRRGVIDGDSLLHLQATGDLLTLRDALHQNKIDSNGKFVEGANRLKISDAVKSGRLTVIASPSEAVQAVTEGVKRRDAEGYKFRISEYDDSQAQRQSVPKFRETVTVSKLTPQYNEPGLSVRMRQSTTSIGDRASKFLEDPSQLAEIQQDFLSSLEAAQFDTDEKVIEHPHTRQRVSVREAAETGLLDVQTGEIVNPDNGRRFSIPRAVHMKLVGGDAAKRIMEQLNMPVEEVAYATQTITSSTHRAPSPVFATASVSQPSGGATTTREFTRTINWHGQPSELRNSQTDPLAAYTTVSSNVTESTEDAPAWARKQ

SEQ ID NO: 10 - protein, 470 aa, Caenorhabditis elegans
  C elegans public gene name=T14F9.1
  genomic DNA homolog sequence=SeqID_519
  cDNA homolog sequence=SeqID_1297
MAEVPHHNIPAVDMLNATSRLQLEAQELRNNKPNWGSYFRSQMIQEDDYNFITSFENAKSKEERDQVLAANNANGQAAKTMANLITQVAKDQNVRYVLTLFDDMLQEDKSRVELFHSAAARQKRTVWSQYLGILQRQDNFIVNQMSSIIAKLACFGTTRMEGQDLQYYFSFLKEQLKNSTTNDYMNTTARCLQMMLRHDEYRHEFVDSDGVQTLVTALNGKTNFQLQYQLIFAVWCLTFNADIARKAPSLGLIQALGDILSESTKEKVIRIILASFVNILSKVDEREVKREAALQMVQCKTLKTLELMDAKKYDDPDLEDDVKFLTEELTLSVHDLSSYDEYYSEVRSGRLQWSPVHKSEKFWRENASKFNDKQFEVVKILIKLLESSHDPLILCVASHDIGEYVRHYPRGKTVVEQYQGKAAVMRLLTAEDPNVRYHALLAVQKLMVHNWEYLGKQLDSDVQTDTVAVK

SEQ ID NO: 11 - protein, 1069 aa, Caenorhabditis elegans
  C elegans public gene name=C34G6.6
  genomic DNA homolog sequence=SeqID_511
MKVFAVLALVVASVLADTLPSVTLCPPETQTIFVLQHNTTVGARIRTIPTSNLAECSDHCSASLDCQGVEFKDGSCAVFRAGSEKATAGSQLLTKTCVKSDRVCQSPFQFDLFEQRILVGFAREVVPAANIQICMAACLNAFDTFGFECESAMFYPVDQECILNTEDRLDRPSLFVEESDDTVIYMDNNCAGFPLVFKNYNYQKTTFSKSQCYPPYITQYIAVEGKQLKNELDRIINVDLDSCQALCTQRLSISSNDFNCKSFMYNNKTRTCILADERSKPLGRADLIATEGFTYFEKKCFASPNTCRNVPSFKRVPQMILVGFAAFVMENVPSVTMCLDQCTNPPPETGDGFVCKSVMYYYNEQECILNSETRESKPELFIPEGEEFLVDYFDITCHLKQEKCPTGQHLKAIRTINAALPEGESELHVLKASAAKGIKECVAKCFGLAPEKCRSFNYDKKTKSCDLLYLDGHNTLQPQVRQGVDLYDLHCLAAMPLVENDCSANKDDALFSRYLHTKQRGIPAKVYKVVSLNSCLEVCAGNPTCAGANYNRRLGDCTLFDAIDDDAEINEHTDFYKNLCVTKEIDTGASAAANVPETKHRVSGTVVEGKDSKSQLLATKKVKKPTIKNTEHRRAPESTVPIGPPVEVKAEAIQTICNYEGIKVQINNGEPFSGVIFVKNKFDTCRVEVANSNAATLVLGLPKDFGMRPISLDNIDDNETGKNKTKKGEETPLKDEIEEFRQKRQAAEFRDCGLVDLLNGTYKSTVVIQTNNLGIPGLVTSMDQLYEVSCDYSSMLGGRVQAGYNMTVTGPEANLIQPRGKIELGNPVLMQLLNGDGTEQPLVQAKLGDILELRWEIMAMDDELDFFVKNCHAEPGVAGGKAGAGEKLRLIDGGCPTPAVAQKLIPGAIEIKSSAVKTTKMQAFRFDSSASIRVTCEVEICKGDCEPVECALTGGVKKSFGRKKREVSNNIEEFETNRYLIPRRSHATTSIVIIDPLQQVNEPVAMSRASTLDLLREDAHEVQMIEEGSICLNSVTVFAIFGTLAVLILGQTVVIAHYAVRRFSSEKTA

SEQ ID NO: 12 - protein, 892 aa, Caenorhabditis elegans
  C elegans public gene name=Y48B6A.3
  genomic DNA homolog sequence=SeqID_531
  cDNA homolog sequence=SeqID_1302
MGVPAFFRWLTKKYPATVVNANEDRQRDQDGNRVPVDCTQPNPNFQEFDNLYLDMNGIIHPCTHPEDRPAPKNEDEMFALIFEYIDRIYSIVRPRRLLYMAIDGVAPRAKMNQQRSRRFRASKEMAEKEASIEEQRNRLMAEGIAVPPKKKEEAHFDSNCITPGTPFMARLADALRYYIHDRVTNDASWANIEIILSDANVPGEGEHKIMDYVRKQRGNPAHDPNTVHCLCGADADLIMLGIATHEANFNIIREEFVPNQPRACDLCGQYGHELKECRGAENETDLGDDYCKPEQREKNFIFLRIPVLREYLEKELSMPNLPFKFDVERALDDWVFLCFFVGNDFLPHLPSLEIREGAIDRLIKLYKEMVYQMKGYLTKDGIPELDRVEMIMKGLGRVEDEIFKRRQQDEERFQARMCREESPADIASRKRKAEQPLIKPEEEEDEGPKDDIRLYESGWKDRYYRAKFDVGSDDIEFRHRVAWAYVEGLCWVLRYYYQGCASWDWYFPYHYAPFASDFETVGEFQPDFTRPTKPFNPLEQLMSVFPAASKQHLPVEWQKLMIQDDSPIIDLYPADFRIDLNGKKYAWQGVALLPFVDETRLLATLQSVYPTLTAEEKQRNTRGPNRIFIGRNHKSFEFFQQVAESKSDDLVPLDPTLLNGVSGKIAYDSTATAPGLPFVSPVNHDECQDLPTNCGICVLYEDPEYPQDYIFPALRLDGAKEPEKTLKPDDWNDRRDGRYQPQVGFNRNAPRGSLDQSGHRQVHHYVRGGGGGGGGYRGNSYDDRRGGGGGGGGYNDRQDFGRNYGGRDGGGPQRYHDQQQQRQGGYQGGGYGGGYGGGGGGGGGGGGGSYHQPYNQDQRRGGRGGGGGPPGYQRPPYRGGGGGGYHGNSSWR

SEQ ID NO: 13 - protein, 908 aa, Caenorhabditis elegans
  C elegans public gene name=Y23H5A.7
  genomic DNA homolog sequence=SeqID_535
MHLKNIFCYEKSKKNRNFKKKPFFGCGFLNLKRFLICLNVKFLGKQHFIRFSISPHPFIRSNSSKYIYSPFIFCHRTANSCVAVCSLFTCLHSLVLLLHSSKTTAFLGVFVRKFGTTRSKNLVRVLLFASFNRNQTQLFAWNCSKLQLRSHHHCIMDPNLRPAVKRVQKHWDQPKNATPPPQLTVYNSLTRQKEVFVPNEGKRVRWYICGPTVYDSSHMGHARSYLSLDILRRVFRDYFGYDVEFIMNITDVDDKIIKRARQSHLLKSYFNESQAPPVMKVCEDVVAALEHFKTKFETEMDPDKKKMFEVMIKKVQQQSSALEEAMKAQDSIATEEAKGRLLNESRDVLSEWLDHNHGKDVRDHSVFDDLAKTYEKEFLADMARLNVLPVDVLTRVSEYVPEVITYVKKIISNGYAYAAEDGSVYFDTKAFEQNPKHFYAKLVPEAYGEDSEQLLKNMKESEGELSMSDDRLKSKRSPNDFALWKSSKDGEPFWPSEWGNGRPGWHIECSVMSSAICGSKLDIHAGGFDLKFPHHDNEIAQVEAHYDDPHWVNYFLHCGTLRIQGMKMSKSLKNFITIRKALEDYTPRQLRLLFLMHNWADVLDYSSSTMERALQFEKITNEFFLLVKDFLRRHYKPDRSEGYQKFQGKELKLMEEFGKLKSEVHEALCDSVDTRSVIEKFRELISLGNAYIVEKEKEGHVPNCLLLRNIAAYITNLLKIFGAIPQSNQEIGFVSEDECNGEGASTSFNKEAVVMPYLDALAQFREKVRLIAKEHKVNGILEECDTLRDKTLTELGVRLEDRNGQTVVKLVDRATLLREQEQKDTEKKRKDKEKADKEQKAREKADKEAAAKKIKPEELFKQGEHVGKYSKFDERGVPTHLADGTEITKSQIKKLEKVYEAQKKKYQQ

SEQ ID NO: 14 - protein, 491 aa, Caenorhabditis elegans
  C elegans public gene name=F20B6.2
  genomic DNA homolog sequence=SeqID_532
  cDNA homolog sequence=SeqID_1303
MAAVDVNQPITGHKSAIIRNYNTNPRLIYQTVCGVNGPLVILNDVKFPQFSEIVKITLPDGSKRSGQVLEISKNKAVVQVFEGTSGIDAKNTICEFTGDILRTPVSEDMLGRIFNGSGKPIDKGPPVLAEDFLDINGQPINPWSRIYPEEMIQTGISAIDVMNSIARGQKIPIFSASGLPHNEIAAQIVRQGGLVQLPDRPHEQTNFAIVFAAMGVNMETARFFKQDFEENGSMENVCLFLNLANDPTIERIITPRIALTSAEFLAYQCKKHVLVVLTDMSSYAEALREVSAAREEVPGRRGFPGYMYTDLATIYERAGRVEGRDGSITQIPILTMPNDDITHPIPDLTGYITEGQIYVDRQLHNRLIYPPINVLPSLSRLMKSAIGEGMTREDHSDVSNQLYACYAIGKDVQAMKAVVGEEALSSDDLLYLEFLTKFEKNFITQGHYENRSVFESLDIGWQLLRIFPREMLKRIPESTLEKYYPRGGAKE

SEQ ID NO: 15 - protein, 312 aa, Caenorhabditis elegans
  C elegans public gene name=K07D4.3
  genomic DNA homolog sequence=SeqID_520
MERFLRLGGLGGNLGTFGANPQDSNQVDTSETVYISSLALLKMLKHGRAGVPMEVMGLMLGEFVDDYTVNVIDVFAMPQSGTGVSVEAVDPVFQAKMLDMLKQTGRPEMVVGWYHSHPGFGCWLSGVDINTQQSFEALSDRAVAVVVDPIQSVKGKVVIDAFRTINPQSMALNQEPRQTTSNLGHLQKPSIQALIHGLNRHYYSIPIAYRTHDLEQKMLLNLNKLSWMDAVSVENYSKCGEQNKEHLKAMLKLAKNYKKALEDEKNMTDQELAIKNVGKMDPKRHIADEVSKMLNDNIVQSLAGMMATTSLQ

SEQ ID NO: 16 - protein, 852 aa, Caenorhabditis elegans
  C elegans public gene name=F25H5.4
  genomic DNA homolog sequence=SeqID_337
  cDNA homolog sequence=SeqID_1291
MVNFTVDEIRALMDRKRNIRNMSVIAHVDHGKSTLTDSLVSKAGIIAGSKAGETRFTDTRKDEQERCITIKSTAISLFFELEKKDLEFVKGENQFETVEVDGKKEKYNGFLINLIDSPGHVDFSSEVTAALRVTDGALVVVDCVSGVCVQTETVLRQAIAERIKPVLFMNKMDRALLELQLGAEELFQTFQRIVENINVIIATYGDDDGPMGPIMVDPSIGNVGFGSGLHGWAFTLKQFAEMYAGKFGVQVDKLMKNLWGDRFFDLKTKKWSSTQTDESKRGFCQFVLDPIFMVFDAVMNIKKDKTAALVEKLGIKLANDEKDLEGKPLMKVFMRKWLPAGDTMLQMIAFHLPSPVTAQKYRMEMLYEGPHDDEAAVAIKTCDPNGPLMMYISKMVPTSDKGRFYAFGRVFSGKVATGMKARIQGPNYVPGKKEDLYEKTIQRTILMMGRFIEPIEDIPSGNIAGLVGVDQYLVKGGTITTYKDAHNMRVMKFSVSPVVRVAVEAKNPADLPKLVEGLKRLAKSDPMVQCIFEESGEHIIAGAGELHLEICLKDLEEDHACIPLKKSDPVVSYRETVQSESNQICLSKSPNKHNRLHCTAQPMPDGLADDIEGGTVNARDEFKARAKILAEKYEYDVTEARKIWCFGPDGTGPNLLMDVTKGVQYLNEIKDSVVAGFQWATREGVLSDENMRGVRFNVHDVTLHADAIHRGGGQIIPTARRVFYASVLTAEPRLLEPVYLVEIQCPEAAVGGIYGVLNRRRGHVFEESQVTGTPMFVVKAYLPVNESFGFTADLRSNTGGQAFPQCVFDHWQVLPGDPLEAGTKPNQIVLDTRKRKGLKEGVPALDNYLDKM

SEQ ID NO: 17 - protein, 253 aa, Caenorhabditis elegans
  C elegans public gene name=C36B1.4
  genomic DNA homolog sequence=SeqID_521
  cDNA homolog sequence=SeqID_1292
MNRYDRAITIFSPDGHLFQVEYAQEAVKKGSTAVGVRGKDCIVIGVEKKSIPALQDDRTIRKIHMIDDHVMLAFAGLSADARVLVDRARIECQSYKLTLEDPVTVAYISRYIANTKQRFTQSPGRRPFGISMLIGGFDHDGTPRLFKTEPSGAYYEYVANATGRGEKPVREYLEEQYSEENTVDEATTLKLVVKSLAQVVPPGSQNIEIAVMKKVNDELQQRVLSTEEIEALLKVVETERVAAEAEEAASKKK

SEQ ID NO: 18 - protein, 248 aa, Caenorhabditis elegans
  C elegans public gene name=F25H2.9
  genomic DNA homolog sequence=SeqID_525
  cDNA homolog sequence=SeqID_1293
MFLTRSEYDRGVNTFSPEGRLFQVEYAIEAVKLGSTSIGIKTSEGVLLAAEKRSTSKLMVNDAIEKISKVDQHIGVTFAGLIADSRTLVERAQIEAQNFWFTYNRKIRVEDVTQSVANLALQFGDDDVKASMSRPFGVAMLFAGVDQEGAKLFHLDPSGTFIDCKAKSIGAASDGAEQNLKEQYHDALTIKEGLKMALAILKQVMEEKLNSANVEVVVIKPTVDAKGRPIGEFTRVSNEELDQVITSL

SEQ ID NO: 19 - protein, 1497 aa, Caenorhabditis elegans
  C elegans public gene name=F56C11.1
  genomic DNA homolog sequence=SeqID_522
  cDNA homolog sequence=SeqID_1304
MRSKHVLYIAILFSSIFGGKGIQQNEEFQRYDGWYNNLANSEWGSAGSRLHRDARSYYSDGVYSVNNSLPSARELSDILFKGESGIPNTRGCTTLLAFFSQVVAYEIMQSNGVSCPLETLKIQVPLCDNVFDKECEGKTEIPFTRAKYDKATGNGLNSPREQINERTSWIDGSFIYGTTQPWVSSLRSFKQGRLAEGVPGYPPLNNPHIPLNNPAPPQVHRLMSPDRLFMLGDSRVNENPGLLSFGLILFRWHNYNANQIHREHPDWTDEQIFQAARRLVIASMQKIIAYDFVPGLLGEDVRLSNYTKYMPHVPPGISHAFGAAAFRFPHSIVPPAMLLRKRGNKCEFRTEVGGYPALRLCQNWWNAQDIVKEYSVDEIILGMASQIAERDDNIVVEDLRDYIFGPMHFSRLDVVASSIMRGRDNGVPPYNELRRTFGLAPKTWETMNEDFYKKHTAKVEKLKELYGGNILYLDAYVGGMLEGGENGPGELFKEIIKDQFTRIRDGDRFWFENKLNGLFTDEEVQMIHSITLRDIIKATTDIDETMLQKDVFFFKEGDPCPQPFQVNTTGLEPCVPFMQSTYWTDNDTTYVFTLIGLACVPLICYGIGRYLVNRRIAIGHNSACDSLTTDFANDDCGAKGDIYGVNALEWLQEEYIRQVRIEIENTTLAVKKPRGGILRKIRFETGQKIELFHSMPNPSAMHGPFVLLSQKNNHHLVIRLSSDRDLSKFLDQIRQAASGINAEVIIKDEENSILLSQAITKERRQDRLDLFFREAYAKAFNDSELQDSETSFDSSNDDILNETISREELASAMGMKANNEFVKRMFAMTAKHNEDSLSFNEFLTVLREFVNAPQKQKLQTLFKMCDLEGKNKVLRKDLAELVKSLNQTAGVHITESVQLRLFNEVLHYAGVSNDAKYLTYDDFNALFSDIPDKQPVGLPFNRKNYQPSIGETSSLNSFAVVDRSINSSAPLTLIHKVSAFLETYRQHVFIVFCFVAINLVLFFERFWHYRYMAENRDLRRVMGAGIAITRGAAGALSFCMALILLTVCRNIITLLRETVIAQYIPFDSAIAFHKIVALFAAFWATLHTVGHCVNFYHVGTQSQEGLACLFQEAFFGSNFLPSISYWFFSTITGLTGIALVAVMCIIYVFALPCFIKRAYHAFRLTHLLNIAFYALTLLHGLPKLLDSPKFGYYVVGPIVLFVIDRIIGLMQYYKKLEIVNAEILPSDIIYIEYRRPREFKYKSGQWVTVSSPSISCTFNESHAFSIASSPQDENMKLYIKAVGPWTWKLRSELIRSLNTGSPFPLIHMKGPYGDGNQEWMDYEVAIMVGAGIGVTPYASTLVDLVQRTSSDSFHRVRCRKVYFLWVCSTHKNYEWFVDVLKNVEDQARSGILETHIFVTQTFHKFDLRTTMLYICEKHFRATNSGISMFTGLHAKNHFGRPNFKAFFQFIQSEHKEQSKIGVFSCGPVNLNESIAEGCADANRQRDAPSFAHRFETF

SEQ ID NO: 20 - protein, 430 aa, Caenorhabditis elegans
  C elegans public gene name=C07H6.5
  genomic DNA homolog sequence=SeqID_458
  cDNA homolog sequence=SeqID_1289
MSGAEQQQIVPANNGDENWKAGLNLPAKDRRFKTADVTDTKGVEFEDFCLGRDLLMGIFEKGWEKPSPIQEASIGVALTGQDILARAKNGTGKTGAYCIPVIEKIQPALKAIQAMVIVPTRELALQTSQICVELSKHIQLKVMVTTGGTDLRDDIMRLNGTVHLVIATPGRILDLMEKGVAKMEHCKTLVLDEADKLLSQDFQGILDRLINFLPKERQVMLYSATFPNTVTSFMQKHMHKPYEINLMEELTLLGVTQYYAFVQEKQKVHCLNTLFRKLQINQSIIFCNSTQRVELLAKKITEIGYSCYYIHSKMAQNHRNRVFHDFRQGNCRNLVCSDLLTRGIDIQAVNVVINFDFPRNAETYLHRIGRSGRFGHLGVAINLITYEDRHTLRRIEQELRTRIEPIPKTVDPKLYVADQQLVDAADETTA

SEQ ID NO: 21 - protein, 567 aa, Caenorhabditis elegans
  C elegans public gene name=F49D11.1
  genomic DNA homolog sequence=SeqID_536
  cDNA homolog sequence=SeqID_1305
MDALQAYGGSDSEHSDDDASMDQVAKGKSSTLLERAIVTAPDVESKSAIRQVAIVDPKTKEIKSNPKFDQLFKPESGPVNHFKSEQQRSQKNTLTGFVEPAHLNEFHFNRQIRSFDTLGYAQNPTAESGTTHFVGDVKKAEAEKGVSLFESKKTGGEKRKRVRNDDSADIDGYTGPWSRFIDEKTVAKPTPELQKQMDEIVKKRQEKSRRFKKEKEDSEQMAEESSTLHLKEAEDYQGRSFLVPPSFTGVNLREDYVPERCFVPKKLVHTYRGHNKGVNFLQWFPKSAHLFLSCSMDTKIKLWEVYDRQRVVRTYAGHKLPVREVAFNNEGTEFLSASFDRYVKLWDTETGQVKQRFHTGHVPYCLKYHPDDDKNHMFLVGMQNKKIIQWDSRSGEIVQEYDRHLQAVNSITFFDKNRRFASTSDDKSVRIWEWEIPVDTKLIQNVGLHAIPTMTKSPNDKWVVGQCMDNRIVLFQLVDDKLRFSKKKAFRGHNAAGYACNIDFSPDQSFLISGDADGKLFIWDWRTHKIVGKWKAHDSTCIAALWHPHEKSRMITAGWDGLIKMWN

SEQ ID NO: 22 - protein, 316 aa, Caenorhabditis elegans
  C elegans public gene name=C56G2.6
  genomic DNA homolog sequence=SeqID_512
  cDNA homolog sequence=SeqID_1306
MACQCFLVGAGYVALAAVAYRLLTIFSNILGPYVLLSPIDLKKRAGASWAVVTGATDGIGKAYAFELARRGFNVLLVSRTQSKLDETKKEILEKYSSIEVRTAAFDFTNAAPSAYKDLLATLNQVEIGVLINNVGMSYEYPDVLHKVDGGIERLANITTINTLPPTLLSAGILPQMVARKAGVIVNVGSSAGANQMALWAVYSATKKYVSWLTAILRKEYEHQGITVQTIAPMMVATKMSKVKRTSFFTPDGAVFAKSALNTVGNTSDTTGYITHQLQLELMDLIPTFIRDKILTNMSVGTRAAALRKKEREAKSQ

SEQ ID NO: 23 - protein, 260 aa, Caenorhabditis elegans
  C elegans public gene name=CD4.6
  genomic DNA homolog sequence=SeqID_537
  cDNA homolog sequence=SeqID_1290
MFRNQYDGDVTVWSPQGRLHQVEYAVEAMKQGSATVGIKSETHAVIVALKRAQNDLSSHQKKVYEIDTHAGVSIAGLLSDGRILARYLQTECSSWRWDYKQAVPIKKLAESMQLKLQANTQYYGRRPFGVGILIAGYDKDGAHIIQTDPSAEVVSMHGTSIGARSQSARTYLERNVDNFEKSTPEQLIVHALLALRDTLPAEENLNAQNTSIGIVGKDSPFSLLEDAQVAVHLNQVSTHPRTTGGAAAAAAPGGAEPMQM

SEQ ID NO: 24 - protein, 215 aa, Caenorhabditis elegans
  C elegans public gene name=K01G5.4
  genomic DNA homolog sequence=SeqID_526
  cDNA homolog sequence=SeqID_1307
MSGGDGIPTFKLVLVGDGGTGKTTFVKRHLTGEFEKKYVATLGVEVHPLVFHTNRGQIRFNVWDTAGQEKFGGLRDGYYIQGQCAIIMFDVTARVTYKNVPNWHRDLARVCENIPIVLCGNKVDVKDRKVKAKTITFHRKKNLQYYDISAKSNYNFEKPFLWLARKLLGDPNLEFVAMPALAPPEVQMDPAMIAEYEKDLDNAAKADLPDDDDDL

SEQ ID NO: 25 - protein, 375 aa, Caenorhabditis elegans
  C elegans public gene name=T25C8.2
  genomic DNA homolog sequence=SeqID_336
  cDNA homolog sequence=SeqID_1308
MEEEIAALVVDNGSGMCKAGFAGDDAPRAVFPSIVGRPRHQGVMVGMGQKDSYVGDEAQSKRGILTLKYPIEHGIVTNWDDMEKIWHHTFYNELRIAPEEHPVLLTEAPLNPKSNREKMTQIMFETFNTPAMYVNIQAVLSLYASGRTTGIVLDTGDGVTHTVPIYEGYALPHAIQRLDLAGRDLTDYMMKILTERGYTFTTTAEREIVRDIKEKLCYVAHDFESELAAAASSSSLEKSYELPDGQVITIGNERFRCPEVLFQPAFIGMEGAGIHETTYQSIMKCDVDIRKDLYANTVLSGGTSMFPGIADRMQKEIQHLAPSTMKIKIIAPPERKYSVWIGGSILASLSTFQQMWISKQEYDESGPSIVHRKCF

SEQ ID NO: 26 - protein, 285 aa, Caenorhabditis elegans
  C elegans public gene name=C54G4.8
  genomic DNA homolog sequence=SeqID_513
  cDNA homolog sequence=SeqID_1309
MQRAVVQGSKRGLAALAGVTAASGMGLVYALENSVSASGDNVHPYALPWAHSGPFSSFDIASVRRGYEVYKQVCAACHSMKFLHYRHFVDTIMTEEEAKAEAADALINDVDDKGASIQRPGMLTDKLPNPYPNKKAAAAANNGAAPPDLSLMALARHGGDDYVFSLLTGYLEAPAGVKVDDGKAYNPYFPGGIISMPQQLFDEGIEYKDGTPATMSQQAKDVSAFMHWAAEPFHDTRKKWALKIAALIPFVAVVLIYGKRHIWSFTKSQKFLFKTVKGREPPKAQ

SEQ ID NO: 27 - protein, 435 aa, Caenorhabditis elegans
  C elegans public gene name=C52E4.4
  genomic DNA homolog sequence=SeqID_523
  cDNA homolog sequence=SeqID_1310
MPDHLGDDMRKTKKDDTKEEEKNFQALDEGDIAVLKRYGQGPYAEQLKTLDADIENCLKKVNELSGVKESDTGLAPPALWDIAADKQAMQQEQPLQVARCTKIITSDKHDPRYLINVKQFAKFVVDLADSVAPTDIEEGMRVGVDRNKYQIHLPLPAKIDPTVTMMQVEEKPDVTYSDVGGCKDQIEKLREVVETPLLHPERYVNLGIEPPKGVLLYGPPGTGKTLCARAVANRTDACFIRVIGSELVQKYVGEGARMVRELFEMARTKKACLIFFDEIDAVGGARFDDGQGGDNEVQRTMLELINQLDGFDPRGNIKVLMATNRPDTLDPALMRPGRLDRKVEFALPDLAGRAHILKIHAKQMSVERDIRYDLLARLCPNSTGAEIRSVCTEAGMFAIRARRKVATEKDFLEAINKVVKGYAKFSATPRYLTHN

SEQ ID NO: 28 - protein, 163 aa, Caenorhabditis elegans
  C elegans public gene name=H06I04.4
  cDNA homolog sequence=SeqID_1311
MVFVKTLHRTLFLEVAANEDVLSIKQKIEAAEGIPAEEQRLCYAGRQLEDSDCGIDSEATIYVNLELLGGAKKRKKKVYTTPKKNKRKPKKVKLAVLKYYKIDENGKITRLRKECQQPSCGGGVFMAQHANRHYCGRCHDTLVVDTATAAATSGEKGGKKGKK

SEQ ID NO: 29 - protein, 606 aa, Caenorhabditis elegans
  C elegans public gene name=Y49A3A.2
  genomic DNA homolog sequence=SeqID_514
  cDNA homolog sequence=SeqID_1312
  cDNA homolog sequence=SeqID_1922
MAAESSYGFVYGVSGPVVTAEKMAGSAMYELVRVGHQELVGEIIRLEGDYATIQVYEETSGVTIGDPVLRTGKPLSVELGPGIMGSIFDGIQRPLKDIADITQSIYIPKGVSTNALSREARWDFVVSKDLRVGGHVTGGDIIGTVDENLLIKHKILLPPSACGTITFVAPSGQYTVEDTLLELEFAGRKQKFSMLQIWPVRSPRPVTEKLAANNPLLCGQRVLDALFPCVQGGTTAIPGAFGCGKTVISQSLSKYSNSDAIIYVGCGERGNEMSEVLRDFPELTMEVEGVTTSIMKRTALVANTSNMPVAAREASIYTGITLAEYFRDMGLNVAMMADSTSRWAEALREISGRLGEMPADSGYPAYLAARLASFYERAGRVKCLGSPEREGSVTIVGAVSPPGGDFADPVTSATLGIVQVFWGLDKKLAQRKHFPSINWLISYSEYMRALEEFYEKNYPEFVSLRTKCKEILQEEEDLSEIVQLVGKASLAESDKVTLEVAKIIKDDFLQQNGYTKYDRFCPFYKTVGMLKNMIGFYDLARHAVEATAQSDNKITWNVIKDSMGDLIYQLSAMKFKDPVADGEAKIRKDYEDLAEAMANAFRNLED

SEQ ID NO: 30 - protein, 734 aa, Caenorhabditis elegans
  C elegans public gene name=M01E5.5
  genomic DNA homolog sequence=SeqID_507
  cDNA homolog sequence=SeqID_1298
  cDNA homolog sequence=SeqID_1920
MSVVSNHHSNGNGNSTVYDTNGNDEIKKEVKDEPMASDSEVPFGELMKRDKKEKKQKKRKAESGSDEDDYKPEKRKSSAKNGKKKDVGSDSEDDYKPEKKKSKKNNKKKAQESSEDDDEESEGDVSEEDVKPQKRKSKGAEKSKPSTSKKDAGGKKEPPKKKVKKEEDIEDIWEWWKEEKKPAGVKWNSLQHCGPLFAPPYIPLPSHVHFKYGGEKMKLTLETEEIAQFYAGVLDHEYSTKEAFNKNFMKDWRKVMTVEERERIHDLKKCDFRAIDAYQKEQREIRKAMTKEEKLKIKEEKEAEVKIYGIAIIDGHRQKVANFRIEPPGVFRGRGGHPKMGLIKKRIMPEDVIINCGKDTEIPKPPPGHKWKEVRHDNTVTWLCSWTESVLGQNKYIMLNPSSKIKGEKDFEKYETARRLKKKIGGIRERYTDDFKSKEMRVRQRATALYFIDKLALRAGNEKDVDEAADTVGCCSLRVEHIKLFDSAKLNEDDKKEKEFVVEFDFLGKDSIRYFNRVSVEKRVYKNLKIFMEGKAPSDDLFDRLDTATLNDHLRSLMDGLTVKVFRTYNASITLQEQLIKLTNPKDNVAAKILSYNRANRQVAILCNHQRAVSKGFDESMQKLEQKIKDKKKEVKEAEAALKSARGAEKEKAQKKYDRLKEQLKKLKISRTDKDENKQIALGTSKLNYIDPRITVAWCKKFEVPLEKVFTKTHREKFRWAIDMTNSSDEEYVF

SEQ ID NO: 31 - protein, 379 aa, Caenorhabditis elegans
  C elegans public gene name=ZK1127.5
  genomic DNA homolog sequence=SeqID_538
  cDNA homolog sequence=SeqID_1313
MSSETLEFSGCNFFRIRLAYSILSGRPIRIINIRKNDDRPGIRDFESKLIGLLEKVTNGTKVEISRTGTQVIFRPGMITGGVVNLDCGTERCISYFLEPLLLLSPFCKVPMVIKLKGVTNAPGEISVDGMKASWLKVYNKFVLNDEKLDIKIQARGLKPEGGGVVVFTAPIVKTLRPVKRQQVGKVCKIRGQAYVTKVTPSLAYRMIDAAKKAMHGYISDVYITVDQRKGDAGGASPGYGLFLTAETTEGVIYQAEAISRPKGESGVPILPEDIGIEAGHALLQQIYMGGALDSSAQILASTFMTLCPKDVSHFLYGPLPMYSVHALRHLKQFFEIEFKMEDFKKTLKEEEADLKTGSADKAMVTAVGVGYSNLNKTIL

SEQ ID NO: 32 - protein, 1193 aa, Caenorhabditis elegans
  C elegans public gene name=C26E6.4
  genomic DNA homolog sequence=SeqID_539
  cDNA homolog sequence=SeqID_1314
MYDDEDEMVNDPMDGDYIDDSDEISAEAWQEACWVVISAYFDEKGLVRQQLDSFDEFVQMNVQRIVEDSPPVELQSENQHLGTDMENPAKFSLKFNQIYLSKPTHWEKDGAPMPMMPNEARLRNLTYASPLYVDITKVVTRDDSATEKVYDKVFVGKVPVMLRSSYCMLSNMTDRDLTELNECPLDPGGYFVINGSEKVLIAQEKMATNTVYVFSMKDGKYAFKTECRSCLENSSRPTSTMWVNMLARGGGGGKKTAMGQRIIGILPYIKQEIPIMIVFRALGFVSDRDILGHIIYDFNDPEMMEMVKPSLDEAFVIQEQNVALNFIGARGAKPGVTREQRIKYAREILQKELLPHVGVSEHCETKKAFFIGYMVHRLLLAALGRRELDDRDHIGNKRLDLAGPLLAFLFRSLFRNLLKEMRMTAQKYINKNDDFALDVCVKTSTITRGLTYSLATGNWGDQKKAHQSRAGVSQVLNRLTYTATLSHLRRANSPIGREGKLAKPRQLHNTQWGMVCPAETPEGQAVGLVKNLALMAYISVGSLPEPILEFLEEWSMENLEEVSPSAIADATKIFVNGAWVGIHREPDQLMTTLKKLRRQMDIIVSEVSMVRDIRDREIRIYTDAGRVCRPLLIVENQKLALKKRHIDQLKEAADEANKYTWSDLVGGGVVELIDSMEEETSMIAMMPEDLRSGGYCDTHTHCEIHPAMILGVCASIIPFPDHNQSPRNTYQSAMGKQAMGVYTTNFHVRMDTLAHVLYYPQKPLVTTRSMEYLRFNELPAGINAIVAILSYSGYNQEDSVIMNNSAIDRGLFRSVFYRSYRDNEANLDNANEELIEKPTREKCSGMRHSLYDKLDEDGIISPGMRVSGDDVIIGKTVALPDIDDDLDASGKKYPKRDASTFLRSSETGIVDQVMLSLNSDGNKFVKIRMRSVRLPQIGDKFASRHGQKGTMGIMYRQEDMPFTAEGLTPDIIINPHAVPSRMTIGHLIECLQGKLSANKGEIGDATPFNDTVNVQKISGLLCEYGYHLRGNEVMYNGHTGKKLTTQIFFGPTYYQRLKHMVDDKIHSRARGPIQMMNRQPMEGRARDGGLRFGEMERDCQISHGATQFLRERLFEVSDPYHVYVCNNCGLIVVANLRTNSFECKACRNKTQVSAVRIPYACKLLFQELMSMSIAPRLMVKPRQSKRSKHQSEA

SEQ ID NO: 33 - protein, 707 aa, Caenorhabditis elegans
  C elegans public gene name=F43D9.3
  genomic DNA homolog sequence=SeqID_533
  cDNA homolog sequence=SeqID_1315
MRQCTPFDTLLVFYSTWPVLKNILTNKIMPAELESVRTRQIVALRTMINLNEPVVNSGVREPVWKVLVLDRTGQDIISPLLPVKQLRELGVTLHLLIGARREPLTDVPAVYFVSPNDENIDLMSEDLKKAMYDSFYCNFISPLARPRLESLASAAVHGGAVSQVQKVVDQYLNFISLEDDLFVLRRYSENSTFSYHAMNSPGTSDVAVNAMLDSIADGLFAVCATMGIVPIIRCPKGNAAEMVAKKLDQKLRDNLRDSRNNLFTMDGVRMGLLQTSRPLLVIGDRSADLATMLHHTWTYQALMHDVLELDQNRVTISTSSTGKKKDYDMATGGSDKLWNNHKGSAFPTVAEAVQENLDDYRSKEDDIKKIKQALGLSGESEAADEALTNVLADTTAKLGSTVMSLPDLLESKRLIDLHTNIATTLLDVIKERKLDVSLSSSKSCCNTHRLVDLFYQPVTQFLSNINHQEDVLRVLIIAFLCQETVNQNGYDQMMNLLRERGIEESALKHVQKLKSISQLGSRAANSAHTEEHQGAGTKTISMFGKLLSHSSKFVMEGVKNLVPKEHNLPLTKMIDSLNTPPSSTGISSAVGINQMIGGSSQGPDIDDIYCFFDPKLMHQPTKETILLARQQSAQDVILFVVGGGNYVEYQNLVDYGKRKNLMRVTYGCTELVNPAQFCDQVSCCSLSLPLTDLSGDSPYFFCSPLEF

SEQ ID NO: 34 - protein, 741 aa, Caenorhabditis elegans
  C elegans public gene name=F52B11.3
  genomic DNA homolog sequence=SeqID_508
MWGVIFLLLSIVPAAQSVFECSSHETTAFVRIPRARLDGTPVVISTAGHDLTCAQYCRNNIEPTTGAQRVCASFNFDGRETCYFFDDAATPAGTSQLTANPSANNFYYEKTCIPNVSAHEACTYRSFSFERARNTQLEGFVKKSVTVENREHCLSACLKEKEFVCKSVNFHYDTSLCELSVEDKRSKPTHVRMSEKIDYYDNNCLSRQNRCGPSGGNLVFVKTTNFEIRYYDHTQSVEAQESYCLQKCLDSLNTFCRSVEFNPKEKNCIVSDEDTFSRADQQGQVVGKDYYEPICVAADLSSSTCRQQAAFERFIGSSIEGEVVASAQGVTISDCISLCFQNLNCKSINYDRTASSCFIYAVGRQDANIKANPSMDYYEFNCESQFGGMALCTNEGIRFIVNTKEPYTGAIYAAERFSTCSQVVENAKQISITFPPPTVSSDCGTVIRDGKMEALVVVSLDGVLPHQVTTEWDRFYRVSCDVSMDKMVKEGSVVVTTIYEASSQNTTVLDVATPPPVSAELQILNQLEEPLHKASIGDPLLLVITSEQAGPHNMMVTECTATRVGGFGDTVPFTLIENGCPRYPALVGPVEQDFDKNRLKSDLRAFRLDGSYDVQIVCSIMFCAGPNGCPVSNCLDSGTNELFMSHGRKKRSADLEAGETEEKLSAIIRVFAKGEDEEEMEMANNTMMTSMSDSTELLCIAEPFFVSSVVSLSVLCFALSAIIAIWGCHSLHSKPVKQVAA

SEQ ID NO: 35 - protein, 776 aa, Caenorhabditis elegans
  C elegans public gene name=C30C11.4
  genomic DNA homolog sequence=SeqID_515
  cDNA homolog sequence=SeqID_1288
MSVLGFDIGNLNCYIGVARQGGIEVITNDYSLHATPACVSFGPKDRSMGVAARQAVTTNIKNTVINFKHLIGRKFSDPVAQRFIPFIPCKVVKLPNDDIGVQVSYLGEPHTFTPEQVLAALLTKLRTIVESQLSDVKKVSDCVLAVPSYFTDVQRRAVLSAIQYAGLNSLRIVNETTAIALAYGIYKQDLPEEDAKSRNVVFLDIGHSSTQASLVAFNRGKLQMVNTSYDLESGGIWFDALIREHFRKEFKTKYGIDAATSPRPWLRLLDECERVKKQMSANQTPIPLNIECFMEDKDVTGKMQRQEFEDLAAPIFNRIKQVLINLFADGVSIKPEEIDEIEIVGGSSRIPMIREIVKDLFGKEPKTTMNQDEAVARGAAMQCAILSPTFRVREFAIKDTQPYRIRLSWNSTGENGGENDVFSPRDEVPFSKLVSLLRSGPFNVEAHYAQPNVVPHNQVHIGSWKVNGARPGADGGNQKVKVKVRVNPDGIFTIASATMYEPRIVEEVPAEAMEVDGDAKTEAPAEPLEPVKKTKLVPVDLEVIESIPVSYDVQKFHNLELQMQESDAREKAKADAKNSLEEYVYEMRDKVSDQYAEFITPAAADEFRSVLTSTEDWLYDEGEDAERDVYEKRLSELKAVGTPVVERYRESETRKPAFDSFDQSIMRVRKAYEDYANGGPTYAHLDSKEMEKVINAIEDKKKWLDEARHKQETRSKTDAPVVFTEEILQNKNVFENVVNPILNKKKPAAPAPPKKEEPQPAAGDQPQSQPGEMDVD

SEQ ID NO: 36 - protein, 618 aa, Caenorhabditis elegans
  C elegans public gene name=F01G10.1
  genomic DNA homolog sequence=SeqID_509
  cDNA homolog sequence=SeqID_1316
  cDNA homolog sequence=SeqID_1924
MTVSEQLRNDLEDAANRMRISSIEMTCASKSGHPTSSTSAAEIMSTLFFSEMKYDVAEPKSASADRFVLSKGHACPILYAAWEEAGLLSHEQVLSLRKIDSDIEGHPTPRLNFIDVATGSLGQGLGVATGMAYVGKYIDKASYRVFCLLGDGESAEGSVWEAAAFASIYKLDNLVAIVDVNRLGQSQATSLGHDVETYKARFAAFGFNAIIVNGHNVDELLAAYETARSTKGKPTAIIAKTLKGKGIEGIENEDNWHGKPVPEGTVNAIKARFHGSQKGKLVAQKPINDAPAIDLHVGSIKMAAPEYKKGDKVATRAAYGTALAKLGDASPRVIGLDGDTKNSTFSDKLLKKHPDQFIECFIAEQNLVGVAVGAQCRDRTIPFTSTFAAFFTRATDQIRMAAVSFANLKCVGSHVGVSIGEDGPSQMALEDLAIFRTIPGATVFYPTDAVSAERATELAANTKGVVFIRTGRPALPVLYDNEEPFHIGQAKVVKQSAQDKIVLVGSGVTLYESLKAAEELEKEGIHATVIDPFTIKPLDGKTIAEHALKVGGRVVTTEDHYAAGGIGEAVSAALADYPTIRVRSLNVKEVPRSGPPDALVDMYGISARHIVAAVKNFQ

SEQ ID NO: 37 - protein, 434 aa, Caenorhabditis elegans
  C elegans public gene name=C23H3.4
  genomic DNA homolog sequence=SeqID_510
  cDNA homolog sequence=SeqID_1317
MRNRSKRQQEKLSKKLTERQKDELIADWTPEPLVPETPQDHPVLNPKYADGKMTKDVSIDGEKYLNMASTNFLSFIGVKRIEDRAKQTIFKYGVGSCGPRGFYGTVDVHLDLEKELAKFMGCEEAVLYSYGFATVSSAIPAYAKKGDVIFVDEGVNFAIQKGLQASRSRVEYFKHNDMEHLERLLLEQEQRDKKDPKKAKSVRRFIVVEGLYVNYADLCPLPKIIEFKWRFKVRVFIDESWSFGVIGKTGRGVTEHFNVPMEDVDMVMASLENALASTGGFCVGRSYVVGHQRLSGLGYCFSASLPPLLATAASEAISIIDEEPSRVQKVTEMAINGQKKLQDALSGSKFSLQGCPESPMKHIYYNGEDEEKQLDTFVETVFTKNHLLLTRARYLDKDELFKIRPSIRVMFQHDLTEEEIQRAVDAIRVVAHKF

SEQ ID NO: 38 - protein, 540 aa, Caenorhabditis elegans
  C elegans public gene name=K01C8.10
  genomic DNA homolog sequence=SeqID_527
  cDNA homolog sequence=SeqID_1318
MPPAVPAAAATARQSASGRERNFKDKDKPESVRNSNIVAAKAVADAVRTSLGPRGMDKMIQSGNGDVTITNDGATILNQMSVIHPTAKMLVELSKAQDIEAGDGTTTVVVMAGALLDAAQNLLSKGIHPTTISESFQSAAAEAEKILDEMSSPVDLSNDALLNKMATTSLNSKVVSQHSWLLAPMAVNAVKKIINSENDSNVNLKMIKIIKKMGDTVEESELIEGALIDQKTMGRGAPTRIEKAKIGLIQFQISPPKTDMENQVIITDYAQMDRALKEERQYLLEICKQIKAAGCNVLLIQKSILRDAVNELALHFLAKMKIMCIKDIEREDIEFYSRILGCRPVASVDHFNADALGYADLVEEIPTGGDGKVIKVTGVQNPGHAVSILLRGSNKLVLEEADRSIHDALCVIRCLVKKKALLPGGGAPEMEIAVKLRNLAQTQHGATQYCWRAFADALELIPYTLAENAGLSPIHTVTELRNNHANGNSSYGVNVRKGYVTDMVEEDVVQPLLVTASAIKQASECVRSILKIDDIVMAVR

SEQ ID NO: 39 - protein, 595 aa, Caenorhabditis elegans
  C elegans public gene name=F54B3.3
  genomic DNA homolog sequence=SeqID_524
MSWLFGVQKNATPQIPDDFQAGAAPGGPQQPGQGQRQEGNSKMAYSFDSTALERAAKAARDLEKFPNAKEALELSRMQEVTRQKEVENETKKIEAQLANMKSEHIRVAEEERRKTLGEETKHAHSRAEYQDQLARKRAEEELAMKARMQEESLRKQEESVKKQEQLRKQTIEHELALKHKYELEKIDAETRARAKAARDNRDVNLEQMKLHEEENRKTVIEKIKTSGELIGSGLNQFLNDKTKIAAAVGGLTALAVGWYTAKRGTGVTARYIESRLGKPSLVRETSRITPLEVLKHPIKSVQMMTRQKKDPLNGVVLPPALERRLRDIAITTSNTKRNNGLFRNVMFYGPPGTGKTLFAKSLAQHSGLDYAVLTGGDIAPLGRDGVSAIHKVFDWASKSRKGLIVFIDEADAFLQKRSKNGMSEDTRAALNAFLFRTGEQSRKFMLVVASNQPEQFDWAVNDRFDQLVEFTLPGMEERERILLQYFNEHIVTPATSGSRSQRLKLDNFDWVAKCNEVAKKTSGMSGRELSKLVIGWQASAYASETGVLTEAIVDRNTADAMVQHEHKMEWLEKEQLKARNQEVKFGTTLKRETAV

SEQ ID NO: 40 - protein, 496 aa, Caenorhabditis elegans
  C elegans public gene name=T08B2.9
  genomic DNA homolog sequence=SeqID_528
  cDNA homolog sequence=SeqID_1296
MTAETDVRSTENLPQQILDFLQESNEFNSIQLAQQWNLDHQKVIGAIKSLLANEGVLTTKDVTEKRLELTNEGVQFANEGSPEYLVFEFVGTDGAAQADIQKKPFGKIGMAKAMQFKWVSVDKGRVVRQATEVTDSTRKQLESLRIGSSDVSENEKKELKKRKLISEVNIKALVVSKGTSFTTSLAKQEADLTPEMIASGSWKDMQFKKYNFDSLGVVPSSGHLHPLMKVRSEFRQIFFSMGFSEMATNRYVESSFWNFDALFQPQQHPARDAHDTFFVSDPAISTKFPEDYLERVKTVHSKGGYGSAGYNYDWKIEEAQKNVLRTHTTAVSARQLYQLAQEGFRPSKLFSIDRVFRNETLDATHLAEFHQVEGVIAEKNLSLAHLIGIFTEFFKKLGITNLRFKPTYNPYTEPSMEIFAYHQGLTKWVEIGNSGMFRPEMLLPMGLPADVNVAGYGLSLERPTMIKYGINNIRDLFGSKIDLNVVYNNPICRLDK

SEQ ID NO: 41 - protein, 1503 aa, Caenorhabditis elegans
  C elegans public gene name=F53G12.3
  genomic DNA homolog sequence=SeqID_522
  cDNA homolog sequence=SeqID_1304
MAAENFYNVNNFQSLPLEIKVQFSKETLFSALQQEAETQRYDGWYNNLANSEWGSAGSRLHRDARSYYSDGVYSVNNSLPSARELSDILFKGESGIPNTRGCTTLLAFFSQVVAYEIMQSNGVSCPLETLKIQVPLCDNVFDNECEGKTTIPFYRAKYDKATGNGLNSPREQINERTSWIDGSFIYGTTQPWVSALRSFKQGRLAEGVPGYPPLNNPHIPLNNPAPPQVHRLMSPDRLFMLGDSRVNENPGLLSFGLILFRWHNYNANQIYREHPDWTDEQIFQAARRLVIASMQKIIAYDFVPGLLGEDVRLSNYTKYMPHVPPGISHAFGAAAFRFPHSIVPPAMLLRKRGNKCEFRTEVGGYPALRLCQNWWNAQDIVKEYSVDEIILGMASQIAERDDNIVVEDLRDYIFGPMHFSRLDVVASSIMRGRDNGVPPYNELRRTFGLAPKTWETMNEDFYKKHTAKVEKLKELYGGNILYLDAYVGGMLEGGENGPGEMFKEIIKDQFTRIRDGDRFWFENKLNRLFTDEEVQMIHSITLRDIIKATTDIDETMLQKDVFFFKEGDPCPQPFQVNTIGLEPCAPLIQSTYWDDNDTTYIYTLIGLACIPLICYSIGHYMVERRIRIGHNSACDSLTTDFSTESPKVNVYKVNALEWLQEEYIRQVRIEIENTTLTVKKPRGGILRKIRFETGQKIEVFHSIPNPSAMHGPFVLLSQKNNHHLVIRLSSDRDLSKFLDQIRQAASGINAEVIIKDEENSILLSQAITKERRQDRLDLFFREAYAKAFNDSELQDSETSFDSSNDDILNETISREELASAMGMKANNEFVKRMFAMTAKHNEDSLSFNEFLTVLREFVNAPQKQKLQTLFKMCDLEGKNKVLRKDLAELVKSLNQTAGVHITESVQLRLFNDVLHKSGVSDDAEYLTCNNFDALFSEISDVQPIGLPFNRKNYNSHIKEPSCHTSFPIVDHSTPAPLSLIQRICAFLETYRQHVFIIFCFVAINIVLFFELFWHSRYLNEDRDLRRVMGAGIAITLSSAGALSFCMALILLTVCRNIITLLRETVIAQYIPFDSAIAFHKIVALFTLFWSTLHTIGHCVNFYHVGTQSDRGLACLFQETFFGSDVVPTLSYWFYGTITGLTGIGLVIVMSIIYVFALPKFTRRAYHAFRLTHLLNIGFYALTILHGLPSLFGSPKFGYYVVGPIVLFVIDRIIGLMQYYKSLDIAHAEILPSDIIYIEYRRPREFEYKSGQWITVSSPSISCTFNESHAFSIASSPQDENMKLYIKAVGPWTWKLRSELIRSLNTGSPFPLIHMKGPYGDGNQEWMNYEVAIMVGAGIGVTPYASTLVDLVQKTSSDSFHRVRCRKVYFLWVCSSHKNFEWFVDMLKNVENQAKPGILETHIFVTQMFHKFDLRTTMLYICEKHFRATNSGISMFTGLHAKNHFGRPNFKAFFQFIQSEHKEQSEIGVFSCGPVNLNESIAEGCADANRQRDAPSFAHRFETF

SEQ ID NO: 42 - protein, 437 aa, Caenorhabditis elegans
  C elegans public gene name=C01H6.5
  genomic DNA homolog sequence=SeqID_540
  cDNA homolog sequence=SeqID_1320
MRVSAQIEVIPCKVCGDKSSGVHYGVITCEGCKGFFRRSQSSIVNYQCPRQKNCVVDRVNRNRCQYCRLKKCIELGMSRDAVKFGRMSKKQREKVEDEVRMHKELAANGLGYQAIYGDYSPPPSHPSYCFDQSMYGHYPSGTSTPVNGYSIAVAATPTTPMPQNMYGATPSSTNGTQYVAHQATGGSFPSPQVPEEDVATRVIRAFNQQHSSYTTQHGVCNVDPDCIPHLSRAGGWELFARELNPLIQAIIEFAKSIDGFMNLPQETQIQLLKGSVFELSLVFAAMYYNVDAQAVCGERYSVPFACLIAEDDAEMQLIVEVNNTLQEIVHLQPHQSELALLAAGLILEQVSSSHGIGILDTATIATAETLKNALYQSVMPRIGCMEDTIHRIQDVETRIRQTARLHQEALQNFRMSDPTSSEKLPALYKELFTADRP

SEQ ID NO: 43 - protein, 184 aa, Caenorhabditis elegans
  C elegans public gene name=ZK792.6
  genomic DNA homolog sequence=SeqID_516
  cDNA homolog sequence=SeqID_1321
MTEYKLVVVGDGGVGKSALTIQLIQNHFVEEYDPTIEDSYRKQVVIDGETCLLDILDTAGQEEYSAMRDQYMRTGEGFLLVFAVNEAKSFENVANYREQIRRVKDSDDVPMVLVGNKCDLSSRSVDFRTVSETAKGYGIPNVDTSAKTRMGVDEAFYTLVREIRKHRERHDNNKPQKKKKCQIM

SEQ ID NO: 44 - protein, 463 aa, Caenorhabditis elegans
  C elegans public gene name=W02F12.5
  genomic DNA homolog sequence=SeqID_338
MLGRRAVSVHRFLSRAARQSVTAASSAQPSLQAKTSLLEPLVQNVRITSSANFHMSAVRMSDVITVEGPAFAESISEGDIRWLKQKGDHVNEDELVAEIETDKTSVEVPAPQAGTIVEFLVEDGAKVTAKQKLYKLQPGAGGGSSSAPAKEEPKSAPAKEESKPAPAKEDSKPAVTAAAPPKPVSGDIPKSAPPVARPPSTPSSSTPVGAVPVTRVVVPKGVDPSHAITGARDEVRVKANRMRMRIAQRLKDAQNTYAMLTTFNEIDMSSLIEMRKTYQKDFVAKHGVKLGMMSPFVRAAAYALQESPVVNAVLDENEIVYRHFVDISVAVATPKGLVVPVLRNVESMNYAQIELELANLGVKARDGKLAVEDMEGGTFTISNGGVFGSMFGTPIINPPQSAILGMHGVFDRVVPVNGKPEIRPIMQIALTYDHRLIDGREAVTFLKKIKTAVEDPRIMFMNL

SEQ ID NO: 45 - protein, 655 aa, Caenorhabditis elegans
  C elegans public gene name=Y32F6A.3
  genomic DNA homolog sequence=SeqID_534
  cDNA homolog sequence=SeqID_1322
MSATEKDKTPLLGVSQPISLAHPDSKDIAQTTLLIETLKKFGSYEPKEETEQRMEVLRNLNRLVKEWVKNVTAMKIPNGEGVNAGGKLFTFGSYRLGVHSSGADIDTLAVVPRHIDRSDFFTSFKEMLNNDPNVTELHGVEEAFVPVMKLKYSGVELDILFARLALKEVPDTQELSDDNLLRNLDQESVRSLNGCRVAEQLLKLVPRQKEFCVTLRAIKLWAKNHGIYSNSMGFFGGITWAILVARACQLYPNASPSRLVHRMFFIFSTWTWPHPVVLNEMNNDRNDIPTLCELVWDPRRKNTDRFHVMPIITPAFPEQNSTHNVTRSTATVIKNEICEALEICRDISEGKSKWTALFEEVNFFSRYKHFIALIMAAPNEEEELNYGGFLESRIRLLVQSLERNQDIIIAHNDPNKHKPSPNAKFDVNPENKRVTVWFIGLEFAEHAKTLDLTNEIQRFKTNVELQASNVKGIGPNCQVQIDMFYVKRNSLIQVISAADLRRGRRWKKVVPIATNTSVSSSTPRSVVRTTSTSSVPTTPTGLAAPKTPLSASVSATNEPDSTTNGTPLSRKRSMDEESSTTVTSQISDESVPKKKTRDDTLEENRVSMVVEVSNVVVEQRTKVVQEIVDLQADNGLNTSNGLEASEQKMEVPQSV

SEQ ID NO: 46 - protein, 128 aa, Caenorhabditis elegans
  C elegans public gene name=M28.5
  genomic DNA homolog sequence=SeqID_517
  cDNA homolog sequence=SeqID_1331
MADDGVNPKAFPLADTNLSQKLMDLVQQAMNYKQLKKGANEATKTLNRGISEIIVMAADAEPLEILLHLPLLCEDKNVPYVFVRSKAALGRACGVTRPVIAASITQNEGSQLKSQIQKIKEDVEKLLI

SEQ ID NO: 47 - protein, 829 aa, Caenorhabditis elegans
  C elegans public gene name=Y105E8A.9
  genomic DNA homolog sequence=SeqID_503
  cDNA homolog sequence=SeqID_1323
MATAVELAIEKIDEYKSKIGRTLGTPMRLRDLIRQVRAARTMAEERAVVDRESANIRESFRDDDSPWKCRNIAKLLYIHMLGYPAHFGQMECMKLVAHPRFTDKRIGYLGAMLLLDERSEVHMLVTNSLKNDLTCSTQFVSGLALCTLGSICSAEMCRDLANEVEKIIKQNNAYLKKKAALCAFRIVRKVPELMEVFIPCTRSLLGEKNHGVLMGATTLVTEMCEKSPDVLNHFKKLVPNLVRILKNLLMSGYSPEHDVTGISDPFLQVKILRLLRVLGKDDVRVTEEMNDILAQVATNTETAKNVGNAILYETVLTIMEIKSESGLRILAVNILGRFLLNTDKNIRYVALNTLLKTVHVDYQAVQRHRNVVVECLKDPDISIRKRAMELCFALMNRTNIAIMTKEVLIFLETADAEFKSECASRMYIATERYSPNHEWHLDTMITVLRLAGKYVPDEVVSCMIQMISANEQLQSYAVSQLYHAAQKDAINAQPLLQVAFWTIGEFGDLLLQPTDVDSTPISENDVVGVFESVLPSALTSLWTKCYGVTALAKLGTRFQSTGDRIGALVRMNQAHIQLELQQRSVEFNVILNLGDLRDGLLERMPVITHNSLNAAAPSMIDEEVSAESGAPVVTNGDLLGDLNLGGGGSTNPSNDYSSDLLGVGVGSGAASAQAPPPPPPPTSNSNILDIFGDTPSSNAAGGFDFGMAAPAKEPTYQPVIAINKGGIEVQLQVIETWKNEKARLRMTAYNYTPRTLSNYNFFAAVTKTFEIALEPASSPNIDPNEHTTQFMTITRKAPNTTARMRTKISYIVDGTEQVGEGVVNEFPGL

SEQ ID NO: 48 - protein, 1535 aa, Caenorhabditis elegans
  C elegans public gene name=C54D1.5
  genomic DNA homolog sequence=SeqID_502
  cDNA homolog sequence=SeqID_1324
MGQPQPAELYPSVDPNHFGADGNPCYDRATRQPQRCVPDFVNAAFNLEVQVTNTCGTKRPTKFCVQSGHTGQRSVCETCDDRHEGFSHPAKYLTDFNVGNNETWWQSDTMQEGQQYPTTTNLTLVLGKSFDITYVRLKFISPRPESFTIYKKTHTDSEWEPWQFYSGSCRATYGLSDRAPILPGNEATAQCTKEFSDISPITGGNIAFSTLEGRPSAHAFEESEVLQKWVTASAIRISLNRMNTFGDEVFKDPQVLRSYYYAISDFAVGGRCKCNGHASECVGSSSVDGENRLVCRCEHNTQGADCNECLPFYNDRPWRSGTSVEANECIACNCSQLSNRCYFDQQLFEETGHGGHCIDCQGNTQGVHCEQCIANHWRRPGENYCVACGCNEIGSLSTQCDNEGKCQCKPGVTGRFCDQCLDGFYDFSTNGCKNCGCETSGSLNNQPRCDSSSGSCSCKLNVEGRQCDKCKPGYFDLSTENQFGCTPCFCFGHSSICNTADGYFAMNVSSVFDQDKQKWAGQNRIGLQDTQWAELDKAVAVSDTDNSPVYFVAPEQFLGDQRSSYNQDLVFTLKVAKHVTNQDVKDIIIVGADRQELSTSITAQGNPFPTTEAQTYRFRVHADPYFGWYPRINELDFIGILSNITAIKIRGTYSYKDIGYLSNVNLGTAGVAPSAANPKQATWIEHCECLPGFVGQFCESCESGFRRETKFGGPFNHCIKCDCHNHSNSCEAESGSCICEHNTAGDTCERCARGYYGDALQGTEEDCQKCPCPNDGPCILHADGDVICTECPNGYTGRRCDECSDGYFGNPKDGTECVECACSGNTDPNSIGNCDKITGECKKCIFNTHGFNCENCKPGYWGDALIEPKGNCQSCGCFAAGTRRPNNDYTLLECNQQDGQCDCLPNVIGIQCDQCAHGFYNITSGLGCQECNCDPLGSEGNTCDVNTGQCQCKPGVTGQRCDRCADYHFGFSANGCQPCDCEYIGSENQQCDVNSGQCLCKENVEGRRCDQCAENRYGITQGCLPCDDCYTLIQSRVNVFREKVKSLDNTLQEIIENPAPVNDTKFDEKVKETSRAASEVWEAVKQKTKEGGGTIKTKSKAIKDEIVAALEKLTSIDESVAQAKVGADAAENDMKRWEIIIENARREIENVLHYLETEGEERAQIAYNASQKYGEQSKRMSELASGTREEAEKHLKQASEIEQLSEQAIANATQANKEASDAIYGGEQISKQIAELKEKQNQLNESIHRTLDLAEEQKKSADEANNLAAVSLTNVEAVKIPSVDPKELRNDVAGVLEESENLVDSSVKENSANDELFDEVNRSVADARNELQSSQDQQRVSDQLMLELEKSRERIVDSVSTADKTLKDAEAALQVLEEFGAKIEKSRNDAVAEFAGVEGINQRLDDIIDAQDKRRNSLPIDKQFVIDYRKSADVLLNETHALADRYKDIIHSDVDTRDSTEAVQYDIEQLMEELTDSNENLQYYKKQAEDDKQMATEAVRKQLLPRILPSKQMLPFSLRKMKSRKSSILWIPWKK

SEQ ID NO: 49 - protein, 454 aa, Caenorhabditis elegans
  C elegans public gene name=T20H4.3
  genomic DNA homolog sequence=SeqID_541
  cDNA homolog sequence=SeqID_1333
MSTKEEITKEIEEQGAEVRRVKGDKNSTEEAKKEAIDKLLALKLTYKEVTGQEYAAPNARQSKPKKEEKPKQQPKQQEKKQDGKKQTLLGVGTKKDDNYSEWYSEVITKAEMIEYYDVSGCYVLRPWSFAVWESIQEWFDSGIKKLGVKNCYFPMFVSNAALEREKTHIADFAPEVAWVTRAGNSEMAEPIAIRPTSETVMYPSYKKWVQSHRDLPIKLNQWCNVVRWEFKHPTPFLRTREFLWQEGHTAFANPADAEKEVFQILDLYAGVYTDLLAIPVVKGRKSEKEKFAGGDFTTTVEAYVACNGRGIQGATSHHLGQNFSKMFDISYEDPAKEGERAFAWQNSWGLSTRTIGAMVMIHGDDKGLVLPPRVAAVQVIVVPVGFKTENKQSLFDAVDKVTKDLVADGVKAEHDLRENYNAGWKFNHWELKGVPIRFEVGPNDLAKNQGTRST

SEQ ID NO: 50 - protein, 189 aa, Caenorhabditis elegans
  C elegans public gene name=F40F8.10
  genomic DNA homolog sequence=SeqID_518
  cDNA homolog sequence=SeqID_1325
MARLKTVQSKVTKSPRRPFEKERLDQELKLIGTFGLKNKREVWRVKYTLAKVRKAARELLTLEDKDPKRLFEGNALLRRLVKIGVLDETKMKLDYVLGLKVEDFLERRLQTQVFKLGLAKSIHHARILIKQHHIRVRRQVVDVPSFIVRLDSQKHIDFSLQSPYGGGRPGRVKRRTLRKGDGAGGDDEE

SEQ ID NO: 51 - protein, 188 aa, Caenorhabditis elegans
  C elegans public gene name=K04G7.4
  genomic DNA homolog sequence=SeqID_529
  cDNA homolog sequence=SeqID_1326
MPGSMSKLGGLATGLLACSRSGALSNQVRGVVHKSLLRLPSEHPEPWDYKHNGFNYIDGLKDDTRSHFHQNSKLIVVEGNIGSGKTTLAKQLADQLGFVHFPEFRMDDILVDRYGNDLRNYYNKLVTVFQTFPCSIRIQVVNSQLPCKIAFSTAVSINISTHLLIFSIPVKELCSNVLHIRISFLPMQ

SEQ ID NO: 52 - protein, 451 aa, Caenorhabditis elegans
  C elegans public gene name=Y55H10A.1
  cDNA homolog sequence=SeqID_1327
MRVLFAVFSLIMACQAYDAVLFSNSREIGGTPAAKLVESATAEEPVVFIVNPDFTLGQFSVKANAYTSEPSADYLAKSVKNSNFHESQYFSHQIEATQAQWLSSADQYSAGSPIYIIYGEEWTSMEQLAEQLISKIDNSVGIITSTDAVAHEKSSRVKRVATDEFNSDSENSAAAEANGGFPFPLVIPPYNQTFYSVKPTNGHSCLFYLEGLTVVVEQKKEKVLYYANAYIPGSNFTWAYSETDVTCPNGTIGDFIFKIHLTLENDITGMQGTSKKAFTMKKGDKIDFDLTFTGDLFGYWALNKASASNLAISGYDPYKSASVDGSKVVNGSATQYTKLNSVAGWSLACGQSQAVFFPTNEQSVRIGVALMNTQIQLFNYQNPEKWVESAHFTLQTEDCTGTFSSGSWMGIVSALVLIAGLMFGYVMLQSVQTMDRFDDPKQRQIVINVRE

SEQ ID NO: 53 - protein, 157 aa, Caenorhabditis elegans
  C elegans public gene name=F29G9.3
  genomic DNA homolog sequence=SeqID_530
  cDNA homolog sequence=SeqID_1332
MMQYMLLFSRQGKLRLQKWYTAYPDKQKKKICRELITQILARKPKMCAFLEYKDLKVVYKRYASLYFCCAIEQNDNELITLEVIHRYVELLDKYFGSVCELDIIFNFEKAYFILDEFLLAGEIQETSKKQVLKAIAAQDLIQEEETPQGFFEDHGLG

SEQ ID NO: 54 - protein, 207 aa, Caenorhabditis elegans
  C elegans public gene name=F27C1.7
  cDNA homolog sequence=SeqID_1328
MAQLMKRGFSTSAALAKAQLVKTPIQVHGVEGRYAAALYSAGHKQNKLDQISTDLNNVRSVYKDNKKFQEFVLDPTLKANKKKTAIEAISTKLGLTKETGNFLGLLAENGRLNKLESVVSSFESIMRAHRGELFVQVTSAEELSSSNQKALSDALSKIGKSGQKLTVTYAVKPSILGGLVVTIGDKYVDLSIASRVKKYKDALATAI

SEQ ID NO: 55 - protein, 581 aa, Caenorhabditis elegans
  C elegans public gene name=Y55F3AR.3
  genomic DNA homolog sequence=SeqID_343
  cDNA homolog sequence=SeqID_1318
MAMKIPKSGYNRFMKEGAQHFKGTDEAVQRNIEACTELASQIRSAYGPNGMNKMVINHIEKLFVTNDAATILKELEIQHPAARIIIMATEMQEKQIGDNTNTVVILAAALLEHAANLIHMGMTPQEVAAGYEQAAEKALEILPTLVVKEATDMKNIEEVRQYIRSAITSKQYDNEDIIADLVAKACVTTCPANSFNFNVDNIRICKIIGSGVHTSTVMNGMVFKRGAEGEIREARDARIAVYTCPFDLTQTETKGTVLIENADELRNFSKGEEAEVEEQVKAIADNARSSILAKFWLMNFSKGEEAEVEEQQVKAIADNGVKVVVAAGKFGDMYLHFLNKYKIMAVRLTSKFDLRRLCRTVGAQPQARICAPAVNLLGHCDSVAVQEIGDENVVVFDKKSETGKVATIIIRGSSQSRIDDVERAVDDAVNTYKALTKDGKLLAGAGAVEIELAKEIESFGAKAPGLEQYAIKKFAHALETLPKAIAENAGMPTTETLTKLYAEHVAGKKNAGIDIWKRETMDAVVNNIFDLYAGKRLAIKLATDAASTILKVDQIIMSKQATGGPKPRGPKAQDEDDDGMA

SEQ ID NO: 56 - protein, 558 aa, Caenorhabditis elegans
  C elegans public gene name=F10C1.2
  genomic DNA homolog sequence=SeqID_384
  cDNA homolog sequence=SeqID_1432
MEAESAPQAPMSGGRVLKMVTEMGSATVGGISPALSANAAKSFLEATDKEKKTLQGLNDRLGNYIDRVKKLEEQNRKLVADLDELRGKWGKDTSEIKIKYSESLSTARKDIDDAARRKAEVDVKVARHRDDLAEYRSRYEDIQQRRESDREKISQWTNAIADAQSEVEMLRARFKQLTDEEKRVTADNSRIWEELQKARSDLDDETIGRIDFQNQVQTLMEELEFLRRVHEQEVKELQALLAQAPADTREFFKNELALAIRDIKDEYDIIAKQGKQDMESWYKLKVSEVQGSANRANMESTYQRDEVKRMRDNIGDLRGKLGDLENKNSLLEKEVQNLNYQLTDDQRQYEAALNDRDATLRRMREECQTLVAELQALLDTKQMLDAEIAIYRKMLEGEETRVGLTQMVEQAVKTHSLQQQENTDSTRSVRGEVSTKTTFQRSAKGNVTISECDPNGKFIKLENSHRNKDENVGEHKIRRKLDGRREIVYSIPANVVIKPGKNLTIYARDQGGINNPPESLVFDGENTWGIGANVVTSLVNKDGEERATHTQKTIQSGQ

SEQ ID NO: 57 - protein, 968 aa, Caenorhabditis elegans
  C elegans public gene name=F28H1.3
  genomic DNA homolog sequence=SeqID_414
MKHLTASEVRSTFINFFREKKEHTYVHSSSVIPHDDPTLLFANAGMNQFKPLFLGIADPNSDLAKLKRAVNTQKCIRAGGKHNDLDDVGKDVYHHTYFEMLGNWSFGDYFKKEIITWAWELLTTVYGIPAERLYVSVFGGDEANGVPADSEARDIWRSVGVPDERILNFGMKDNFWEMGDVGPCGPCSEIHYDRIGNRDASHLVNADDPMVVEIWNLVFIQFNREEGGVLKPLPAKHIDCGLGLERLIAVMQDKTSNYDTDIFQPIFEAIHKGSGVRAYTGFIGDEDKDGVDMAYRVVADHVRTLTIALSDGGRPDNSGRGYVLRRILRRGVRYASEKLNAQPGFFASLVPVVISILGETFPELSRDPVTVMDIINDEEKQFLKTLSRGRVLFQRAVQSLPEGTMTFPGDVSWRLYDTYGFPADLTQLMAEEKGLSVDNTAFEEARRKAIETSSAGTGKFRDTLDLDVHALAELQQKGVPTTDDSPKYAYTFTGEGSDAVYKFEPCVGKILAIRRDGKFVDQLAAGEEGAILLDRTNFYAEQGGQIYDVGVLTKVNDESNEFNVSNCQVRGGYIVLVGSAEGSFSVGDQVNERFDEDRKQLIMKNHTGTHVLNYALRKVLADSDQKGSLVAPDRMRFDFTNKAGMTVQQVKKAEEYAQQLIDTKGQVYAKNSPLGEAKKVKGLRAMFDETYPDPVRVVAVGTPVEQLLQNPDAEEGQNTTVEFCGGTHLQNVSHIGRIVIASEEAIAKGIRRIVALTGPEAERAIARADRLTARLEEESKHADKKDELLANKDKFKALQKKIQEIVDEANGAQLPYWRKDSIREKAKAIQKTLDGYTKAQQAAVAEKVLGEAKELAAVAEQPTVLVHVFAANANSKAIDNALKLLKDTKAVMAFSVNEDSGKVLCLAKVDKSLVSNGLKANEWVNEVCTVLGGKGGGKDANAQLTGENVDKLDAAVELAQKFALAAIN

SEQ ID NO: 58 - protein, 209 aa, Caenorhabditis elegans
  C elegans public gene name=C52E4.6
  genomic DNA homolog sequence=SeqID_488
  cDNA homolog sequence=SeqID_1460
MASFVEMRKLAEAKVQNMIRTIVKPKEQNGNVEPKKEEDEKFESTYKQNENTQITPSSFGKRPLYSKVDINCDKWLMTLDEESRLKIDNPPSLVDGLSKETESELRYLGCELIQQGAILLKLPQTAAATGQILFQRYYYQKSFVRYHFEHAVQACLLLASKIEEEPRRPREVYNVFHRLERLHRLQQSGHDINKRLEAKHGSSILRCFG

SEQ ID NO: 59 - protein, 352 aa, Caenorhabditis elegans
  C elegans public gene name=T01C3.7
  genomic DNA homolog sequence=SeqID_351
  cDNA homolog sequence=SeqID_1374
MGRPEFNRGGGGGGFRGGRGGDRGGSRGGFGGGGRGGYGGGDRGSFGGGDRGGFRGGRGGGDRGGFRGGRGGGDRGGFGGRGSPRGGFGGRGSPRGGRGSPRGGRGGAGGMRGGKTVVVEPHRLGGVFIVKGKEDALATKNMVVGESVYGEKRVSVDDGAGSIEYRVWNPFRSKLAASIMGGLENTHIKPGTKLLYLGAASGTTVSHCSDVVGPEGIVYAVEFSHRSGRDLLGVAKKRPNVVPIVEDARHPHKYRMLVGMVDVIFSDVAQPDQARIVALNAQNFLRNGGHAVISIKANCIDSTAEPEAVFAGEVNKLKEEKFKPLEQVTLEPYERDHAVVVAVYRPVKGKKV

SEQ ID NO: 60 - protein, 443 aa, Caenorhabditis elegans
  C elegans public gene name=T05H4.6
  genomic DNA homolog sequence=SeqID_477
  cDNA homolog sequence=SeqID_1367
MSAPAAGATAGGDDAADRNVEMWKIKRLIKSLELARGNGTSMISLIIPPKDQVARIQRMLAEEYGTASNIKSRVNRLSVLGAITSVQGRLKLYNKVPPNGLVVYCGTIMTDEGKEKKVNIDFEPFKAINTSLYLCDNKFHTEALQGLLADDNKFGFIIMDGNGCLFGTLQGNTREVLHKFTVDLPKKHGRGGQSAVRFARLRNEKRHNYVRKVAENSVEQFIKNDKVTVAGLILAGSADFKTELGQSDMFDQRLQAKMIKTVDIAYGGENGFNQAIELAADTLASVKFIQEKKLIGGYFDEISQDTGKYVFGVKDTLAALEMGAIETLICWENLDIVRYKMKNSLGEDILLNLRPDEEKDKSHFTDSETGQDMEIIETMPLLEWFANNYKNFGAALEIVTDKSQEGAQFVRGFGGIGGLLRYRVDLAHVDLEDELDNIDLDDY

SEQ ID NO: 61 - protein, 671 aa, Caenorhabditis elegans
  C elegans public gene name=K08B4.1
  genomic DNA homolog sequence=SeqID_464
  cDNA homolog sequence=SeqID_1345
MPLAYSTHDNFYESPKTPQPTWDHVHAQFPLGEPARNLDKFIEAMFQSVSPLAGVAAAPSQIAALQQIQALMTFQMQQNNLFPKIDTISKSPTPELASPSAKRMRLSPSTSSHSDVASTSKGTNGQDQSKNSPTNSDPFYTIGQSTPNTSSFLDTSNSSFGAPSTVVANPMTNYQLAFQAKLGSLHSLIGDSVQSLTSDRMIDFLSNKEKYECVISIFHAKVAQKSYGNEKRFFCPPPCIYLIGQGWKLKKDRVAQLYKTLKASAQKDAAIENDPIHEQQATELVAYIGIGSDTSERQQLDFSTGKVRHPGDQRQDPNIYDYCAAKTLYISDSDKRKYFDLNAQFFYGCGMEIGGFVSQRIKVISKPSKKKQSMKNTDCKYLCIASGTKVALFNRLRSQTVSTRYLHVEGNAFHASSTKWGAFTIHLFDDERGLQETDNFAVRDGFVYYGSVVKLVDSVTGIALPRLRIRKVDKQQVILDASCSEEPVSQLHKCAFQMIDNELVYLCLSHDKIIQHQATAINEHRHQINDGAAWTIISTDKAEYRFFEAMGQVANPISPCPVVGSLEVDGHGEASRVELHGRDFKPNLKVWFGATPVETTFRSEESLHCSIPPVSQVRNEQTHWMFTNRTTGDVEVPISLVRDDGVVYSSGLTFSYKSLERHGPCRIVSNY

SEQ ID NO: 62 - protein, 466 aa, Caenorhabditis elegans
  C elegans public gene name=C29F9.7
  genomic DNA homolog sequence=SeqID_355
MSLSTHYHAHKPNVPIIMEDVFGWVREGNAFQVRVWLDDHEHDLNVGDDHAFSLLHWAAKGGHVAIAEMLLSRGARVNSTNMGDDTSLHLAAAHGHRQIVVKLLSRKADVNATNEHGMTPLHYACFWGYEQIAEDLISCGAAVNVCNKKGMTPLDVCQPMCKNTILEIAQEHGQSPNDRVPFKDTTWKGTKSRTRDATLSRYTGVDVSSLNLITKIAESHSGELWRGKWQGNDIVARILNVQEVTARISRDFQTEFPALRIFAHPNICAVLAAANQPPNLVIISQYMPFGSLYNVLHEQSSVVIDHGQAVRFALDIARGMSYLHSLDPMLLRFYLSSKHVVVDEELTAKLSMADTKFSFQEVGKAYSPAWMSPEALSRAPEDLNIRAADMWSFAILLWELNTREVPFSDLPPMECGMKIALEGLRVHIPPGIARNMNRLMNICMNEDPGRRPNFDQIIPILERMIL

SEQ ID NO: 63 - protein, 214 aa, Caenorhabditis elegans
  C elegans public gene name=T01H3.1
  cDNA homolog sequence=SeqID_1463
MAAGAILKTTATLTVITTLIILGTGLFYMLSGQGHRFDIGWFLTSTSPHMWAGLGIGFSLSLSVLGAGWGIFTTGSSILGGGVKAPRIRTKNLVSIIFCEAVAIFGIIMAFVFVGKLAEFRREDLPDTEDGMAILARNLASGYMIFGGGLTVGLSNLVCGLAVGIVGSGAAIADAANPALFVKILIIEIFASAIGLFGMIIGIVQTNKASFGNK

SEQ ID NO: 64 - protein, 201 aa, Caenorhabditis elegans
  C elegans public gene name=B0361.10
  genomic DNA homolog sequence=SeqID_456
MKLYSILVFHKNVDTSDVKLFKSECDLSSFSFFQRGSVQEFMTFTAKLLVERSGLGARSSVKENEYLVHCYVRNDGLSAVCVTDAEYQQRVAMSFLGRVLDDFTTRVPATQWPGIRSDKDCSYTGLKDLLEKWQNPREADPMTRVQEEVEETKMVMHNTIQSVLDRGEKLDDLVKKSENLSDQSKMFYTSARKMNKCCNYV

SEQ ID NO: 65 - protein, 462 aa, Caenorhabditis elegans
  C elegans public gene name=F25B4.6
  genomic DNA homolog sequence=SeqID_345
  cDNA homolog sequence=SeqID_1437
MSLGQLSYTPVTDVGIGAIELYFPQNFVDQNDLEKFNNVSSGKYTIGLGQQQMGFCSDNEDIVSISLTVTRKLIETYKISTDSIGCLVVGTETMIDKSKSVKTALMDLFPGNSDIEGVDIKNACFGGAQALLHAIDWVTVNHPLDKKNAIVVVADIAIYEEGPARCTGGAGAIAFLICPDASIPIDRQFSACHMKNTWDFFKPITPIPSEYPVVDGSLSLSSYLEAVRMTYTYFISKVNRHTTGIDGLNSFDGVFLHSPFTKMVQKGLAVMNYTDSQLRHKQLNGNGVDHKLDENDRAGLAKMIELSAQVWKEKTDPYLVFNRRIGNMYTPSLFAQLLAYLAADDCVTGEKSILFFAYGSGLASAIFPGRVRQTSNLDKIRQVAIRAIKRLDDRIQFTPEEFTETLQKREVFLRSKEIPKSPSETSLFPNTYFLDNMDKLYRRSYTLHEEPNGVQNGNGIHH

SEQ ID NO: 66 - protein, 1008 aa, Caenorhabditis elegans
  C elegans public gene name=C04H5.6
  genomic DNA homolog sequence=SeqID_310
  cDNA homolog sequence=SeqID_1380
MSVEQFINDQLHSIVGISDRSICQYVHALAKKAKSAPDLVEKLRDAGDFPISPAIQSFADQLMSRMPRQATSARQRGPTTAELAEQELNRLNRAVGVLEDYSASSTKTKNVRKRKESSSEDDEAPIKASKPGKSVKPSKSDDSESDIEAMEAKLDADIAERDALAARINKKEKDKTRNVMEKKRDDNKDKEGSSMDKLREESRRQYLKKRKVDKLEELEAIVHDDQTLFAREKLTKREKADMEYRKKVLEYTKAHGKAGDVMKMKRYHLPDASTKQIPSQYVEDDEEDFRPGGDGAKWEEEQLMASMLHLGAKDAKRKEQEFELLLDEKVDFIQALQMPGTNEEVVETEAEKKKMSIEETRKSLPVYAFRDAFIEAVKEHQVLIIEGETGSGKTTQLPQYLYEAGFCEGGKRIGCTQPRRVAAMSVAARVADEVGCKLGTQVGYSIRFEDCTSEKTVLKYMTDGMLLREFLNEPDLASYSVMMIDEAHERTLHTDILFGLVKDIARFRKDLKLLISSATLDAEKFSSFFDDAPIFRIPGRRFPVDIYYTQAPEADYVDAAIVTIMQIHLTQPLPGDILVFLTGQEEIETVQEALMERSKALGSKIKELIPLPVYANLPSDLQAKIFEPTPKDARKVVLATNIAETSVTIDGINYVIDPGFSKQNSFDARSGVEHLHVVTISKAAANQRAGRAGRTGPGKCFRLYTAWAYKHELEEQPIPEIQRTNLGNVVLMLKSLGIHDLVHFDFLDPPPQETLVIALEQLYALGALNHRGELTKLGRRMAEFPCDPCMSKMIIASEKYECSEEIVTIAAMLSCNAAVFYRPKAQVIHADSARKGFWSPAGDHITLMNVYNKWQESSFSQRWCVENYVQHRTMKRARDVRDQLVGLLERVEIETKSSTDTIKIRKAITAGYFYNVSKLDNTGHYKTVKHKHTTHPHPNSCLFEETPRWVVYFELVFTSKEFMREMSEIESGWLLEVAPHYYKGRELEDATNKKMPKNKGKSGKDLER

SEQ ID NO: 67 - protein, 678 aa, Caenorhabditis elegans
  C elegans public gene name=T10F2.1
  genomic DNA homolog sequence=SeqID_301
  cDNA homolog sequence=SeqID_1447
MATPEIEAKLAPLRAAVKEYGDLIRDLKAKGAPKIDIDKAVVELKARKRLLEDTEIALAPKEASFDRLKLEDLLKRRFFYDQSFAIYGGVTGLYDFGPMGCSLKANMLQEWRKHFILEEGMLEVDCTSLTPEPVLKASGHVDRFADWMVKDMKNGECFRADHLIKNSIEKLLNDKKTSAAVKQDGQDVLARLEGFDNKDMHEVITRFNFKSPITGNDLTEPIAFNLMFPTQIGPTGDFKAFLRPETAQGIFVNFKRLLEFNQGKLPFAAAQIGLGFRNEISPRQGLIRVREFTMCEIEHFVDPEDKSLAKFAKVADQKLVLFSACNQLDGAPAQEVAIGEAVAKKTVANETLGYYMARCHQFLMKVGIDGRRLRFRQHLSNEMAHYAQDCWDAEILTSYGWIECVGNADRACYDLQQHYKATNVKLVAEKKLPEPVDVNFVEAQANMALLGKSFKKDAKKIQTSLQQLTSEQVSALEEELLAKKLYNLSVDGQNYALTPEHLNIKKYTKKIHVQEITPSVIEPSYGIGRIMYALLEHSFRQREGDEQRTFLAFKPLVAPIKCSVLPISANDTLIPVMDAVKEELSRFEMSYKVDDSSGTIGRRYARTDEIGIPFGITVDFDSLKTTPFTVTIRHAETMSQIRLEVSELGRLISDLVAGRQQWSDAQAKYPKFEASATE

SEQ ID NO: 68 - protein, 1186 aa, Caenorhabditis elegans
  C elegans public gene name=R74.1
  genomic DNA homolog sequence=SeqID_420
  cDNA homolog sequence=SeqID_1280
MSKINKERKKVAQLQEIEKSIQELWESKKAFEADARDDGKPKYLVTFPFPYMNGRLHLGHTFSASKCEFAAGFQRLQGKEVLFPFGFHCTGMPIKACADKLKREMQDFGYPPNFPEDVVEEVKEEVSAVDEIIKDKSKGKKSKLVAKTGNAKYQWQIMKSLGLCDEEIKEFSDPNHWLYYFPPHCIADLKKMGLKADWRRSFITTDVNPYFDSFVRWQFNLLRAAKKIDFGKRYTIYSPKDGQPCMDHDRASGEGVGPQEYTLIKLKVLDPKPQALSHIKEDIYLVAATLRPETMYGQTNCYLHPDIQYSVFYATENEKQVFVATARSARIMSYQGLTKENGKVNYVLGLEKIAGSKILGAPLSAPLAKYERVYALPMLTIKDDKGTGVVTSVPSDSPDDFAALSDLKKKKPLREKYGLTDEMVLPFEPVPIIKIEGLGDLAAVEMCSRLKIESQNEKDKLEEAKKEVYLKGFYDGVMLVGKYAGKKTADVKKVIQDDLTAEGLATKYVEPEKKVMSRSGDECVVALCDQWYLNYGEAEWKAAAKKVLEPLRTFNDETRRGLETTVDWLHEYACSRSYGLGTKLPWDTQYLIESLSDSTIYNAYYTVAHLLQQGAFDGSVVGPAGIKADQMTDASWSYVFLGEIYDSKTMPVEEEKLKSLRKEFMYWYPIDMRASGKDLIGNHLTYLLFNHAAIWPTDTSKWPKGIRANGHLLLNNEKMSKSTGNFMTLEEAIEKFSADGMRLSLADAGDGLEDANFVYAMADAAILRLFTMIEWIKEMIEQRDAGLLRKDAKKFADRVFANEMNSLIAATEQNYEATNFKDALKTGFFEYQAIRDTYRELCAGIDEPMSESLVFRFIETQMLILSPICPHIAEYIWQLLGKDGLIVNAPWPTVDPVDEKLAIGARFITESLAEFRARLKTYMTPKKKALKEIPEVPTEAVIYVAKEYPPWQKTILDILEKQAKANNGALPDNKAISQLIGKEESLKKFAKKAMPFVQMIKERFEQKGVSALASSSPVDQTSILNENIDFIMNALDLDRVTIRHTDEEGIDANIVETTVPLVPMLNFTPNRPTIKLVARNVQICNAMFDVDVPIVNGDSVSMVIRKMRRISKAIKPKFEVSLWRYKNAVWGDRQMISYRNPFEENIQLSDADIFNFEADNKISVTSGSEKFDLGRTIVYKANVPEN

SEQ ID NO: 69 - protein, 268 aa, Caenorhabditis elegans
  C elegans public gene name=T10E9.7
  genomic DNA homolog sequence=SeqID_344
  cDNA homolog sequence=SeqID_1454
MLGSVIRQAVSRQIVRNSPISTTAAVAQTNQTGDKKESPKKPTIWKIDEHKRERLANFGKYAAECLPKFVQKVQFAAGDELELLIHPSGVVPVLSFLKGNHSAQFTNLTFITGMDVPTRKNRLEVIYSLYSVRFNARVRVRTYTDEIAPIDSATPVFKGADWFEREVYDMYGVWFNNHPDLRRILTDYGFEGHPFRKDYPLSGYNEVRYDPELKRVVYEPSELAQEFRKFDLNTPWETFPAFRNQSITSGYETILEVAEPTPATPQNK

SEQ ID NO: 70 - protein, 855 aa, Caenorhabditis elegans
  C elegans public gene name=C50F2.3
  genomic DNA homolog sequence=SeqID_445
  cDNA homolog sequence=SeqID_1341
MADKENATKIEKMPNSETMKGISSEDVPFEEDIIRNPTSVNCWQRYIDHKLQNKSPAKQMFLIYERALAVFERSYKLWYHYLKYRESTIVNKCPTDNSWRALCDTYERCLMRLHKMPRIWICYCEVMIKRGLITETRRVFDRALRSLPVTQHMRIWTLYIGFLTSHDLPETTIRVYRRYLKMNPKAREDYVEYLIERDQIDEAAKELTTLVNQDQNVSEKGRTAHQLWTQLCDLISKNPVKIFSLNVDAIIRQGIYRYTDQVGFLWCSLADYYIRSAEFERARDVYEEAIAKVSTVRDFAQVYDAYAAFEEREVSIMMQEVEQSGDPEEEVDLEWMFQRYQHLMERKNELMNSVLLRQNPHNVGEWLNRVNIYEGNYNKQIETFKEAVKSVNPKIQVGKVRDLWIGLAKLYEDNGDLDAARKTFETAVISQFGGVSELANVWCAYAEMEMKHKRAKAALTVMQRACVVPKPGDYENMQSVQARVHRSPILWAMYADYEECCGTVESCRKVYDKMIELRVASPQMIMNYAMFLEENEYFELAFQAYEKGIALFKWPGVFDIWNTYLVKFIKRYGGKKLERARDLFEQCLENCPPTHAKYIFLLYAKLEEEHGLARHALSIYNRACSGVDRADMHSMYNIYIKKVQEMYGIAQCRPIFERAISELPEDKSRAMSLRYAQLETTVGEIDRARAIYAHAAEISDPKVHVKFWDTWKNFEVAHGNEATVRDMLRVRRSVEASYNVNVTLTSVQMRVDAERKAQETTTSSNPMDSLDQQQQQPSDGAGSITQVSMNKGNISFVRGAGKTVQQNTTENPDEIDLDEDDDDEEDDGGDADISVKVVPAQIFGNLKLAEEEEEA

SEQ ID NO: 71 - protein, 513 aa, Caenorhabditis elegans
  C elegans public gene name=T25G3.3
  genomic DNA homolog sequence=SeqID_499
MQSLDIKPTVGLIACCECGVAIEPNPANMCSGCLRSRVDITEGITRQCTIYMCKFCDRYFVPPSAWMRAELESKELLSICLKKLKPMLTKVRLTDACFVWTEAHSKRIKVKITIQKEVFTNTILQQAVVVEFTVHSQLCDDCRRAEAKDFWRACVQVRQRAEFKKTLFYLEQLLLKHSAHKECTGVKPVPTGIDFYFAKQQEARKFVDFLMTVLPCKYHYAQELVSHDTKNNTYDYKHTFCVEIVPICRDNIVCLPKKQAQQYGNMSQIVLCLRVSNVITLIDPNNLQLVDVQATNFWREPFDSLCGPKQLTEFYVLDVEPVNNFERKAGHGYVSKKHELADVWLVRSDQVGMSDAQSLSARTHIGHLLSPGDLVMAFDMKNCNVNNATFDAMNIDNVPDAIIVRKVFDRTRRTAKRQWKLKRLVVDGNIVGNETASVADEFQGFMEDIEEDALMREKINIYKDAEKGPNVDGDDAEDHPDAPTLAEMLDDLKFDDEEMKEAESAEDDEAMQE

SEQ ID NO: 72 - protein, 419 aa, Caenorhabditis elegans
  C elegans public gene name=R06A4.4
  genomic DNA homolog sequence=SeqID_346
MAFQPDQHELEQLLRCSLDGNKKVQEAACSAFATLEEEAGEQLIPFLGEILDQLVKAFQCYQAKNLLILYDAIGTLANSVGDALSHPVYVQMLMPPLMEKWERLSDEDKELFPLLECISAIVSAMGQSFLPYIQPVFTRCCSLIEKCVQQNQQHIMAPDQVEAPETDFIIVALDLLSGLAESLPEHMDPLVANSKLVELMLFCSLDVTPDVRQSCFALLGDLTKACPERVLPQSSNFIFFLAQNLDPSKISVCNNAIWALGELALKMGPAMKQFIGPIIEPLIVVINSQQNMQRTLLENTAITIGRLGQCCGEELAPHISRFVRPCCYSLRNIKDNAEKESAFIGLCNMINMNPVGVLNDFIFWCDAIASWTVPTDSLRVLFAGILQSFKQQVGDFNWNNFILQLPPPLRERLSAFYQI

SEQ ID NO: 73 - protein, 342 aa, Caenorhabditis elegans
  C elegans public gene name=F19B6.2
  genomic DNA homolog sequence=SeqID_429
  cDNA homolog sequence=SeqID_1414
MQAWIQQGLHGMQMGGRVGNYDQTFVVYGPVFLPNATQSKISEINYGGKILLPSSALNLLMQYNIPMPMLFKLTNMAVQRVTHCGVLEFSAPEGQAILPLWMMQQLGLDDGDTIRIESATLPKATFAKLKPMSLEFLNITNPKAVLEVELRKYACLTKNDRIPTSYAGQTLEFLVVDLKPANSVCIIECDVNLDFDPPEGYVEQPRQVTPAVTAKPPAPDASAFIGAGQKAGGSGGTGQNATSVFGGAGRRLDGKKKPSSSVSLSDGTGVSTSNAAPVANDLPAIPPVVVNEDYKPGRVSFLRYDYKRVDVLEKELREKEASKAGQPSNVFRGGNRTLRGAR

SEQ ID NO: 74 - protein, 590 aa, Caenorhabditis elegans
  C elegans public gene name=F48E8.5
  genomic DNA homolog sequence=SeqID_342
  cDNA homolog sequence=SeqID_1395
MSVVEEATDDALYPIAVLIDELRNEDVTLRLNSIRKLSTIALALGVERTRNELIQFLTDTIYDEDEVLLVLAEQLGNFTPLVGGPDHVHCLLLPLENLATVEETVVRDKAVESLRKIADKHSSASLEEHFVPMLRRLATGDWFTSRTSACGLFSVVYPRVSPAIKSELKSMFRTLCRDDTPMVRRAAAAKLGEFAKVFEKTAVIEGLHSSLTDLHVDEQDSVRLLTVESAIAFGTLLDKANKKKLIEPILIELFDDKSWRVRYMVAEKLIEIQNVLGEDMDTTHLVNMYTNLLKDPEGEVRCAATQRLQEFALNLPEDKRQNIICNSLLNVAKELVTDGNQLVKSELAGVIMGLAPLIGKEQTVSELLPIYMQLLNDQTPEVRLNIISSLDKVNEVIGAAQLSTSLLPAIVGLAEDGKWRVRLAIVQFMPLLASQLGQEFFDEKLLPLCLNWLTDHVFSIREASTLIMKELTQKFGGQWASTNIVPKMQKLQKDTNYLQRMTCLFCLNTLSEAMTQEQILKEIMPIVKDLVEDDVPNVRFNAAKSLKRIGKNLTPSTLTSEVKPLLEKLGKDSDFDVRYFSEEAKNSLGL

SEQ ID NO: 75 - protein, 2271 aa, Caenorhabditis elegans
  C elegans public gene name=F18C12.2
  genomic DNA homolog sequence=SeqID_370
MAQFCSENRDIACYLVTKHSWKGKYKRVFSIGTLAITTYNPNTLEITNQWLYEDFLSVKPLRNGGSNDSKQDEYKIHVRNRGKNNDMRFSSDYTTDILTHCLQFSTKFADKNFEPLTVTAFKQSWSDRRIPVTLRANASCLEQIDNRGVVVQSYPYKNIRSIGKVSDCPGGFVVDVGEHRRRHMFASSNNEELVKEIRRLASDNIGIIVPIAKEQLTLEDFMRTRLGLCSRDEELTSYAEFKISKITRRNEMPVRRLLCLSETCIIERDLATYAVICATPLKHIVCLVRSEKDPQQFIVEYENGDGRAYVAAERDLILASLLDGIRASGNNEVFVCGHRFERNLRVIPFSTNLDEDSESQCMKHIIAPPPGLRRCDLIRRFNANVPYSGLRFSKSHEGFFSENKGKVIVNAIEAVLMENYTKDDKEYKHKTEAQLQCLRRLFASKSGFQAFTEVNGVREKLGSLVVRVLSWKSESIDHSTVEALCALMYPMHDQYELRIEQLNKQSLMSSPKFVENLLDLIVLHVDRSTGWLVIASMLNFLTFSVCSPYSETTAGDTFDHILKLVSLRGRSFFRLFQCPSMTIVKGAGMVMRAIIEEADVETSKSMQMLALSEGAFLTHLFMSLLSTGKDLRVMTNKQLSGHLISLWIADNQQANDLLIRCLPRGLLNYMESDEKVPVNEKDLLIVRNNFDAASNETKQNAMKEKFDQLRVTAEAGLERFVQHWDLEQKLNFLPKRVIDEKQQQRQQPVVLRKRRNRVRPNVNWKLFAYQFSKDHSQADLIWNEKTREEFRHAMDTETRALISEKEQAPTGLPIAWNHTEFQIRYPSLLEEIKIGDYYLRLLLIEADENATPIHNPLEFFNNVYHRFLLSTKVDMKCLCLRAMAITYSRHHMTIGAFQDSKYFVEMLQKCINPLERDHLVLLLSKLALNKDNVRELIISNILPLLVDLCVLAHLHVQRAKVQNQTNVIEASAEQMAEGGSEEWYYHDKDAKQVGPLSFEKMKSLYTEKTIFEKSQIWAAGMDKWMSLAAVPQFRWTVCQQKDQPNEINTGKGPFQATVMNFTDLSVLCLDTILQMCEFFPSRDSHDCVVRPMPSVKKQLTEPVLLYQLVQLLLTYEPQIVQRVALLLYLVMQDNPFLPRLYLSGVFYFILMYNGSNVLPIARFLHYTHMKQAFRSTLPQFEGQRQSVLATLLPEAATFYLEQYGPEKYAEVFLGEFDNPEIIWNTAMRRHLIERIAVHVADFSHRLTSNVRALYQFCPIPLIDYPELAQELFCHVYYLRHLCNKQRFPDWEIRDPIPFLRCCLATWYNELEKKPATMSVDLAREILSVDLTNEEHRKPAFIRRQYYKLAAKYHPDKNPEGREMFERINAAYELLSSETANNSGMPDSHRIVLCLQAQSIIYSRYSQELSEYKYAGYSQLIKTIDLEAKDEALFIKGGGDLLSAAIELANYTLISSALNAEQLRRDNGLEALVTAFDRCVPMVTMSSLPDDMAVRVCIHVCDCFATAATFEACRQRLMEMPSIFGALTRLLQFSNLPRLSTAAAQCIRAMAVDTLLQFQLFQTGVLWQLVPHLFHFDYTLDEGGVQHSEDSNKQSLANSLARSSCEALAALAGFRENTPDNDGVQASLRALLTPYICRCMKLETNDMVLKTLNSNMENPYMIWDNGTRAEVLEFVERHRTSNEPTSELYGAEFELSVHKNELIVGDIFIRIYNEQPTFALHEPKKVAIDLLDYIKKHSAELTGAPKPKAISDDLIEIDWGNGSQANGNSLDTETKVLMTMTALANLVSANPGVEILLIGNFPLLITYLRCRKHPKLQIAALQVILLAAANKECVTDLATCNVTTTLFTLLRDQPKMIARVLDVLIALSSNGQIGKEMLEHGGLMYILSILCLTNSDQGQRLQAAELLAKLQADKLTGPRWTRFIIKFLPEIFADSLRDSPNTALQMFDSSSENPELIWNEVTRQKVKGIIDTEVGKLYEQHIKDPTVKWNTTSLADKSCAYGDSINGELVVGGVFVRLYVENPGFNVRHPKLFSTELIEKVLELMSRPTPELDLVTKAFVELVRHHPNTADQLPSQGYLPQFCTAMCLQNTSASRSAILILQELSENQFCCDALSQLPCIDGIMKSMKNQPSLMRESAHALKCLMKRNTGELAQQMLSCGMVPYLLQVLDSSMNGVSNGAAARAEIVDALKSAILDLKVGQKIAEILDKSPVWAQFKDQRHDLFLPEARTQAITGGPTGVAGYLTEGMFNPPPMSNQPPPMHQTSGDFQPPL

SEQ ID NO: 76 - protein, 86 aa, Caenorhabditis elegans
  C elegans public gene name=F49C12.13
  cDNA homolog sequence=SeqID_1466
MGILIPLVSVSAFWAIIGFGGPWIVPKGPNRGIIQLMIIMTAVCCWMFWIMVFLHQLNPLIGPQINVKTIRWISEKWGDAPNVINN

SEQ ID NO: 77 - protein, 426 aa, Caenorhabditis elegans
  C elegans public gene name=F55A12.7
  genomic DNA homolog sequence=SeqID_390
  cDNA homolog sequence=SeqID_1294
MSISGLFILDLKGNVVISRNYRGDVDMSCIEKFMPLLVEKEDEGSASPVLVHQGISYTYIKYMNVYLVTISKKNTNVILVLSALYKIVEVFCEYFKTLEEEAVRDNFVIIYELFDEMLDFGYPQTTESKILQEFITQQGNRLETVRPPMAVTNAVSWRSEGIKYRKNEVFLDVIESVNMLANAQGTVLRSEIVGSIRFRVVLSGMPELRLGLNDKVFFQQSGASSRRGNSGKGVELEDIKFHQCVRLSRFDSERTISFIPPDGEFELMSYRLTTQVKPLIWVEAAVERHAHSRVEYMVKAKSQFKRQSVANHVEVIIPVPSDVSAPKFKTGAGTAKYVPELNAIVWSIRSFPGGREYIMRSSFMLPSIGSEELEGRPPINVKFEIPYYTTSGLQVRYLKIIEKSGYQALPWVRYVTQNGDYQMRMT

SEQ ID NO: 78 - protein, 487 aa, Caenorhabditis elegans
  C elegans public gene name=W01B11.3
  genomic DNA homolog sequence=SeqID_476
MLVLFEVAAGYAVFKLSNEKKLKNVDNIWEEFSTAEKAQENLQLVSFKKFKTTAGAVEATSEITEGKLSKTLKKLLKSSVDETEKLAVGDAKLGNLIKEKLSLNCVHDSSINELMRGVRAHIEDLLAEHKEEMNAMNLAVAHSLARYKVKFNPEKIDTMIVQAVSLLDDLDKELNNYVMRVREWYGWHFPELGKTIQDHQAYAKIIKAIGMRQNCINTDLSSILPEELEEKVKEDAEISMGTDISDIDLIHIKGLCDQVIELSAYRAQLFDYLKNRMTALAPNLTVLLGELVGARLISHAGSLVSLAKAPASTIQILGAEKALFRALKTKKDTPKYGLIYHAQLITQAPPKVKGKMARKLAAKCSLATRIDALSDESATNEIGIECRAALENVLRTESERGPSKNKSFGSHRHDKYEFKSETYEYDASADTPASRKHKRFDDNEESTNAIKKMKIEEVKEEDEAEPEKKKKKKEKKAKKADTDSDEE

SEQ ID NO: 79 - protein, 531 aa, Caenorhabditis elegans
  C elegans public gene name=R13A5.12
  genomic DNA homolog sequence=SeqID_322
  cDNA homolog sequence=SeqID_1394
MKDRFKQKYTAGAAVAYMSRKQALKKLQLTLKDFRRLCIIKGIYPHEPAHKKQANKGSTANKVFYYRKDINFLAHEPIINKFRDYKVFLRKLNHLKAKKEEDKLKKLYENKPVYSLDTIVKERFPTFGSALRDMDDALSLCFTFAMLPHTRVLKEGMIDSCRKLTAEFMHYVIESQSLRNTFISIKGIYYQAEVHGEKITWVVPHERGLPHVTDVDFTVLVTFVEFYIAMLGFVNFKLYQDIGLFYPPQIGQVVKTDEMETEEYKEKVYSLAKPLAKRKDVEQAEDDEPLDLLGEDSDALAQKVREAKSIKTMFKGCVFYLNRECPKEALTFIIRNGGGIVGWEGGPTDLKADSKNISHHVVDRPMDKLEVNRLYVQPQWVFDCLNARRKLPTERYMPGVALPPHFSPFTSEKAGDYIPFERLEELRSMGKDVSDLEAAIPKTMDELPMRRKEVKPEKPKGIHIAVGQMHKKSKEKFHETVEKGQELKMRELMISKKHQRVYHSMKTTFKRNRNDALKLKKKAKLAKATEA

SEQ ID NO: 80 - protein, 1400 aa, Caenorhabditis elegans
  C elegans public gene name=C42D4.8
  genomic DNA homolog sequence=SeqID_358
  cDNA homolog sequence=SeqID_1444
MGKEQFREADKALKVVGVKFAPGDCEFMRQTAHVPIFNNKLYEDVEGKLQPANYGPLDPKMGVSTKTGTCSTCGLGLTDCVGHFGYFDLDVPVFHIGFFKLTIQLLQCICKNCSSILLTPEQHRVFSRQVMNPNLDYLHRKALHKRIVAACKKGSTCSHCGLKNGTVKKAVGAVLKIAFASPVSVDELGKFATMFSSNQEVGDHVRKMKFTLLNPLFVQKLFSNIKEGDIPVLMVRSGEEKHPNDLLLTRMPVPPVCIRPSVVSEVKAGTTEDDVTMKLMEIMLTNDVLKKHKRDGAPSKTLFETWEHLQIQCALYINSEMSGLPPDMQPKRAMRAFTQRLKGKQGRFRGNLCGKRVDFSGRTVISPDPNLRIDQVGVPIHVAMTLTFPEIVNASNIEKMRQLVINGSDVHPGANYLVEKKTGNKKLLKYGKRDELAKNLRMGDTIERHLDDNDVVLFNRQPSLHKISIMSHRAKVMPGRTFRFNECACTPYNADFDGDEMNLHLPQTYEAKAEASELMNVKNNLITPRSGEPLVAAIQDFITGGYLLTHKDTFLPRAEVYRFAAALIDASAKKQTKIRIPPPAIRRPVELWTGKQLIELIIRPDKGSDVSLNLTAKNKSYTGNLELCSKDSYVIIRNSVLLAGCLDKSLLGSSSKVNIFYMLMRDYGEDAAVDAMWRLARMAPVFLSNRGFSIGIGDVRPSEQLLREKGQLVDNGYSKCSQYIKELEEGKLKAQPGCTEEETLESIILRELSTIRDHAGQVCLRNLSKYNAPLTMAVCGSKGSFINISQMIACVGQQAISGHRPPDGFEERSLPHFERKKKTPEAKGFVANSFYSGLTPTEFFFHTMGGREGLVDTAVKTAETGYMQRRLVKCLEDLCASYDGTVRSSVGDVIEFVFGEDGLDPAMMEAKDGSVVDFTHVLEHAKNIQTTKEQPIPVDKLDEVLKAEIQKKFKGKYVHFADKLSEYITQTEIKKSKKWQNGKAHCGNHETADLKTKESCKICKNLEAYKTSLLANSCLTKTQLCSFIELCYYKVARAITEPGTAVGAIAATSIGEPSTQMTLKTFHFAGVASMNITQGVPRIKEIINAVKTISTPIITAALLDPYDESLARRVKARIEKTTLGEICDYIEEVYLPDDYFLLVKLNSKRIRLLQLEVCMESISYAIATSKVCPQMRGCKIVAHGKTMMAIRPPSTSKLSKTMTMQILKYSLANVVVKGIPSVNRCVIHADEKKGDFYSLLVEGTDFRSVLSSVGVDPRKTNFNNALVVADVLGIEAARSCIINEIIATMDAHGIGLDRRHVMLLADVMTYRGEVLGITRNGLVKMKDSVLLLASFEKTMDHLFEAAFFSQRDVIHGVSECIIMGTPMTVGTGTFKLMQKYDKKAVLKQNSPIFERLNVTL

SEQ ID NO: 81 - protein, 117 aa, Caenorhabditis elegans
  C elegans public gene name=F39B2.6
  genomic DNA homolog sequence=SeqID_431
  cDNA homolog sequence=SeqID_1476
MTFKRRNHGRNKKNRGHVAFIRCTNCGRCCPKDKAIKKFVVRNIVEAAAVRDIGDASAYTQYALPKLYHKLHYCIACAIHSKVVRNRSREARRDRNPPPRFGQRAAAARPGAPGPRP

SEQ ID NO: 82 - protein, 430 aa, Caenorhabditis elegans
  C elegans public gene name=F28C6.3
  genomic DNA homolog sequence=SeqID_416
  cDNA homolog sequence=SeqID_1398
MKPDIKDREYMYRLIIGQLFYDGHQQIAVNLANTLGCSAPAPPPSDKLFRLVTIAKQFVEDPDYKAEEKSSPMQFEPVSSGLDLEYDADVQPVSSEPSEYETIYLTVHKAPCRAAAFNSDGSLVATGSADCSIKIMDVERILAREKEHREMNENGPDAHHPVIRTLYDHVDDVNTVIFHPRDSILISGSNDKTVKLFDFSKTAVKKAMKTLSEVYPVRALSCHPGGEFLLVATDHPTVRLYNIETAQAYASANPDDQHTESVTDVHYSENARLYVTASKDGHVKIWDGVSNRCVETFKRAHDGSSICSAKFTKNGKYILTSGMDSIVKLWELSTNRCLIVYTGAGATGAQDFATNASFNHNEDYVLFPDEKSGSMCSWDARNSDRKRLLALGHTSACRTFVHSPSMPAFMTGSDDHRARFWYRKPATNEH

SEQ ID NO: 83 - protein, 403 aa, Caenorhabditis elegans
  C elegans public gene name=T17E9.2
  genomic DNA homolog sequence=SeqID_436
MPNIPTAPRDMDEARSKSFQFWSTQPVPQMDETVPADVNCAIEENIALDKVRAEPFSLPAGFRWSNVDLSDEEQLNELYNLLTRNYVEDDDSMFRFDYSADFLKWALQVPGFRPEWHCGVRADSNNRLLAFIGAVPQTVRVYDKTVNMVEINFLCVHKNLRSRRVAPVLIREITRRVNVTGIFQAAFTAGIVIPKPVSVCRYYHRSLNPRKLIDVRFSHLSAKMTMARTIKLYKLPEETATRNLREMKSTDVPQVFKLLTTSLKQYSLAPVYNSEEELAHALVPKKGVVYSYVAENQNGKITDFVSFYSLPSTVMGHTTHKTIYAAYLYYYVAGSVTPKQLINDSLILANREKFDVFNALDLMHNEKIFSDLKFGKGDGNLQYYLYNWKCADMKPSQIGLVLQ

SEQ ID NO: 84 - protein, 417 aa, Caenorhabditis elegans
  C elegans public gene name=K07A1.12
  genomic DNA homolog sequence=SeqID_484
  cDNA homolog sequence=SeqID_1431
MATLEDGTSEDRVANDEYKIWKKNTPFLYDLVMTHALEWPSLSVQWLPDVAKDNSDHTIHRLILGTHTSDEQNHLLISKICMPTDDAQFDASRYDTERSEYGGFGAVNGKVEPDIRINHEGEVNRARYMPQKSNIIATKSPHADVYIFDYLKHSAVPRDNTFNPLIRLKGHTKEGYGLSWNPNKEGLILSASDDQTVCHWDINANQNVAGELQAKDVFKGHESVVEDVAWHVLHDGVFGSVGDDKKLLIWDVRTSTPGHCIDAHSAEVNCLAFNPYSEFILATGSADKTVALWDLRNLRMKLHSFESHRDEIFQVQWSPHNETILASSGTDKRLHVWDLSKIGEDQSAEDAEDGPPELLFIHGGHTAKISDFSWNPNEPWVVCSVSEDNILQVWQMADNIYNEVDEETPADVVERQQ

SEQ ID NO: 85 - protein, 2198 aa, Caenorhabditis elegans
  C elegans public gene name=D2085.1
  genomic DNA homolog sequence=SeqID_330
MRATLHLEDGSTFVGSIYGATKSVVGEIVFQTGMVGYVESLTDPSYAKQLLTLTYPLIGNYGVPSAEILDQFKLPAEFESDRIWPAALIVEKICVDGEHSHWQAVQSLSEWLRKADVPCLSGIDVRQLVKKIRETGTMKAKLVIESDNAQNFDYVDVNAENLVDFVSRKEPVVYGSGDQTILAVDCGLKNNQIRCLAKRGFRVKVVPWNHPIDTESDYDGLFLSNGPGDPEICAPLVDRLAKVIARGDKPIFGICLGHQILSRAIGAKTYKLKYGNRGHNQPCTHYATGRCYITSQNHGYAVDPDSLPADWKALFTNENDKTNEGIVHSSKPFFSVQFHPEHTAGPTDCEFLFDVFADSVRQAKSGTFMNVDQELTRLMTFTPIYHAKEQRKVLVLGSGGLTIGQAGEFDYSGAQALKALREEGIRTVLINPNIATVQTSKGFADFTYFLPITKEYVTDVIKKERPTGILCTFGGQTALNCAIDLYKDGIFEQYDVQVLGTQINTIMKTEDRDLFNQEISAIGEKVAPSKAATTMEGAIEAAEELGYPVLVRAAYALGGLGSGFADNREELIAIAQQALAHSNQVLVDKSLKGWKEVEYEVVRDAYDNCITVCNMENVDPLGIHTGESVVVAPSQTLSDREYNALRTCAIKVIRHLGIIGECNIQYALDPYSLTYYIIEVNARLSRSSALASKATGYPLAYVAAKLALGQHLPVIRNSVTGTTTACFEPSLDYCVVKIPRWDLGKFARVSTQIGSSMKSVGEVMGIGRCFEEALQKALRMVSDHADGFSPYTFSRPTTADDLSKPTDKRMFALARGMYYGDFDVEKAHELTRIDRWFLFRMQNIVDIYHRLEKTDVNTVSAELLLEAKQAGFSDRQIAKKIGSNEYTVREARFVKGITPCVKQIDTVAGEWPAQTNYLYTTFNGIENDVSFNMKNAVMVLGSGVYRIGSSVEFDSSCVGCIRELKALGYSTITVNCNPETVSTDYDICDRLYFEEISFETVLDVYHLEKPKGVILAFGGQAPNNIAMSLSRAQVKIFGTSPNDIDNAEDRFKFSRKLESLKISQPQWKKSENMEDAKNFCAQVGYPCLIRPSYVLSGAAMNVAHNAEDLEVFLKQAAVVAKEHPVVVSKFINEAKELDVDAVALDGKLVVMAVSEHIENAGVHSGDATLVTPAQDMNKLTLDRIKDITFRIAEAFNVTGPFNMQLIAKNNELKVIECNLRVSRSFPFVSKTLDYDFVALATRAMMASDSPAIRATIKPTATLLKGKGRVGVKVPQFSFSRLAGADVMLGVEMASTGEVACFGTSRCDAYLKALLSTGFVVPKQNIFISIGGYHAKAEMLKSVEALLKLGYELYGSKGTADYFQSNKINVKPVDWPFEEGSSDEKTASGTRSVVEFLENKEFHLVINLPIRGSGAYRVSAFRTHGYKTRRMAIDNGIPLITDIKCAKTFIQALEMVGKRPTMNSLVDCVTSKSLKRLPGMVDIHVHVREPGATHKEDWATCSKAALAGGVTTILAMPNTSPVLVDTDSFYQTEQLASAKSVVDYALYIGATPNNSKFAAEFADKAAGLKMYLNETFSTLKMDNISDWAKHLSAFPANRPIVCHAEKQTLAAILCMAQMANRAVHIAHVATADEINLVKEAKQRGWNVTCEVCPHHLFLIEEDLPDGIREVRPRLVKPEDRQALWDNMEYIDCFATDHAPHTWAEKTGKDGKIPPGFPGVEYMLPLLLTAVHDGKLTMKELTDRMSTNPRRIFNLPPQDDTYIEVDLNEEWTIPENGGQSKAGWTPFAGRKVFGKVHNVIIRGEEAVIDGRIVAIPGFGKNVRLYPHSGTAHRGDSDFDQILEPIPQQMIESSSDEQSPLHTPPRAHTPIAFPGELLAKNCISVKHLDKGQINRIFELADRYKHDVEKGHPLTHILNGKVLVNLFYEVSTRTSCSFSAAMQRLGGSVISVDSQSSSVQKGETLEDTVQVLGSYGDILVLRSNENGAADRAARVCDQPVINGGDGTGEHPTQALLDVYTIRQEMGTVNGLTIALVGDLKNGRTVHSLAKLLCLYKDITLHYVAPSTELEMPQEVLDYVSSKSNFVQKKFTSLAEGINHVDVVYVTRIQKERFSSPDEYNKVKGSYVINAKLLNEAARDVEEPSSLLVPARSLPIVMHPLPRVDEIAVELDHDERAAYFRQAKNGVFVRMSILSLLLGRGHL

SEQ ID NO: 86 - protein, 404 aa, Caenorhabditis elegans
  C elegans public gene name=Y52B11A.9
  genomic DNA homolog sequence=SeqID_312
MGKHEKGSSKDLANRTKSKGLQKLKFFCQMCQKQCRDANGFKCHLTSEAHQRQLLLFAENSNSYLRQFSNDFEKNFMQLLRTSYGTKRVRANEVYNAFIKDKGHVHMNSTVWHSLTGFVQYLGSSGKCKIDEGDKGWYIAYIDQEALIRKEEDQRKQQQEKDDEERHMQIMDGMVQRGKELAGDDEHEYEATELIRDTPDQKIQLDLNLGILDRKLDVKSGVASAKISIFDMPKVKKEDPDEPGPSQPSRKSGKKRSRSRSPAAKKFSKKSALDEIKEMEERKKERKNRKDYWMREGIVVKVITKSLGSEYYKAKGVVRKVVDDYTAQVKLDDGTVVKLDQEHVETVIPSLGRQMMIVNGAYRGQEATLESIDEKRFSLRLKIASGPTRGRQIDVPYEDASKLA

SEQ ID NO: 87 - protein, 504 aa, Caenorhabditis elegans
  C elegans public gene name=C30C11.2
  genomic DNA homolog sequence=SeqID_430
  cDNA homolog sequence=SeqID_1382
MAPKTGETVVEKMEVDEAKQDVPATEPAKDLNAIAVENIKEQLAALDKGEEHLITRVLQVLPKTRKQINDNVLYKLVSSHLSSDAQFAEGMLKYLHYTPAADTEVQPMDTSNVKTKSPKKGVKPVFASPESDCYLRLLVLLHLYAQKKNTEALALGENQLTSIYNFDRRTLDGLAAKTLYFLCVIYEREGRLFDHQGFLNSRLRTATLRNFSESQAVLICWLLRCYLINRQYQSAAHLVSKVAFPDNASNNDLARYMYYQGRIKALQLDYNSAAGYFLQAQRKAPQEGAIGFKQAVQKWVVVIGLLQGEIPDRSVFRQPIYRKCLAHYLDLSRGVRDGDVARFNHNLEQFKTQFEADDTLTLIVRLRQNVIKTAIKQISLAYSRIYIKDIAKKLYITNETETEYIVAKAIADGAIDAVITSDVRDGPRYMQSSETADIYRTSEPQAHFDTRIRYCLELHNQAVKALRYPPKKKIAVETIEQAREREQQELEFAKELADEDDDDF

SEQ ID NO: 88 - protein, 441 aa, Caenorhabditis elegans
  C elegans public gene name=R160.1
  genomic DNA homolog sequence=SeqID_323
  cDNA homolog sequence=SeqID_1294
MIGGLFVYNHKGEVLISRIYRDDVTRNAVDAFRVNVIHARQQVRSPVTNMARTSFFHVKRGNVWICAVTRQNVNAAMVFEFLKRFADTMQSYFGKLNEENVKNNFVLIYELLDEILDFGYPQNTDPGVLKTFITQQGVRTADAPVPVTKEEQSQITSQVTGQIGWRREGIKYRRNELFLDVIEYVNLLMNQQGQVLSAHVAGKVAMKSYLSGMPECKFGINDKITIEGKSKPGSDDPNKASRAAVAIDDCQFHQCVKLTKFETEHAISFIPPDGEYELMRYRTTKDIQLPFRVIPLVREVSRNKMEVKVVVKSNFKPSLLAQKLEVRIPTPPNTSGVQLICMKGKAKYKAGENAIVWKIKRMAGMKESQISAEIDLLSTGNVEKKKWNRPPVSMNFEVPFAPSGLKVRYLKVFEPKLNYSDHDVIKWVRYIGRSGLYETRC

SEQ ID NO: 89 - protein, 244 aa, Caenorhabditis elegans
  C elegans public gene name=F53G12.10
  genomic DNA homolog sequence=SeqID_450
  cDNA homolog sequence=SeqID_1350
MAPTKKVPQVPETVLKRRKQRADARTKAAQHKVTVAAKNKEKKTQYFKRAEKYVQEYRNAQKEGLRLKREAEAKGDFYVPAEHKVAFVVRIRGINQLHPKPRKALQILRLRQINNGVFVKLNKATLPLLRIIEPYVAWGYPNNKTIHDLLYKRGYAKVDGNRVPITDNTIVEQSLGKFNIICLEDLAHEIATVGPHFKEATNFLWPFKLNNPTGGWTKKTNHFVEGGDFGNREDQINNLLRKMV

SEQ ID NO: 90 - protein, 439 aa, Caenorhabditis elegans
  C elegans public gene name=F55F8.5
  cDNA homolog sequence=SeqID_1428
MDLADLMEVENGDHSINQKHVQITFFSKDEEIPQIPDAVFDVPTGAECDDMNLLLNKTIEANDGAWKERRFEFLVGETFLRTSLAEFIEEYEVETETILKVECVIGIEAPKPLHDIQAPDWVSSVQIANGHIFSTTYGGDIVIVDRKGKETKLAVNSANRLLKCISIVKAPSKKNQLDGTEFVVGGENQLLTLYAIEKGALVEKLILRGHERAVECVSVNSDSTRAISGSVDTNLKIWNLDASDEATTYEKEEEEESAKKRRKKETKTKVPMVTIGGHRDKVSAVEWCPWNSGHAFSCSWDHTIVEWDLELAGEISRIKGPKSFTSIDLHPKSDLLISSCTDAIPRLYDPKNRDGSMVKQSFIGHQNGWVEAVKWNPLDTNQFVSVSTDKTAKMWDVRSSKSSLFDIHGHDDRILCATWNEGLIATGSADCTIKIFETA

SEQ ID NO: 91 - protein, 535 aa, Caenorhabditis elegans
  C elegans public gene name=T27F2.1
  genomic DNA homolog sequence=SeqID_364
MSMKLRDILPAPVAADEAASQIRRDPWFGGRDNEPSAALVSKEPPPYGKRTSFRPRGPEDFGDGGAFPEIHVAQFPLGLGLGDMRGKPENTLALQYGTDGKLQHDAIARIGHVKDKVVYSKLNDMKAKTWNEDDDDIQKPDDDAVIDATEKTRMALEKIVNSKVASALPVRHADKLAPAQYIRYTPSQQNGAAGSQQRIIRMVEEQKDPMEPPKFKINQKIPRAPPSPPAPVMHSPPRKMTAKDQNDWKIPPCISNWKNPKGFTVGLDKRLAADGRGLQQTHINENFAKLADALYIADRKAREEVETRAQLERRVAQNKKSEQEAKMAEAAAKARQERSAMRRKDDEDDEQVKVREEIRRDRLDDIRKERNIARSRPDKADKLRKERERDISEKIVLGLPDTNQKRTGEPQFDQRLFDKTQGLDSGAMDDDTYNPYDAAWRGGDSVQQHVYRPSKNLDNDVYGGDLDKIIEQKNRFVADKGFSGAEGSSRGSGPVQFEKDQDVFGLSSLFEHTKEKKRGGDGGDSRGESKRSRRD

SEQ ID NO: 92 - protein, 277 aa, Caenorhabditis elegans
  C elegans public gene name=C47B2.4
  cDNA homolog sequence=SeqID_1421
MATADVKSTVPHMDMDRGGAFDFSNCIRNQAMCKMGGKAPKLTSTGTTIVAVAFKGGLVMGADSRATAGNIIADKHCEKVHKLTESIYACGAGTAADLDQVTKMLSGNLRLLELNTGRKARVITALRQAKQHLFNYQGYIGAYLLIGGVDPTGPHLYMCSANGTTMAFPFTAQGSGSYAAITILERDFKVDMTKDEAEKLVQRALEAGMHGDNASGNSLNLVIIEPSETVFKGPIVPEFCKRPEPNDLVYKFQAGATKVLKHKTYKYDVVESMDITH

SEQ ID NO: 93 - protein, 195 aa, Caenorhabditis elegans
  C elegans public gene name=B0303.15
  genomic DNA homolog sequence=SeqID_398
  cDNA homolog sequence=SeqID_1465
MASKGAARVRKKEIVKVVHGALLRTNIKAQMASAAPPLGPQLGQRGLNVANFCKEFNKETGHFKQGVPLPTRITVKPDRTYDLEICTPTTTWLLKQAAGIGRGKASKDEIVGKLTVKHLYEIAKIKSRDKALQHVPLEQICRMLIKTCRTLGIDVQYHDLDPVELKEFLVARKEKVDAQLKDLADKKAAKMLRTT

SEQ ID NO: 94 - protein, 581 aa, Caenorhabditis elegans
  C elegans public gene name=W10G6.3
  genomic DNA homolog sequence=SeqID_384
  cDNA homolog sequence=SeqID_1432
MTDPDSYRSSITSRPSFNRTVTSSSQNYGAPGSGNRVLKIVTETHSSSVSSGLSPYGQNAASTIRDNREREKKEIMELNDRLASYIEKVRFLDAQNRKLDADLKMLQGRFGKSTGSVKVMYEMEITTATNVVKQTGKDHGETEKEIRKLQDQLDELRKKFEEAQRGRAEDRLKIDDLLVTLSNLEAEINLLKRRIALLEEEVARLKKENFRLTSELQRVRIELDQETLLRIDNQNKVKTILEEIDFMKRGFETELKELQAQAARDTTSENREYFKNELANAMRDIRAEYDQIMNGNRNDMESWYQLRVQEINTQSNRQNAENNYQKEEVKRLRNQTSELRQKLSDLESRNLLLEKQIEDLNYQLEDDQRSYEAALNDKDAQIRKLREECQALMVELQMLLDTKQTLDGELKVYRQMLEGNSEGNGLRQLVEKVVRTSAINEEADTETMRVVKGEHSSRTSYQRSAKGNVAIKETSPEGKFVILENTHRAKEEPLGDWKLKRKIDGKREIVFTFPSDYILHPFQSVKIFARGQGIANPPEVLIFEGDETFGVGANVQTILYNNKGEERATHIQRQSQQTTSS

SEQ ID NO: 95 - protein, 205 aa, Caenorhabditis elegans
  C elegans public gene name=C39F7.4
  genomic DNA homolog sequence=SeqID_394
  cDNA homolog sequence=SeqID_1436
MAAMNPEYDYLFKLLLIGDSGVGKSCLLLRFADDTYTESYISTIGVDFKIRTIELDGKTIKLQIWDTAGQERFRTITSSYYRGAHGIIVVYDITDQETFNNVKQWLQEIDRYACENVNKLLVGNKCDLTAKRAVETQAAQDYAGQLGIPFLETSAKSSTNVEQAFLTMASEIKSRMGPVQGAGGAPGVRITGSQPVQDKKSGGCC

SEQ ID NO: 96 - protein, 105 aa, Caenorhabditis elegans
  C elegans public gene name=T26A5.7
  cDNA homolog sequence=SeqID_1449
MEYSEAKVIEEQYSNDEEIGSYMYFFEHNNKKWCIDATKESPWKGRLINHSVLRPNLKTKVVEIDGSHHLILVARRQIAQGEELLYDYGDRSAETIAKNPWLVNT

SEQ ID NO: 97 - protein, 1127 aa, Caenorhabditis elegans
  C elegans public gene name=F14B4.3
  genomic DNA homolog sequence=SeqID_313
  cDNA homolog sequence=SeqID_1279
MDCDIASYHVDSFDFLVSKGCQFAAQAVPAEKFRLKNGDAVTMKFTSAQLHKPTLDTGAKLTSDTLPLLPAECRQRGLTYAGNLKVGIDVHVNGSRLDIIEIILGKVPIMLRSEGCHLRGMSRKELVVAGEEPIEKGGYFIVNGSEKVIRLLIANRRNFPIAIIRKTFKEKGKLFSEFGVMMRSVKENHTAVMMTLHYLDTGTMQLALQFRREIFYVPLMYIVKALTDKNDAVISAGFKRGRNQDQFYSSCILNMLAQCQEEEILNQEAAIRAIGSRFRVAVSDRVAPWEDDLEAGRFIIRECVLIHLDSDEEKFHTLAYMTQKLIALVKGECAPETPDNPQFQEASVSGHILLLILRERMENIIGMVRRKLEYMSSRKDFILTSAAILKALGNHTGGEITRGMAYFLATGNLVTRVGLALQQESGFSVIAERINQLRFVSHFRAIHRGAFFMEMRTTDVRKLRPEAWGFICPVHTPDGAPCGLLNHVTASCRIVTDLSDNSNVPSLLAELGMYTHKTVALAPPGEELYPVLMNGRFLGYVPITKAASIERYLRCAKVAKDARIPYTSEIALVRRSTDIKNIQTQYPGIYILSDAGRLIRPVRNLAMDAVEHIGTFEQVYLSVVLDPEEAEPGVTMHQELHPSCLFSFAGNLIPFPDHNQSPRNVYQCQMGKQTMGTAVHAWHSRADNKMYRLQFPQQPMLKLEAYEKYEMDEYPLGTNACVAVISYTGYDMEDAMTINKASYQRGFAHGTVIKVERINLVTERERKTIFYRNPREEIKTVGPDGLPIPGRRYFLDEVYYVTFNMETGDFRTHKFHYAEPAYCGLVRIVEQGEGDSGAKHALIQWRIERNPIIGDKFASRHGQKGINSFLWPVESLPFSETGMVPDIIFNPHGFPSRMTIGMMIESMAGKAAATHGENYDASPFVFNEDNTAINHFGELLTKAGYNYYGNETFYSGVDGRQMEMQIFFGIVYYQRLRHMIADKFQVRATGPIDPITHQPVKGRKKGGGIRFGEMERDAIIAHGTSFVLQDRLLNCSDRDVAYACRRCGSLLSVLMSSRAGSHLLKKKRKDDEPLDYTETQRCRTCDKDDQVFLLQVPRVFRYLTAELAAMNVKIKLGIEHPSKVTGS

SEQ ID NO: 98 - protein, 595 aa, Caenorhabditis elegans
  C elegans public gene name=Y43F4B.5
  genomic DNA homolog sequence=SeqID_448
  cDNA homolog sequence=SeqID_1283
MTLGCAKLDKQVADWLAWDKNDKNRNEIQKLVDEKNVDALKARMDTRLVFGTAGVRSPMQAGFGRLNDLTIIQITHGFARHMLNVYGQPKNGVAIGFDGRYNSRRFAELSANVFVRNNIPVYLFSEVSPTPVVSWATIKLGCDAGLIITASHNPKEDNGYKAYWSNGAQIIGPHDTEIVRIKEAEPQPRDEYWDLSELKSSPLFHSADVVIDPYFEVEKSLNFTREINGSTPLKFTYSAFHGIGYHYTKRMFAEFGFPASSFISVAEQQDPNPDFPTIPFPNPEEGRKVLTLAMETADKNGSTVILANDPDADRIQMAEKQKDGEWRVFTGNEMGALITWWIWTNWRKANPNADASKVYILNSAVSSQIVKTIADAEGFKNETTLTGFKWMGNRAEELRADGNQVILAWEESIGYMPGHTMDKDGVSAAAVFAEIAAFLHAEGKSLQDQLYALYNRYGFHLVRSTYWMVPAPEVTKKLFSTLRADLKFPTKIGEAEVASVRDLTIGYDNSKPDNKPVLPLSTSSEMVTFFLKTGSVTTLRASGTEPKIKYYIELITAPGKTQNDLESVISEMDQLEKDVVATLLRPQQFGLIPRK

SEQ ID NO: 99 - protein, 494 aa, Caenorhabditis elegans
  C elegans public gene name=D1054.15
  genomic DNA homolog sequence=SeqID_473
  cDNA homolog sequence=SeqID_1352
MSASVSDPYEQMPAAPTDDDLEDKPEADKKALLNQVFKSLKRAQDLFYHDYAQPPPMPEENDSLIRSMKRKHEYGNVIKKVEEMKVRRENEMLALPTSQPMHGTGSVIASAGTPLAITDGSGKLVNQQQGSAKSGTLLPLVPLGNSSKGEDNTTRSLLPSKAPMMMKPKWHAPWKLYRVASGHTGWVRAVDVEPGNQWFASGGADRIIKIWDLASGQLKLSLTGHISSVRAVKVSPRHPFLFSGGEDKQVKCWDLEYNKVIRHYHGHLSAVQALSVHPSLDVLVTCARDSTARVWDMRTKAQVHCFAGHTNTVADVVCQSVDPQVITASHDATVRLWDLAAGRSMCTLTHHKKSVRALTIHPRLNMFASASPDNIKQWKLPKGEFMQNLSGHNAIINTLSSNDDGVVVSGADNGSLCFWDWRSGFCFQKIQTKPQPGSIESEAGIYASCFDKTGLRLITAEADKTIKMYKEDDEATEESHPIVWRPEIVKKKAY

SEQ ID NO: 100 - protein, 180 aa, Caenorhabditis elegans
  C elegans public gene name=Y37D8A.10
  cDNA homolog sequence=SeqID_1339
MTDEPVKVVNKWDGPTVKNALDEVVKKILNDKVGWTESHNLMNLRLLISFIGVAFSAFACGYDYYEPFPKSKIVLAVCSVSYFICMGILQMYQWYVEKDCIYEATEVDGKQSRKWAWSSEIKAHDDKYTLSAEFKKEGRSGQGKITKSIGAYIDNDGEIIVPLVKKEVDDLYNRLIRSEQ

SEQ ID NO: 101 - protein, 437 aa, Caenorhabditis elegans
  C elegans public gene name=K02F2.2
  genomic DNA homolog sequence=SeqID_442
  cDNA homolog sequence=SeqID_1284
MAQSKPAYKVADIKLADFGRKEIILAENEMPGLMAMRSKYGPSQPLKGARIAGCLHMTIQTAVLIETLTALGAEVQWSSCNIFSTQDHAAAAIAQTGVPVYAWKGETDEEYEWCIEQTIVFKDGQPLNMILDDGGDLTNLVHAKYPQYLAGIRGLSEETTTGVHNLAKMLAKGDLKVPAINVNDSVTKSKFDNLYGIRESLPDGIKRATDVMLAGKVAVVAGYGDVGKGSAASLKAFGSRVIVTEIDPINALQAAMEGYEVTTLEEAAPKANIIVTTTGCKDIVTGKHFELLPNDAIVCNVGHFDCEIDVKWLNTNATKKDTIKPQVDRYTLKNGRHVILLAEGRLVNLGCATGHPSFVMSNSFTNQVLAQVELWTKFGTPQEYKLGLYVLPKTLDEEVAYLHLAQLGVKLTKLSDEQASYLGVPVAGPYKPDHYRY

SEQ ID NO: 102 - protein, 580 aa, Caenorhabditis elegans
  C elegans public gene name=M57.2
  cDNA homolog sequence=SeqID_1372
MHFVKKVPTTEEEKAAKQKEHTKRSQQFLHVRDKIVAKREKGEYDDEILSLTQAILEKNADIYTFWNIRRTTIELRMEANEKVQQSADAEEEEKTKSSQKIENLLAGELFLSYECIKSNPKSYSAWYQRAWALQRQSAPDFKKELALCEKALQLDCRNFHCWDHRRIVARMAKRSEAEELEFSNKLINDNFSNYSAWHYRSIALKNIHRDEKTGAPKIDDELIASELQKVKNAFFMDAEDQSAWTYTRWLLEVGSGKEFLRPESHTPIELISASFHGNNTTLVFSRAVTIQFLLTFVDTENTTGWRAFSSTSPNPTSSRVWQYLSDTPLRVVTSNPTDLENISWTELNEQPYVNLDRLKTIYDVVEVPQPAYIGELLEDCKQLIELEPKNKWPLYMRTLVLLEYQPIKSYEEIIKNLENLSENLDPKRSELYKSLISRQNLNFSIREQFERILGPDTDWLTCRYSKLTSLEGVEYLAGFVGSADFSGNRLKEIQRIVLPNLKSLTINENPIESLPPSPCLSHLTFFSIAGTQIASVSAVMPFFQTIPSLDRLVFCETPLVEKTEELRAQLPGVRLIPHWL

SEQ ID NO: 103 - protein, 584 aa, Caenorhabditis elegans
  C elegans public gene name=T01D1.2
  genomic DNA homolog sequence=SeqID_490
  cDNA homolog sequence=SeqID_1362
MSGAVLPAVLVVPKMESVVVPIAESTVINAKDTTPSTAADNDVSPSPSEPDTDAIKMFVGQIPRQWNETDCRRLFEKYGSVFSCNILRDKSTQASKGCCFVTFYHRKDAIEAQGALHNIKVIEGMHHPVQMKPADTENRNERKLFIGQLSKKHNEENLREIFAKFGHIEDCSVLRDQDGKSRGCAFVTFTNRSCAVVATKEMHHSQTMEGCSAPLVVKFADTQKDKDVKTKSMITGSGAGSPKGGAASLLQNLNPALLQQLGGGQNYQAVASLLSLINGQQGQQQQHQQQQNVLGILGTVLSALGKLTEGGDDASAKSSSEKPRHQALMTSPAPTATSSTSSSASHHHQQHQQQLSQQQQQQQHPQQQGLGNPLLGNPAMAAQNQFDAITMAQIAHQQQMLALQGFAVQQGAPSQQQQGLAGGMAGAKTTSPVAASLANHQQIALTPFAGGAAALDHFQAMQQYALLANLQATGGVGVQATTSAAQMVGNGDVKGPDGANLFIYHLPQDFGDSDLINTFAPFGGILSAKVFIDKVTNLSKCFGFVSYENAQSATNAISAMNGFQIGSKRLKVQLKVDRGNPYNR

SEQ ID NO: 104 - protein, 987 aa, Caenorhabditis elegans
  C elegans public gene name=R06C7.8
  genomic DNA homolog sequence=SeqID_463
MSHIRVAFAPLDTNPSTCGLETFATQIETLSQMMTAEEMKAELYDCVRRILREQKFDQIRENEAMLRLYKVMGRSSTNLKGRGIYEQLFKKDHFTGSLKFYLQWAEECGKDQMLEEFKDVLKLARDRLSERIEMTAIESGFRDLVDEYFNGESGDMFTRPDETMDLFRFNAGSKKKRRSSVCFLQHNVPINNSGKAAFGPKTKTDLRQACIDRPNYHGISIEEFRFAKWKDTFGEDVDDDYRKRKDSGVVFVKHQVIDTDRQAREEVENRFNANLNPRRRHLSPVSEKTVDDEEEKRSRIYSPLVATKDAHRPALRSKIENPPATVTLSSDTKSASEKDVSDSDDADDDERLKIMTAGRKDGNPPDRSTSISSNYSTASARTSKSGAGLDLMAENKCLEAHAMFSDTVHLASEKTMVLGDDSVFVPERSLATTQIVTDFSVLCDPDPTMTITQERPKKVSNGLNVVYDEAAEPEESQKVEESEVQPEIVLVSPVTQTSPATMFNDIYDDEIEFGFFKPSRGNFVTSTPAQGVHLVNIDEYFGNKEEESTHEQEAPVFVAPTSSTFSKLTRRKSLAANQAVQPSVTESSKPERSDPKDSSIDCLTANLGRRLSIGADEIPNLTENNESEITGCKIRRRSEIIKQGDINPWDETLRKKLMCLVRPPQNMHEFQERAPKIQALRDCEVSGEKLHIQTLIGQGGYAKVYRAVTDDQRTVAVKYEVPSCSWEVYICDQMRNRLKDRGLELMAKCCIMEVMDAYVYSTASLLVNQYHEYGTLLEYANNMKDPNWHITCFLITQMARVVKEVHASKIIHGDIKPDNFMITRKIDDKWGKDALMSNDSFVIKIIDWGRAIDMMPLKNQRFKGRAGTEAFDCPEMVDGRSWTYQADYFGFAATMAVVVAGKYAQLTGASVGDYSLNVDIKRRNILRDACYDVINRFLNIPSCDSLPDWNILIKSFSEIWNEKFEASGWRQAVSKFNEACDLAANQK

SEQ ID NO: 105 - protein, 1261 aa, Caenorhabditis elegans
  C elegans public gene name=Y47D3A.26
  genomic DNA homolog sequence=SeqID_380
  cDNA homolog sequence=SeqID_1375
MKIKEVRITGFRSYKDNTNVSGFSPRSNVVVGRNGSGKSNFFHAIQFVLSDEYAHLKEEQRLGLLHESTGPKVAHARVEITFDNSEKRLMAFENSEVKIVRQVGKKKDQYYIDNKMVPRAEVVNLMESAGFSRSNPYYIVKQGKINELATSPDAYKLKLLREVAGTRVYDERKEESLKILKETKMKTEKIQGLLKYIDERLQTLENEKEDLKEYQKLDKTKRSVEYTMYDNTNKEAIKEKTKLDEQKVELNQKDNNVKSQLNDVIAEMAKLKTDKKKLESLGRGLREDKETLQAEETKMVEEKMTLKLEIDSLNEENTRERQGRQNAEHSLQGVGDEIFKNEEELDTIKPEYAKLLEEESRLKTDIRIDESRAKEILAKQGQRSQFSSVDDRDKFLRNEIRRISGLIADNKEREETIQKELADVEREDEKLNNEIQSISRTIDENRYEMDTFAAKSTSLKQEYDAAYVAQQTAAREEKAIRDKIGNTEQDISAANDQLRRIVARPVYNGITGVRKVIEEFKHDNRNGQHDDVINGYYGTVIELAEVPDMFRTAVEVIAQNRLFYHVVETDRIATKILRKFNEMQLPGEINFFPMNRVSAPRQRDLSNNSNARPMSDVIDYEVQYDKVFKSITANVIIVRTLDQAARDLRNEGFDVVSVDGDQMSKKGVMTGGFIDKKRSKLELHTQKDRFTKELAELQKSLAEAEKMVRERTQEAEKIRNRMQQHENQIGDFHRKHRELTEAKNAISQQFYMVTSTKEPKKDQLLGIKNHLRELLAQKENFEQEIGSNMSSQLTSDEEQTVKKLRKKVDEMTKQLATVSRRRMDLMHRKNAIENLLTKKLYKTKESLTARVDDISDNERRHKLENANAQLTSLLTRMESTRKQLATAISELQDYETKEKALQINIDNVLEQQRDLEKQQADFQLQYDKITAKEDEVKQKREDSLKKLILSRYSIKTRKNQFSYEISDSEEVGAKREPIEHRKLKISTFCLEYRAKLEKVHSNMRLLGALPTDTFSKWQNVKPRELEKKLLECVNELKKYENVNKKALDQYMTASSQKEELTKRMAEQKKSEDSIEELLKVLENRKYEAIDLTFKQVKKNFEQVFKQLVPHGRGKMQMRAREQRDDEEGINSVELYEGISVLVSFVSDDGDSETREMTQLSGGQKSLVALAIIFSIQKCDPAPFYLFDEIDAALDAQHRKSVADMIQSLSDQAQFVTTTFRPELLATAEKFYGVRFRNKVSHIDSVTREQAYDFVEDDTTHG

SEQ ID NO: 106 - protein, 184 aa, Caenorhabditis elegans
  C elegans public gene name=F22B5.1
  genomic DNA homolog sequence=SeqID_392
  cDNA homolog sequence=SeqID_1366
MGFLKILRKQRAREREMRILILGLDNAGKTTLMKKFLDEPTDTIEPTLGFDIKTVHFKDFQLNLWDVGGQKSLRSYWKNYFESTDALIWVVDSSDRERLLQCSEELKKLLGEERLAGASLLVLANKSDLPGAIDVNSIAQVLDLHSIKSHHWKIFSCCALSGDRLVQAMTWLCDDVGSRLFILD

SEQ ID NO: 107 - protein, 538 aa, Caenorhabditis elegans
  C elegans public gene name=F25B5.4
  genomic DNA homolog sequence=SeqID_457
  cDNA homolog sequence=SeqID_1381
MQIFVKTLTGKTITLEVEASDTIENVKAKIQDKEGIPPDQQRLIFAGKQLEDGRTLSDYNIQKESTLHLVLRLRGGMQIFVKTLTGKTITLEVEASDTIENVKAKIQDKEGIPPDQQRLIFAGKQLEDGRTLSDYNIQKESTLHLVLRLRGGMQIFVKTLTGKTITLEVEASDTIENVKAKIQDKEGIPPDQQRLIFAGKQLEDGRTLSDYNIQKESTLHLVLRLRGGMQIFVKTLTGKTITLEVEASDTIENVKAKIQDKEGIPPDQQRLIFAGKQLEDGRTLSDYNIQKESTLHLVLRLRGGMQIFVKTLTGKTITLEVEASDTIENVKAKIQDKEGIPPDQQRLIFAGKQLEDGRTLSDYNIQKESTLHLVLRLRGGMQIFVKTLIGKTITLEVEASDTIENVKAKIQDKEGIPPDQQRLIFAGKQLEDGRTLSDYNIQKESTLHLVLRLRGGMQIFVKTLTGKTITLEVEASDTIENVKAKIQDKEGIPPDQQRLIFAGVYSSFGAPSQRRYADLRQDFDWKNHHSRGRSFGHH

SEQ ID NO: 108 - protein, 208 aa, Caenorhabditis elegans
  C elegans public gene name=F42C5.8
  cDNA homolog sequence=SeqID_1300
MGISRDSWHKRYKTGATQPVPHKKRKFELGRPAANTKIGAHRVRLVRTRGGNEKYRALRLDSGNFSWASEQTTRKTRIVDTMYNATNNELVRTKTLVKGAIISVDAAPFRQWYEAHYALPLARKKNAKLSEEDNAILNKKRSHHTMKKYTERQKTAAVDALLIEQFNTGRLLARISSSPGQVGQANGYILEGKELDFYLRKIRAKKAK

SEQ ID NO: 109 - protein, 226 aa, Caenorhabditis elegans
  C elegans public gene name=C17H12.14
  genomic DNA homolog sequence=SeqID_377
  cDNA homolog sequence=SeqID_1453
MGISDNDVQKQLRHMMAFIEQEANEKAEEIDAKAEEEFNIEKGRLVQQQRQKIMEFFEKKEKQVELQRKIQASNSLNAGRLRCLKAREDHIGAVLDEARSNLSRISGDAARYPAILKGLVMQGLLQLLEKEVVLRCREKDLRLVEQLLPECLDGLQKEWGSTTKVVLDKQNFLPSESAGGVELSARAGKIKVSSTLESRLELIANQIVPQVRTALFGPNPNRSFFD

SEQ ID NO: 110 - protein, 463 aa, Caenorhabditis elegans
  C elegans public gene name=R03G5.1
  genomic DNA homolog sequence=SeqID_422
  cDNA homolog sequence=SeqID_1384
MGKEKVHINIVVIGHVDSGKSTTTGHLIYKCGGIDKRTIEKFEKEAQEMGKGSFKYAWVLDKLKAERERGITIDIALWKFETAKYYITIIDAPGHRDFIKNMITGTSQADCAVLVVACGTGEFEAGISKNGQTREHALLAQTLGVKQLIVACNKMDSTEPPFSEARFTEITNEVSGFIKKIGYNPKAVPFVPISGFNGDNMLEVSSNMPWFKGWAVERKEGNASGKTLLEALDSIIPPQRPTDRPLRLPLQDVYKIGGIGTVPVGRVETGIIKPGMVVTFAPQNVTTEVKSVEMHHESLPEAVPGDNVGFNVKNVSVKDIRRGSVCSDSKQDPAKEARTFHAQVIIMNHPGQISNGYTPVLDCHTAHIACKFNELKEKVDRRTGKKVEDFPKFLKSGDAGIVELIPTKPLCVESFTDYAPLGRFAVRDMRQTVAVGVIKSVEKSDGSSGKVTKSAQKAAPKKK

SEQ ID NO: 111 - protein, 684 aa, Caenorhabditis elegans
  C elegans public gene name=C47D12.6
  genomic DNA homolog sequence=SeqID_331
  cDNA homolog sequence=SeqID_1340
MSKAPTDMAPWPAFIEERIKLWDKLKAEYDAEIAAKESEPIQITLPDGKIHEGKTWRTTPFEIAERISKGLAEAAVIAKVNGAVWDLDRPFEGNAKLELLKFDDDEAKQVFWHSSAHVLGEAMERYCGGHLCYGPPIQEGFYYDMWHENRTICPDDFPKIDQIVKAAVKDKQKFERLEMTKEDLLEMFKYNEFKVRIITEKIHTPKTTVYRCGPLIDLCRGPHVRHTGKVKAMAITKNSSSYWEGKADAESLQRLYGISFPDSKQLKEWQKLQEEAAKRDHRKLGKEHDLFFFHQLSPGSAFWYPKGAHIYNKLVDFIRKQYRRRGFTEVITPNMYNKKLWETSGHWQHYSEDMFKIEVEKEEFGLKPMNCPGHCLMFGHMPHTYNELPFRFADFGVLHRNEMSGALTGLTRVRRFQQDDAHIFCRQDQISEEIKQCLDFLEYAYEKVFGFTFKLNLSTRPEGFLGNIETWDKAEADLTNALNASGRKWVLNPGDGAFYGPKIDITIQDALKRNFQCATIQLDFQLPNQFDLSYFDEKGEKQRPVMIHRAVLGSVERMTAILTESYGGKWPFWLSPRQCKIITVHESVRDYANDVKKQIFEAGFEIEYEENCGDTMNKQVRKAQLAQFNFILVIGAKEKENGTVNVRTRDNAVRGEVALDKLISKFRRFADEYVADTEKSEEWA

SEQ ID NO: 112 - protein, 782 aa, Caenorhabditis elegans
  C elegans public gene name=Y47G6A.10
  genomic DNA homolog sequence=SeqID_428
  cDNA homolog sequence=SeqID_1360
MWRLYRKTPKQLRNSVESCFKSVNSRQFSVSSFSAVAKDDKSVLKQQEVLHLLAKDQRFEERFFNQVQQTIRYFASKPNDLKKFFRKEASTDNKESSSSSDKKDSKGNKGEDNNPFNQFPGGWQQIAVSVGILLALYAFMDYQSYREISWKEFYSDFLEAGLVERLEVVDKRWVRIVSSSGKYAGQTCYFNIGSVDSFERSLGAAQHHLQYDADRQIPVLYKSEFNFKREIPNLISVAFPLLFGYYIYRMLKGGGAAGGAGRAGGGGLGGMFGGFGQSTARVINREDIKVKFADVAGCEEAKIEIMEFVNFLKNPQQYKDLGAKIPKGAILTGPPGTGKTLLAKATAGEANVPFITVSGSEFLEMFVGVGPARVRDMFSMARKNSPCILFIDEIDAVGRKRGGKGGMGGHSEQENTLNQLLVEMDGFTTDESSVIVIAATNRVDILDSALLRPGRFDRQIYVPVPDIKGRASIFRVHLGPLRTSLDKTVLSRKLAAHTPGFSGADISNVCNEAALIAARDANHEISNKHFEQAIERVVAGMEKKTQVLQKEEKKTVAYHEAGHAIAGWFLQHADPLLKVSIIPRGKGLGYAQYLPKEQYLYSKDQLLDRMCMTLGGRVAEEIFFGRITTGAQDDLQKVTQMAYSQVVKFGMSEKVGPLSFETPAPGEMAFDKPYSEATAQLIDQEVRDLVMNALRRTRDLLLEKRSDIERVALRLLEKEILNREDMIELVGKRPFVEKNTYEEMVSGTGGLDENVELPKGLENWNKESEKKKKDEEKKKNDE

SEQ ID NO: 113 - protein, 647 aa, Caenorhabditis elegans
  C elegans public gene name=K07C5.6
  genomic DNA homolog sequence=SeqID_475
MASYKQNLPPSALIKQQVNVADKKSKAEVQRDRQLEEDRKAGTAPAMVDVQTGRDINPHIPMFISQNPWYVPSEGPTLKHQRPHEEREKKMTQIHEWYQKGTTGKSATKFRKGACENCGAMGHQKRDCFDRPRKSNAKETNDNIAEDDYVQPNLTLGFDAKRDRWNGYDPSTHKQVIEDYEHLEEARKVVREHEMKEGEVEPATTEDGAPKDEDMYAEDADMAGVSVDMDSRTRITVRNLRIREDTAKYLYNLAENSPYYDPKSRSMRENPFAGVAGKELEAARFSGDNFVRYSGEVTAANEAQVFAWQATRGGVYAHSIAEPTKLEALKKEYEKEKSTLKNETQKELLDKYGGGEHMERPADELLLAQTESYIEYNRKGKVIKGKEKVAISSRFKEDIYPQNHTSVFGSFWREGRWGYKCCHQFVKNSYCTGKQGIEAETSAAKGTTTSNEEIFKVPKLVEKTEVKEEKEKEDSIKDEVAEENSDNDNDEEKEKVSEKSISPSPPSDDEEKEKEREKERLIEKERRERDQRRRDKKREKRERKKAKLGKRKRRHRDSDDESDPSSGSGSESDSDEEMRKAMKKAKREKAEGMKAAREGDRGRKYNTDYSNTAPNEKEMEAYRVTSVHSADPMAAYMNSKFEKKHTK

SEQ ID NO: 114 - protein, 432 aa, Caenorhabditis elegans
  C elegans public gene name=B0511.10
  genomic DNA homolog sequence=SeqID_393
MSTFDLTQRMAPFLDLHLIIPLLEFIEPRGIYDEKSLTEMHRQLLTKTNMIDSVIETYNGKPIPAAIEAKKKQIIKERDELKSKVDSVVAILEIPEVKEMMDNNRERDGNVRILEHLTQNHNFTVDMVDTLFKYSKFMYECGNYTVASVCLYYYRNLVNQADPNYLNALYGKLASEILLQEWEHARDDLLKLRAYIDANPFDTEWELVTQRAWLMHWALFVYYNYPKGRDEIIEMFLNQQPYLNAIQVLAPHLLRYLAVAVVTSKSRQKNSLKDLVKVIDIERHSYKDPVTDFLTCLYIKYDFDEAQEMLQKCEEVLSNDFFLTAVLGDFRESARLLIFEMFCRIHQCITIEMLARRLNMSQEEAERWIVDLIRTYRIEGAKIDSKLGQVVMGVKSVSIHEQVMENTKRLTLRAQQIALQLEKGRQDKVKAT

SEQ ID NO: 115 - protein, 130 aa, Caenorhabditis elegans
  C elegans public gene name=T02H6.11
  cDNA homolog sequence=SeqID_1355
MASQAASKAVTFAYNGTIASTLRKFAWSNLWGGREYGLQFHDTYFEPAPEVTEALRRLNLQEPHVFDQRKIRLSRAHTLALHGEKLPKAEWTQWDQESWYLKPYLDEIEAEKKARAETSGLIPPYQMKQH

SEQ ID NO: 116 - protein, 303 aa, Caenorhabditis elegans
  C elegans public gene name=F13B10.2
  cDNA homolog sequence=SeqID_1299
MSHRKFSAPRHGHMGFTPKKRSRTYRGRIKAFTKYAKKWQDEDGKKLIEADFAKLKKYCSSIRVIAHTQMKILRRRQKKAHLVEIQVNGGTIEQKVDWAREHLEKQVQVDTVFAQDEMIDTIGVTRGHGFKGVTSRWHTKKLPRKTHKGLRKVACIGAWHPSRVAFTVARAGQKGFHHRTIINNKIYRIGKSALTEEGKNNGSTEFDLTQKTITPMGGFPRYGIVNQDYIMLRGAVLGPKKRLITLRKSLITQTKRVAHEKINLKWIDTSSKTGHGRFQTTAEKRAFMGKLKRDFLAEAEAKA

SEQ ID NO: 117 - protein, 352 aa, Caenorhabditis elegans
  C elegans public gene name=K12H4.3
  genomic DNA homolog sequence=SeqID_324
MGKFSKIKKVQEEESAHQKMEWEAAGAKDSSSDDSSDESDNDDQPKQATEETRKRAELWTNRERVLVLCSRGADVRTRYLMKDIKDLLPHAKGDSKLDQQKSLNVLNEIAEMKNCTKVMYFESRKRKDTYLWMSNVEKGPSIKFLVHNVHTMKELKMSGNCLRASRPVLSFDDAFDKKPQLKLIKAVLMQTLGTPHHHPRSQPFVDHVFNFSVGEGDKIWFRNFQIVDESLQLQEVGPRFVLEMVRLFAGSFEGAVLYDNPNYVSPNVIRREHRKGQHSYIEKQLAVKASNIKQAKVTEILAEKTVDLVGKEFDTQNNAAADSEAAAQITAQIEKRRVRKKKSQASKYTGSD

SEQ ID NO: 118 - protein, 563 aa, Caenorhabditis elegans
  C elegans public gene name=C01G8.5
  genomic DNA homolog sequence=SeqID_303
  cDNA homolog sequence=SeqID_1477
MSKKAINVRVTSMDSELEFAIQSSTTGKQLFDQVVKTIGLREIWYFGLQYTDNKGFPTWLKLNKKVLSQDVKKDPTLVFKFRAKFYPEDVAEEIIQDVTMRLFYLQVKDGILSDEIYCPPETSVLLASYAMQAKYGDYVPETHVAGCLTADRLLPQRVLGQFKLNSEEWERRIMTWWADHRATTREQAMLEYLKIAQDLEMYGVNYFEIRNKKGTDLYLGVDALGLNIYDKADRLSPKVGFPWSEIRNISFNDKKFVIKPIDKKAHDFVFYAPRLRINKRILALCMGNHELYMRRRKPDTIEVQQMKQQAREDRALKIAEQEKLTREMSAREEAEQRQRDAEKRMAQMQEDMERARLELAEAHNTIHSLEAQLKQLQLAKQALEQKEYELRELTAQLQSEKAMSDGERRHLRDQVDAREREVFSMREEVERQTTVTRQLQTQIHSQQHTQHYSNSHHVSNGHAHDETATDDEDNGATELTNDADQNVPQHELERVTAAEKNIQIKNKLDMLTRELDSVKDQNAVTDYDVLHMENKKAGRDKYKTLRQIRGGNTKRRIDQYENM

SEQ ID NO: 119 - protein, 151 aa, Caenorhabditis elegans
  C elegans public gene name=F36A2.6
  genomic DNA homolog sequence=SeqID_432
  cDNA homolog sequence=SeqID_1456
MATQDDAHLAELKKKRTFRKFMYRGVDLDQLLDMSREQFTKLLPCRMRRRLDRGLKRKHLALIAKVQKAKKAAGVLEKPATVKTHLRDMIILPELVGGVIGIYNGKVFNQTEIKPEMIGFYLGEFAISYKPVKHGRPGIGATHSSRFIPLK

SEQ ID NO: 120 - protein, 655 aa, Caenorhabditis elegans
  C elegans public gene name=W07E6.4
  genomic DNA homolog sequence=SeqID_415
  cDNA homolog sequence=SeqID_1385
MTAVVSNREEDSMNNEPSLSGRAIIGLIYPPPDIRTIVDKTARFAAKNGVDFENKIREKEAKNPKFNFLSITDPYHAYYKKMVYDFSEGRVEAPKVPQAVKEHVKKAEFVPSAPPPAYEFSADPSTINAYDLDLIRLVALFVARNGRQFLTQLMTREARNYQFDFLKPAHCNFTYFTKLVDQYQKVLVPSTNVVAQLQDDATNKKRLIEDINYRVSWEKHQKGLKDREEAEAEKERQAYASIDWHDFVVVQTVDFQPGDTSQLPPLCTPKDVGARILLEARNEMQKAAAEMQEMDMEESDSDDEDAVQAPEAPAFTAPLPPTKQKDVIVRDYDPKRNVTQKPKAVENWIISPLTGERIPSDKLAEHVRYNTVDSQYKEDRDRHIGERSTEEPVLALGADISRNLGNFAERRTDIFGVGGEQTMIGKKLGEEDNSQQGQNKLIWDGTEETRDMITRAVQNKVTLDQQINEIHRQHGFVADPSKEKIGAQQVPRHQSTQGNVTITQGITNIPGQMPSGWPPVPPMGMPGMPNQALPPIRQMDFGGGPPAKRPRTEDDLIPEADWLKKVNGAISLNVHLPQAPEHGMDGSIVQFTIQVTAPMSELKQQIQDRYGMPVGKQKLMSDGLFVKDNMSSAFYNLADRTAIYLQVKERGGKKK

SEQ ID NO: 121 - protein, 197 aa, Caenorhabditis elegans
  C elegans public gene name=C41G7.1
  cDNA homolog sequence=SeqID_1468
MEVDDVWDDTELIKMYDESLQEISKNETSAKITSRKFKGEDGKMYTWKVGGKCMAPYEENGEVTDYPATIDTIGGADNLEVGVTFIYYGGQAVVQMKDLWLNEEAIADAVKAENDLQKTKKTSTVNSVAHSNSKSTSSAPNTSMPFPSFAPPVPPNIIAMAPVNQKEAMNSMLMSWYMSGYHTGYYQALADQKNVQN

SEQ ID NO: 122 - protein, 237 aa, Caenorhabditis elegans
  C elegans public gene name=C34C12.8
  genomic DNA homolog sequence=SeqID_356
  cDNA homolog sequence=SeqID_1415
MLRKGVSFVGQAVQQTLKTQKNLRIQRFSATASQSSEEVNYEIRKDGKRLRGADYEEIVLTSIAGEDKTQIPKGAFDVLLKEYDDLQAESLDFKDKYQRSLAETENVRRRGIKQTDDAKVFAIQSFCKDLLEVSDILDIAVKSVKPEDLESGGKALKDLFEGVSMTRTVMAKTFAKHGLVTVDPTNEKFDPNLHEAVFQIPSANAKQPVGHIEVCTKIGYSLKERPIRPAQVGVVSK

SEQ ID NO: 123 - protein, 316 aa, Caenorhabditis elegans
  C elegans public gene name=C45G9.5
  cDNA homolog sequence=SeqID_1459
MTQEPSDTSDYQRFDEMLLHLEPRGARVPYNVVYDQDNNIWVASKGGLYKFNGKTLRTLHEDKKFFKKMAPFPQVISYKDRIIYTSAEFSDRTTILRVISLDGDVVHESFIEGLLNSMTITDSGDMYIVKQAEPGHRNNFIMTTHLDTPIGWDVVAESKPGEAFSRICALDDKTLVASINDFPMNMFSKQRLVFYDLETNTETGSTSKAGKEPGEIFFPRFIKKYGDGFILNDKSGRFSEFKKNGEFVAIRARIDAFLGEGFDVKDGEALMALTGMVKDPNEQLICDDWLETIKLDGSSWKADREKKKQEDEQAKN

SEQ ID NO: 124 - protein, 160 aa, Caenorhabditis elegans
  C elegans public gene name=W08E3.1
  genomic DNA homolog sequence=SeqID_427
  cDNA homolog sequence=SeqID_1408
MTISKNNKMMAHLNYRMKIILQDGRTFIGFFKAFDKHMNILLAECEEHRQIKPKAGKKTDGEEKRILGLVLVRGEHIVSMTVDGPPPRDDDSVRLAKAGGAGGVGQAKPGGRGMPAMPGMPGMPPGGAPGGLSGAMRGHGGPGMAAMQPGYGGPPGGRPF

SEQ ID NO: 125 - protein, 165 aa, Caenorhabditis elegans
  C elegans public gene name=JC8.3
  genomic DNA homolog sequence=SeqID_469
MPPKFDPTEIKIVYLRCVGGEVGATSALAPKVGPLGLSPKKIGEDIAKATQDWKGLKVTCKLTIQNRVAKIDVVPSAASLIVKELKEPPRDRKKVKNVKHNGDLTVDTIIKIARIMRPRSMAKKLEGTVKEILGTAQSVGCTIDGQHPHDIIESIANGEIEIPAQ

SEQ ID NO: 126 - protein, 545 aa, Caenorhabditis elegans
  C elegans public gene name=F22D6.3
  genomic DNA homolog sequence=SeqID_447
  cDNA homolog sequence=SeqID_1393
MSKLYIDTDAGSDQHPGTEAQPLATLVQAMLISKNSGEFLMKKKSEEGESWEPAAKAAIKKAVKKYEAEVKKLEKAGCREKEAEEAQHAALEEAKKITFSLDKSLPEAKVIKIGESVQHRDQRVSIKAWVHRLRRQGKSLMFLVLRDGYGFLQCVLNDKLCQSYDAVTLSTETSVQVYGIIKALPDGKSAPDGHELTVDYWEVIGKAPAGGIDNVLNESAGVDVMLDNRHLVIRGENASRILRIRAAATRAMRDHFFAAGYTEVAPPTLVQTQVEGGSTLFGLDYYGEPAYLTQSSQLYLETCNAALGDVYCISQSYRAEKSRTRRHLSEYQHVEAECAFITFDQLMDRIEALVCDTVDRLLADPVTKSLIEFVNPGYKAPARPFKRMPYKEAIEWLQKNDVRNEMGEKFVYGEDIAEAAERRMTDTIGVPILLNRFPHGIKAFYMPRCADDNELTESVDLLMPGVGEIVGGSMRIWKEDQLLAAFEKGGLDSKNYYWYMDQRKYGSVPHGGYGLGLERFICWLTDTNHIRDVCLYPRFVGRCAP

SEQ ID NO: 127 - protein, 327 aa, Caenorhabditis elegans
  C elegans public gene name=B0491.5
  cDNA homolog sequence=SeqID_1274
MGHGEEPLTATYKTQRPPWIGLWSDREYKGRADWWKEPGLEDSVTRSGKLRLYRARFREEDPDWYDPKVKDGESLAGPFGLDSKKTKNLTKKGDQPGELSEFQNKVYEGSHQFKAIAEKFGISKEHPGLSVSPTLSDNMLTPKDELGRNAVLPNSWYPAGPRFFDSPLNEGSFWKGLAAAKYAGILLAPYTMLEIRALNTVSVSEFSPRTYMKRYLQLAPFPLAVAFAWGFSLSAASSIRHKDDVHNHWFASVAVGSTVATMKSNVALGTTAAIFTAILGAFWQYQRHSETGLQGMTAHPQSAGIWGGPLLWQKMQLGNADVPTTRY

SEQ ID NO: 128 - protein, 113 aa, Caenorhabditis elegans
  C elegans public gene name=F57B10.10
  genomic DNA homolog sequence=SeqID_452
MAAQVVPVLSKLFDDYQKTTSSKLKIIDAYMTYILFTGIFQFIYCLLVGTFPFNSFLSGFISTVTSFVLASCLRMQVNQENRSEFTAVSTERAFADFIFANLILHLVVVNFLG

SEQ ID NO: 129 - protein, 872 aa, Caenorhabditis elegans
  C elegans public gene name=T23F6.4
  genomic DNA homolog sequence=SeqID_368
  cDNA homolog sequence=SeqID_1472
MTTRLIVKNLPSTCTEQQLRKFFEKYGQISDASLKYTKEGKFRGFAFVGFLDEGSASNALAKSNQTFFNSKKLTVEECRPFGDANKPRAWSKYAKDSSAYKRTHGEKEEANPGKSDETEEPAPKKQKDDAKFDQFLEAKGVVVEKEVKLSKDKSAEAKKLMAELMDGIGGDTSLSLIFSGLPSSAKGKNIKEWLNPIRVKAMKIARNEDVAAAFVTFNRPPDVRRALQKDGQFLGGFKIGIEKIETPEPEHEVIEEHGASLESRDKEEETVREKILETGRLFLRNLPYATKEDDLQFLFKKYGEVSEVQVVIDKKTGACKGFAIVEFVFPEAAVAAYSALDGYVFKGRMMHILPGDEKRTKEGEEESEVVPDDPDNPLKAEAKKEKKKKSFKEEKDEQKKASAGKTAHSWNALFLGANAIADTLAQRLNVKKSDLLTSDQGESAGVRLALAETRLVRETRDFFLENGVKLDAFSKPAEKRSDTVMLAKNLPAGVESEELQRMFEKFGDCTKVLMPTEGGVSALVIMGNPVDAKKAFRALAYSRFRSQPLYLEWAPYDVMGATAPPAEDKTAEVADKPKLSKREMTYEEKRKERKNRQQGITEEEKDDGEVIEEEEKPKEVEAEDKKKSSKKQSEKEIESGSTLFVKNLAFDTTDGSLEFLFRKRYGDLVKSAQISKKLNPAEPTKPLSMGFGFVQFYTAFDAKTALKDMQGELLDGHSLELKISHRENADKGALKRKEVKQKEQGECTKLLVRNLPFEASVKEVETLFETFGAVKTIRIPKKPGQKQQHRGFGFVDFISADEAHRAFDSLVHSTHLYGRRLVLEWAKDDETVEELREKTAEKFAGNKKGVKKSKAQTEEFQQQLQIADDEKD

SEQ ID NO: 130 - protein, 414 aa, Caenorhabditis elegans
  C elegans public gene name=F23F12.6
  genomic DNA homolog sequence=SeqID_317
  cDNA homolog sequence=SeqID_1471
MSAAALEEIGIAPLQENTSLRPPPLPATCVDVSSDDYIKLTTLERQLAHLQVMEDYIKLETRNLEKELLHAQEEVKRIQSVPLVIGQFLEAVDQNHAIVGSTTGSNYYVRVLSILDRELLKPGCSVALHKYSNALVDVLPPEADSSIQMLRPDEKPDISYGDIGGLDMQKQEVREAVELPLTHGELYQQIGIDPPRGVLMYGPPGCGKTMLAKAVAANTAASFIRVVGSEFVQKYLGEGPRMVRDVFRLAKENSPSIIFIDEIDAIATKRFDAQTGADREVQRILLELLNQMDGFDQSTNVKVIMATNRQDTLDPALLRPGRLDRKIEFPLPDRRQKRLVFSTVCSRMNLSDDVDLEDWVARPDKISGADINSICQEAGMQAVRENRYVVLTKDLEKAYKNVVKKDTNDFEFYK

SEQ ID NO: 131 - protein, 469 aa, Caenorhabditis elegans
  C elegans public gene name=Y39G10AR.8
  genomic DNA homolog sequence=SeqID_325
  cDNA homolog sequence=SeqID_1278
MASEAEKDKCQSWLAKQDLDKVGVDNLNPLTEEVISRQATINIGTIGHVAHGKSTLVKAFSGVHTVKFKRELERNITIKLGYANAKIYRCSNQECPRPGCYRSAGSSTPDRFPCERAGCGGEFTCVRHVSFVDCPGHDILMATMLNGAAVMDAAFLLVAGNEPCPQPQTSEHLAAVEIMQLNHLMILQNKVDIIKESQARENYEQIAGFVQGTVAENAPVIPISAQLKYNVDLVCEYLCKKIPVPVRDFKSPARLIIIRSFDVNKPGSEVENLKGGVAGGTLTKGILRVGQEIEVRPGIVSKTATGQLQCRPIFSRIDSLFAEKNQLEYAVPGGLIGVGTKIDPTLCRGDRLVGHILGAVGTLPDIFIEIEISFYLLRRLLGVRTEGKKKGAKVQKLVKEETLLVNIGSLSTGGRVTAVKGDAAKIRLNDPICTEVGEKIAMSRRFEKSWRLIGWGTIRKGQTVEPYKN

SEQ ID NO: 132 - protein, 362 aa, Caenorhabditis elegans
  C elegans public gene name=R12E2.3
  genomic DNA homolog sequence=SeqID_304
  cDNA homolog sequence=SeqID_1390
MAPTNKDGDVATVKAVDVLKQKAGAHHCLGNVHANLPVNKVTVHPLVLLSVVDHFNRVSKTQSVKRVVGVLLGSMKKDKTLDIGNSFAVPFDEDDKDKSTWFLDMDYLESMYGMFYKVAAKEKIVGWYHTGPKLHKNDIAINEQLKRFCPNPVLVIIDAEPKNIGLPTEAYIEVQEVHDDGTPPIKTFEHVPSDIGAEEAEEVGVEHLLRDIKDQTAGTLSQRITDQLMGLRGLQSQLESIEKYLHDIVRGTLPVNHHVIYYVQEVLNLLPDVTHPDYIVSQNVQTNDQLMCVYMGSLVRSVVALHNLIDNKISLQKAEKEQETGEAEKKKDEKDKKDKKDEKKDEKKEKDSKSSTPNTPKK

SEQ ID NO: 133 - protein, 665 aa, Caenorhabditis elegans
  C elegans public gene name=K10B2.1
  genomic DNA homolog sequence=SeqID_426
  cDNA homolog sequence=SeqID_1383
MSSPHRASTTQQLADLSLTEGEHDEGKPLSIDYLQGHEGLIEEVLKWSEHEQLDFMDKIVHRLSHYQLGKVDNFIRPMLQRDFISNLPAHLVELILFNVNSDSLKSCEEVSTSWRCALARGQHWKKLIEKNVRSDSLWWGLSEKRQWDKFLNISRDMSVRRICEKFNYDVNIKRDKLDQLILMHVFYSKLYPKIIRDIHNIDNNWKRGNYKMTRINCQSENSKGVYCLQYDDDKIVSGLRDNTIKIWDRKDYSCSRILSGHTGSVLCLQYDNRVIISGSSDATVRVWDVETGECIKTLIHHCEAVLHLRFANGIMVTCSKDRSIAVWDMVSPRDITIRRVLVGHRAAVNVVDFDDRYIVSASGDRTIKVWSMDTLEFVRTLAGHRRGIACLQYRGRLVVSGSSDNTIRLWDIHSGVCLRVLEGHEELVRCIRFDEKRIVSGAYDGKIKVWDLQAALDPRALSSEICLCSLVQHTGRVFRLQFDDFQIVSSSHDDTILIWDFLDAPPSGLPSSTNRATLPELPNQAAVARAQMLFEMAARREIERRDREVVEEPALRPRANAARRHNADIAAAAAAAEAARGAGDNDESSSEEDLDRVDQVNNPNVAGPAPPQPHNQNHRRRQPRPELPVRLMQEMAAFDNMRRQQNNMDHLGGGDVDEEMPDGGP

SEQ ID NO: 134 - protein, 429 aa, Caenorhabditis elegans
  C elegans public gene name=F01F1.8
  genomic DNA homolog sequence=SeqID_347
  cDNA homolog sequence=SeqID_1376
MSSIQCLNPKAELARHAAALELNISGARGLQDVMRSNLGPKGTLKMLVSGAGDIKLTKDGNVLLHEMAIQHPTASMIAKASTAQDDVTGDGTTSTVLLIGELLKQAESLVLEGLHPRIVTEGFEWANTKTLELLEKFKKEAPVERDLLVEVCRTALRTKLHQKLADHITECVVDAVLAIRRDGEEPDLHMVEKMEMHHDSDMDTTLVRGLVLDHGARHPDMPRHVKDAYILTCNVSLEYEKTEVNSGLFYKTAKEREALLAAEREFITRRVHKIIELKKKVIDNSPDGKNKGFVVINQKGIDPPSLDLLASEGILALRRAKRRNMERLQLAVGGEAVNSVDDLTPEDLGWAGLVYEHSLGEEKYTFIEECRAPKSVTLLIKGPNKHTITQIKDAIHDGLRAVFNTIVDSCSPWSCCFRNCCLRDVEKRC

SEQ ID NO: 135 - protein, 694 aa, Caenorhabditis elegans
  C elegans public gene name=F08D12.1
  genomic DNA homolog sequence=SeqID_497
MADASAGGLYQCLTDISRADTSGDYQKALTSANKLIRKYPKETFAFKCKLVAQIQLSQYADALELIRKTPAHQMGHVGFEKAYIHYRQDELDEAIKELNTCDKDDVKALELKAQVFYKQENYQQAYDIYLYLLKNHSDDSDELRRANFLAVQARLEAQGVKQAVAETEDSYSQLYNRACVEIEAEKLPQALESLEKALKTCRKSFEDEDREEDEIEEELDSIRVQKAYVLQRMGQKAEALAIYEKVQAANHPDSSVKATITNNIPAASSDFALPESRKRFKAALQIFQSKCSKFPDFWLKMLQKSKKTKFLQKNGNFTYFTSKNSQIYRFSAQIPPKIPNFSFQIDQTKLTRRQRLTLMLNNALVLLLSNQREPCKRALEELVAKFGSSKDVALIEATLHFKMGDAEAALKVLAGSDLEQSLARLHVLLNAGRLPEAVGAIRDLPISGKLGASSLLTSTLIAADSRDEAVKELVAASTAKNQTPEALKSILEDLVEVEQQRGNETAATKHLEKLVEKFPEDLQLQCRLVGAYSKTDPKKAESLSAKLFPETMEVDVNVDELEDSDWILYGEKYRQKKEAKSPQTAEIAATRKLKIATKRKRKIRLPKNYNSAVTPDPERWLPRQERSTYKRKRKNREREIGRGTQGSSSANPNVEYVTASPNSPRPLPGPVAEGPRQQRPNFQKQKKKKNASKF

SEQ ID NO: 136 - protein, 487 aa, Caenorhabditis elegans
  C elegans public gene name=C47E12.1
  genomic DNA homolog sequence=SeqID_362
  cDNA homolog sequence=SeqID_1351
MVLDIDMFRTEKGGNPEIIRKSQQDRFKDPKLVDEVIELDEKWRKERFVADQLNRQKNAISKAIGEKMKKKEPQGTDDSVADDIVARLAELKIDELSQLTVVQLKKLRVLVDEKSVQTAAAVIANENARHEKLIQIGNLIHSSVVVSKDEANNKIERTFGDLSTKKKYSHVDLVVMVDGFDGERGTVVAGGRGYFLKGPLVFLEQAIIQLALQRLNVKGYVPLYTPFFMRKEVMQEVAQLSQFDDELYKVSSKGSEIAGDTSVDEKYLIATSEQPIAAYHRNEWIKETELPIKYAGVSTCFRQEVGSHGRDTRGIFRVHQFEKIEQFVLCSPNDNESWTLFDEMIGNAESYYQELQIPYQVVNIVSGELNNAAAKKFDLEAWFPGSGAYRELVSCSNCLDYQSRRLKVRYGQTKKLSGEVPFVHMLNATMCATTRVICAILENNQTEEGINVPTAIQQWMPENYRTFIPFVKPAPIDEDAKKATGKK

SEQ ID NO: 137 - protein, 292 aa, Caenorhabditis elegans
  C elegans public gene name=C47E12.4
  cDNA homolog sequence=SeqID_1386
MSTGAGDSAVYEAVERGSLYSLDYRVYIKGPQGIVSPWHDIPLFANKDKRVYNMIVEIPRWTNAKMEMATKEPFSPIKQDEKKGVARFVHNIFPHKGYIWNYGALPQTWEDPNHVVPDTGAKGDNDPIDVIEVGSKVAGRGAVLQVKVLGTLALIDEGETDWKLVAIDVNDENADKLNDIDDVEKVYPGLLAASVEWFRNYKIPAGKPANEFAFNGEFKNREYAEKVIDETNEYWKTLIKEANPSLNTVSRVPEAVHQGTDEAAATAIGATPEHGANAPLPGDVDKWHFVQG

SEQ ID NO: 138 - protein, 257 aa, Caenorhabditis elegans
  C elegans public gene name=F56F3.5
  genomic DNA homolog sequence=SeqID_311
  cDNA homolog sequence=SeqID_1422
MAVGKNNNKMGKKGGKKKAVDPFSRKEWYDIKAPNMFNTRQVGKTLINRTQGTKIASEGLKGRVFEVSLGDLNNSEADFRKFKLIAEDVQGKNVLTNFHAMSMTHDKLCSIVKKWHTLIEANTAVKTTDGYTLRVFVIAFTKKSVNQVKKTSYTKTSKIRKIRSEMIGCIEKEVTGCDLKEVVSKLIPDSIGKDIEKTCSKLYPLQEVYIRKVKIIKRPKVDLGRLHDLHGDSITVGADGEKVDRPDDYEPPVQQEV

SEQ ID NO: 139 - protein, 1148 aa, Caenorhabditis elegans
  C elegans public gene name=C06E1.10
  genomic DNA homolog sequence=SeqID_349
  cDNA homolog sequence=SeqID_1380
MGKRKTKEDNASEDYDANELMIVPGEKRKKLEKSGEKSATGGKKNRNFAKEKEVAKLTKQAKRKLAAVQSRKALKQTQEELFAGLAEFQLDPSKLCQLSSSTKLSKEPEKAPVFPEKLKVFSGKTKTEAKRTQQDYYPTDDESSSEEEEEEEEGDNDIEDAGNTVEVKIEPIDLDDVDEAIDGNPETNLDQIVVKREDDEESDNEDILALPTTTVINRKKVIVERSKEIQKSRAELPIFAEEMRIVEAINENLVTVVCGETGSGKTTQIPQFLYEAGYASEGELIGITEPRRVAAIAMAQRVGVELAKPDEVSYQIRYEGTRSETTNILFMTDGVLMKEMEQDVMLKKYSVILIDEAHERSMYSDVLIGMLSRIVPLRSKTARPLRLVIMSATLRLDDFTHKKLFPLLTPKVIKVDARQFPVSVHFEKRTPDDYIASAFRKTCRIHETLPPGAILVFVTGQHEVKQLITKLKKRYPVVYETDKNGEVLVKGTKEWKEKKVEAAKSIKLEDFKEETPETEDFEDVDDGLMDGDDMNERGAAEAFDDYEEFENGDGDLSDGKVENSIGAPPADCEPLYCLPLYSLLSMGKQRRVFDETPAGMRLCVISTNVAETSLTIPGVKYVIDGGFEKRRLYDSITGVSRFAVCRISQASGDQRAGRAGRISAGHAYRLYSSAVYQDFVKFADPEILSKPADQLVLHLKSMNIVKVVNFPFPSAPDEQMLESAEKRLCRLGALSESTKNGKTEARITKLGKTLAVFPLAPSYAKFIAMADQHNLMSHAILLISLLSVREPLIPVSSLRGDTPEETKELMKNVLKERRRWCSHTGARRLGDLKVLMHAASVAEQIKYNARECEKVGLRVKALVEARKLRQQLTNIVNASCKKEHAAALDSDLPPPTDQQAQLLRQMVVASFSDRLARRVDRSVGQEEVQKGAYETTLIKGHVFIDPCSVVFTEEPEFVIYQELVQVNEKKLMTSVCAVDKEWLSRLAESYCNYGEQDKNQEPIYDPVKDMVVKTVKVTFGPLNWELPNENRSVPHDIMMYRYFALFLLDGLVFEKLKEYTPKLLAPPSTMVKSWAKLQKRTEMLLNKLIEKEVTTRSSLKEQWLKNENWLLEEYLEWVPESVHQQISLMWPPLEDHEKTIKMGRNKKY

SEQ ID NO: 140 - protein, 373 aa, Caenorhabditis elegans
  C elegans public gene name=F10G8.3
  genomic DNA homolog sequence=SeqID_418
  cDNA homolog sequence=SeqID_1295
MFGSSGFGNKSMFGGSNISTSTTTPAANTTQNDDFLVDGAPEDTIQVIKFSPTPQDKPMLACGSWDGTIRVWMFNDANTFEGKAQQNIPAPILDIAWIEDSSKIFIACADKEARLWDLASNQVAVVGTHDGPVKTCHWINGNNYQCLMTGSFDKTLRFWDMKNLPNQTQMAQIQLPERVYAADVLYPMAVVALANKHIKVYNLENGPTEVKDIESQLKFQIRCISIFKDKSNQNPAGFALGSIEGRVAVQYVDVANPKDNFTFKCHRSAELVNGFQEIYAVNDICFHPQHGTLVTIGSDGRYSMWDKDARTKLKTSEPHPMPLTCCDVHSSGAFLVYALGYDWSRGHEGNTQPGSKIVIHKCIEDMKPRPTKK

SEQ ID NO: 141 - protein, 419 aa, Caenorhabditis elegans
  C elegans public gene name=C17G10.2
  genomic DNA homolog sequence=SeqID_500
MDLPQKKKFTESERAALAKKLDDDLDQFMEEMAARKSDKKEERKPFDFDDWCKEIDQHPAFMTEMPTDGKYQDTIEALQSMKYDKEDDEDKQMNAEHHKEEGNKHFKFKKYRWATDCYSNGIKENSPDRKLNAVLYFNRAAAQKHLGNLRSAIKDCSMGRKFDPTHLKGVIRGAECLLELEYAKDALNWIESSKKIFAFTKETSDTPDLTDDEKKFIDQLETLRVKSVELSLKEERDKRKSRAEERKETESKKQLLDALKERNLNLCPRVPFDRPELMDMARLTVSLPLMHSHECVKFDDDLNLVWPILLQYPEAGQTDVLTETNELTTVGELLKEVLNSPAQWDPEHKFNFENVRFFVSDEYDEYLMEVYEWNDFKSVLSMPGYQIKQGLPVIMIMTKEKAASSLEALAEDENRYVAK

SEQ ID NO: 142 - protein, 486 aa, Caenorhabditis elegans
  C elegans public gene name=K07C5.4
  genomic DNA homolog sequence=SeqID_405
  cDNA homolog sequence=SeqID_1271
MSEVPHFVLYEHAAGYALMKIKEFDDAGLILQEVDAAHADGYKFSQIVELASFDPFKNTEAALENCNSISEGLAHPDLTNFLQKSLPKKKKHVVLGINDSKLAGSLTEAFPDLKLVFGGVITEILRGTRVHFERLAKNLPHHSLSKAQLSLGHSYSRSKVKFDVHRVDNMVIQSIALLDQLDKDINLFGMRIREWYSYHYPELFRLAPDQYKYSRLAVAILDRNKMAENENLENEILEILDNDSEKTAQIIEAARTSMGMDISDLDLENIKRFAARVSSLMEYRQQLHEYIKDRMDHCAPSLSALIGEQVGARLISHAGSLTNLAKYPASTVQILGAEKALFRALKTRSNTPKYGLLFHSSFIGKAGTKNKGRVSRYLANKCSIAARVDCFSETPVSTYGEFLRQQVEDRLEYFTSGTVPKKNIDVMKEAEEAAVEVKEKVIKKKKKAAKKAKRLAEESVTATAEAEVDEDAPKPKKKKKSKAGDE

SEQ ID NO: 143 - protein, 1469 aa, Caenorhabditis elegans
  C elegans public gene name=R13G10.1
  genomic DNA homolog sequence=SeqID_471
MQPFKRRALTSDDDRPYADTDSMPEVDLDVDRRRQYMEQLNIFDDVSSGAYMLELEAAENGVKYDEKEDLLNVQIPPKYEDQISDPDGNRMIILNIYVENFKSYAGKHILGPFHKNLTMILGPNGSGKSNVIDALLFVFGFKAGKIRTKKLSALINSGGNYESCSVTIMFQMVKDMPVENYDKYEVLTDNCVCITRTINRENNSKYRIDDKDASQKDVQELLLRAGIDMTHNRFLILQGEVEAIALMKPTSKNPNEEGMLEYIEDIVGTNRFVAPISKLMHRVSLLEHKSSQYGASVRRHEGHLKVFEKAMVIGMAYLNTFNNLNYLRGIRVKHNLCRYAETMRDAKMSLVTRTGELEENKDIMLEAKDEVRKKETHERSLNSIVTELENKRIDWQSKKNDWHARDAKRKQGLKSCTQDLGKLMKERDEARREKFEIETAPENARISKQNMQLEWDQLKEQENVCQRTATENLIKYDQKSSADRAKHDDLEKKLSDELLQSMRAKAELDVSESELKDMTIMMEQGQKRVDELKGTLQTMMAENIRDNTELNAVTTELQDRKLKFDKAVEKLPHLKSTEQLLRSKKYELDQEVIEASNTQEVTYRHQATAKLHELKEAGLFPGFKGRLGDLASIPIKFDTAISTVFFAQLDYHVVQTSDECRIGIGFCHEYKLPRTTFVFLDHLKDTDTSGMDSTMKFPAERLFDKIHCVNPEIRREFYFLIHDILVVDSLEEATRIDKKYPGRHRYCTLNGSILNRSGALTGGGKPTTGRIRNDNNPNMSGVKKVDLSKLRAAQEKHNHALEAHLKLQLKQEEIRADNGPIIKQLEIRKRELIMSTKEQKTRIAELKSSIAAHERRMVNYREVTVEDLDEKRAQIADLKRQVEESQKSSAKIKQQIEQYKRKMDRMFMELVQKNKDSIEQAKDRMGQLEQDIARQTAIIENNPSHLEQAEKKLSELEHMCLEKRSEADALAQLEVGEDVKGIDIINAQLQTSTASIDAQRARYTEAVAARREADAAYQTTVDNYNMVKQTYDELMRIIDDLENKTMADNAELDIIESAWMQPEKLYPPGKFVRYNDPDIAAKMTDGHVVLPYECISMIEPHREAYEEHEARMLEDDVFEDTANKICKLEKDVDKFRREFDNKGVRDYAMIVSLLMNEVTSAKKFSDKLKAHREKLNELRMARFNEFSEALAFLGTTTQMLYQLITNGGDASLKFVEEGKSTDPFDGGIKFSVRPAKKSWKLIENLSGGEKTLASLCFVFAMHHYRPTPLYVMDEIDAALDLNNVSLIANYIKHSERTRNAQFIIISLRNQMFEVGNRLLGIYKIDGKTYNIMVDPIAVEIKNRPILKIFEEEIKRREKLRRAEIEPEIDLSNGLSNVVIAPKRKQRRLEMLKLSDFGLDDDSDLPEFNRFPPATRRELSVEDSDEDDEPVRRRPRRQVEEEDEEDELIEEATPSPPPIVVQRRVRRSRH

SEQ ID NO: 144 - protein, 180 aa, Caenorhabditis elegans
  C elegans public gene name=B0432.3
  genomic DNA homolog sequence=SeqID_435
  cDNA homolog sequence=SeqID_1457
MKLVLVSTRGVRSLNSTNFPAPWPFVKKGAFGQRKIGPMNYEKFKWPGQNREFPELSPKFQKLNPKELHRYTGVQADGFHDEKTGEFVPVKEMRSELVVPNLDGFKLRPYVSYRTDVQIEKRRVAYEKKVLEKGSERLADLHTVEDERWPPPKMSAETLFELAYGDTVRSAYKEGKYGNK

SEQ ID NO: 145 - protein, 216 aa, Caenorhabditis elegans
  C elegans public gene name=K04G7.11
  genomic DNA homolog sequence=SeqID_409
  cDNA homolog sequence=SeqID_1353
MKDFNQRFRDLHKLRQRARKENHEQVVEEDRRSKLPKNHEAKKERDQWQVKELQDRKAAEDKGLDYERVRSLEMSADVTEKLEQKRKRKKNPDQGFTSYEDMTLRQHTRLTAALDPDLDSYKKMRECVGGEQFYPTADTLIHGNHYPTTAAMDKLTKDVHGQVKRREQYHRRRLYDPDAPIDYINEKNKKFNKKLDKYYGKYTEDIKDDLERGTAI

SEQ ID NO: 146 - protein, 180 aa, Caenorhabditis elegans
  C elegans public gene name=E04A4.8
  genomic DNA homolog sequence=SeqID_466
  cDNA homolog sequence=SeqID_1450
MPTKALGETLNEYVVVGRKIPTEKEPVTPIWKMQIFATNHVIAKSRFWYFVSMLRRVKKANGEILSIKQVFEKNPGTVKNYGVWLKYDSRTGHHNMYREYRDTTVAGAVTQCYRDMGARHRAQADRIHILKVQTVKAEDTKRAGIKMFHDAKIRFPLPHRVTKRKNLSVFTTARQNTHFA

SEQ ID NO: 147 - protein, 238 aa, Caenorhabditis elegans
  C elegans public gene name=T12A2.7
  cDNA homolog sequence=SeqID_1467
MSSKPLALTGGSGSSQLQDDQVLVDALPYLDTEYNEADRQLAMKLVEHECKTFRPTKNYLTHLPVPDYDAFLTKCMLKEMDRMKKKEEMGKLDMSRCELPAPSAVKGVDRKLWAKVLRNAKAQNEHLLMRQINLELMDEYAAESYLQRNKVMEDLLTHAEKELRKTKEAVMEVHANRKMAQLKAGEKVKQLEQSWVSMVTNNYRMEMENRQIDSDNRKQIKALKLDPTKLDDKEDQEN

SEQ ID NO: 148 - protein, 198 aa, Caenorhabditis elegans
  C elegans public gene name=C09D4.5
  genomic DNA homolog sequence=SeqID_443
  cDNA homolog sequence=SeqID_1391
MSNLRLQKRLASAVLKCGKHRVWLDPNEVSEISGANSRQSIRRLVNDGLIIRKPVTVHSRFRAREYEEARRKGRHTGYGKRRGTANARMPEKTLWIRRMRVLRNLLRRYRDAKKLDKHLYHELYLRAKGNNFKNKKNLIEYIFKKKTENKRAKQLADQAQARRDKNKESRKRREERQVVKRAELLRKISQSEKVIAGK

SEQ ID NO: 149 - protein, 648 aa, Caenorhabditis elegans
  C elegans public gene name=C14B9.4
  genomic DNA homolog sequence=SeqID_407
  cDNA homolog sequence=SeqID_1377
MNRLPNIAKPPQKSNQRKEKAPPEVPALIADKDRGTYYEKGRFLGKGGFAHCYELTNRATREVVAGKVVPKSMLVKQYQRDKMTQEVQIHRELGHINIVKLFNFFEDNLNVYITLELCARRSLMELHKRRKAVTEPEARYFTHQIVDGVLYLHDLNIIHRDMKLGNLFLNDDLVVKIGDFGLATTVNGDERKKTLCGTPNYIAPEVLNKAGHSFEVDIWAVGCILYILLFGQPPFESKSLEETYSRIRHNNYTIPSIATQPAASLIRKMLDPEPTRRPTAKQVQRDGFFKSGFMPTRLPVSCLTMVPKFGGHETSMMEENVAPRGVDARSQRPLNGRAGLSALPQHIVSNNADRERAQQQAAEATFREPEDAYLSQLFHQVAVLLEQRIPGLEEEEAALDGYQSPECLPVFWISKWVDYSDKYGIGYQLCDNSVGVLFNDNSRIMLDQAGNELTYIEKSNKEHYFSMHSGEMPGLLNKKVTLLKYFRSYMNDHLVKAGEGSEQRAGDDLARLPTLRVWFRTKSAIVLHLSNGTVQINFFNDHVKMMMCPLMQAVTFIDQNKRMLTYKLNNLQRNGCPEKFLHRLKYAKTMIERLMSDANVVSQNPARQPDMPRSMAAARSASAGSRGPNQAASHLPQSASGSNIHPRR

SEQ ID NO: 150 - protein, 613 aa, Caenorhabditis elegans
  C elegans public gene name=F25B3.6
  genomic DNA homolog sequence=SeqID_314
  cDNA homolog sequence=SeqID_1359
MSSSESASSDEETKRRAPATSDSDSDSDAGPKPGKPLSTDSSASDSDAEKPQAKPAKKKTLTKRKRRATGSSDDDQVDDDLFADKEDKARWKKLTELEKEQEIFERMEARENAIAREEIAQQLAKKAKKSSEKGVKTEKRRKMNSGGSDAGSPKRKASSDSDSEMDAAFHRPSDINRKHKEKNAMDALKNKRKEIEKKNAKNEALSIDAVFGANSGSSSSSSSSESSRSSSSSRESSPERVSEKDKIVKKDVDGLSELRRARLSRHKLSLMIHAPFFDSTVVGCYVRLGQGQMSGSGSKYRIWKIVGVEESNKVYELEGKKTNKIIKCQNGGSERPFRMQFVSNADFEQIEFDEWLLACKRHGNLPTVDIMDKKKQDIEKAINHKYSDKEVDLMIKEKSKYQTVPRNFAMTKANWSKQKELAQQRGDIREAEQIQTKIDEIERQADELEKERSKSISAIAFINHRNRSKIKDQVLSGQLKIEENSQDDPFTRKKGGMRVVSGSKSRLDGTLSASSSTTNLSDGGKDKSSSLAKPTQPPPSTQIKKKTDISSLHDFDLDIDLGKLKDFSTPESSGNKRPSISSSKGVSLSDYRMRRSGGGDAGSSTSAAPSSAV

SEQ ID NO: 151 - protein, 475 aa, Caenorhabditis elegans
  C elegans public gene name=ZK622.3
  genomic DNA homolog sequence=SeqID_492
  cDNA homolog sequence=SeqID_1273
MSTDQQSSVEDQTVAMVNVRRANFKSFWDKYSDKPDTNSMMLNHSAEELESSDRADILASLPLLHNKDVVDIGAGIGRFTTVLAETARWVLSTDFIDSFIKKNQERNAHLGNINYQVGDAVGLKMESNSVDLVFTNWLMMYLSDEETVEFIFNCMRWLRSHGIVHLRESCSEPSTGRSKAKSMHDTANANPTHYRFSSLYINLLRAIRYRDVDNKLWRFNVQWSCSVPTYIKRSNNWRQVHWLAEKVPAEDGAKGTSFNELVELIKNTWQNEQEAWDAKLDDEKYVWTDKVFSSALTSLPSNSTFFLYTPRTVSPYCHINAHTLAETFNANVWNTEIIPEYYRTSLTKSNNLKDQRVRFGWNQSLTDSVTYWQQKDALFDVFVATEFLSTVDDETIRQLPNVMSDGAKFITLEPVDEVNEAEMKQRIQELGYTLKSFTDVTDQCIEAQEQYFKDHEQLRDEKVIRKNWVLLELTH

SEQ ID NO: 152 - protein, 380 aa, Caenorhabditis elegans
  C elegans public gene name=D1014.3
  genomic DNA homolog sequence=SeqID_482
MAVAVSFLSPSSVTTKRDRAITRKRGDGVWDHWSTSILRFFLLTAHSISSLLFLTFWNFRFFFDFSSFPRIFSALLCVNLENFQKMSDNEAKARQKMAEGRKKLSGGGGFLNRMFGGGGSNAEAADLFIQGGNLFKMAKNWQAAGDAFLEAAEFYAKNGDSKHDCATQYAEAANCFRKIQPERAVQCLEKTSEIYTDMGRFTMAAKNHVSIAELYETELPDKEQCVKHYQQAADYYKGEEQKSSASKCLVKVAMYSAELEKYSQAIAVFEEIAFFEADHSTLKYAAKGHFFQALLCHLCIDPINTQQALQKYENASPSFTDSRECKFVKELLAAIDEKKEETFTECVANFDKISRLDNWSTSLLLKVKRTIEGEDEDDLR

SEQ ID NO: 153 - protein, 713 aa, Caenorhabditis elegans
  C elegans public gene name=F26F4.10
  genomic DNA homolog sequence=SeqID_382
MSANKELQQGYSDYSAASDQAALLNRLITAMQKGELTDELLEHIPELGDAKKLNDKLKYRKSILEKSIAEQAAKNKKNGVKATSTSSPSSSTSAPAEKKAKKDGKTGGAPPKQAKKVDYVTVEDYGSSIFGRLQSLFKKAIEDAFPGLDVPLLLAETPNPQFGDYQCNSAMPIAAKLKANKINKRPGDVAKEIQAKLPTKIDFVEKIDVMPAGFINIFLNTDYLRRQISLLASEGVKLPKLTRKRVLVDFSSPNIAKEMHVGHLRSTIIGDSICRLFEAVGFDVLRVNHIGDWGTQFGMLIAHLYDRFPDFLKKLPDISDLQAFYKESKKRFDEDEQFKKRAYEYVVKLQSHDGDIVKAWNTICDVSKKYNQIVYNYLDIKIKDVGESFYQDKMIELVKWVKTNKPDMLREEDGRQIMFPTGCDIPLTVVKSDGGFTYDTSDLAALKYRMLEEKCDWNIYVVDSGQSLHLETVYAAGRDFGWYDESIQRVEHVAFGLVLGDDKKKFKTRSGETVRLLDLLSEGVKRATEKLIEKGRETAMSEEQLVAARDAVAFGCVKYADLSHTRTQDYVFSFDRMLEDRGNTAVYLLYAYTRIQSIFEKDEVKNVDLVKYIASTPTLPLDHPGEFKLAKQLLKLSDCVLLVLDSLMLHQMCDYVYQLATLFHDFYNECYVIENKEGEKPFVHMHRLALCDVTRKVMSTCFKILGLREVNKM

SEQ ID NO: 154 - protein, 250 aa, Caenorhabditis elegans
  C elegans public gene name=K04G2.1
  genomic DNA homolog sequence=SeqID_437
  cDNA homolog sequence=SeqID_1478
MADDLGLDLGKKKKSKKVIKIDGDDAPVETGVEAVEDGLGELNLGAKKKKKTPKTAGEEVVEEKVPTLEIGIGAQNLIDAKGAWPDYTYEEALTLVYQVMKDKNPDFAGDKKKFAIKLPEVARAGSKKTAFSNFLEICRLMKRQDKHVLQFLLAELGTTGSIDGSNCLIVKGRWQQKQFESVLRKYIKEYVMCHTCKSPETQLTKDTRLFFLQCTNCGSRCSVTAIKSGFKAVVGKRAAIRRAEEATAGK

SEQ ID NO: 155 - protein, 351 aa, Caenorhabditis elegans
  C elegans public gene name=C47E8.4
  genomic DNA homolog sequence=SeqID_371
  cDNA homolog sequence=SeqID_1452
MSLSILNSLKNIAFIGFYFIFAVNKMSRADEGRLIHLAKKREREKEDIEQQLRKLEEDKEKCRVGITNKFMANYETVEEVVKSKTYGLVSLDDMKNIQKNEISNRDLQVARGDQSSSTQSKDSQEAREKEEHVAKHTQKRFLSFAFDDEEDEEDAAPIIPKKRVGMDPTVDTSFLPDKEREEFLRKKKESLAAEWRVKQDAEKNEEITVAYAYWDGSSHRKNMKIKKGNTISQCLGRAIEALKKEFTELKSCTAENLMFVKEDLIIPHFYTFQDFIVTKAMGKTGPLFVFDSASDVRIRQDAALDYGESHPAKIVLRSWYEKNKHIYPASRWEPFVPSKKYGRNFDDLSDL

SEQ ID NO: 156 - protein, 324 aa, Caenorhabditis elegans
  C elegans public gene name=R03E1.2
  cDNA homolog sequence=SeqID_1479
MKFVLLVSALVAACAASSLEIIAAPASLKFPDADATLKTTLISTLNENILGLSARQVDGFSVSVDMFSRPRALAVVTVIGADNLNLGGKTYSTKSDGVENVGFDQDMALIFGADRENVQVSAGGITGSMLALAAQQEAVDATVIKTKRSTLVKELEAVYQLAAAIKSAGVQMDNNADVFRVSITGLVGITESAQKEEAVADVKAAIEALTASINNAYGGQAVIELLAFEAESGAAEKSTESREIPNHNIQKRDTKSKTPTQLARENLQVTVPVSSDYPAIFAIFLGLVVILVVALIYIVVGMASIDPEKDSIIYRMTTTRMKKD

SEQ ID NO: 157 - protein, 1000 aa, Caenorhabditis elegans
  C elegans public gene name=F38E11.5
  genomic DNA homolog sequence=SeqID_419
MPLRLDVKRKLLARSDRVKCVDLHPVETWLLAALYNGNVHIWNYETQTLVKSFEVCDVPVRAAKFVPRKSWVVTGSDDMHIRVFNYNTLERVHQFEAHSDYLRSLVVHPTLPYVISSSDDMLVKMWDWDNKWAMKQSFEGHTHYVMQIAINPKDNNTFATASLDKTVKVWQFGSNVPNFTLEGHEKGVNCVDYYHGGEKPYIISGADDHLVKIWDYQNKTCVQTLDGHAQNVSSVCFHPELPLIITGSEDSTVRLWHANTYRLETTLNYGLERVWCIQAQKGANTIAIGYDEGSVTLKLGREEPAVSMDSSGKILWAKHSEIQQANLKTISTEESEAIQDGERLPLSVKDLGSSEIYPQTLAHSSNGRFVVACGDGEYIVYTAMALRNKDFGQGLEFVWAVDPNMFAVRESATNVKIKKNFKDHKSIRSDMVLEGISGGPLLALRSNNSLCFFDWESAVLVRRIEITSKSIYWSDNGEMVAICGDDSFYVLKYSAEAVANATEVTEDGIEDAFEVIGEQAEAVKTGFWIGDCFIFTTALNRINYYVGGEIVTIAHVDRPLYLLGYMAKESRVYAVDKDLNVISYKLLLSVLEYQTAVMRRDFDTADKVLTTIPKEQRTRVAHFLEKQGFKKQALAVSQDPDHKFDLSVALGDLKTAYDLALQSDSEEKWKALSNAATLKSELLLAGECLGRARDFGGLMLLATCAGSAPLLQKLADDSAAAESHNISFLSSLLLGDIDACLDKLISTGRLPEAAFLARTHAPSRVSSILELWKAKASGHSEKSSRKIGESLADPVKYENLFPGFTQSLKAESFVREISKIPVPASVRVPSAATRNIQEELDEAVASGAVSFTDDGQAVLKNAPRQTETQLKAPPPPSVARQPSPVRQPSPIREPSPIREPEPEEEEEQEEFDDDQQEVHVPANQESADAHGTSKTPDVVLETSRPDIVPPRGSAAPDLVSASSQQSAQDFQDDTQWSDEDFGDAENGDLNMDDLNLDEED

SEQ ID NO: 158 - protein, 445 aa, Caenorhabditis elegans
  C elegans public gene name=T09A5.11
  genomic DNA homolog sequence=SeqID_348
MRWLPGLLLIASIGFHQSLADRVLVLGETAAVKDTHSVFLNSVKERGHELTVRAADDSQLALFKHGQLIFDHLFILAPGVQVFGGSLSPSEISKFVDAGGNVLVAAGSNIGDALREIAAEHGFEFEEAGTSVIDHHNYDQTLDSGDHTTLVVGKDQLISAELIVGNSAKLHPVLFKGIGLVAGKTNNLALSIVRASGTAYSYDPKAVRATNPSIAGSRTLLVGGLQSRNNARIVFTGSSELFSNTFFSAKTNSVNPSVQGAQSGNADFATAITRWVMKESGVLRVKTVNHHKKGETVPPVEGYFITEDVVYTIEIEELKNGKWVPFQGKDVQLEFVRIDPFVRATLKNSNGRLSVAFKLPDVLGVFKFLVDYRRVGYTHLYDVQQVSVRPLWHTQYERFIRSAYPYYASSFSMMAGLVLFSIVYLYHKDTPVKGAKVLDSEKKKN

SEQ ID NO: 159 - protein, 167 aa, Caenorhabditis elegans
  C elegans public gene name=F36A2.7
  cDNA homolog sequence=SeqID_1469
MSLSLLTPRLVTKNTIARIVLVRNASSGLTLKHEQTIKINDQQGFFKYQRDVSRDTRYSNPAKPGDTAARFMFRKLGHAYEIYPLFGLLAIWCVLFGYTVWYSFEKAEIWLDRSHTVAPWDWERIRNNYWKKPTLVFDPTGVTHQRLEILETLQDEMVAAAKERGTR

SEQ ID NO: 160 - protein, 228 aa, Caenorhabditis elegans
  C elegans public gene name=M88.2
  cDNA homolog sequence=SeqID_1480
MSSNLIRFVGNHDIASEGKFLFEILSQLRNFGVGRLVTKNEWTRKWPNNPSYMKILRAEPGMDRWLFEGKVYAEWVFRGKNLGVYEFSKDLNRSDWQLVHKHQEKSYTSSTTPMQDLVLPDSFPLPPLQVHLSQKSARKNGLDEKTVSRRAPLTLSVDPEFQHLKPFIKQEAPSTKSVSIYEEVDKNALLDLYGNELPVKVEAWNAGPAMFQPRFNATTMRVEEQPPK

SEQ ID NO: 161 - protein, 194 aa, Caenorhabditis elegans
  C elegans public gene name=ZC434.2
  cDNA homolog sequence=SeqID_1346
MPEIIGKLLKSDGKVVSEIEKQVSQALIDLETNDDVQSQLKELYIVGVKEVELGNKSAIIIYVPVPQLKAFHKIHPALVRELEKKFGGRDILILAKRRILPKPQRGSKARPQKQKRPRSRTLTAVHDAWLDELVYPAEVVGRRIRVKLDGKKVYKVHLDKSHQTNVGHKIGVFASVYRKLTGKDVTFEFPDPIF

SEQ ID NO: 162 - protein, 824 aa, Caenorhabditis elegans
  C elegans public gene name=H15N14.2
  genomic DNA homolog sequence=SeqID_315
  cDNA homolog sequence=SeqID_1379
MSPVPCLSTCCCFRKIVEYSTMSWFRKSANDSLLETNHDRIPVAPPREVRAPSPRLPPSYQTSNEKMFRVRKAPSEEHTLANYAYVNRSDFDDKQIKHVRVNPGPAHHYIFSIRNDGSIKPGEIAFGVPHRKWAALSLDQEVRVTPFTFQQSEYVGSMILTADFNAKKNVTSEPLNADLMAREFSIQFGGQAFSKGMQMAFRFEDKEKNKTHTLSLVVKSIEGFDIGKAAAAASGASNTDSSATKPKQIEAGELLPNSVIVFDKEEGSMLNLIGKSKGKSAYRSIINPDWDFQQMGIGGLDTEFSHIFRRAFASRVFPPEFIEQLGMKHVRGILLFGPPGTGKTLMARQIGKMLNAREPKIVNGPQILDKYVGESESNVRKLFADAEEEWRRCGANSGLHIIIFDEIDAICKQRGSMAGSSSVHDTVVNQLLSKMDGVEQLNNILVIGMTNRRDMIDEALLRPGRLEVQMEVSLPDETGRLQILKIHTARMREYNKMDPNVDLEDISKRTKNFSGAELEGLVRAAQSSAMNRLVKAGGKAQADPDAIEKLAINSGDFDYALENDIKPAFGRSDESLNRFLSRGMIVWGPEVTKILDEGSLLAATVKNPENSGFRTVVLAGAAKTGKTSLAAQMAKSSDFPFVKVISPEDTVGFSESAKCMALKKAFEDAKRSKLSVLLIDNLERLIDYHPVGPRYSNLVIQALLVLLNAPPPAGHRLFVIATSSDRMFLRDMGLMDVFGDVIDIPKLTTAGQMMNVIQESNIYSDDQLPMIEQKLASICRGEGFHGVGIKHLLELIESARQCEADYRVPTLLNMMEGLALNLYR

SEQ ID NO: 163 - protein, 260 aa, Caenorhabditis elegans
  C elegans public gene name=F59C6.5
  cDNA homolog sequence=SeqID_1368
MGEGLVEQRQADDKASWDAYWKVRDIDSRGSIYPRFRYYAHKAFDAPATWFRETIVQPLNNKNRLPYYHRQLTRVPEIDECGVNDKACFYEANEQYRLDKMVDGFILQTLRQRVDRCMLYNNPDHSPCAKVIEDMEENELNFFMKYGELGGESDVRDAYMKQKHRMIWERRHPEIMDERAAKLADHKARLANGEFDYSFWKKGMFYQDKKNYEPPYEFQMSKSALEGDKPLSKDWEYYKKVSQDPEFDKDQGKKSDFRLF

SEQ ID NO: 164 - protein, 495 aa, Caenorhabditis elegans
  C elegans public gene name=LLC1.3
  genomic DNA homolog sequence=SeqID_316
  cDNA homolog sequence=SeqID_1275
MSLSRTTQLPFAKRQFFQVLARNYSNTQDADLVVIGGGPGGYVAAIKAAQLGMKTVCVEKNATLGGTCLNVGCIPSKALLNNSHYLHMAQHDFAARGIDCTASLNLPKMMEAKSNSVKQLTGGIKQLFKANKVGHVEGFATIVGPNTVQAKKNDGSVETINARNILIASGSEVTPFPGITIDEKQIVSSTGALSLGQVPKKMVVIGAGVIGLELGSVWQRLGAEVTAVEFLGHVGGMGIDGEVSKNFQRSLTKQGFKFLLNTKVMGASQNGSTITVEVEGAKDGKKQTLECDTLLVSVGRRPYTEGLGLSNVQIDLDNRGRVPVNERFQTKVPSIFAIGDVIEGPMLAHKAEDEGILCVEGIAGGPVHIDYNCVPSVVYTHPEVAWVGKAEEQLKQEGVAYKIGKFPFVANSRAKTNNDQEGFVKVLADKQTDRMLGVHIIGPNAGEMIAEATLAMEYGASAEDVARVCHPHPTLSEAFREANLAAYCGKAINNV

SEQ ID NO: 165 - protein, 1173 aa, Caenorhabditis elegans
  C elegans public gene name=C10H11.9
  genomic DNA homolog sequence=SeqID_478
  cDNA homolog sequence=SeqID_1396
MEQDELRDQLVDPKSPINIESLLDTITALVNDCKIPVLMRMKSVDNFISRYERVVESLAALRMKAADFRQLKVIGRGAFGEVHLVRHTRTNTVYAMKMLNKDDMIKRADSAFFWEERDIMAHANSEWIVRLQYAFQDPRHLYMVMEYMPGGDLVNLMTSYEVSEKWTRFYTAEIVEALAALHSMGYIHRDVKPDNMLISISGHIKLADFGTCVKMNANGVVRCSTAVGTPDYISPEVLRNQGQDAEFGKEVDWWSVGVFIYEMLVGETPFYAEALVSTYTNIMNHKTSLKFPDEPLISTQAKDIIKKFLSAAPDRLGRNSVDDIRNHKFFVNDEWTFATLREASPPVIPSLKSDDDTTHFEEIETRDRDNAGDFQLPKTFNGNQLPFIGFTYSNEYSPVKNLLKGHGAGSKQNGIEQHKPQTVVEQPLTNGHASGVPEEKYEAVKMELDSKNREFELLKDSIARNEIRAKMIENEKNSLSTKISDLERELKDNKDKLRHGADSDAKVNELAVELRMSKEYNSEMESELSKFRDKCEQLKEDLRKKSGELAQEKNETQRVFQQKKDADEAFAEIKRDYELLQTRENEKSVQLKKALDERKENGAYQQSVAKATDAEWERKMQFYEKQLEHANDERKREEQKRTAAEFDQSRVARKLAGIEANYELLQNDYKSMKEARKDLERDLQDVITEKRRLEIRVEQLMDSRNTDERVLSLCQDELVESQEEAKYKEDGLRGKIDGFKHELENEKMKTQTLEENLLVADKERGMLKMEVQELMQRHKWEITNKDQTLKHLETQLDEIKQQSKIESSEQESNDKQTIADLRKKLDLEKAHKKAVINKLEEEMAKRQPLKKGEKGVTKSALIKKEREIMALEQERDTMSKRIAALFYENDKQAEHFNIAIQDMQTTQDALRDELKECKEELANRNVNTRYEDKRSLDSREGIPSSLSNQHIQMEGWLSLRDNTKKSRKPKWTNCFVALNEYSFTIYVDEKAVSVILLIEAGAMAHVRHVTAADLRNVDDSQLPKIFHIMYDDASCNSSRHASNSDLSMIESFREESWKRHDFQELSYHIRTFCDVCNKKLSDIIRPTPAFECKNCHFKTHKDHVAQGSLPMCRYNTGLSRELVLMAPQTDNCNKWVSQLRRFIESSRSAAVSVSRVSSRRHAPGSSNSSTIYQ

SEQ ID NO: 166 - protein, 278 aa, Caenorhabditis elegans
  C elegans public gene name=F59A3.3
  cDNA homolog sequence=SeqID_1369
MLTSRALRIPRKPFVDLDYARHMPSAYVERTKRTVPRKVFGDRFGAPDIKMYYVHPDDYVPSHRRPWEDKQISSHLHRSDKYFSAQLSNQYFNLRRPKSERMADTEWTFFPGDLVQVMVGKDKGRQGLVLTTSRDSSDVIVDGLHTKLGEDMEGSEKLGVDKTLRWQEQPLSVSKKQVMLVDPNDEQPCEARWQLNGPGDEYIRVSTRSGYEIPIPSQAKVTYEYLQPENYIEVEGKDTPADAVLERTYMPKVASFEQEIMEEMGIKEERTPKPTFWY

SEQ ID NO: 167 - protein, 159 aa, Caenorhabditis elegans
  C elegans public gene name=D1007.12
  cDNA homolog sequence=SeqID_1442
MKVETCVYSGYKIHPGHGKRLVRTDGKVQIFLSGKALKGAKLRRNPRDIRWTVLYRIKNKKGTHGQEQVTRKKTKKSVQVVNRAVAGLSLDAILAKRNQTEDFRRQQREQAAKIAKDANKAVRAAKAAANKEKKASQPKTQQKTAKNVKTAAPRVGGKR

SEQ ID NO: 168 - protein, 208 aa, Caenorhabditis elegans
  C elegans public gene name=F26H9.6
  genomic DNA homolog sequence=SeqID_341
  cDNA homolog sequence=SeqID_1430
MAARNAGTARPGGPNRTCQFKLVLLGESAVGKSSLVLRFVKGQFHEYQESTIGAAFLTQTVCLDDATIKFEIWDTAGQERYHSLAPMYYRGAQAAIVVYDITNQESFQKAKNWVKELQRQASPNIVMALAGNKADVANKRTVEYEEANAYAEDNALLFMETSAKTSMNVNDIFMAIAKKLPIGPAQGEPTGTVDMNQPQQQQKGSCCK

SEQ ID NO: 169 - protein, 2553 aa, Caenorhabditis elegans
  C elegans public gene name=Y71G12B.11
  genomic DNA homolog sequence=SeqID_326
  cDNA homolog sequence=SeqID_1343
MGVLSLTVSSAEKGIKKTMQFEPSTLIYDAAKLIREKFAMHDVNANEYGIFRLDENPSKSLWMDNGRTFEHYLVRNKDEIEYKRKIRLLKVRMLDGAVKTISVDESQPVSQLMMTVCNKIGISNYEEYSLVRDDILMQNGGGGGGGGGQNGGSTWNLKEKESRSKSSDRGGGGIYGTMRKKNEQKLEELRKKLHTDEELPWLDHTKTLREQGITEEETLILRRKYFFSDSNVDSRDPVQLNLLYVQCRDGILRGLHPVEKETAFQLAALQSHIQYGDFPYDKPKFHLDGRDVLPKEYAKNKENEKKVVAMYKELSGTSELDAKSKYVHLCRGLKTYGVTFFVVKEKLPGKNKLVPRLLGVNKESVMRVDENSKQILKEWPLEQVRRWVPSAKCFSLDFGDYQDGYYSVQTTDGEKIAQLIQGYVDIILKKKRTQDHQGIEGDEGSTMLEDMVAPAKATLVAHGQIGSGQHATDGLVAVRGVLRTPQGGQGYGINGAQYGAVSGEITSQELARAQRLRYQDMYQHPQRALIGTIEATIRAVEDAEIELEAEPQIDIPRFNDDYSQNRWMEEQQAVNKENVNERLAAMGAATAQVVQWTAVEEYDDRVGTAIATIGSNLPDVSRNVRDLGAFMEHRERGDLLDATKKLCGAFGKFLNTVNPETEARRNEVFRTAGHVGETSQHLINVMEAPNEGQQKFDERLVQSAKNVATSTAQLVLCAKTISAECDEPQVQERVIQSATKCAFATSQLVACARVVAPTIDNNACQQQLSTAATEVTQSVNNLLHDAEHAVYQQSSLTDIHEAARQVTSALDSLLEHAKCSPKTQTTRREEEEMYNEVLRRTNRMVVHQGPSEDLTREARKVVRHSQLLTEQFQHEAHQRPEHRERLLDAAAKVAHATSEMILATEQAESQPRQVETEYALRTAAERLGQVTNETTQEQQEQHIMQRLEQAAKQTAYDATQTISAANSAKDVIESRSYKENLVYESTQTAGHLPNLITSIRESQKVDNTPGEKFKAQSRLIRDSYKVLETSVRLFETARTAVPMVSDSHLASSLDQSANRLGTSLADLRTSVNDAQQLNFSQQLLYSEELIKELDDQLVNTQKRAIARELPPIQNATSFSVSSKLMATTSNVGSGVAQLITAAATSNDDKYVGTSAVELAQGLRDFTDAITEIVTVRTDIQLDKLIVSARSVVHESGRVFDRVREKSAPTVLTDAAMNVSTSLKQVISCLPDTKHIEKAIHEIQTAHTSANIRPMEVRQAANKFIEATSQLVVTIGSPDSREAVDIFVRAYCDLHGSVVAQLQRQSNMNNVKTAIIDRLEEAQRGSIGVLETLRQAGNPSDHTLSQQFTSKTRELATTVNQLVELSGMDGGESRWQRECDAALRRIQAVYHVTQHANVPLNDNGYFASLQSVSDGSRRLGEAMTGMARHAKGNDTEGFCTSVRDSADALCSLAESASHSAYLVGISHPASSPGRAALIDSSEVARSVESINASCQRVESRQLNREELMSDISSITKQSSSLAQLCRIASEKTQNPNVKKHLVGCAMGVASKTSSLVTAFKDLDRMPDAESRCTSSASELRQVALQLLHFADKPDFAAIQGSISTEGHSAQQPILQSSREMLDSSAQMIQTAKSWASAPQDEATWQRMAVNSRQVSDSIMRLVNAIHEAAPGQMELEAAIGRLSALSGQIERSAMDCYASGNVQKHGANAERQLLQQVQHIASQLEDKVDDLHNAAVEHGERLPKVVQLHCQMVEDLADAACCAAGMTVDSNQQTELFDKCKTVVEAELAMMVASRESGGNPNAVHAHANVKDAAGQLKHAIGDMRQTIAKVSSEQGAVQGMVDTISSSIAHTDVAVSSAHPGSSFADAQTRMTAYLEDIRRTAIEMPTLNTTDLGAASLNLSEKYRLVAGDVRQAAGMLPEADIGQRLKLAVQKLGTSCIETVTVAGGKRAHPEDERIQRQLSSQAGTVVERVEQVLAALHSASRGTQACINAANTVSGIIGDLDTTIMFATSGSLNSSDDRKFPSHKEAIVKTAKALVEDTKALVAGAASNQEQLAVAAQNAVRTIVNLSDAVKTGAVSLSSENSETQVLVIHAVRDVAAALTSLIQATKNASGLSLQHPAMGHLKDAAKVMVSNVARLLKTVATVEEKNQQGTRAVEAAVDAIGFEMKQFEHDLNEGAAIPTDFRPEHLQQTAEHVSEITKRVMQGADAPQSEEEIIGVANLSRSAVRSLLAVVRTISNDADTAPQRYAVLDSGRDVANNVKSLLVSLHTQMVRNPGQEESRRLLLEASKGVSSALSHLVGLCNEMTGLPHNHEMESAAAQAENELLGAASSIEAASAKLAELRPRQIVQENTQEIVETEFDDNIIISAKGILHAVHTLMRSASNAQRELAMQGRAAAGGTGTYQWSEGLISAARVVVASVHKLCDAANTLMKGQTTEERLISAAKQVSSSTAQLLVACNVRADPDSQANRRLQAAGQAVRNAAERLVQSAQQEMIARDDRNIAISDRLVNGIAQVMDAQEEVLRKERELGEARHKLAHLNKARYERDGEEA

SEQ ID NO: 170 - protein, 521 aa, Caenorhabditis elegans
  C elegans public gene name=C37A2.4
  cDNA homolog sequence=SeqID_1356
MAGRKSSRTAERVPTTQKPERKSAILSPHDELRERLLETAIDMKENIPQRNTRNSSVGSQKSDCSETRKRRSTKEGPAAKRHSGEKHRNGSREDSLEYISDDREVGSSSSQSSRTRGQPLPAMPEEEEVFDKSSSSDNLAESEESHEMVRLEERQDIEEEIEDDFDDEEEDVVNDKEEYEEIESEDEDDYPVQNEGFAVTKRLMNDEHMVTAPTFLSTAKCDGIGSPTKVWSLMVKRDEIPRATRFLLGNHPDMDDEKRRILIDWMMEVCESEKLHRETFHLAVDYVDRYLESSNVECSTDNFQLVGTAALFIAAKYEEIYPPKCIDFAHLTDSAFTCDNIRTMEVLIVKYIGWSLGPITSIQWLSTYLQLLGTGKKNKSDHYEEQNMYVPELLRSEYLEMCKILDFLLFEIDSFTFSYRTIAAAVLFVNYEPTCAVEKATGFMQAQLEKVIEYVEPVCRAFAKQRQLLDDVIPKHESIKSDDSHNIQVYVKRSSMEPIVKSERERIQHLKARRLHPQRLF

SEQ ID NO: 171 - protein, 523 aa, Caenorhabditis elegans
  C elegans public gene name=B0511.8
  cDNA homolog sequence=SeqID_1427
MHGLKRSLMIRTVCRGKATTAGADLPQSSQEIEVTTPKSENVPAKSANASTVYRPPYYRKPHQHHEPKHMLQEEFVNAGDASGAGVRVFDYYKTAEMVHSMPTIKEKIDFVSPYERPWTRAEKTWRRDWHPTLMATRKAWGIPPTPAHFDTLDYYKYLTKTRVENESLDDFYHGLRPPTADLQTSFQNTLKSMEFGDGINFSDEDTQKLFGSLIDDAMGGIAHNVSRLADHRVAYDVESEAFWVRSGFMFLYDEEEIGTRDVKRRLNNFPKFIGDDRRKLGELAFVHRDKLAAQVRSKEPSAPLHSFDSEDAKLPIFDTNYNFEETLFSPKVYNLWPDQEPLWQCPGYHADSGESHTYGILGVKSLRPLRKRIAHWMGWENENELESSEEAKQMLDDGARSQAIISMFTTLCAQAHTHGFTQYTDITRSFTSQLVLSDGINFWFAIGQLNTIAINVECDGFVNPRTNYIRIDGPYRLFDYCDKNGQYLSVQEEIDAENKVQRKIAPGLNEKVLERVTQMLMKQ

SEQ ID NO: 172 - protein, 448 aa, Caenorhabditis elegans
  C elegans public gene name=T22D1.10
  genomic DNA homolog sequence=SeqID_399
  cDNA homolog sequence=SeqID_1392
MATLDGINVKDIVKVERTSVHSHITGLGLNDRLEAEYVSGGMVGQVAARQAAGLIVKMIQEGKIAGRALLVTGEPGAGKTAIAIAISKELGEDTPFVSIVASEIYSNEINKTEALTQAFRRALGIQIKEETEVLEGEVISLEVDRSANGMGPKVGKLTMRTTDMETIYDLGSKMVDACLKEKVMPGDVIQVDKASGRVTRLGRSFNRSHDYDAMGPKVKLVQCPDGEIQKRRETVHTVCLHDIDVINSRTQGYVALFSGDTGEIKAEVRDQINKKVLEWREEGKAKFVPGVLFIDEAHMLDIECFSFLNRAIEGELSPLIIMATNRLIEKVRGTDVESAHGIPSDFLDRMLIINAIPYTKEDTAKILSIRCDEEGVKLQPTALDLLVKLQEATSLRYCIHLIAASEVIRIRSKAEIVTTDHIGSAYRLFFDTKRSEKILTEESAGFLQ

SEQ ID NO: 173 - protein, 214 aa, Caenorhabditis elegans
  C elegans public gene name=F10B5.1
  genomic DNA homolog sequence=SeqID_489
  cDNA homolog sequence=SeqID_1406
MGRRPARCYRYIKNKPYPKSRFCRGVPDAKIRIFDLGNKRANVDTFPACVHMMSNEREHLSSEALEAARICANKYMVKNCGKDGFHLRVRKHPFHVTRINKMLSCAGADRLQTGMRGAYGKPQGLVARVDIGDILFSMRIKEGNVKHAIEAFRRAKFKFPGRQIIVSSRKWGFTKWDREDYERMRAEGRLRSDGVGVQLQREHGPLTKWIENPI

SEQ ID NO: 174 - protein, 560 aa, Caenorhabditis elegans
  C elegans public gene name=F55F8.4
  genomic DNA homolog sequence=SeqID_332
  cDNA homolog sequence=SeqID_1434
MGKGFQNFMSKKDFHPSAFRNLKMVWEARQKKSLEDKRQEELRVAYEKEQEILNNKALLGDEKAKMGLSFMYDAPAGMTKREEPKEEPKFEWQRKYQAPREDWAKGNEEIQDQPFGIQVRNVRCCKCHKWGHINTDRECPLFGKSGNFEDEGYANNPSDLIKDLRRRRQEGKAGPSTSKSSAAAATGEDDDEDEWMDHQQLASDMREEHGIKLKSSVLAGMQTDQQLTRMKKEMTEEEMMLEFFNSMTEKEKKKLHKKLMSGADLEDVMKKKSKKEKKKEKKEKRKNKDKKKDKKKNKKSKSRETDDDSDGSDSEDDWKEKSSKRIKREVESSPEYRSKYIKQEVLSEDENSHGRKDSSRKRAHNDSESSNEVRSSERKRSRRDDSPNAKRSIGLKSPERRSSRDRKSSPKQRQDSPVRRRRSPSSIRKESQRVRKHSPEQKRNGRHDSRSVSPVRRRRSPSPDNRQLGSRKQYSPLRRRQSSPMVASPRRRRSPSPERQRKRRSPSDSPPTRRLSTSPIRRRRSPSPNKLPVRRRRHDSGSPDRDGSESPKMWRKKSHK

SEQ ID NO: 175 - protein, 187 aa, Caenorhabditis elegans
  C elegans public gene name=Y48G8AL.8
  genomic DNA homolog sequence=SeqID_439
  cDNA homolog sequence=SeqID_1402
MTKVHYSRAPENSTKSCKARGSDLRVHFKNTHEAAMALRGMPLRRAQAFLNHVKEHKEIVPFRRFHGGIGRAAQTKQWNTTQGRWPVKSADFLLDLLKNAESNAEYKGLDVDHLVIEHINVQRAAKLRRRTYRAHGRINPYMSSPCHIEVILAEKEDVVSKPTDDAAPKVKKESKRKQRRQLARGEF

SEQ ID NO: 176 - protein, 1208 aa, Caenorhabditis elegans
  C elegans public gene name=K08E4.1
  genomic DNA homolog sequence=SeqID_379
  cDNA homolog sequence=SeqID_1426
MSSDESDAASNKEEDTTLSDDDGSDVEIKNSKKDRKRKLASESEKSGSDDDDDDDDDEDENVTSKKSKKQKRKNKAPSGRDFLAWDVEVDDEDEDDDNDYDDEDDPSMNAMNEREEAERAMKEMELSQRNRDRYKFQNMTEDEVQKYFENKYKGDKNDSQYDDEDSAMDDISKNSHLPSTKDPNLWIVKCRMGEEKLVAMHLMRKCLAVEHTNEPFQIKSVVVKEGLKGMIYIEAFKQSHVMSAIEGFSALNQFTITMVPIKDMVDVLRVVKDIPQLKLGSYVRLKRTMYKDDLAVVDLVDIAQNRVNLKLIPRVDYQKRRGAMRTDADKNYKLKRRPMPKLFDQDTIKEVGGEIVTDGDFLVFEGNHFRRGFLYKYFPINAIQADGVKPTLGELEKFQESSDDLKRELETASLKDTENPFVPGDIVEVKAGELVNLRGKVMTVDGTKVVMMPDQEDLKEAITLNAHELRKYFKEGDHAKVISGRYEGHTGLIVRVKDSTAIVLSDLGMEELKVRVRDLQLCADVTTGVDSLGQFQYHDLVQLDHTGNVGVIVRLEKEHLEVLNMHGVVNRIKPQAIIAKKDVRFAKVLDSQNNSIEAKDLVKVIGGPNAKERETDEDPVGEVLYAFRGTVFVYSRKVTKNGGVLVCKPKQLILQGAKKTTSTPMVSRMASPNPMASPRHSSGGMTPRSPQDGMSSRGSSGGQTPRQGGGGGRGGHFGTANQQKVRRDLTLIGKNVRIIKGPMKGHFGIVRDATEDTVRVELHTQCRTISVDRARVMVVGDTGITAGSGGGSSFYSSSKTPMRDSGKTPMYGSKTPMYGAQTPMYGSMTPAYDGGRTPAYGEGGRTPAYGSKTPAYGDLDEHSSSRTPAYGNDSSRTPAYGSADGARTPAYGSTEGGRTPAYGSMDNSRTPAYDDSGRTPGYESMPSRTPNYDSSSKTPAYPESEHSARTPAYNNDYDIPLSPAYEPDAPEAYDNAPARTPAFVSRTPGYDTYENSSPTYEPDAATKVEEDIGDTSSPTYDSPPHSYVVPTPGAMLNPATPGAYHVDTPGFAAPMTPGSGGAYDQYVAPSPFAGYDSNNYNNADGAIEQIPDHFLAQGVWIVQNLCVQIKDHEGRFNGREAIIKDVTDGKVDVYMPDHKCNLEVDFDQLTPMKPQPGDDARVIFGQDAGHSGQLVSMDGFEAVIRSQEDMSDMRVINIGLCCKMHSET

SEQ ID NO: 177 - protein, 1244 aa, Caenorhabditis elegans
  C elegans public gene name=C08B11.3
  cDNA homolog sequence=SeqID_1387
MESRKRKSELEHYIDKLTDPPEKQRKMAEFYNSLRMFYKRRWNATLKLPHVQGVEVNLYRLYDTVMALGGWQKVAASDKWSDIAEMFGCKDDILCGDHAIKIIYMRYLSKFEQVETIGDVDDYVDNEMSRSRGRNATSFFATNECPISNNRMVQEYQHRDERGQIINEPDYARLTKSLISGLPNEIDFAMNVCMLLSHAGPKQLRICHAPTLLTLLVAHTGVYDEDDETMADMGKEWKRTTKHNFRDFWASSGVPLDMLMTFLDREIEAEYIDEDDQFFTGVSETFNVKDSRCWRLNQVTTIIRNLSFEPANRVTIVKTWPVMKFLIMCASCKWSPLYVAALDALSNLATDIDLTDKTLVYISQHAILRIITDGIFSLDKFKLVRSLEILTGLCGFEGNEAIICDWLNSATIAHIFEVVGVKDIMMCVYTLECLYQISEMGDTACDLISESPKAIQQLVSMATLEAVSFGPAGLAGMKVVEYQPSFTQGSNQQQNPHHSQGGHQLGHSNVRMGGLNHNQHHQQIGPPGAPGAAPMTVRQVIQNNLALQQVQRENLNREQYSTQSSQPHPPHTNVPPSPSILAHHSSGLVQQNGMKFDRRTGNLPVRPIAPSTNSGESQLEQLTEKWIRQNCVFEPAMSTPRGELYAAYVDDLRNLYHSMSGSLAMFSGVMKNLYPDVNFRMAQNGIMIVAQGIRLIRPHRLAPAASQSASESHPLMKKMLTSEPKEENGVLINGHAVQESGAERIIKTEPIRTDEPSVLIESQEQSVPKKQNDINGEETDEVELNSKIVTPEKKSITNGTVEVCQEPIQASKLFDENYANQIEGSEVSIEIREQFVNDTDNVKLESEKINGIICNGNSKVKKESMASRAAHIVAVAAACNGDLERMNVVSNGNDIEKEIEKETEKVEEETNEEKNKEVVETEVVDDAQESEKRKCVPPSSNPTDYMCDWDCCSIYYASPSHVLKHLSEEHVAEELRLLCRWNGCADPTPRNRWSLITHIQDSHCNEAQLKAASQKRKEGGGIAPVRGAPRAEVISRDINNHPGYAKNAAFDAIRRHAFNFLSRELTDEAEGPVTKSIRLTSCLILRNLARYSAEGRQKLRRHESHICWLALSRLESAHALSQLLSELHQAPAAEEEQQKMLSEVPSSASLSSMAGSSSQLPTVPDSPTSSVASAPMKESTSVSNKPTVHINRMLNFSSLNEKTPTSPQFTAGSSPHRHQPIQQHIPSQPSPLVQTTPVRAGAGI

SEQ ID NO: 178 - protein, 494 aa, Caenorhabditis elegans
  C elegans public gene name=Y51H7C.6
  genomic DNA homolog sequence=SeqID_417
MPEPILHSKFLSGLPAGRKNGVRHGEKPEKVGEKQFDFTRKIRELRLELEIKKREEERIEKDIAIILEENTIDGGEQNRSFGLAVTRLNNHMLVVENSAKQLTSALKNISVLADTISGRVSALDVAKTRVVGCLQLAGDMRDLGVCAEGIDDAIRSEDFETASQHIHRFLTLDQAVFQIREFKQKDATDSIRHSYEVLSSAKERLSKILKSRLTESVQKGDVAEMQRFIKMFPLIHEPDEGLQRYSVFLNQKIDKLAEDNLAIMKAGGTDDNRRNVLYADTLFMFFEGVAEIIESNLPVLEHSYGLEKLLDFMFILQARIDEFFRRLHEEFDTRRRLSHFNRLVDDVIHQKKAAEAVEDAPDPMEIDAIASEICMMNTSAEMYWRFVSRRIGKNEVIRSPSGDGDDEENEEARQERHRLRKEAKEQKMDQLLNRSRVGTKMQELIGNYCLLEHFYMLKSVQKAIKSDVKEDAGGLTRCGDKKYRKRPLKQEKIC

SEQ ID NO: 179 - protein, 268 aa, Caenorhabditis elegans
  C elegans public gene name=C26D10.2
  genomic DNA homolog sequence=SeqID_451
  cDNA homolog sequence=SeqID_1289
MEEEQLLDYEEEQEEIQDKQPEVGGGDARKTKGTYASIHSSGFRDFLLKPEILRAIGDCGFEHPSEVQHECIPQAILGMDVVCQAKSGMGKTAVFVITTLQQLEPVDGEVSVVCMCHTRELAFQISKEYERFSKYLPGVKVAVFFGGMAIKKDEERLANDCPHIVVGTPGRMLALARSGKLKLDKVKYFVLDECDKMIGDADMRRDVQEIVKMTPQQKQVMMFSATLPKELRTVCKRFMQDVRFISDPEPTEPLFTFLKQKTCIKPKC

SEQ ID NO: 180 - protein, 320 aa, Caenorhabditis elegans
  C elegans public gene name=D1054.14
  genomic DNA homolog sequence=SeqID_468
  cDNA homolog sequence=SeqID_1338
MANRTEKAAKTVKGTNPQFLVEKIIRQRIYDSMYWKEHCFALTAELVVDKGMDLRYIGGIYAGNIKPTPFLCLALKMLQIQPDKDIVLEFIQQEEFKYIRALGAMYLRLTFDSTEIYKYLEPLYNDFRKLRYMNKMGRFEAIYMDDFIDNLLREDRYCDIQLPRLQKRWALEEVDMLPSYKSLLDGDLVAMSDSDSEEEEVTKKEKPRLTSRRRSRSRDRERDVGDRREVREREKLKERRERGDDEPGPSSSGSGRRDDRDDRRRDRDRSRDRDRRDRRDDDRRDKKKESRRGGADNDEEREIAEANALRAKLGLAPLER

SEQ ID NO: 181 - protein, 870 aa, Caenorhabditis elegans
  C elegans public gene name=T14G10.5
  genomic DNA homolog sequence=SeqID_378
  cDNA homolog sequence=SeqID_1429
MKTNKKDEETGGNVYAHLDKTSVLQEARAFNETPINARKCCFILSKLIYIIQQGESIGRTEATEAFFGVTKLWQSKDVSLRRMVYLAVKELAEVSDDVIIVTSSLTKDMTGREDLYRAAAIRALCKITDTGMLQTIERYMKQAIVDRNSAISSSAIVSSIHLMRKSSEVVRRWANEVQEAVSSDNHMVQYHALALLYQIRANDRLAVNKLVQKFSKNALRSPYAVCYLIRIATRCLVDDDQPDSSVFTFIESCLRHKSEMVVYEAARAIVSLPQTTPSEIQPAITALQMCCTSPKAAVRFAAVRTLNKVAMAHPNAVMSCNVDLEKFITDPNRSIATLAITTLLKTGAESSVERLMQQIAGFVNEISDEFKIVVVDAIRSLCSRYPRKHTVMMPFLAKMLRSDGSYDYKKAIVETIIAIIEENPDAKVAGLAHLCEFIEDCEHDNLSTRVLHLLGREAPKTPNPSSYIRFIYNRVILESTKVRAAAVTALAKFGAQCVDLRPSIQVLLKRCLLDSDDEVRDRATFYLKMLTEAAEGLIHNFILDGLQVSPSGLERSILDYLRSGSYSSPFDLRVVPVTQQALSQPEKRVPQLVEEEEKPKAPKVEPYAAQLAAIPQFAALGPVFKSSTRIALTESIAEYTVHMIKHTFANAMVLQFECKNTMNDQLLLDVSVELEDPDGEWETGNTVQIDKLPYGEVHSAFSLLEFPDSGAISGSLGAILKFKVMDVDPTSGEPDSDDTYEQTYVLEEVDVNVSDSVQGVAKSSFGSAWEALGDDATREETFQLSTVENIPDAVKKISEILGLVPCERSDRVPEGKTQHTVFLSGVFRGGYDVLSKATVAVDPNDNSIAMNIIIKSNEPLVADLVISAVV

SEQ ID NO: 182 - protein, 211 aa, Caenorhabditis elegans
  C elegans public gene name=F53G12.1
  genomic DNA homolog sequence=SeqID_306
  cDNA homolog sequence=SeqID_1399
MGSRDDEYDYLFKVVLIGDSGVGKSNLLSRFTRNEFNLESKSTIGVEFATRSISVEGKTVKAQIWDTAGQERYRAITSAYYRGAVGALLVYDIAKHVTYENVERWLKELRDHADQNIVIMLVGNKSDLRHLRAVPTDEAKIYAERNQLSFIETSALDSTNVEAAFTNILTEIYKSVSNKHVGTDRQGYGGGSGTIIPSPASDPPKKQCCIP

SEQ ID NO: 183 - protein, 934 aa, Caenorhabditis elegans
  C elegans public gene name=D2013.5
  genomic DNA homolog sequence=SeqID_449
  cDNA homolog sequence=SeqID_1365
MRIATRRRFISNNLHKFSRISASTSATLAAYSNGNQHQNRQFGTNALFSKKGGLLQKRQTVINLQSERAFIGIAASAARHLLKLRYFIATGVIGGSVAARTWYEEWKSNLPDLSLPEWFDSNGSWNEFSQKMKGIKDGFGADGQNKWAEWMAKFEQFKQQKEDQNGNSGGGGGGEGNVPVKEPVILASLMSAFSSKKDEPEEKKDNVSAEERIQKLQEEMLKTQSQYQRELERLEKENKVLKQRLLLSDDKAAIRLKRLKRSLIDMYSEVLDLLNEYDSSYNTSDNLPRVVVVGDQSAGKTSVLEMVAQARIFPRGSGEMMTRAPVKVTLSEGPYHVAQFRDSSREFDLTKETDLQQLRNETEVRMRNSVRDGKTVSNEVISLTVKGPNLPRMVLVDLPGVISTVTADMARETKDDIIRMSKAHMENPNAIILCIQDGSVDAERSNVTDLVSSIDPSGKRTILVLTKVDMAEKNLANPDRIKKILEGKLFPMKALGYFGVVTGRGNSSDSIDEIRKYEENFFSTSQLLRDGVLKPSQMTTRNMSLAVSDCFWRMVRDSIESQTDAFRAAKFNLEAEWKNHFLRIRQLNRDELYDKARGEILDEIILMPAYASSSSGSFNTTVDIKLKHFADKQLAQKSIETGWDTLKEVFFRQINQDARTKKDHDPVFDALKEAVIEEAMLTHGWDDKAMDYLRVIQLNAMEDRAVQDKRSWDAACNFLHKAASERLAAVKKQLTDDRGPGWASKWLMWKTPTADNHYSCVIQDELYSILGADPEHKQALTDDDITVIRRNIETKGVLEVPTESIRKQWKLVFKKHFLERIINSSKDCLSMYQMYRQGMIEGQDIDCQTIVLFYRIQKMVNLTCNALRQQITNTEHRRLEKEIKEVLDDWSQEPDIKKKYLTGRRVDLAEEIQQVRRIQEKLEEFMAQLQREKI

SEQ ID NO: 184 - protein, 189 aa, Caenorhabditis elegans
  C elegans public gene name=R13A5.8
  genomic DNA homolog sequence=SeqID_453
  cDNA homolog sequence=SeqID_1455
MKLIESNDTVVFPEGVTFTVKNRIVHVTGPRGTIRKDFRHLHMEMERIGKSTLRVRKWFGVRKELAAIRTVCSHIKNMIKGVTVGFRYKMRSVYAHFPINVTLQDGNRTVEIRNFLGEKIVRRVPLPEGVIATISTAQKDEIVVEGNDVQFVSQAAARIQQSTAVKEKDIRKFLDGIYVSEKTTIVPTD

SEQ ID NO: 185 - protein, 1154 aa, Caenorhabditis elegans
  C elegans public gene name=F09F7.3
  genomic DNA homolog sequence=SeqID_433
  cDNA homolog sequence=SeqID_1378
MTIGQVNGRARIKSECGKDQKCMPLEDKWLLVPAFLKVRGLVKQHLVSFDHFVQEEIRSIMLSNQKITSDANPNFYLKYLDIRIGKPSSEEGLNMTHDKITPQECRLRDMTYSAPISVDIEYTRGNQRVFKKDLIIGRMPIMLRSSKCILRDLAEEELARVQECPYDPGGYFVVKGSEKVILIQEQLSKNRIMVGRNSSKELQCEVLSSTSERKSKTYVTMKKGKYSVRHNQLTDDVPVSIIFKAMGVESDFDIVSTIGHEEKYVSAFAQTLEESINAGVYTQQQALAYVTSKVKARKFTPFGSLPGTSVSVLTPPKEHEAVDFLSNSMITHIACPDGNFKMKAIYLGLMTRRLIQTELGENGLDDRDFYGNKRLELAGSLLSLLFEDVFKRFNSELKRIADNALMKTMAAPLDIVKHMRQDMITNTIVNAMSTGNWIIKRFRMERLGVTQVLSRLSYISALGMMTRINSTFEKTRKVSGPRSLQPSQWGMLCPSDTPEGEACGLVKNLALISHITTDSDEKPVLRLLLNSGVEDLHNVHFSHVNKPENTLIFLNGVLIGTAVDPERVVKAVRDLRRSGLLSEFVSVSRSLTNRSVFISSDGGRLCRPYIIVKNGTPMLTQAHVQELKEGKMIFEDFVDDGIVEYLDVNEMNDALIAVYGREIGPETTHLEIEPFTLLGVCAGLIPYPHHNQSPRNTYQCAMGKQAMGTIAYNQQKRIDSIMYLLCYPQRPLVKSKTIELTNFEKLPAGANGIIAVMSYSGYDIEDALVLNKASLDRGYGRCLVYKHVKGTAKKYPNQTFDRLLGPALDPNTRKPIFKHKNLDQEGIVFAGARIMPKQTIINKHMPVVSGESGPGASASANTIGIAGRQVDYKDVSITYKTPTPSYAERVLLTYNEDEAHLFKVLLRQTRRPELGDKFSSRHGQKGVCGLIAQQEDMPFNDLGMVPDMIMNPHGYPSRMTVGKLMELLSGKAGVVNGTYHYGTAFGGDQVKDVCEELAACGYNYMGKDMLTSGITGQPLSAYIYFGPIYYQKLKHMVLDKMHARARGPRAALTRQPTEGRSREGGLRLGEMERDCLIAYGASMLLIERLMVSSDEFKVDVCTGCGVIGSKGWCQKCRSSKSMANIKIPYACKLLFQELQSMNIVPRLDLARYTE

SEQ ID NO: 186 - protein, 318 aa, Caenorhabditis elegans
  C elegans public gene name=F38H4.9
  genomic DNA homolog sequence=SeqID_372
  cDNA homolog sequence=SeqID_1370
MAAAPPSADPLDKALIVDVDQWIEQLYECKPLSENQVKTLCEKAKEILEKEPNVQEVRCPVTVCGDVHGQFHDLMELFKMGGKSPDTNYLFMGDYVDRGYYSVETVSLLVCLKIRYKDRVTLLRGNHESRQITQVYGFYDECLRKYGNSNVWKYFTDLFDCFPLTALVDGQIFCLHGGLSPSIDTLDHIRALDRIQEVPHEGPMCDLLWSDPDDRGGWGISPRGAGYTFGQDISETFNHSNGLTLISRAHQLVMEGYNWSHDRNVVTVFSAPNYCYRCGNQAAMVELDDDLKYSFLQFDPAPRRGEPHVTRRTPDYFL

SEQ ID NO: 187 - protein, 1758 aa, Caenorhabditis elegans
  C elegans public gene name=F01G12.5
  genomic DNA homolog sequence=SeqID_401
  cDNA homolog sequence=SeqID_1357
MKQRAALGPVLRLAILALLAVSYVQSQATCRDCSNRGCFCVGEKGSMGAPGPQGPPGTQGIRGFPGPEGLAGPKGLKGAQGPPGPVGIKGDRGAVGVPGFPGNDGGNGRPGEPGPPGAPGWDGCNGTDGAPGIPGRPGPPGMPGFPGPPGMDGLKGEPAIGYAGAPGEKGDGGMPGMPGLPGPSGRDGYPGEKGDRGDTGNAGPRGPPGEAGSPGNPGIGSIGPKGDPGDLGSVGPPGPPGPREFTGSGSIVGPRGNPGEKGDKGEPGEGGQRGYPGNGGLSGQPGLPGMKGEKGLSGPAGPRGKEGRPGNAGPPGFKGDRGLDGLGGIPGLPGQKGEAGYPGRDGPKGNSGPPGPPGGGTFNDGAPGPPGLPGRPGNPGPPGTDGYPGAPGPAGPIGNTGGPGLPGYPGNEGLPGPKGDKGDGGIPGAPGVSGPSGIPGLPGPKGEPGYRGTPGQSIPGLPGKDGKPGLDGAPGRKGENGLPGVRGPPGDSLNGLPGAPGQRGAPGPNGYDGRDGVNGLPGAPGTKGDRGGTCSACAPGTKGEKGLPGYSGQPGPQGDRGLPGMPGPVGDAGDDGLPGPAGRPGSPGPPGQDGFPGLPGQKGEPTQLTLRPGPPGYPGLKGENGFPGQPGVDGLPGPSGPVGPPGAPGYPGEKGDAGLPGLSGKPGQDGLPGLPGNKGEAGYGQPGQPGFPGAKGDGGLPGLPGTPGLQGMPGEPAPENQVNPAPPGQPGLPGLPGTKGEGGYPGRPGEVGQPGFPGLPGMKGDSGLPGPPGLPGHPGVPGDKGFGGVPGLPGIPGPKGDVGNPGLPGLNGQKGEPGVGVPGQPGSPGFPGLKGDAGLPGLPGTPGLEGQRGFPGAPGLKGGDGLPGLSGQPGYPGEKGDAGLPGVPGREGSPGFPGQDGLPGVPGMKGEDGLPGLPGVTGLKGDLGAPGQSGAPGLPGAPGYPGMKGNAGIPGVPGFKGDGGLPGLPGLNGPKGEPGVPGMPGTPGMKGNGGLPGLPGRDGLSGVPGMKGDRGFNGLPGEKGEAGPAARDGQKGDAGLPGQPGLRGPQGPSGLPGVPGFKGETGLPGYGQPGQPGEKGLPGIPGKAGRQGAPGSPGQDGLPGFPGMKGESGYPGQDGLPGRDGLPGVPGQKGDLGQSGQPGLSGAPGLDGQPGVPGIRGDKGQGGLPGIPGDRGMDGYPGQKGENGYPGQPGLPGLGGEKGFAGTPGFPGLKGSPGYPGQDGLPGIPGLKGDSGFPGQPGQEGLPGLSGEKGMGGLPGMPGQPGQSIAGPVGPPGAPGLQGKDGFPGLPGQKGESGLSGLPGAPGLKGESGMPGFPGAKGDLGANGIPGKRGEDGLPGVPGRDGQPGIPGLKGEVGGAGLPGQPGFPGIPGLKGEGGLPGFPGAKGEAGFPGTPGVPGYAGEKGDGGLPGLPGRDGLPGADGPVGPPGPSGPQNLVEPGEKGLPGLPGAPGLRGEKGMPGLDGPPGNDGPPGLPGQRGNDGYPGAPGLSGEKGMGGLPGFPGLDGQPGGPGAPGLPGAPGAAGPAYRDGFVLVKHSQTTEVPRCPEGQTKLWDGYSLLYIEGNEKSHNQDLGHAGSCLQRFSTMPFLFCDFNNVCNYASRNDKSYWLSTSEAIPMMPVNEREIEPYISRCAVCEAPANTIAVHSQTIQIPNCPAGWSSLWIGYSFAMHTGAGAEGGGQSLSSPGSCLEDFRATPFIECNGARGSCHYFANKFSFWLTTIDNDSEFKVPESQTLKSGNLRTRVSRCQVCVKSTDGRH

SEQ ID NO: 188 - protein, 531 aa, Caenorhabditis elegans
  C elegans public gene name=B0464.1
  genomic DNA homolog sequence=SeqID_406
  cDNA homolog sequence=SeqID_1462
MADAAEGEQPKLSKKELNKLARKAKKDEKAGEKGGNQQQAAAMDQEDASKDFYGSYGLVNSKEKKVLNFLKVKEINVSNATKDVWVRGRIHTTRSKGKNCFLVLRQGVYTVQVAMFMNEKISKQMLKFVSSISKESIVDVYATINKVDNPIESCTQKDVELLAQQVFVVSTSAPKLPLQIEDASRRAPTDEEKASEQENQLAVVNLDTRLDNRVIDLRTPTSHAIFRIQAGICNQFRNILDVRGFVEIMAPKIISAPSEGGANVFEVSYFKGSAYLAQSPQLYKQMAIAGDFEKVYTIGPVFRAEDSNTHRHMTEFVGLDLEMAFNFHYHEVMETIAEVLTQMFKGLQQNYQDEIAAVGNQYPAEPFQFCEPPLILKYPDAITLLRENGIEIGDEDDLSTPVEKFLGKLVKEKYSTDFYVLDKFPLSVRPFYTMPDAHDERYSNSYDMFMRGEEILSGAQRIHDADMLVERAKHHQVDLAKIQSYIDSFKYGCPPHAGGGIGLERVTMLFLGLHNIRLASLFPRDPKRLTP

SEQ ID NO: 189 - protein, 181 aa, Caenorhabditis elegans
  C elegans public gene name=B0336.2
  genomic DNA homolog sequence=SeqID_392
  cDNA homolog sequence=SeqID_1366
MGNVFGSLFKGLFGKREMRILMVGLDAAGKTTILYKLKLGEIVTTIPTIGFNVETVEYKNISFTVWDVGGQDKIRPLWRHYFQNTQGLIFVVDSNDRERVGEAREELMRMLAEDELRDAVLLVFANKQDLPQAMNAAEVTDKLGLHSLRNRSWYIQATCATSGDGLYEGLDWLSNQLKNRS

SEQ ID NO: 190 - protein, 166 aa, Caenorhabditis elegans
  C elegans public gene name=F29B9.6
  genomic DNA homolog sequence=SeqID_375
  cDNA homolog sequence=SeqID_1439
MSGIAAGRLAEERKHWRKDHPFGFIAKPVKNADGTLNLFNWECAIPGRKDTIWEGGLYRIRMLFKDDFPSTPPKCKFEPPLFHPNVYPSGTVCLSLLDENKDWKPSISIKQLLIGIQDLLNHPNIEDPAQAEAYQIYCQNRAEYEKRVKKEAVKYAAELVQKQMLE

SEQ ID NO: 191 - protein, 247 aa, Caenorhabditis elegans
  C elegans public gene name=C53H9.2
  genomic DNA homolog sequence=SeqID_391
MWRELWRVVEKSDIIVQIVDARNPLLFRSKDLDDYVKEVDPAKQILLLVNKADLLKPEQQASWREYFEKENIKVIFWSAIDEVLDPIDEDAVETSNPSTSTHMFVTNKDELIAKFKELGHVSDEPSAKPVMVGMVGYPNVGKSSTINKLAGGKKVSVSATPGKTRHFQTIHIDSQLCLCDCPGLVMPSFSFGRSEMFLNGILPVDQMRDHFGPTSLLLSRVPVHVIEADVQGCCQWKIDLGSRTSRS

SEQ ID NO: 192 - protein, 413 aa, Caenorhabditis elegans
  C elegans public gene name=C37C3.2
  genomic DNA homolog sequence=SeqID_363
MALNVNRAVADPFYRYKMPKLSAKVEGKGNGIKTVISNMSEIAKALERPPMYPTKYFGCELGAQTNFDAKNERYIVNGEHDANKLQDILDGFIKKFVLCKSCENPETQLFVRKNNIKSKCKACGCSFDIDLKHKLSTFIMKNPPKIDVDFSKAEQKNGKKTSGADAAAAVAADIIHNSDKGSSNDDDDDDWEPEPVEPNGMLSAGMGKLVLDKDLEKSEEQRLDMLHTFFLKAKEEDRISDAKGQTALRDEAERLELKQKASLLLANVFLDEKVITDKQISKHRNLLLRFTLNDKKAQRYLLGGVEQVIHKHEAELLSKSAHIIKSLYDEDVCEEDSLISWGEKPSSKYVSKSFAKKIIENSQPVLNWLKEAEEETEKFTWATYVFCVFLPIFEPIQLISKKPQFFFAFSPFQ

SEQ ID NO: 193 - protein, 192 aa, Caenorhabditis elegans
  C elegans public gene name=C35B1.1
  genomic DNA homolog sequence=SeqID_495
  cDNA homolog sequence=SeqID_1270
MTTPSRRRLMRDFKKLQEDPPAGVSGAPTEDNILTWEAIIFGPQETPFEDGTFKLSLEFTEEYPNKPPTVKFISKMFHPNVYADGSICLDILQNRWSPTYDVAAILTSIQSLLDEPNPNSPANSLAAQLYQENRREYEKRVQQIVEQSWLNFGENEGDAVLKDDVEIEEIAAPGANDADDDRMDEGASGSNA

SEQ ID NO: 194 - protein, 152 aa, Caenorhabditis elegans
  C elegans public gene name=C38C3.5
  cDNA homolog sequence=SeqID_1371
MASGVKVDPSCKNAYDLLHNKHQHSYIIFKIDKNDTAIVVEKVGEKNAPYAEFVEEMKKLVEDGKECRYAAVDVEVTVQRQGAEGTSTLNKVIFVQYCPDNAPVRRRMLYASSVRALKASLGLESLFQVQASEMSDLDEKSVKSDLMSNQRI

SEQ ID NO: 195 - protein, 183 aa, Caenorhabditis elegans
  C elegans public gene name=C48B6.2
  genomic DNA homolog sequence=SeqID_411
  cDNA homolog sequence=SeqID_1325
MVRKLKTHEQKLLKKTDFMSWQVDQQGKQGDMLRKFYVKKREHYALYNTLAAKSREVADLIKNLSESDPFRSKCTEDMLTKFYAAGLVPTSDTLERIGKVTGASFARRRLPVVMRNIGMCESVKTASDLVEQGHVRIGTKLVTDPAFMVTRSSEDMITWTKASKIKKHVMDYNNTRDDFDLMD

SEQ ID NO: 196 - protein, 425 aa, Caenorhabditis elegans
  C elegans public gene name=T09B4.9
  genomic DNA homolog sequence=SeqID_446
  cDNA homolog sequence=SeqID_1412
MLSRICGNGIRLTRTRLQFQPSIVTFRDYSNPAPKRGFLNNLIDNVRDEMQKNKELQEHQQQLKARMQELNESDALKDARKKFEIVEKETLKSSEVVKQKIEELSDHMKKMVHEIQKTEAGKKMTEAGAEALKQARKAAEHVEKVAEKVGDTEVYKHVSTSMKTVKDEIDNIADVRMYSRPEALTKRTDGFDLEKERVVEANDSATDVTLHKDSKWYSGWKNFSESNTYYHKLLDWKIKYDESDNMAVRMMRGVTEKIGSVFSGQNEVSEVLTEIHKIDANFDKQEWLRFCETKIIPNILEAFIRFDLEVLQSWCHERAYTQLSTVVKEYQKMHFSTKDSRIIDINKVEMATGKMMEQGPVLIISFQVYMINVTKNADGKVVEGDPDNPKRINHIWVLCRDVEEYNPALAWKLLEVHMQETPLAL

SEQ ID NO: 197 - protein, 489 aa, Caenorhabditis elegans
  C elegans public gene name=T26G10.1
  genomic DNA homolog sequence=SeqID_458
  cDNA homolog sequence=SeqID_1289
MSDSSSSDGEDNQKFLGNRKKNLTKKKVVTEEIEKDDEEDVKEKSFAELGVSQPLCDACQRLGWMKPSKIQQAALPHALQGKDVIGLAETGSGKTGAFAIPVLQSLLDHPQAFFCLVLTPTRELAFQIGQQFEALGSGIGLIAAVIVGGVDMAAQAMALARRPHIIVATPGRLVDHLENTKGFNLKALKFLIMDEADRILNMDFEVELDKILKVIPRERRTYLFSATMTKKVSKLERASLRDPARVSVSSRYKTVDNLKQHYIFVPNKYKETYLVYLLNEHAGNSAIVFCATCATTMQIAVMLRQLGMQAVPLHGQMSQEKRLGSLNKFKSKAREILVCTDVAARGLDIPHVDMVINYDMPSQSKDYVHRVGRTARAGRSGIAITVVTQYDVEAYQKIEANLGKKLDEYKCVENEVMVLVERTQEATENARIEMKEMDEKKKSGKKRRQNDDFGDTEESGGRFKMGIKSMGGRGGSGGGRGGKKKKMSK

SEQ ID NO: 198 - protein, 293 aa, Caenorhabditis elegans
  C elegans public gene name=F54C9.5
  genomic DNA homolog sequence=SeqID_438
  cDNA homolog sequence=SeqID_1438
MGLVKVIKNKAYFKRYQVKLRRRREGKTDYYARKRLTVQDKNKYNTPKYRLIVRITNKDVVAQLAYSKIEGDVVVASAYSHELPRYGLKVGLTNYAAAYATGLLLARRHLKTIGLDSTYKGHEELTGEDYNVEEEGDRAPFKAVLDIGLARTTTGSKIFAVMKGVADGGINVPHSESRFFGFDQESKEYNAEAHRDRILGKHVADYMTYLKEEDEDRYKRQFSKFLAAGLNADNLVATYQKVHSAIRADASPAAKKAAKPSKRHTAKRLTYDERKQRVADKKALLLQLKEQQE

SEQ ID NO: 199 - protein, 716 aa, Caenorhabditis elegans
  C elegans public gene name=H06I04.3
  genomic DNA homolog sequence=SeqID_397
  cDNA homolog sequence=SeqID_1416
MGKKVKIGKQRRDKYYKLAKEAGYRSRAAFKLVQLNKRFEFLEKSRATVDLCAAPGGWMQVASQFMPVSSLIVGVDLAPIKPIKNCIALQGDITTNETRAAIKKELKTWSADCVLHDGAPNVGLNWVHDAFQQNCLTLSALKLATQILRKGGTFVTKVFRSNDYSCLIRVFEKLFKRVHVWKPAASRLESAEIFVVCEVYQKPDKVGAEYLDPKKVFANPDGSEGTKPNPQNLLIGKQKKAKAEGYDTDSLAIHSTINATDFIKSSGYLDILGTANVITLDDEKWKNHEKTTEEVIEYMNDVKVLGPRELRVLLRWRKSMLETLEEQRKAVEGEAKEVEIEENLTEEQLEDRAMAEIDELIAKASEDEKAALKKKKKKMLKAKARVLKRRELKMIIDGDEGPQAEDQEVFQLKKIRKAKELAEITKDTQAPDFDMMEDGDSDEEEGLGEGEWETHGEEGENSDEDENELIHTEKSGMSKMEKRNARTESWFEKEEISGLVSDEDDDDEMNAIEKHIGKNRSKKTENYENTVSFDDSKGKKKGKKGGKGGEDDGFNTNDADEQASESESSDAEMDEVAKEKLSRFDAQIDLDDDDEEERYEDEGRRAAKRKCDKKIIGEDLKPVAKKRKLTPEQLAIGEQMIYSAKAARNLEDEAWNRYANNDEDLPDWFADDEKKHYFKQTPVTKEQVALYRERMREFNARPSKKVAEAKARKQKK

SEQ ID NO: 200 - protein, 592 aa, Caenorhabditis elegans
  C elegans public gene name=T19A6.2
  genomic DNA homolog sequence=SeqID_318
MYKSFKPIRDSKGKILKAAPFQDTLASGTQARIEPNRKWFGNTRIIGQEQLQKFQANLGKVLSDPFQVVMKQTKLPISLLQEKAKTQRVHVTETESFEYTFGKKSLRKKAKLTEASLEEMSKSAEDRDVKYKPELDLSREKELGDRPENMNPLFRAGQSNRVWGELYKVIDSSDVVVQVVDARDPMGTRCRHVEEFLRKEKPHKHLVTVINKVDLVPTWVTRKWIGELSKEMPTIAFHASINNSFGKGAVINLLRQFAKLHPDRPQISVGFIGYPNVGKSSLVNTLRKKKVCKTAPIAGETKVWQYVMLMRRIYLIDSPGVVYPQGDSETQIILKGVVRVENVKDPENHVQGVLDRCKPEHLRRQYGIPEFTDVDDFLTKIAIKQGRLLKGGDPDIVAVSKVVLNEFQRGKLPYFVPPPGCEERAKKDFSQAPINEMCADDDEQLPLDAQLELDDVARNGGPDEDDDEAIDDEEQEELTEIGSTCSGLTDLSGISDLAGDLSDADDVADDDEKPSSSDSKTKKSKTDVASVRTRGKRGGKKANKAKLSGKTIVQAASEKKDKSVVEFAKPGATKTNMWRKKLEKRRKVKHQK

SEQ ID NO: 201 - protein, 1244 aa, Caenorhabditis elegans
  C elegans public gene name=M106.1
  genomic DNA homolog sequence=SeqID_493
  cDNA homolog sequence=SeqID_1375
MHIKSIHLDGFKSYQKHTDILDFSPTFNAITGYNGSGKSNILDSICFIMGINKLDNIRAKSMHELISHGGTKAIVQVRFDNTDKRCSPFGMEHLDEIVVQRIITAQATGKGCATSYTLNGHAATNGKMQDFFRGVGLNVNNPHFLIMQGRITTVLNMKPEEILGMVEEAAGTKMYDQKKKDAEKTMFLKDAKLKEVDRIFQSSIDPRMVKFREDRKNMVEVTRLKKLKENFSRKYEAFQYFQTCEAVKKSAKEIEDAKKGIEDLGEKFNQLDLDLKNKEDEKKKMEESRDDQHEEAALSAAHLSKQSIMLQKETVKNQLVETINKLKKEGEQINKSLSKDREVLDAKRKEHEDSKAANSKDIQSQSDDEALVTKYRNDLESLTRGTIANDKGEHVSIESEIQSCKSTASQMSSGITAAKKRGERLHNQIKHLEGEKATLSARSKSDIGSADNYQKEVDEINKQLQLLGFNIDADTEKREHAAKLHESITKLKDMDTRLLNSYKDGRYALNYQRPPLHIDKFDEKRDVFGYVAHLIKMKPGCEQFAVAADIALGGVLGNVVVSTQDIARILIDGKAFTSRKTMIPVSENARNASSYNTLPDVKLRRAKEIAEKYNDTVTKMIDLIEYPDFISNTILNAVGQILVVDSLDVAREIAYDEVAKTRMITRRGDDVRTNGIMTGGYNDPGNKPALIALEPMYARRPQIEAQQRELDALNRELQLTEASSQKCRDLNNQLATAMRKLAQVKTNINNSEFGIVVRDLKVHSEEYEKNQAEIEATVKTLKDVEDKIKTLESMKNKDKNSQEKRKKELTALLQKAEQTVAQNKNRGEKARREVMLLQATVEEMEKTIKKDEGIWEQKKKECDELEEKLPNAIAALKDAELEQKAAQAKLNDLKNNQRQISTRLGKIAKECDALIREKAKTKSKREEKEKELTSLQQSEASNRKEARSKLKKFEWLSDEEAHFNKKGGLYDFEGYTVSKGKDEIKELTDKIETLERSCCIQNVSNLDTCEAKVLDIKNKRERITEDFNMLKKTIATLDKKKVDELIRAHESVNKDFGQIFNCLLPDAHASLVPPEGKTVCEGLEVKVSFGGVVKDSLHELSGGQRSLVALSLILAMLKFKPAPLYILDEVDAALDLSHTANIGMMIKTHFHHNQFIIVSLKQGMFSNADVLFQTRFADGHSTCTRLNGGDIAVLCQDKVLQAQALELTDAGKAKKDAAAKKGAQKNDKEPPKKKPIVVDDDDFE

SEQ ID NO: 202 - protein, 1026 aa, Caenorhabditis elegans
  C elegans public gene name=W08D2.7
  genomic DNA homolog sequence=SeqID_307
  cDNA homolog sequence=SeqID_1424
MADLFDEFIEPGVKNEIMDVEEAPENPMEKLDSAKKRQAREDMTNLLANMHNDVGVGNFDEATSKRARVEEEEEVEEARMENIIVHTIRTDNENCTHEVAIPPNAEFAELRENSGTEPAKYYPFQLDAFQKQAILCIDNNQSVLVSAHTSAGKTVVATYAIAKCLREKQRVIYTSPIKALSNQKYRELEEEFKDVGLMTGDVTLNPDASCLVMTTEILRSMLYRGSEIMKEVGWVVYDEIHYMRDKERGVVWEETIILMSKNIKQAFLSATIPNARQFAQWVASIKQQPVNVVYTDYRPTPLQHWIYPVGGEGMYEVVNVKGEFREDKFRDAMSGLATAGDSAGSFNKRRTGGGTQGDSNVLKIIRSVASNDGLNCIVFSFSRKECESYAISLKDMDFNKDHEKGMVKSVYESAIAQLSPEDQKLPQILNILPLLRRGIGVHHSGLMPILKETIEILFGEGLVKVLFATETFSMGLNMPARTVVFTSARKFDGSDNRYITSGEYIQMAGRAGRRGKDDRGTVILMVDSAMSADDAKQIIKGATDPLNSQFRLTYNMVLNLMRVEGMAVSWIINNSFHQFQSYAKIPEIDKKCVQVERKIASFNFPWENEMRTLVDLQDQLEATRQRIIQIQREPKYIVGFLHAGRLFKVKSGDRDFKWGILNQFKKEQNPDDRNDQIYLCDMMIAINTEGRFDPTNPATLVPGFDLPKRRWIRVPMTIDRITAISAVRLKVPADIDKPDGQMRLDGMMAAATKRFGNQIPLLDPIQDMEIKTVEMKELIAREKSLEGRLETHSMTKRDNMKDLKKQFEQKQDAVKELNALKAERKSVQSTLHLEELNNRKRVLRRLGYLGNDDALVLKGSVACELSASDELILTEMLLKGIFNTLDVAQTAALLSCFVFQDKCAAPKLATELQTCLSELHEQARNVAKVSNECKMEVMEDKYVSSFNPGLMDVVYQWVNGATFSEIVKTTDVFEGSIIRTLRRLEEVLREMINAAKALANKELEQKFEDARKNLKRDIVFAASLYL

SEQ ID NO: 203 - protein, 458 aa, Caenorhabditis elegans
  C elegans public gene name=C27H6.2
  genomic DNA homolog sequence=SeqID_459
  cDNA homolog sequence=SeqID_1392
MDMEVDEAISGTSSSRLAPIEEVKPTPKQIKRIAAHSHVKGLGIDTETQEAHYEAAGFVGQAPARTAASIVVDMIRLKCMAGRAVLIAGPPATGKTAIALAMSQELGDGVPFVPLVASEVFSNEVKKTEVLMRSFRRAIGLRVKETKDVYEGEVTELSPVEASDNSGMGKTISHLVLSLKTAKGSKQLKLDPSIYDSILKQRVEVGDVIYIEANSGIVKRVGRCDVYASEFDLEADEFVPMPKGDVRKSKDIVQNVSLHDLDIANARPQGRQGDVSNIVSQLMTPKKTEVTDRLRSEINKVVNEYIESGVAELMPGVLFIDEVHMLDVECFTYLYRALESPMAPVVVFATNRGTTTVRGLGDKAPHGIPPEMLDRLMIIPTMKYNEEDIRKILVHRTEAENVQFEEKAFDLLTRLCAQTCGREVIEVEDVDRCTKLFMDRGESLKKAEEEMRQPKNKK

SEQ ID NO: 204 - protein, 219 aa, Caenorhabditis elegans
  C elegans public gene name=T04A8.11
  cDNA homolog sequence=SeqID_1464
MKKYSFPVTYENVRFPPNGQLKLPVMPAEPFYDAEKGEKKYKSTKRMIEARGVEEVHTELIHEQYGLAAVSGGFIDSDDFKFIQDRINKNLIDNQFSVWRVDAPWLPRTKKAQGTRLGGGKGSIQKYVTPVRANRIILEVGGHITEIEAKAFLLYLCERFSFPVEFVSETMLAERRKKAEEERAMNKNGFNWGKVIKYNMQNCNSWLSSYDVAWKGKYR

SEQ ID NO: 205 - protein, 169 aa, Caenorhabditis elegans
  C elegans public gene name=R10E11.8
  genomic DNA homolog sequence=SeqID_353
  cDNA homolog sequence=SeqID_1474
MSTDTKQIIADALLKNEQAMYGPFFGSLGVTSAMAFAAAGSAYGTAKAGTGIASMAVARPDLVMKAIIPVVMAGIVAIYGLVVAVIVSGKVEPAGANYTINNAFSQFAGGLVCGLCGLGAGYAIGIAGDAGVRALSQQPRMFVGMILILIFAEVLGLYGMIVALILGAT

SEQ ID NO: 206 - protein, 3183 aa, Caenorhabditis elegans
  C elegans public gene name=K08E5.3
  genomic DNA homolog sequence=SeqID_461
MGRLSLGILLLAAVTSIASDNSCGGRSRLGANPCQDYSLHDCDPVAECFSEQPGYFQCQCPKGFTDSSADKRFPGRKCVRAVDECALGRHTCDPHADCIDTHQGYTCKCRSGWSDTSLDPLRSPGRSCKKADMCSNIDCAAEAECRETPIGPMCQCVSGYVDVSRQHGRPAGRVCRAVVNECAEGRHDCSSHATCIDTADGFTCRCKDSYRDESSDTLKHPGKNCVRTVQPDPPECDVSDPMSCDPAKREVCIFVENTYKCRCANGYSRLPDGRCVVINECAEPRLNTCGKNAECIDLAEGYTCQCRSGYADISPVSQPGRICRARVNECSNKEKYNVDCSENAICADTEHSYSCRCRPGFADVSAAFNKLPGRRCIEAVNECASPSLNDCSKNAFCEDAKEGYICTCRPGYVDNSPNAARHPGRICTKPVEKIKTDLKDTSFSTDDGCDPKNPKCGANEACVQRHGQHNCECVETAFRYTDGSCRVYSACSKRNTCDKNAICLNRFDSYTCQCRPGYIDLSADLTNAPGRICKELINECASSDNECSPYARCIDATNGYACQCLDGFIDVSSRYNKPPGRQCTNSNNECSEKSLNTCDENADCVDTPDGYTCQCYGGFVDVSSNANLPPGRVCTVQTTCPKQKTDLVFLIDGSGSIGSYVFKNEVLRFVREFVELFEIGRSKTRVGLIQYSDQIRHEFDLDQYGDRDSLLKGISETQYLTGLTRTGAAIQHMVQEGFSERRGARPQQSDIARVAIILTDGRSQDNVTGPADSARKLSINTFAIGVTDHVLASELESIAGSPNRWFYVDKFKDLDTRLRSMIQKAACPSPTKQETPSEDVCNPRTQTGCDRSLNEHCAVENGRPRCVCPEGFTRHPFTRVCGGDLCNPQLITSCIFPEECQITPYKNFRCSCPEGYNRDYRSGFCVSVKEVQISPQHDANCHNGGVRCSENERCTNDGSDWFCECLPGFERIRNGQCAYPGSCNPNDPMSCDVRKRQQCLPRGNIYTCQCGRNEKRHPITDICLKNECLTGEHDCDRSARCIDTDESYICACQSGFIDHSPNPSERPGRVCVALQNECLDGSNRCSPNALCTDTEEGYVCRCKSGFVDYSPNPQTFPGMVCKELVNECTNPRLNQCDRNAHCIDTIEGYSCICKPGFVDMDEFGNPGRRCEQIKTNDKCSPGKNDCDRNARCIQIGDDDYSCACPPGFKDKSPSSSRPGRLCIPVIPECDNPTLNDCDSPDRAVCTDTDDGYMCRCRQGFLDISPSISVKPGRLCKPLQNECALGIDDCARDGGICEDNPDSFTCRCAMNYLDVSFDRVTRPGRKCKRLINECQTGQNDCSEEATCTDTEDSYICACPQSHIDLSPDTVNRPGRRCLMRINECTSNRHDCSPNADCIDTPESYKCRCRDDFVDESPDSSRRPGRICRPALVDECRTGKHDCHVNAICQDLPQGYTCQCSADFVDVSPHRASHPGRLCQPRPTPPPPECRLDGGNQCKVHLNEVCRLMGGEPKCSCPVNYQRDSSGSCSIINECLFTQLNDCHTAADCIDQVQGYTCQCRDGFKDIGDRRRPGRMCKPMVNECQYPHLNDCHQNAACIDLEEGYECKCNQGFMDHSHGRPGRICKQLTNECLRPSLNSCDRNARCIDKEEGYECECRDGFIDVSPSPTLKGRACRELVNECANSRLNDCDKNARCKDTMDSYECDCPVNSKDISPSPSFPGRVCLMFINECESGVHDCDPSATCRDNEQSFTCECPSGFVDRSPNKHARPGRVCVKLVDECREGRHTCSSHADCRDLEEGYTCECRDGYVDRSPNLASQPGRVCSAPEVCPPNHDCSSAAVCEPLGGMKYQCVCIQGYVDQSPGSQKGRVCVRNNACHDPRLNTCSRNAICYDEPRGYRCECKRGFMDRSPDSSQRGRVCEPPPPPSPPPRHPCQDPERNDCHPAGTCRATGAQSYTCECLSGYADRSPDPRNKPGRLCVLTEPVCLDPEQNDCHAAAICSEVNGPEKYTCKCRDGYTDESPDPLRRPGRICKGLINECLDRSLNDCHSLAVCKDLPNGYTCQCPINAKDQSPDPRKPGRICSLSVNECANPSLNSCSAFADCFDEENGYRCRCRNGYHDDDPAHPGHRCSFMINECDSSNLNDCDRNANCIDTAGGYDCACKAPYRDEGPPQSPGRICRLNECLNPNRNTCDRNADCRDLDYGYTCTCRHGFYDQSPNPQEPGRICIEFQQEEHIERVKVTTVQSEPRREFPCGRDDCIKARGEVCISGEYCGCKPGEGRSASTGKCQEVQETPFELRVVTRDQRPLMYSTEFGSQKSPSYVEIVELFEKNMARTFGGTSLAPRYVNTKVDYITHPKTKNSSWDQGLLFKYEVQTTKSQSQPIDECELWKQMQASLDRTNGAIGGGSLRVASDTDLLNPCKQQEEWGNCGGMSCKEHLKEVCIAGHICGCPDGMKRRDANSECRVVESWNVPLWVVRDKEKPIVFSESFDNPQTPVYKDYSKRLEKGIEGCYPHTELKNAFVTAEVNDIVNPVLMNASYDTGLLFNTTVHFRKGMVHVPSDAYYQLIKYVTKENNNEVGDSELYLNPTQPDPFNPCFKNDCDPHGKCIEISKYAYKCECGVGYRDINPQSPGKKCLPVHGFNECERKEDNECSENARCIDLEHLYKCECLPSYYDTSPVGSVPGSLCVLDYCSDVNFCPTNTTCKNMEQQAECKCDAGFMDIRKSEKRTALMLGDDTLCMHVRDVDECALGLNNCSGVAHCIDRAVGYTCKCPDGYIDGNPDEPGRVCGALLCDLCNAHGDCVHNTATNNITCVCTDGWTGPQCQVAPSNASLVLLILLALLFLLLTLCCLLYFCTKCHCFKGRRFAGAGANGFGYRRGGAWPWSTLEGSASSESGAEFSAMSAAGNDYYPDIGIPRAKLKSGMMASGNTAEVRNMEVARLDQYLDENAVRIPRAHLVDAHGDTSFDSLSEASSEYTIKEEIERKVITDVTTKEIKTTTTTDEQGNTIVTTTEAVHPRDTTIVHGGGYTQNESSSSSFSGGERAYQSQSQQQQSMSQGMSQSMSQHATSAGYSSSGMESSAHNSGYASIRHTGERERGGSEEEFSIGRARGMAAASSGYQHSSSENREVEEYCSEEEDVEHSVGDKRTIVTKNHSYEPFVNGESERFKTEVVTSQTSTHVTKK

SEQ ID NO: 207 - protein, 466 aa, Caenorhabditis elegans
  C elegans public gene name=F43G9.10
  genomic DNA homolog sequence=SeqID_410
  cDNA homolog sequence=SeqID_1388
MGDYVPGFEQRESDNRSFGHSRLPTLGAIPIKNEKGQTVMQKVKVSRYVAGKAPEYARNYDSDSSESDRETDRDDDRRRRRRRESSDEEDRRRHRRHEDYGRRRQVEKPEVLGKVEDESSENEQESEEDEEKQEERRERARMRRLELHENNREKDEEQEDSAESDEEDFERRRQMLRDRAIKREEEIKREIKEELEEDDVEEEEEEESSEEEDSDEDDDPVPRLKPIFTRKKDRITLQEAEKEKEKEILKKIEDEKRAEERKRESAKLVEKVLQEEEAAEKRKTEDRVDLSSVLTDDETENMAYEAWKLREMKRLKRNRDEREEAAREKAELDKIHAMSEEERLKYLRLNPKVITNKQDKGKYKFLQKYFHRGAFFLDEEDEVLKRNFAEATNDDQFDKTILPKVMQVKNFGKASRTKYTHLTEEDTTDHQGVWASTNQLNSQFSTKRAGGSRPVFERPATKKRKN

SEQ ID NO: 208 - protein, 823 aa, Caenorhabditis elegans
  C elegans public gene name=R144.2
  genomic DNA homolog sequence=SeqID_460
MESVESAARDYRETLAELRNNNKTQINLLTILADDFKKAAPQIVEVIERHLTTCSPSQKLLVMYVCDSILKNVKKPNDYDALFARKIVSMFEHAFRQGDERIRTSLYRIRVTWASTTLFMPSKLYELDMKINKLDPNWPISNPQTGRALRDDPQVMAPSQSRPAGNATSPAASTSTNRVFVNPKFIGSSTPGAASASKTVVEKTKSPGTVNKEKQVKKEPKQDPLDKLLPSSSASKTSSSPAGLKRKSAPSEHPNAPIRKKPQQPPKPQTAIDEDLRSISLTKKPPVPSAQDQDFRPKTLKPTSVIGSHAFAPVAAPIRPMIPVPPPVSVAPFVPAPPLSSAPPFQHPQQHHPQLPPPPVHQGMGRGYHHNSPPQDPAPIVPVQAPPPQQHLPAPENVYSSEQPKLDVPANNRIFVDGKAYEVMFVDDTAVIERGGAPHRIYFAGPPRNLVIDGIPHLLQFDTPTQIDILGSKHMVKFGAPSRELYIGGHPFKGQFGGPPIIATINGRRHEIRLTGSAPEVRIEPEPAYHLTHFLHKMREEKKIEIASEKPEKKEDWLSYLKNLRTRNILPAPARSPSSPRNQTPPPANLPIPGMNNAGQRGGYHNRHQPQQNARWGGANKQQNIPPPPSDPSPIGSGVEKRSAPPAAITDFNIRLLQIRYDSVVDALITKRADACKFCGMRLDDSQGKSKEWQDHMDWHVKQNLARHGSNNSAAVPYRQWYPSTSTWLTPRASDETNEQEADKPEEPLPGVASSGVKTKECSVCGEKFDEYYDDDEETWRLRDTVNVHGKIVHSACASDAARSLDNSSFFNDSDIKKEEPFD

SEQ ID NO: 209 - protein, 725 aa, Caenorhabditis elegans
  C elegans public gene name=Y54E2A.11
  genomic DNA homolog sequence=SeqID_434
  cDNA homolog sequence=SeqID_1397
MVEIDFNKENEEDFSDPPGFVDDVTDDVLVPDVLHKKPTIDEFEDNCVFIAGIPVVGADRLGKLQSVLKKVLERLDPAVKLYIPPSPEGGCLGVLLTEWADQRSAQFAVKSLNGYAFDKNHTFTARSFKDMKQLEAPSDHWTTPEKQAYNDVGDLWWWLQNERCRDQFAISHDKLGVPTVGVFTNMKGNDPELAGDADKAERANWTETVFTWSPHGSYLSTIHKQGIILWGGKDYARAHRFAHTNVQYIDFSPWETYLVTYAAPEESNSWGDCEKDSLRIWDVRTGELKKAFSTFELTGRTQLPTWPFFRWSFDEKYFACLKAPEKDKLEREQKINGISIFESEKFELYEGRPVNIENIKQFEWSPTSTVLAYYSECTDAVPAEFGLLQVPSMQRLRSARVHNVADAQMFWQKSGKRLAFYTMRFKKKEYRETGEVKYVGGCQYHVDIFEIDKKDVSLMNLPLSEPFIHFDWDPEGDKFCVLVGNTAKATPQVYKIEANSHAPKLVSKLDAGVHFNEVQFAPKGGWLAVLAKVSAGGNVYFIDTSLSEAKRTNVIEHPLFNKGYWDPTGRYFVTCSTLGGRAGADLGYRIFTFQGRELCRKNLDRLAQFKWRPRPPVKLSEQKQREIKKNLKKTAAKFIKQDDDEKCRASQEVVEKRRKIMAAFDIIRSRNREQLDATRDERISLRNGVDTEAQLDEDEFVDEEITIALSTSKTQAPLTEEEMRD

SEQ ID NO: 210 - protein, 236 aa, Caenorhabditis elegans
  C elegans public gene name=F39H11.5
  cDNA homolog sequence=SeqID_1344
MNAHDEVQRTLNPTCTGTSVIALQYKTGVVVLTDRVVSYGKMARYKNVSRQYKVNDNVLIAFGGDHADFHWLQNVIERQVLLWKRFDQDIGPKALHGYLTSLLYAKRCKMNPVWNTLVVAGVEEEEKNNKETSTPFIGVITQKGCAYQVKHIATGLGAFLLNQAVEDEWRKKGEDLSREEAEAVLRKSLELTLYHDCVADNEFEIGRVDATEGVVLGKEEKIIGDWSIAETNCQYE

SEQ ID NO: 211 - protein, 572 aa, Caenorhabditis elegans
  C elegans public gene name=T02G5.9
  genomic DNA homolog sequence=SeqID_333
MSEPEAKLSKNEQKRLAKQAKKEQERLEKDAAKLNVAVADAPKVVREADPSDPQEYFNMRVRMIEARRAAGDNPFPHKFNVTISLTDFITKYTPLEKEQVVEEIVSVAGRIHSKRESGSKLVFYDIHGEGTHIQIMANAKFHTGDVDFVTLHDRIKRGDIVGFTGRATRTKAGELSLIPNEILQLTPCLHMLPHSHFGLKDKELRFRKRYLDLILNPRVKDNFVIRSKIITFLRRYLDNLGFLEVETPIMNQIAGGATAKPFITHHNDLDMNLFLRVAPELYHKMLVVGGIDRVYEVGRLFRNEGIDLTHNPEFTTCEFYMAYADYEDVIQLTEDLLSSMVMSIKGTYKIEYHPNGPNTEPVYEVDFTPPFKRVHMYDGLAEKLGATLPDPSTLHTEEAREVFDKLCRDNNVDCSAPRTTARLLDKLVGEYLESTFISPTFLIGHPQIMSPLAKWHRSIPGLTERFELFAVTREIANAYTELNDPITQRQRFEQQAKDKDAGDDEAQMIDETFCNALEYGLPPTGGWGMGIDRLSMILTDNNNIKEVLLFPAMRPEDGTEKKTDFDAPTTLA

SEQ ID NO: 212 - protein, 355 aa, Caenorhabditis elegans [sequence omitted]

SEQ ID NO: 213 - protein, 967 aa, Caenorhabditis elegans
  C elegans public gene name=C25F6.2
  genomic DNA homolog sequence=SeqID_423
  cDNA homolog sequence=SeqID_1363
MSHESSEKAHKAIENVEDYCQTLTRHGNEELRTNLERVITTFKSNLMHSLLDIHDLYEQTLLSERKSDAEKNMEVRRVIERLEGGPHSYNSRPAATTSTSNYNLSSTTPLISDLRDRGGFSYLNGGGLGNGLGNGLGNGLLSSPYNSSSTHYLHERQRQTSHDGTWRETTTRTVDTPSGLERRVVEHTGVIDDHGRKWELENIVLEKGHTGLGFSITGGMDQPTEDGDTSIYVTNIIEGGAALADGRMRKNDIITAVNNTNCENVKHEVAVNALKSSGNVVSLSLKRRKDEAFLPIGGNFGGSTSYLRSGVTPSVSAGNLQHAIHSPSAPIHPPPPPPVHHGSLSQLSVGQYRSTRPNTSVIDLVKGARGLGFSIAGGQGNEHVKGDTDIYVTKIIEEGAAELDGRLRVGDKILEVDHHSLINTTHENAVNVLKNTGNRVRLLIQQGTGAIFNDSASQQFMPTTPILRPSSVQDYNRSQMGSQSHLSYGGPLNTSYSSQAPIAIPLEPRPVQLVKGQNGLGFNIVGGEDNEPIYISFVLPGGVADLSGNVKTGDVLLEVNGVVLRNATHKEAAEALRNAGNPVYLTLQYRPQEYQIFESKIEKLRNDVIAQSRMGTLSRKSEYVRALFDYDPSRENSVAPHRSMGFNYGDILHIINSSDDEWWTARKVHENGEETAEGVIPSKKRVEKRERLRRKQVNFNSGSQSLGRNSSTTGLENRRGSRSQLSFSRKFPFVKSTDRLNDLNEESSNVAEEPVWSYQAVEQQAINYVRPVIILGALKDRINDELVNRDPSKFSSCVPHTSRPPREGEVNGRDYYFVNKHNMEEDVKNNLFIEAGQFQNNLYGTSIQSVRDVANQGRHCILDVSGNAIRRLQSNANIQPISIFIKPSSAQQILELDSQLATNRQDDRAMSGEEAQAQYSRCHRIEQTFGDLFTQEISNVHSANDVLSKVYSIISRESQTPIWVPRH

SEQ ID NO: 214 - protein, 657 aa, Caenorhabditis elegans
  C elegans public gene name=F43E2.8
  genomic DNA homolog sequence=SeqID_387
  cDNA homolog sequence=SeqID_1288
MKVFSLILIAFVANAYCDEGASTEKEEKMGTIIGIDLGTTYSCVGVFKNGRVEIIANDQGNRITPSYVAFSGDQGERLIGDAAKNQLTINPENTIFDAKRLIGRFYNEKTVQQDIKHWPFKIVDKSNKPNVEVKVGSETKQFTPEEVSAMVLTKMKQIAESYLGHEVKNAVVTVPAYFNDAQKQATKDAGSIAGLNVVRIINEPTAAAIAYGLDKKDGERNILVFDLGGGTFDVSLLTIDSGVFEVLATNGDTHLGGEDFDQRVMEYFIKLYKKKSGKDLRKDNRAVQKLRREVEKAKRALSTQHQTKIEIESLFDGEDFSETLTRAKFEELNMDLFRATLKPVQKVLEDADMKKTDVHEIVLVGGSTRIPKVQQLIKDYFNGKEPSRGINPDEAVAYGAAVQAGVIGGVENTGDVVLLDVNPLTLGIETVGGVMTKLIGRNTVIPTKKSQVFSTAADSQSAVSIVIYEGERPMVMDNHKLGNFDVTGIPPAPRGVPQIEVTFEIDVNGILHVSAEDKGTGNKNKLTITNDHNRLSPEDIERMINDADKFAADDQAQKEKVESRNELEAYAYQMKTQIADKEKLGGKLTDEDKVSIESAVERAIEWLGSNQDASTEENKEQKKELESVVQPIVSKLYSAGGQGEQASEEPSEDHDEL

SEQ ID NO: 215 - protein, 610 aa, Caenorhabditis elegans
  C elegans public gene name=Y39E4B.1
  genomic DNA homolog sequence=SeqID_308
  cDNA homolog sequence=SeqID_1364
MSRKGPLIKNNETDVPLRIAIVEKDRCKPKNCGLACKRACPVNRQGKQCIVVEATSTISQISEILCIGCGICVKKCPYDAIKIINLPANLANETTHRYSQNSFKLHRLPTPRCGEVLGLVGTNGIGKSTALKILAGKQKPNLGNFQKEQEWTTIINHFRGSELQNYFTRILEDTLKCVIKPQYVDQIPRAAKGTVEKNLTRKHDNDNLNSVIDQMELRGLLDREIDQLSGGELQRFAIAMCCVQKADVYMFDEPSSYLDVKQRLKAAAIIRERVSDTNYVVVVEHDLAVLDYLSDFICCLYGVPGVYGVVTLPSGVREGINMFLEGFIRTENMRFRESKLSFKTSEQQEDIKRTGNIKYPSMSKTLGNFHLDVEAGDFSDSEIIVMLGENGTGKTTMIKMMAGSLKPEDENTELPHVSISYKPQKISPKSETTVRFMLHDKIQNMYEHPQFKTDVMNPLMMEQLLDRNVKELSGGELQRVALALCLGKTASLYLIDEPSAYLDSEQRLHAAKVIKRFIMHAKKTAFVVEHDFIMATYLADRVVVFEGQPSVKCTACKPQSLLEGMNRFLKMLDITFRRDQETYRPRINKLDSVKDVDQKKSGQFFFLDDN

SEQ ID NO: 216 - protein, 342 aa, Caenorhabditis elegans
  C elegans public gene name=F18H3.5
  genomic DNA homolog sequence=SeqID_485
  cDNA homolog sequence=SeqID_1276
MCENLYGEEYKMEILRLQKMMNNMTCGQMAKPLTMKDFQIHQALGKGAYGNVYRVRSLHDGKDYALKQIMISSKNEGIPQSVLREITVMKHLARKAHPNIISLKSVFHQLDPVRAILKINMIMERCDWDLHTFLRNIPRGVPEQQAKHVTAQIVRALDFLHTHSIIHRDLKPQNILLNRDQTVKLADFGLSKEYSNTTAFTTLVVTLWYRSPEVLLQSYYNSTVDMWALGCIVSEIYCRQPLFVGQNEAEQLTDIFKKMGTPVGKDWPSESVIARDSFPQYRPTNLKDLSPQMSKQAIEFVQQCLRYDHSKRLSARGALSHPFLKPAVATKSRVLKQINFNK

SEQ ID NO: 217 - protein, 810 aa, Caenorhabditis elegans
  C elegans public gene name=C41C4.8
  genomic DNA homolog sequence=SeqID_305
  cDNA homolog sequence=SeqID_1334
MASVPTQRDEKEKKNDELATAILKDKKRPNRLIIDQSDNDDNSMVMLSQAKMDELGLFRGDSVILKGKKRRETVSIVLNADNCPNDKIKMNKVVRNNLRSRLGDVVSISSAQLEYGKRVHVLPIDDTIEGLTGNLFDVFLRPYFTDAYRPVHKGDIFTVQAAMRTVEFKVVETDPAPACIVAPDTVIHYEGDPIKREEEEEALNEVGYDDLGGVRKQLAQIKEMVELPLRHPQLFKAIGVKPPRGILLFGPPGTGKTLIARAVANETGAFFFLINGPEIMSKMSGESESNLRKAFAECEKNSPAILFIDEIDAIAPKREKAHGEVEKRIVSQLLTLMDGLKTRAHVVVIAATNRPNSIDGALRRFGRFDREIDIGIPDAVGRLEILRIHTKNMKLGEDVDLEQVANECHGFVGADLASLCSEAAIQQIREKMELIDLEDDTIDAEVLNSLAVTMENFRFAMGKSSPSALREAVVETPNTTWSDIGGLQNVKRELQELVQYPVEHPEKYLKFGMQPSRGVLFYGPPGCGKTLLAKAIANECQANFISIKGPELLTMWFGESEANVRDVFDKARAAAPCVLFFDELDSIAKARGGSVGDAGGAADRVINQVLTEMDGMNAKKNVFIIGATNRPDIIDPAVLRPGRLDQLIYIPLPDEASRLQIFKASLRKTPLSADLDLNFLAKNTVGFSGADLTEICQRACKLAIRESIEREIRQEKERQDRSARGEELMEDELADPVPEITRAHFEEAMKFARRSVTDNDIRKYEMFAQTLQQSRGFGNNFKFPGEAPSAGQPVGGNGGSGGNDDDDLYN

SEQ ID NO: 218 - protein, 152 aa, Caenorhabditis elegans
  C elegans public gene name=R09B3.5
  genomic DNA homolog sequence=SeqID_470
MSGEEEKAADFYVRYYVGHKGKFGHEFLEFEFRPNGSLRYANNSNYKNDTMIRKEATVSESVLSELKRIIEDSEIMQEDDDNWPEPDKIGRQELEILYKNEHISFTTGKIGALADVNNSKDPDGLRSFYYLVQDLKCLVFSLIGLHFKIKPI

SEQ ID NO: 219 - protein, 982 aa, Caenorhabditis elegans
  C elegans public gene name=F13D11.2
  genomic DNA homolog sequence=SeqID_455
MVQSDSPEELAQRAKPAWRLQQMPVQLSNFVSKTPLIGSEWPPTGDWRSANNNSLGDWNKCCVPGSEIPQHLGPFGNSSLTMLTAQQPGEKIHPDGGYVSPKEDGRKSSEHTNSYDVSASQSPSNDGAQSDSTSDEHIDVECMTETEMDTDEKDSTIKPEDQATPKLEEGSDSKPESTSVEGTSSNYQVTSEPVQMPQMPIPVIPSFLKNSLPAPIPITPTQSANVERSNSPSIEEALLLTLSQQQFAEVFAEAAKIRKSSSESIGFQRSGTSAFLNIEPKEMSMSSANNNNEEAPASTVSACSTPTTTTSASFCRPPGLGPVALPPTQNGQTPMLVCPICGFMCPSKFHFNSHMNTHGDHQCSMCDYTSRTEGRLKKHMRESHTVEEQLRAGFESEPAKESASSPKNLSLSKDGSATSPINEIFNLSTTMASILDSTNNAVSSTSTTEQPSALSALTLDMSSTPSLLSTLAHSSFGVSALDQIKAISENPSFMPEGGINLASALGVVSNAIKGDTPSPEKQSNGECRRSSSGKIKIFKCKQCGHQSLSKDDQWAHARTHIPAEKQLNCQHCNFVTEYKHHLEYHYRNHIGSKPFQCKKCAYNCVNKSMLNSHMKSHTNHYQFRCMDCTYATKYCHSLKLHLKKYNHRRVPEGIEMSGGDSSPPFTSDATITFSPLMKQEIKTETVEPVTSIAQPFPFNPMMGNHGLNFANHMLLNKHLDVGLMGLRNSVMSPLKCSACDFVASSADEKMRHSMSHILNSSNVPTSIASLYNSLNLPSFSHVAPDNDNALESMDCDVKIDDDNITESHCYEEMDQGSDSAVSPTGSSQISSGDEETKKCKSLSLEQISARANGNNSPMSNDSAMEKDGESADDAPHSPSDTTSVPSPPLHSSSIVAPIPITPQPNEFLQSILAQASLLGPLLANRPSAFYCDHCKIPFDTQQVLDSHMRFHTPGNPFMCSDCQYQAFNELSFALHMYQARHQ

SEQ ID NO: 220 - protein, 431 aa, Caenorhabditis elegans
  C elegans public gene name=Y53G8AL.2
  genomic DNA homolog sequence=SeqID_374
  cDNA homolog sequence=SeqID_1347
MLSVLGRSGLGARQAVSVVGSQNFSSAVTSAENAHPEPRVSSQSAQFRKGAGGRASFSGNVVTVFGASGFLGLPVVNKFAKNGSQIIIPYRQDPYYMREHKVLGELGQVLYFPFELMDEESIRKAVKYSNVVINLIGTRVPTGKYNYYDVNDTGARRLARICKEMGVEKFVHLSALGATTQPQKGHFVAKSQFLHSKGLGEVAVREEFPEATIIRPSVIYGELDGFIQYYVSRWRKTPLDYVYLYKKGEETYKMPIWVGDVAAGIQSAVNDPTAKGHTYEFVGPHCYQLSELIDFMYKKAHCLSDFGFRYKRHGMPDPYFMALTMATELYGKVFKCKVPLNREWMEFVEVQSDILTGERTLADLGVRRLTEFELAGGQQAFYRSFNRYFEEQYGELPAPSLPLRSPPLTKKNTGRGATGIKSETSKNVAFN

SEQ ID NO: 221 - protein, 374 aa, Caenorhabditis elegans
  C elegans public gene name=Y53F4B.22
  genomic DNA homolog sequence=SeqID_336
  cDNA homolog sequence=SeqID_1308
MDYDVIANQPVVIDNGSGVIKAGFAGEQQPKVRFANFVGRPKYHRVMAGGLDGDIFIGPKAESNRGLFSIEYPMEHGIVNNWSDMEKIWEYIFGQDQLKIFPEEHPVLLTDAPLNPLKNRERSAEIFFETFNVPALYIQMQAVLSLYATGRTTGVVLDSGDGVTHAVPIVKGFAMKHAIQRMDLAGRDVTEYLRVLLRREGYEFHRSNEFEIVREMKENACYLALDPTKVENNSVKSSYALPDTTKIEISNSLFRAPEVLFKPDLIGTEWPGMAHVVNQSIMKCDVDLRQTLYSNIVLSGGTTLFKGFGDRLLGEMRKIAPADGKIRISASQERNSLTWIGGSIVASLDTFRKMWLGKKEYEDMGASAMHKRFF

SEQ ID NO: 222 - protein, 1232 aa, Caenorhabditis elegans
  C elegans public gene name=Y71F9AL.17
  genomic DNA homolog sequence=SeqID_481
  cDNA homolog sequence=SeqID_1373
MSLLIKFESKSARVKGISFHPTRPWVLTSLHSGVIQLWDYRMCVLLEKFDEHDGPVRGICFHHDQPIFVSGGDDYKIKVWNYKQKRCIFTLLGHLDYIRTTFFHHKYPWIISASDDQTVRIWNWQSRNSIAILTGHNHYVMCAQFHPTEDLVASASLDQTVRVWDISGLRKKQMPGGGAPSRPTGGQQAELFGQPDAVVKHVLEGHDRGVNWVAFHHTNPILVSGSDDRQVKIWRYNETKAWELDSCRGHYNNVSSVIFHPNADLILSNSEDKSIRVWDMQKRTSLHVFRHENERFWVLAAHPSLNMFAAGHDNGMVVFKIQRERPAYCVSDNLVFYVKGQQIRKLDLTTNKDVALCKLRYPQPFMQPYYSLSFNPAEGTFLLTSRTHNKDLCAFELYKVASNSDGTTEAACVKSTGINALWVARNRFAVLDKAQNVSLRDLTNKELRKLENINTAVDDIFYAGTGMLLLRNDDGLQLFDVQQKIVTASVKVSKVRYVIWSKSMEFAALLSKHTLTLVNRKLEILCTQQESTRVKSGAWDDDSVFLYTTSNHIKYAINSGDCGIVRTLDLPLYILAIRGNVLYCLNRDATPVEVPIDNSDYKFKLALINKRIDEVVNMVRSANLVGQSIIGYLEKKGYPEIALHFVKDEKTRFGLAIECGNLEIALEAAKKLDEPAVWEALGETALLQGNHQIVEMSYQRTKNFEKLSFLYFVTGNTDKLVKMMKIAQARNDAHGHFQTALYTGDVEERVKVLRNCGQTSLAYLAAATHGYSAEAEELKAELESRQQPIPPVDPNARLLVPPPPVARLEENWPLLASARGTFDAQLLGLGGQSAPTNVGGVKPAAAAFAVMDDDDGDVGNEAWGDDEYLVGEDGELDVDEGEGPVDGDEEGGWDVDDDLALPDVTDDQGGDDDEEVVPNPAPAVSSEWPNVSRLAADHVAAGSFGTAIKLLHDTIGVVEAAPFKDVFVKAYAASRLSHRGWGGLGPAGPVSIHPVRNFQEDKNHLPVAAFKLSQLAKKLQKAYQMTTNGKFGDAVEKLREILLSVPLIVVSSKQEVAEAEQLITITREYLAALLLETYRKDLPKTNLEDAKRNAELAAYFTHFELQPMHRILTLRSAINTFFKMKQMKTCASLCKRLLELAPKPEVAAQIRKVLTAAEKDNTDAHQLTYDEHNPFVVCSRQFVPLYRGRPLCKCPYCGASYSEGLEGEVCNVCQVAEVGKNVLGLRISTLKS

SEQ ID NO: 223 - protein, 175 aa, Caenorhabditis elegans
  C elegans public gene name=W09C5.8
  cDNA homolog sequence=SeqID_1423
MMLPRLALRAVHTTARLSGGQEFYWGPDKAAGRELVGYGANGDNIYQDRLDYWYPAIRFRKEDSVIAPIRAKEQADWKNLSAEEKKLLYRYSFRQTLSEFEAPTGYWKVISAVILSVLGLCTYYAVLLNVCVYPELPPTFQNEYKEAQVERALVLEKGQFLGAPTHYDYENKKWK

SEQ ID NO: 224 - protein, 720 aa, Caenorhabditis elegans
  C elegans public gene name=C47E8.7
  genomic DNA homolog sequence=SeqID_365
  cDNA homolog sequence=SeqID_1389
MAHLVEGTSIIDGKWQLPILVTDLNIQRSISVLGNLNVGGLMLELVSECDVERDWSDHALWWPEKRRWLQHTRSTLDQNGITAETQLEFTPMHKEARIQLPDMQMIDARVDFSVNSFKATKKLCRDLGIRYSEELSLKRYIPPEDLRRGTSDADNMNGPLSMRPGEESVGPMTLRKAAPIFASQSNLDMRRRGQSPALSQSGHIFNAHEMGTLPRHGTLPRGVSPSPGAYNDTMRRTPIMPSISFSEGLENEQFDDALIHSPRLAPSRDTPVFRPQNYVEKAAINRGWLDSSRSLMEQGIFEGDIILLRFKFMNFFDLNPKYDPVRINQLYEQAKWSILLDEFDHTEEEATLFAALQLQATLQRDSPEPEENNKDDVDILLDELEQNLDAAALNRRSDLTQVPELADYLKYMKPKKLAAFKGFKRAFFSFRDLYLSYHQSSSDVNSAPLGHFSLKGCEVSQDVSVGQQKYHIKLLLPTAEGMIDFILKCDSEHQYARWMAACRLASRGKSMADSSYQQEVESIKNLLKMQSGNGNENGNSNTASRKAAAVKLPNDFNVDEYISSKYVRRARSKQQIQQRVSDAHGNVRQLTATEAKLQYIRAWQALPEHGIHYFIVRFRNARKAELVAVAVNRLAKLNMDNGESLKTWRFANMKKWHVNWEIRHLKIQFEDEDIEFKPLSADCKVVHEFIGGYIFLSMRSKEHSQNLDEELFHKLTGGWA

SEQ ID NO: 225 - protein, 1092 aa, Caenorhabditis elegans
  C elegans public gene name=C53D5.6
  genomic DNA homolog sequence=SeqID_385
  cDNA homolog sequence=SeqID_1277
MDVNQFTELITKLQSADNDIRKQAEEVYEKIEGPTKVAALFEAYTHHTNNSDARSTVLVFLRRVLARDWDAIWETLNEENKQRILAKVLEMIVHETELSIKKKIADLISEIASNLIDDSGDMTWGGVLELMDHCLKSEDLTGNYIALLILRGCPIIFGNRLAHFLPTLKVVLEKCMATPDLQIKATAVRAVIAFAVDNDEEKDVVRLMTSLVPNVLQVCNETSDEDDSDGPLGEFAELASSLPKCLNTHMSQVLQVTLAIAGNKEKNEMVRQNAIEVICSYMESAPKGLKKYAPGALGPILETLLSCMTEMDDDVLNEWLNEIEEEEDYEDIPIIAESAIDRVACCINGKVMLPVFLPLVEKLLTSEDWKMKHAALRAFSAVGEGCQRSMEPHIEQIMAHITNYVNDAHPRVQYAACNAIGQMSSDFAPTLQKKCHAAVIPALLESLDRTDVPRVCAHAASALVNFAEECPKSIIGQYLPFILQKLENVLSAVFNRLGDKRYQVVVENIVTAIASVAEAAEELFKEHHARLIPNLVHILQNVGELKELRGKTIECISLIGYAVGKEQFHATAIEILNLLGDGMKDLAIDDPQYSYMISSWTRFCSILGADFAPFLPVVMDPVLRAARYRPDFNIFNNEDVHENEEGVEYHGIGGEKTVGIRTSGLEEKATACDMLVAFAKEMKEAFMPYVVDVYELAIKNLDFGLHDGVRTASAEIMPCLLTCVEKQGLADKRRLWCEFLKALTTSMEEEDDVEILASFMTTIGSCIEVMKTEGIAEEEVQLIISVLLKQLENYGKRMSDRPVEDEDDDDAEAKEELDYFMELEASCLGAISDLTHSLMKEFKGTIFEGMINVFNCAIQLIEGSKQYFERQWGMCLLDDAIEFGVGHMPTRFPKLIPIMYKLLGDEYPEVRQAASYGFGVMAINYHQISDYRNEILSCLEPLAAMIQREDARATEESTVATENAISAFAKIIGNVPLPAEAYGKVVEMFLSWLPTYSDTEESPYIYTCLAELFDKQDAALFGPENQNLPRIFLVCLLSIANDAFNDDDSGNQTKQRIVTILKQIYASFPQFAQQDGIDEHLTSVLQQTLNGQ

SEQ ID NO: 226 - protein, 382 aa, Caenorhabditis elegans
  C elegans public gene name=Y47G6A.8
  genomic DNA homolog sequence=SeqID_462
MGIKGLSQVIADNAPSAIKVNEMKAFFGRTVAIDASMCLYQFLIAVRQDGSQLQSEDGETTSHLMGMLNRTVRMFENGVKPVYVFDGKPPDMKGGELEKRSERRAEAEKALTEAKEKGDVKEAEKFERRLVKVTKQQNDEAKRLLGLMGIPVVEAPCEAEAQCAHLVKAGKVFGTVTEDMDALTFGSTVLLRHFLAPVAKKIPIKEFNLSLALEEMKLSVEEFIDLCILLGCDYCGTIRGVGPKKAVELIRQHKNIETILENIDQNKYPPPEDWPYKRARELFLNPEVTKPEEVELTWKEADVEGVIQFLCGEKNFNEERIRNALAKLKTSRKSGTQGRIDSFFGNSTKVTCVTAATKRKAEEAEKAKKGAKKGGPPKKRAK

SEQ ID NO: 227 - protein, 246 aa, Caenorhabditis elegans
  C elegans public gene name=C47B2.5
  genomic DNA homolog sequence=SeqID_366
  cDNA homolog sequence=SeqID_1410
MALRVDYEGSNDVGVFCTLTNSYCLVGVGGTQNFYSILEAELSDLIPVVHTSIASTRIVGRLTVGNRHGLLVPNATTDQELQHLRNSLPDEVAIRRVDERLSALGNVIACNDHVAIVHAEISAETEQALVEVLKVEVFRVSLAQNSLVGSYCILSSNGCLVAARTPPETQREIAALLQIPVVAGTCNRGSELIGAGMVVNDWVAFCGLDSTSTELSVVESIFKLGEQGAPTSISNQLRDTLIESML

SEQ ID NO: 228 - protein, 308 aa, Caenorhabditis elegans
  C elegans public gene name=E02H1.1
  genomic DNA homolog sequence=SeqID_454
  cDNA homolog sequence=SeqID_1425
MGKTSKVKKTKAGSSTGNVQSLPFNTDKGQHILKNPGVVNAIVEKSALKATDTVLEVGPGTGNLTVKMLEVAKTVIACEIDPRMIAEVKKRVMGTPLQNKLQVNGGDVMKMEWPFFDVCVANLPYQISSPFVQKLLLHRPLPRYAVLMFQKEFADRLVARPGDKDYSRLSVNVQLLAKVEMLMKVKRTEFRPPPKVDSAVVRIAPKNPPPPVNFVEWEGLLRLCFMRKNKTLMAIFRLSNVIEVIEDNFRKVCSFKNKPIPKDLNMKKVIEETLTASGYGESRARKMRVEDFLALLLAFNKADIHFLS

SEQ ID NO: 229 - protein, 207 aa, Caenorhabditis elegans
  C elegans public gene name=C32E8.2
  cDNA homolog sequence=SeqID_1435
MAPRGNQMLGNAHFRKHWHKRIKTWFDQPARKLRRRQNRQAKAVEIAPRPVAGLLRSVVRCPQKRYNTKTRLGRGFSLQELKAAGISQAQARTIGIAVDVRRTNKTAEGLKANADRLKEYKAKLILFPKKASAPKKGDSSAEELKVAAQLRGDVLPLSHTITFDEPRQVTDAERKVEIFRLLRKERADKKYRGKREKRAREAAEENK

SEQ ID NO: 230 - protein, 130 aa, Caenorhabditis elegans
  C elegans public gene name=F53A3.3
  genomic DNA homolog sequence=SeqID_334
  cDNA homolog sequence=SeqID_1337
MVRMNVLADALNAINNAEKRGKRQVLIRPASKVIVRFLTVMMKHGYIGEFEIVDDHRAGKIVVNLTGRLNKASVISPRLNIRLNDLEKYTNTLLPSRQFGYLILTTSAGIMDHEEARRKHLGGKILGFFF

SEQ ID NO: 231 - protein, 541 aa, Caenorhabditis elegans
  C elegans public gene name=C26E6.8
  genomic DNA homolog sequence=SeqID_413
MLPFDPSTRYDRQVRLWGEEGQASIGSTSACVLGSDSLATEILKSLVLAGVQSFYVVDDAKVEQADIGQNFFLHADDIGRSRAEATLEKLTELNPSVSGSASSQPPTALAMEDVEKLTTFSVVVAANQNEEIDTTFAKVLYNIRVPFICIKTFGLIGTIRICIKEHTIANSHEENPRPDLRLDAPFSKLIEMINETNLDEMTLEQLRHTPYILLHFKALEVFRKQRNDPEAFPSTTAERKELQAILMSFRRSSEESGTKDSENFDEAKAAVIRAFQRTTIGSSVKSILSSPQCSTSTRPFWLICEALRRFVTENNNLLPLRGTLPDMTSDSSRYTRLATLFHEKALSDAQEVLRLTREVEKERGVGDVISDDVCYRFCKNADRIRVQYGDVLDYNEETKAIVEKIRESNIDEETRNQKVDEATWMLLMRAVGRFQKEKGRYPGTNGVPVSIDAQDLKKRVEVLIREALKDEQDFTSISNKVTDTAIAEICRFGAAELHVISSYVGGIAAQEIIKLATNQYVPIDNTFIFDGHTQESATFKF

SEQ ID NO: 232 - protein, 1080 aa, Caenorhabditis elegans
  C elegans public gene name=ZK742.1
  genomic DNA homolog sequence=SeqID_361
  cDNA homolog sequence=SeqID_1417
MAVSAMEVLSEAKRQFAQGDRIDVTLLDQVVEIMNRMSGKEQAEANQILMSLKEERDSWTKVDAILQYSQLNESKYFALQILETVIQHKWKSLPQVQREGIKSYIITKMFELSSDQSVMEQSQLLLHKLNLVLVQIVKQDWPKAWPTFITDIVDSSKNNETVCINNMNILSLLSEEVFDFGSQNLTQAKEQHLKQQFCGQFQEVFTLCVSILEKCPSNSMVQATLKTLQRFLTWIPVGYVFETNITELLSENFLSLEVYRVIALQCLTEISQIQVETNDPSYDEKLVKMFCSTMRHISQVLSLDLDLAAVYKDASDQDQKLISSLAQFLVAFIKEHVHLIEVTDEPLTEAKILMRESHDYAIQLLLKITLIEEMEVFKVCLDCWCWLTAELYRICPFIQPSTLYGMMSQVREHPRRQLYREYLSQLRSTMISRMAKPEEVLIVENDQGEVVREMVKDTDSIALYRNMRETLVYLTHLDNKDTEVKMTEKLASQVNGGEFSWKNLNRLCWAVGSISGTMVEEDEKRFLVLVIRDLLGLCEQKRGKDNKAVIASNIMYVVGQYPRFLRAHWKFLKTVINKLFEFMHETHEGVQDMACDTFIKISIKCKRHFVIVQPAENKPFVEEMLENLTGIICDLSHAQVHVFYEAVGHIISAQIDGNLQEDLIMKLMDIPNRTWNDIIAAASTNDSVLEEPEMVKSVLNILKTNVAACKSIGSSFVTQLGNIYSDLLSLYKILSEKVSRAVTTAGEEALKNPLVKTMRAVKREILILLSTFISKNGDAKLILDSIVPPLFDAVLFDYQKNVPQAREPKVLSLLSILVTQLGSLLCPQVPSILSAVFQCSIDMINKDMEAFPEHRTNFFELVLSLVQECFPVFMEMPPEDLGTVIDAVVWAFQHTMRNVAEIGLDILKELLARVSEQDDKIAQPFYKRYYIDLLKHVLAVACDSSQVHVAGLTYYAEVLCALFRAPEFSIKVPLNDANPSQPNIDYIYEHIGGNFQAHFDNMNQDQIRIIIKGFFSFNTEISSMRNHLRDFLIQIKEHNGEDTSDLYLEEREAEIQQAQQRKRDVPGILKPDEVEDEDMR

SEQ ID NO: 233 - protein, 377 aa, Caenorhabditis elegans
  C elegans public gene name=F33D4.5
  genomic DNA homolog sequence=SeqID_491
  cDNA homolog sequence=SeqID_1361
MLSFVRQTVSSTGSNILRPASADVIQIRGRKRALKQTITRQQKLERRMKREEKEAARKQYSFMEKINIRRMKNLLSPSQQFPGRLNIDDEANLPEKPTLDVFIKSHFKTQYYTVSEALDMHRELQSPSIYNNPNAPIRLRLELNMTTERQTKMVTGSDEIVPVPHPFNHNEKRTILAFANDVKLQELAVESGAEMALGQDTIKKIIKGQFRTDDYDFCVSHSDMGSSILPLRGILKMRFPTRANGGLGENLPELIEKFKNGVKLNIKGDPVYPIWGLSDCVVGRLSMPNEHIEANIATVIAAACAHRNPALGSFVNRALLMTIPGEENYAIDVKPWIPIPTEEEIEKIEKRKNKKKKKDEKKTEDTDDVAPVVAVAL

SEQ ID NO: 234 - protein, 823 aa, Caenorhabditis elegans
  C elegans public gene name=H37A05.1
  genomic DNA homolog sequence=SeqID_319
  cDNA homolog sequence=SeqID_1286
MDYAYRVFKNVKYFYNSINPATLSGAIDVVVVEQPNGEYKSTPFHVRFGKYGVFSYSDKYVDIAVNGVEIDLKMKLADSGVAFFVEEADDQVPDYLLTSPLPEQETPQTAGPAVDKVLAESARKLEETQNENEDVDMNDIAKSRSSSPDGGQGNAREPKQEQSLSQVQRKQTLPFSSSVFSDRRYRSLPDLTVLAAETEVERTDIKKSDGKRTRKTPRPFVHSHSQCSPMEKKHFHKSNDEILRSLRRETHDMDRRIPLRKKSRVTFNQQATRPIDIKIQQYNDSDSELDSSVNSSPSPSLVDQREADRIADGALSDSEVDRQRDRNATPEPHDVTDWKWGELPETREQNKRKKQDEDAEKSTSRWSSWFWRSSTSTADEEQKEKEKLEQEEQGISLDELLNSSSNPVEIEKYLGKPPSVTSIDSGHVSRGVSQPSSPISNHDDYTPTTTPPNDKTPTRESVRFGAGNDIPSSTSATNGVRSRASSDEIFPLSEDELDDNFRPQYMQSLRLSSEKLKSLGLVFGANELRFSITTKFQGTTWCSCNIYLYKWYEQIVVSDIDGTITKSDVLGHVIPAIGGTWAHTGVAELYTRIKNNGYKMVYLSSRAIGQSHTTKQYLKSVAQDSKQLPDGPVLLSPTSIITAFRREVIERRPEEFKIAALTDLKQLFPSGNPFYAGFGNRITDVVSYEAVAVPAARILIIDPSGKVKRSDSSGLALSYKSMASDTVDYMFPPLSVHVKGDARKTERLTSTWSKPLEHSNFTHWHMTPKDVHDDELLEYEAQRKKLIAEQKAKNSFYFFAFHWNYQSLIAQPSQFYMFPLLSI

SEQ ID NO: 235 - protein, 359 aa, Caenorhabditis elegans
  C elegans public gene name=ZK909.2
  genomic DNA homolog sequence=SeqID_483
  cDNA homolog sequence=SeqID_1396
MGSMVFIVKEFLDKAREDFKQRWENPAQNTACLDDFDRIKTLGTGSFGRVMLVKHKQSGNYYAMKILDKQKVVKLKQVEHTLNEKRILQAIDFPFLVNMTFSFKDNSNLYMVLEFISGGEMFSHLRRIGRFSEPHSRFYAAQIVLAFEYLHSLDLIYRDLKPENLLIDSTGYLKITDFGFAKRVKGRTWTLCGTPEYLAPEIILSKGYNKAVDWWALGVLIYEMAAGYPPFFADQPIQIYEKIVSGKVKFPSHFSNELKDLLKNLLQVDLTKRYGNLKNGVADIKNHKWFGSTDWIAIYQKKITPPSFSKGESNGRLFEALYPRVDGPADTRHFVEEVQEPTEFVIAATPQLEELFVEF

SEQ ID NO: 236 - protein, 809 aa, Caenorhabditis elegans
  C elegans public gene name=C06A1.1
  genomic DNA homolog sequence=SeqID_305
  cDNA homolog sequence=SeqID_1334
MASVPTHQSEKEKKNDELSTAILKDKVKPNRLIVDQSEQDDNSVIAVSQAKMDELGLFRGDAVILKGKKRKESVAIIVSDESCPNEKVRMNRVVRNNLRIRLGDVVSITPAPNLSYGTRIHVLPIDDTIEGLTGNLFDVFLKPYFLEAYRPLHKGDIFTVQAAMRTVEFKVVETEPAPACIVSPDTMIHYEGDPIKREEEEESMNDIGYDDLGGVRKQLAQIKEMVELPLRHPQLFKAIGIKPPRGILLFGPPGTGKTLIARAVANETGSFFFLINGPEVMSKMSGESESNLRKAFEECEKNQPAILFIDEIDAIAPKREKTNGEVERRIVSQLLTLMDGVKGRSNLVVIAATNRPNSIDGALRRFGRFDREIDIGIPDAVGRLEILRIHTKNMKLADDVDLEQIANECHGFVGADLASLCSEAALQQIREKMELIDLEDDQIDAEVLNSLAVTMENFRFAQGKSSPSALREAVVETPNTTWSDIGGLQNVKRELQELVQYPVEHPEKYLKFGMQPSRGVLFYGPPGCGKTLLAKAIANECQANFISIKGPELLTMWFGESEANVRDVFDKARAAAPCVLFFDELDSIAKARGGGAGGDGGGASDRVINQVLTEMDGMNAKKNVFIIGATNRPDIIDPAVLRPGRLDQLIYIPLPDEASRHQILKASLRKTPLSKDLDLTFLAKNTVGFSGADLTEICQRACKLAIRESIEKEIRIEKERQDRQARGEELMEDDAVDPVPEITRAHFEEAMKFARRSVTDNDIRKYEMFAQTLQQSRGFGNNFKFPGEQRGSDAPSAPVPAQDDDDLYN

SEQ ID NO: 237 - protein, 1141 aa, Caenorhabditis elegans
  C elegans public gene name=F28D1.10
  genomic DNA homolog sequence=SeqID_386
MAYKDARQVKIAEKLVILNDRAAGMMTRIYNIKKSSGDSKVKPQFLSDKKMEGAIKHIVRKFPVVDCRSNSSTFEYVQEKSTEITKSLSLYYYTFADILDLKDHIMQVLTTMESCQCQLDVTLNYDLTTSYLNLVVHLVTMMILLSRIEDRKAVLGLFNAAYDLQHGQSEASFPRLGQMILDYENPLKKLHEDLGPLNRLIYSALSSVTHTYQRRNKTADSWRTSNVFSLTAAPAQILYAAQTETIACEYLSLDVIDRWIVFCGTVCHSTLLNDDNIRHMWQLALQMNLCLRVFRDETFIVHQEIQAFLESSKEKSKRLQDVKDAFNHASVTAVAVHADRRRFLRSSLRELSLLLRDQPGLLGPKILYVWMALGAGRDEVIWLLRHQVEVPAISKKGSRMVEELVDRQLPELLFYMLELRDLVTKYYAVIQRYYLQYVSSYDSIVVSEEINQANGLTQEEAVLLTDFANEIGNINSDTDLRALRLDWFRFQAWTSAARSHFQLSRHKKLAIYMNTSVFHLKMIDLQDEMLRETSDLSLYCFYPKLAEKHWLNCLQLPAQARYVLSFARLAAHFTSALHDMCPEEKAFITEKALAQCNSVIEETCKQLSYILEKVAEHEFGLAYQMTPSAVAVRVVAQVVQQKGSGKAAAAAAAAARDYFIAGEESYRVDRQALTMPDKLQTTLLEISAALGAHRQIYVADHTFAPRTYLAQSLETKFVELLHGMFWEGQPHASNPKRPSEMLLALQAYMTVLQNLDTAISVDISNTMQTTLLQQTQLVDSKNKDTIAALYTKWYLEVLLRRASSGHMVWSEHLRTMLSSGQEQLSFMPDHYSDPQELRALVQIIGPYGVKLMTERLIWHVASQIMEMSKIVATYKDALQIARSNFDNAEKMKDVLNLLSVEPKDKKTPNATCAADAILQRTIIIGQICLFRDALHDALRHIVESKLPFLQASFDMLYHNLDDVDKVKIGEMSAAMGVTGPVDMSLVNAVRAQNPNIHPQEHYVNSCLLMVAVAICIPRIGMSDLSSYKPSIQASLNNSHCVPMAINTIGSALFHLHEQNDIQSRMKEFLALASSGILRTIHERDNSRQISDDVLRSHTTLYIILEQMVRKNRWLSMDVLETCFPYNLVRTAYQQCYEADAQ

SEQ ID NO: 238 - protein, 410 aa, Caenorhabditis elegans
  C elegans public gene name=F49C12.8
  cDNA homolog sequence=SeqID_1285
MTEAAKKSTKKPVDDGNFDKEIISRWPDLELSQTRFMLNHPEVDSSVKEAKLEKLQETIKEFDMAPFYELVCADFKIVVDATQLAAMKAANQKKIDEITAEVEDAEKNLGESEVRQGLLRKFEYYCQIGDKDNALKAYTATYEKTVGMGYRIDVVFAMIRVGLFFLDHHLINKFITKAKELMEQGGDWERKNRLRSYEALYRMSVRDFAGAADLFLEAVPTFGSYELMTYENLILYTVITTTFALDRPDLRTKVIRCNEVQEQLTGGGLNGTLIPVREYLESYYDCHYDRFFIQLAALESERFKFDRYLSPHFNYYSRGMRHRAYEQFLTPYKTVRIDMMAKDFGVSRAFIDRELHRLIATGQLQCRIDAVNGVIEVNHRDSKNHLYKAVIKDGDILLNRIQKLARVINA

SEQ ID NO: 239 - protein, 984 aa, Caenorhabditis elegans
  C elegans public gene name=ZC518.2
  genomic DNA homolog sequence=SeqID_389
MSNIPTAPGNVGFPQAYGQNQNQQYQHVQQFSQFSQPSAAPLNNAPPNYAANPFPFPTATTSQEPVKPVSQIPNGAPSYQYNHAAPNYPTAASAFPAHSAGFSHQPPSFSPATQPSMNGHHAPPPPAVSRPPAFPTPPPSVGSAAPSIQPPIPSALASARPAPFPAAQPPPAPTPTPSYQQQMAPRPQAPAAYPPASQQQGYPPQPQQNSQYGQPQVPQPQMQNMNQQFGQMNMSGAPGPQQQMGGYRNDIIDLIAERNVQQLGFEDIEIQIPQQVANPNAHVDPNIFRSTLAQVPQTEELLKKSRLPFAITLHPFRDVKNLNIIQTSNIVRCRYCRTYINPYVYLPDHRHWKCNLCNRNNDLPDDFCWDPVTKAFGDPRNRPEIQNATVEFIAPSEYMLRPPQPAVYVFVIDISAAAIQSGYLHTFAEQLLINIDQMPGDDRSQVCFIAVDQCLHFFSFSSNKRYPNEMIVDDIDDAFLPSVTSLLVPMKKFKDTIRTFIKQLPEFYSQIGPTSNGNCLGSALKLAQSMIQEVGGRISIFQVSLPNLGLGALKSREESTEGGQNLGPATDFYKALSLECTGSQICLDLFMFNTQYADLATLSEIAKFSTGCVYHFPNYNYRNDIHQVKRFERTLTRYLTRKLGFEAVLRIRTSRGLALTGFYGNFFVRSPDLLALANVNPDSALAAQVTLEEKLPQYVCFQSALLYTSSKGDRRIRVHTMCLPTTGDLLQLYNNFDLKATVSYLAKIGVERSMTGSSLADSREALVNAVVDSVGAYQKAVSRGSGMLVPRVGHLRLFPSYVLAMLKHPAFSSSRGIRLDERAGAMLMMRFSPLDQILSDIYPRLYRLNELASMPEDQSPPALPLSFEHISRGGVYLMITGTIAFVYVASSADPGFLVNVFGTSTYNDIDEYSLLERDNELSRRVHAFFKQVTQFRFYLGPIITIKEHSPLRDVFVRRLVDDRSESTHSYVEFLQHLKREISGN

SEQ ID NO: 240 - protein, 154 aa, Caenorhabditis elegans
  C elegans public gene name=F26A3.2
  cDNA homolog sequence=SeqID_1411
MVFDPRTLDNPKEISAYRDQRYQGTVRDQETALRTSCTLYVGNLSYYTKEDQVYELFGRAGDVRRVIMGLDRFKKTPCGFCFVEYYTREDAELALQNISNTRMDDRVIRADWDAGFIEGRQYGRGKHGGQVRDEYRKDYDPERGGYNRAIAQKG

SEQ ID NO: 241 - protein, 1358 aa, Caenorhabditis elegans
  C elegans public gene name=Y110A2AL.8
  genomic DNA homolog sequence=SeqID_396
MKVHSEQPPGKDEPGPIRRFLENRLIGNFDSEDFSDAWKKKFAHAPTWCDADMSLQQIKRGKAVGNTVALTARAFFQLWLFRIGCFVQRWAWSTIFISLFLYCLCLGGLRHVTIETDLVKLWVSEGGRLNEEMGYLGQVKFERESGHLVHKVKRAVEQTTEPPAPAVKAEVRRGPELPKENGLGGGFQVVIQTPSFDGQNILSKEALQQHTKLMEEISTYEVKMFNETWTLSDICFKPPGPSFNSGPLAGIMSKLLDKIIPCIWITPIDCYWDGAKPLGPNPPLNLGPEVASFVSSLPPGNVTWKNLNPTSVIKEVGTLFDLGPIGNFFERAGIDGAYLDRPCIDPLEEECPKSAPNYFDRCHALTKFNEWNMAKAMSEQVTLERKIIPKDDGKSDIAETILNDIFGKKRRKRQADTTTKKPATKKDEDYYEYEDDADYLAGIANSTIAKKNPEKEAKDLLCLEYGSSLLKWMQENPERLGEFLTKEEMPDYPNYGDVMTGGCKGFGKKIMEWPEDLIIGGIQRDNGKLVSAEALQSVFLVSGAYDVFARIKNDKTDSHPGLDRHHFQPWMAGEIISTWQRNFTKRLYSHELNRERRQFHPLASTSIADMLEEFSQFNYIIIVIGYILMVIYAAFTQGRFQGWWLAVQSNVALAICGVILVTISSICGLGFATHLGINFNAATTQVVPFLSLGLGIDDMFLLLHNYDEIINICNKNEIGVLLKETGMSVMLTSINNILAFISGYVLPIPALRSFCSQTAILLAFNLIFLMFIFPAMIGIDLRRQRKGKRDLAYCSRGNPQMATSQSVPSNVSNMSSRAELAGYEKQADEYKRHEPWYTVGGFLNKIYIPALKNNVVKACVLIGTTTAVVFGLYGMYTSTLGLELADVLPEHTPPAAFLRAREQYFSFYPMFAVLRGDKLDIPNQQQLIEEYRAQLGSSKFMIKAEGKLQPYWMSMLRVWLQSLDMALEKDLAAGKFDLTNGNPIKVNGEKPSPESMIAARLVCSFGTNYNCDGRLGKMKMVENEVINPEGFYNYLTGWFNVDNMMYYVSQASFYPTPPGWEYNEKLAKVVPAAEPLLYSQMPFYQNDLIDTPAIVKMIEEIRATCEEYSERGLSNHPSGIAFTFWEQYLTLRWNLFQAICIIALAVFCVISILMFNPWAATLIMCIVVITTIELGGFMGLMGIKMNPISAVTLICAVGIGVEFTAHVELAFLTALGTIDQRLESCLQHMFVPVYHGAISTFLGVVMLVFSEFDFVVTYFFYTMTLLVALGVFNGLCVLPVILTLVGPKPELTPTDGSSVLPPPPPLRQQYAEKSGGVEGGMRKRKEKRPAEVEMSARDSPSTSSASHSSDDESSPAHK

SEQ ID NO: 242 - protein, 437 aa, Caenorhabditis elegans
  C elegans public gene name=T23F2.1
  genomic DNA homolog sequence=SeqID_327
MHVVIVHPEQWNGGSDRCTVALIRHFVSQGHRVTWLTTMIDEYWKNHTFDGVEIREVGLKLHPGDWWSQNVALGWHMVFSNLNPDVAIIDHSASCVPMIKWRFPQCKILFYCHFPQQLVTPSRFFLYRWYAKLIGIVEEELFGHIDQIFVNSNFTATQFCKVMPNIEKNKVRVVYPPCDIDWIVSASERPVSRAQRAKNETYTFLSMNRFWPEKRLDIIIEAASILKQKGYHFHVQLAGSVMPHIPESRIYYEVLQRMTEELNVTDMVTFIPSPTDKVKFQLYQQCDTALYTPPNEHFGIVPIEALDQRRPVIVCDSGGPAETVLEDITGTKIAKPCGELLAEAMLHHMNKRDWPELDTDEGYAKQRHRLETEFSTRGFCGNIDRAIAEMMGTLEISSSEPTTTPLVDTIVHQPTATEVYSKPQQYNKAAHSRRAQA

SEQ ID NO: 243 - protein, 569 aa, Caenorhabditis elegans
  C elegans public gene name=C26D10.1
  genomic DNA homolog sequence=SeqID_388
  cDNA homolog sequence=SeqID_1443
MSTAEQRMDTSEVELPNDNVNEQGNKTPRADQPESSASGARNHGEDEEVTEQVELAAMETEASDSIVDNVPKTPRRAGRPKKLPSTSTAAAESAVTPGKRGRKRKGSESVNTTINSTMNSTLNEPKTPGRKQAKLVAPLLTYDLFAPSIIGDRVLSCGEGEALGHPGRTTTKKPRKVDIFEEEGLKPLQAVAGGVHSAVLTSEGEVYMCGINEKGTVPAEGVEKEGSTDEFAKVKFEEDIEKEGKIVMLAAGASFTAALTDQGSVIAWGNLRNSNGNVDVHPLLHKMQEAPVVIVHQAKRKIVKIAAGENHLVMLDEKGCLLTFGDGEMGQLGRSSRTKTIRSKYMCDESGDHLLVPLRFKHKGKFFDVVAKNVFASGFWTIVHGEDGKYYAFGLNNYAQLGIKVDEADVGQDGQDNRELRVFLPAEAPAFGAERTFVNIEGVQHVVILGSDGKVFAMGKNTDNALGLGNWTGKDDQQHWLYDTIQEIEFDSKIVGVSAKLATSIAWSEDGTAYAWGFDTTGQLGLGLKDEDEKMVSKPEEISSAHLDGYSIIGASISDQHTLIIAKKN

SEQ ID NO: 244 - protein, 204 aa, Caenorhabditis elegans
  C elegans public gene name=Y38A8.2
  cDNA homolog sequence=SeqID_1446
MSIMSYTGGTVVAMAGDECVCIASDLRIGEQMTTIATDQKKVHKVTDKVYVGLAGFQSDARTVLEKIMFRKNLYELRENRNIKPQVLSEMISNLAYQHRFGSYFTEPLVAGLDDTNKPYICCMDTIGCVSAPRDFVAVGTGQEYLLGVCENFWRENMKPDELFEATAQSILSCLERDAASGWGAVVYTITKDKVNVSTIKARMD

SEQ ID NO: 245 - protein, 1043 aa, Caenorhabditis elegans
  C elegans public gene name=F55A12.8
  genomic DNA homolog sequence=SeqID_369
  cDNA homolog sequence=SeqID_1281
MRTKLDGRIRTQIENGVASGHRSMFAVVGDKARDQVPILYHILSKSTVSARPNVLWCYKKELSFSTHRAKKAKKMKKATTTISGSLPDADPFDVFISSTQIRYCYYNETEKILGNTFGVLVLQDFEAMTPNLLARTIETIEGGGMVILLMQSVRSLRQLYTISMDVHNRYRTEAHNEITARFNERFILSLASCSSVLVLDDQLRVLPISSHIENVEAIPASQKKIQSESDAELASLKEAMKETKPIGPLLSRARTACQAKALLRFLDVITEKQSNVTCSLTAGRGRGKSAAVGLSLAGAIAFGYTNIFVTSPSPENLKTLFEFVVKGFDALDYQEHTDYELIQSANPEFKNCLVRINVFREHKQTIQYISPTDVQKLGQCELIVIDEAAAIPLPLVKELISGPYISFLSSTINGYEGTGRSLSLKLLQQLRQQSAGGEAKEGKSASNKGKTLHEMHMEESIRYKPGDKIEKWLNRLLCLDATNCQLKLECGTPPPAACELYIVNRDTLFSFHDASEAFLQQVMAIFVSAHYKNSPNDLQMLSDAPAHNLFVLMAPIDKSRKTIPEVLAVVQVCLEGRLDSDNIQNGLESGKRAAGDLLPWTVSQQFMDKQFGTLCGGRIVRVAVHPDYQSMGYGGRAVQLIEQYYLGLATSLDEEEKAPAPPSKTVIKQVKDGHTVELLEERIEPRADLPPLLQRLDERKPERLDYLGVSFGLTVPLLKFWKRNEFVPVYIRQNSNDITGEHTCIILKGLEHGGSDSDEEPSATWLPVYWREFRRRIVNLLSFDFSSFPAQMALSLLQLKNKHVEKQMKRLVIERSELAIHLSNTDLRRMSQYGRNMVDSHIITDILPIVAKLNFEQRLPQELKLAVTQSAILLARGLQHKHFEDISKELDLPMNQIFALLTKAIRRIGDWFDEVCETAVRENLDKEAEASAANKPTSSLPKAVPLANLEDELESAAKEIRARHDRDRKALLAELGNELQKYEIIQDEKELAEAYESVNMKYANKLVSVKSKRTAIQAAIPDAKDPANKNAKKKKRFSSGGRR

SEQ ID NO: 246 - protein, 294 aa, Caenorhabditis elegans
  C elegans public gene name=D2013.7
  cDNA homolog sequence=SeqID_1272
MASNLTVNVHPGVYMNVVDTHMRRTKSSAKNTGQEKCMGTLMGYYEKGSIQVTNCFAIPFNESNDDLEIDDQFNQQMISALKKTSPNEQPVGWFLTTSDITSSCLIYHDYYVRVITEASARRESPPIVVLTIDTTFSGDMSKRMPVRAYLRSKAGIPGAAGPHCAIFNPLRVELAAFPGELVAMQLIEKALDSRRREATLESGLEQLETSTAQMIEWLERMLHYVEDVNKNGEKPGDAQIGRQLMDIVTASSNNMQPEKLDTLVKNTLRDYVMVSYLAKLTQTQLQVHERLVSA

SEQ ID NO: 247 - protein, 4753 aa, Caenorhabditis elegans
  C elegans public gene name=F29D11.1
  genomic DNA homolog sequence=SeqID_328
  cDNA homolog sequence=SeqID_1358
MILRLLIFTALAVTTANSSTRQQSTFHSIQVDSPPSVRSRIISASVNTASSVCNENDFRCNDGKCIRTEWKCDGSGDCSDGEDEKDCPHPGCKSDQWQCDTYTWHSVSCIAEYQRCDNITDCADGSDEKDCPASTVDCSSQNVFMCADGRQCFDVSKKCDGKYDCRDLSDEKDSCSRNHTACFQYQFRCADKTQCIQKSWVCDGSKDCADGSDEPDTCEFKKCTANEFQCKNKRCQPRKFRCDYYDDCGDNSDEDECGEYRCPPGKWNCPGTGHCIDQLKLCDGSKDCADGADEQQCSQNLCPSLGCQAGCHPSPHGGECTCPSGYKLDDRFHRTCSDINECAEFGYCDQLCANHRPGFTCSCLGDCFTLQMEHGPGKDNLTMRGYCVSNNADKMKLFVARREGLYRLNPKNPDEEVKKLASGEFIYGIDFDYGDRKIFWTDRLAHSAFSADVDDEGEISQIKKLSLKSLVYPRCLAVDWITNTLYIIESGSRRIDVSSYDGERRTVLLADGLTLPLDIALDPLRGEMFFTNQLKLEAAAMDGTNRRTLVNTHTHQVSGIVVDITAKRVYWVDPKVDRLESIDYQGNDRRIVAQGMNVVPHPFGLALFDQYLYWTDWTRLGVIQVEKFGSDTKLLWSNTENNVFPMGISAYHPMAQPGPGQSECLAMKIENPCTNADCEGMCILSKDNGGFGVGYKCACPIGQKLVNGKRCIDSIDYLLFSSNKIVRGIFPEINEKALAEAVLPISPISQRRIGMYFEVECDVHGNSFFYADIMDNTIYRIRPDGEGAAPVLVTHNDGLFSMSFDWISKQLYYVDNIRNSLEVVKIGETGLVHPDELVRRQLITELRDPVSVVVHPWKGLLFYAEAMRPAAIYRCHIDGQNCQVIRNTTLGRPSEMAIDFAENRLCWGDTLLKTISCMDFDGKNVVKLDIDNPIPVAITIMNEYIYYVHQRPYSIRRVHKKNGGGSKIVREFGADERSIFSLKACSHQNQPIPDDSREHPCRASQCTQLCFATPSESHPNELEAKCACRQGFMINKENNHSCQKDPAEKIEQLCSSNSTQFQCKNGRCIPKEWKCDGENDCLDESDEIDEKGDKCFHETECAENTIKCRNTKKCIPAQYGCDGDNDCGDYSDEDVKYCKDGQKPVCAAKKFQCDNHRCIPEQWKCDSDNDCGDGSDEKLEMCGNATCAANQFSCANGRCIPIYWLCDGDNDCYDGTDEDKERCPPVQCSALQFRCANGRQCVPLRNHCDGQSDCEDGSDEDSCAVTAESCTPDQFKCVSSGLCIPASWKCDGQQDCDDGSDEPKFGCTSGRQCSSDQFKCGNGRCILNNWLCDGENDCGDGSDESSERGCKTSMNARKCPFEHVACENDQETCIPLHQLCDGKTHCPGGTDEGGRCARDLCSADRAGCSFKCHNSPNGPICSCPFGEQLVNKTKCEPENECLDSSSCSQRCKDEKHGFTCSCDEGYELDVDKRTCKVADNVKDTRIYVSNRNRIYYSDHKLDNWHTFGAIVENAIALAWDSLTDRIYWSDIREKKILSANRNGTNATVFIADGLDITEGIALDWVGRNLYWVDSSLNTIEVANLEDPKQRTLLVHQNVSQPRGIAVDPRKGVMFWTDWGQNPCIERASMDGTDRQIIVKTKIYWPNTIALDYTTDRVYFADSKLDFIDFVNYDGSGRTQVLASSKFVQHPHALAIFEDMMYYSDRRLQKLQVYPKYPNGTTSEYPSHTFSKALGVVAVHPVLQPVIKNNPCSTNPCSHLCLLNNKNTFTCKCPMGEKLDASGKKCIDDAKPFLVIIQKTNVFGIEMNSASEKETPVLAGMVPLSGLGNAFDAAYDALSEEMFILEHTNHAKTLAQITTDSAIYRSTVNGGNKTKMFSSAVPDDAYCLGFDWNGRNLVVGNKITQTIEIIRTQGKQYRSVILSNDQSPTAVVTPVAIAVDADKGYVFWLDRGGGAADAKVARAGLDGSNPLVIASNDLAELDHIAIDTTNTRVYFSEAKAGRISSVTYDGQDRHYVLSDGGRQPNGLAFYGDRLFYADSAFDSIEVATINGDSQPPQWTHFKKDVENLANIKALQPRASSSGHPCHINNGNCDHICIPLMFAQRTCTCANGYVKDGQTSCKLFDESFVIVATKTKVIGYPIDETQSKGVAMEPIGGLSITGVDYDYESKTIYVAEASGINKGITAYTIGESSPRAVIRDSIGSLTIKSLAIDWINYNMYFINHDAERTNIEVSKLDGTYRKILLTTKTETPSSIAVDPVSRYLYWADQGQKPTIQRSFLDGSRREVIVSSGIAEPTDLVVDVASKMIYWSDAKMDGIYRVRSTGGTPELVRSDIASAAGVALHGQNMYWTDNRLEKLFRATSKPNQTSLLLSPTTVAASLKDIGDVAVFSSNNQPRASSPCQITDNLRKSPCTQLCFATPGTQTPTCSCARGVLKGRTCEEPDTYIMFSDGDKIIDVAIEPDVKASRPLKDPFPEISNLQTFDVDVNLRRVYFVVESPVGVNISWFSMNNAENPRLVFGASKQPHAKEIRHISDMKLDWLTQKIYFTTGRGGKVMAIDTAGEHLSTIASGDWTYALAIDPCSGLLFWSDSGYKTSGGLYEPRIERSNLAGGSRKVIVSESISLPAAIAVDFRNQKIYWADVNRLNIEVADYDGQNRKVIASGYRAKSLDIWDRWLYMSDPLSNGVFRIDKESGSGLENVVSDRRIPGALRVFASESDVRTRNQVCNALTSQLCKTDNGGCDQLCTVVADDIGLAASKVQCSCNDTYELVQEPGKDYPTQCVLRGSNSEPAKECLPPYNFQCGDGSCILLGATCDSKPDCADASDENPNYCNTRSCPEDYNLCTNRRCIDSAKKCNHIDDCGDGSDELDCPSAVACAEGTFPCSNGHCINQTKVCDGHNDCHDEQVSDESLATCPGLPIDCRGVKVRCPNTNICIQPADLCDGYDDCGDKADENQLFCMNQQCAQHYVRCPSGRCIPETWQCDGDNDCSDGWDETHTNCTDTAGKKICVGDYLFQCDNLKCISRAFICDGEDDCGDGSDEHSRHGCGNRTCTDQEFHCTSNAKLAQPKYECIPRAWLCDGDVTCAGGEDESTELCKTEKKECNKGEFRCSNQHCIHSTWECDGDNDCLDGSDEHANCTYSSCQPDFFQCANHKCVPNSWKCDGNDDCEDGSDEKDCPKNSASAQKASKCSNGQFQCTSGECIDDAKVCDRNFDCTDRSDESSLCFIDECSLAEKPLCEQKCMDMKIGYKCDCFEGFAIDISDQKSCHNVNECYEGISGCSQKCDDKIGSYKCGCVDGYQLSSDDHSCKRTEMEPEPFFLLANKHYIRKISIDGNKYELAAQGFDNVVSLDIDLTEKKAYLIDQGKLRLLRVDLDEMDSPLSSYETVLRHNVYGTEGIAVDWVGRKLYMLNRQERSIRVCELDGRFCKTLIRDRIQQPKAIVVHPGKGYLFFTEWSLQPYIGRIALDGSPELQDPIFKLAEHDLGWPNAIAIDYFSDRLFWGDAHLNEIGFMDFDGNGRRHIPAQRTSHVSSMVVFDDYLYWADWNLREVLRCDKWTGKNETILKKTVQLPNDLRIVHPMRQPAYPNPCGDNNGGCSHLCLIGAGGNGYTCSCPDQFVLLSDQKTCEPNCTERQFACGGDDAKCIPKLWYCDGEPDCRDGSDEPGESICGQRICPVGEFQCTNHNCTRPFQICDGNDDCGDSSDEQNCDKACDPWMFKCAATGRCIPRRFTCDGDDDCGDRSDEADTLCMSAERNCTAEEFRCNNNKCIAKAWRCDNDDDCGDGSDETPECAQIECKKGWTRCSSSYRCIPNWAFCNGQDDCRDNSDEDKQRCPTCDDVGEFRCATSGKCIPRRWMCDTENDCGDNSDELDASCGGTTRPCSESEFRCNDGKCIPGSKVCDGTIQCSDGLDESQCTLRRCLPGHRQCDDGTCIAEHKWCDRKKDCPNAADELHCEDVSRRTCSPFEFECANSVCIPRKFMCDGDNDCGDNSDETSSECRSAQCDPPLRFRCAHSRLCLNILQLCNGFNDCGPNDFSDEHLSMCSSFSEYGDCSSDQFKCANGKCVNGTVACDRKDDCGDASDEIGCSKHGGKTSCEAFGNNGGCKHICTDVRDGFYCHCRDGFRPDPQSPKECIDIDECAGNNTCTQLCLNTKGSYLCRCHEDYENNVVVGSMTGKDCRAKGDAANVMIGADDSLVQLSLHGSGTNRHAAAKANDDDNDIIGIAFDPRKELMYWIDGSERTIYRSAIANGNQSHEGQKLDVDFAAMGVVPTAIAVDYTTGNLFIAAVSENIENGLVTARKKRMSEPIDNQNTGFIFVCLPDGRYLKKIVAGHLQQPTALITAPSAGRICYSDAGLHAKIECADMDGTHRQIIVKDLVFSPTSMAIDEGKGNRIYWVDPKYRRVDAVNIDGSERTTVVHDRHIPYAVDVFENHIYWLSRESKTLYVQDKFGRGRVSVLASDLEDGHTVRVSQKYAKDTQRTVSGCERAQCSHLCVSLPSTGFACLCPDGIVPQLDGSCATQHVEALTMPKQCKCTNGGKCRLDGSCECTSDFEGDQCEKESSVSRKIIGTLSENFITVLLYILAFLFAFGLIGFCALNLYKRRQLLFKKNEAADGSVSFHGNVISFSNPVLENKQDAPGSEFNMQQMTSMHDDSTTFTNPVYELEDVDMSSPPPSNDQPSTSASAMSPNRPSTSAASSFVPPTFDQDEIELKTADEIIVPKAEISKPPIPARPKKEKADPLRVDNPLYDPDSEVSDV

SEQ ID NO: 248 - protein, 430 aa, Caenorhabditis elegans
  C elegans public gene name=F56H1.4
  genomic DNA homolog sequence=SeqID_444
  cDNA homolog sequence=SeqID_1319
MSQTPPPKDGKNPEAMEVEDAIDEEILKMSTEDLKSRTHLLDNEIRIMRSEVQRINHSATTLKERIKENTERIKVNKTLPYLVSNVVELLDLEDNTEEEGANVDLDAQKTKCAVIKTSTRATYFLPVVGLVDPDELKPGDLVGVNKDSYLILEKLPAEYDSRVKAMEVDERPTEQYSDIGGCDKQIQELIEAVVLPMTHKDRFVNLGIHPPKGVLMYGPPGTGKTMMARAVAAQTKSTFLKLAGPQLVQMFIGDGAKLVRDAFALAKEKAPAIIFIDELDAIGTKRFDSEKAGDREVQRTMLELLNQLDGFQPNDDIKVIAATNRIDVLDPALLRSGRLDRKIELPHPNEDARARIMQIHSRKMNVNKDVNFEELARCTDDFNGAQCKAVCVEAGMIALRRDATEILHEDFMDAILEVQAKKKASLNYYA

SEQ ID NO: 249 - protein, 493 aa, Caenorhabditis elegans
  C elegans public gene name=K08E3.5
  genomic DNA homolog sequence=SeqID_424
  cDNA homolog sequence=SeqID_1335
MPSSEEWKTSTKLEALGSMEGELAHLLSTCKPETLNHNKTELSGFRNLFARFLRAKPTVDWSKIEPLPEGAIRPYKSLGHVVDKELIASQLRKLVVVKLNGGLGTSMGCKGPKSVISVRNDLTFLDLTMQQIQTLNKTYGVDVPLVLMNSFNTNEDTQKVLKKYANVKVSVHTFSQSQYPRINRETLLPIVKSLEADDNECWYPPGHGNFYEAFHNSGLLDKFLADGKEYCFLSNIDNMGATVDLSILNFVLNPSPDQTAPEFLMEVTDKTRADVKGGTLIQYEGRLMLLEIAQVPKDYVDEFKSISKFRIFNTNNLWAKLDAMRKIVVENKLEMEVIVNPKHLDRGLDVIQLETAAGAAIKSFSGAVGVNVPRSRFLPVKKTSDLLLLMSNLYDIDNGSLTLSHQRSFPTTPLVKLGSSFDKVKDYLGRFNGIPDLLELDHLTVSGDVWFGKDVSLKGTVIIIANHGDRIDIPPGSILENKIVSGNLRILEH

SEQ ID NO: 250 - protein, 282 aa, Caenorhabditis elegans
  C elegans public gene name=D2024.6
  genomic DNA homolog sequence=SeqID_309
  cDNA homolog sequence=SeqID_1441
MSEISDAEKVRIASDFIKHAPPGEFNEVFNSVRMLLENDDLLKNKCVNAIAQYNVGQFVPVKLDGVAKQTLITPYNDLGNGRFYDEVSKKSFKYDHVRKEAADLQPHPAESGITEQWRQALQTQLDIYIDDHYAKSGTGVVFARNGVFTICIESHQFQPKNFCNGRWRSEWNVPVGDGKSGSQEMKGKILSQVHYYEDGNVQLFSEKEPVLKVNVSADFDKTAKEIIHAISEEETIYQNAVQENYANMSDTTFKALRRQLPVTRAKMDWNKAQTYRIGQEMK

SEQ ID NO: 251 - protein, 615 aa, Caenorhabditis elegans
  C elegans public gene name=T27B1.2
  genomic DNA homolog sequence=SeqID_486
MWKLSSILYFLFSSILFISIPKEPTETARRNSCSAHFSRVVPSSLSPSLGGPFHNIDQLLPVVGVKGAPPLSLPPPNPSLLFSRLFYLPTVAHQGWAEPAYSNTKYSSHSYTAHSGPCHLLVCNLLPNIGISRVPSSSLLSNFVTMENRTPMQHHSGYEIVKSEPPSTPKTLIKSSYMENTPEMVFGSFPIHSGFCTQVVTHTDPMNNNNQPKTNANGRALAADRKRPYPCNLCSSKFGSKMELEEHQNSHTGQKPFECDTCNARFNRRSTLWNHKRIHSDAKPFVCTVCQMTFKWKNSLKCHKDMHQRKNETSAHLDNDLRQLTYATAAKRKLQMEQEENGGLPASSSASSVISHPLITTTSGNKKRSKAAKAKQTPSSLATTLSQVHLGAVQPLHASALVPPSDHQIDLDTTSLDSLMQSQNQNFLMQLYGYSDDGRHNGGMLSLDDTMLSNLSDSKSDSGSSSGGLSIQLPMQTINMLNFRNLGTQQLPPVHQLASSLPSVSSGMDYVNVNQHDSHYIVSQPDMMLGNQPLYHNGSFANIEKSNPHNNQFTIDSCVLLPSSRQDYPFDYTMVNQQYPMQEQVHDQTVGVSVVQQHYAEQAHAHGKTVPHEQW

SEQ ID NO: 252 - protein, 381 aa, Caenorhabditis elegans
  C elegans public gene name=C03C10.3
  genomic DNA homolog sequence=SeqID_440
  cDNA homolog sequence=SeqID_1445
MTLTEIQNVEKENAGASVPKHSSNKLKLEKELEKLEIVDQTKAASAEETNNESEVNELDADEPMLQDLDNRFVIFPLKHHDIWNFYKKAVASFWTVEEVDLGKDMNDWEKMNGDEQYFISRILAFFAASDGIVNENLCERFSNEVQVSEARFFYGFQIAIENIHSEMYSKLIETYIRDETERNTLFNAVDEFEFIKKKADWALRWISDKKASFAERLIAFAAVEGIFFSGSFASIFWLKKRGLMPGLTHSNELISRDEGLHRDFACLLYSKLQKKLTQQRIYDIIKDAVAIEQEFLTEALPVDMIGMNCRLMSQYIEFVADHLLVELGCDKLYKSKNPFDFMENISIDGKTNFFEKRVSEYQRPGVMVNEAERQFDLEADF

SEQ ID NO: 253 - protein, 135 aa, Caenorhabditis elegans
  C elegans public gene name=C04F12.4
  genomic DNA homolog sequence=SeqID_376
  cDNA homolog sequence=SeqID_1440
MVFNRVVQIGRVVFIASGKDQGKLAAIVNVIDGNRVQIDGPSSDVTRTVRNLKDLQLTKFVLKLRVGQRTKGVKAAFDAAKVTENFQKTQWAKKIAQRAIRAKLTDFERYKLMKAKQMRNRIVRVELAKLKKAQK

SEQ ID NO: 254 - protein, 476 aa, Caenorhabditis elegans
  C elegans public gene name=K02A11.1
  genomic DNA homolog sequence=SeqID_465
  cDNA homolog sequence=SeqID_1349
MDHSELIAELPEIERMTAQERIALARDRRRLQLRRNDERERALPPPRPRRQRLHFAAEVELLEATCRADYAEVERLLNDNANPNLHNDDGLTPLHQCAIDDNQQIMLLLLERGANVNAQDTEQWTPLHAAACCAHINIVKILIQAGANLLAVNAEGNMPYDICDHEETLDVIESEMAARGITQSYIDEMRGAPEKAMLDDMKMLHQQGRELDARAPDGSTYLHVASANGYYDVAAFLLTCSVSPLIRDNDFWQPVHAAACWAQPDLIELLCQYGGDIHAKTKNGETPMDLCEDMSTKQVISQLVQTEARRRRLAFGVRDSRRQSKKRKKFESPQQGATTGDNPFSARGAIRRQSLRDRSGLTPARIEAQKEGADILRTWSKEDVSADVHSSQGSLQHQRESPSKRVLKSSQNKQAKPMSPDEWLRKLETNADDDLDTTPKRSGSTRRRQKKVPGDMSDSRNGDVRRQKSTCCCVIC

SEQ ID NO: 255 - protein, 126 aa, Caenorhabditis elegans
  C elegans public gene name=T28D9.10
  genomic DNA homolog sequence=SeqID_335
  cDNA homolog sequence=SeqID_1448
MKLVRFLMKLSHETVNIELKNGTQVSGTIMGVDVAMNTHLRAVSMTVKNKEPVKLDTLSIRGNNIRYIILPDPLALDTLLIDDEPRKKARAARAGASRGRGRGGMRGGRGGRGRGRGGPRGGGPRR

SEQ ID NO: 256 - protein, 700 aa, Caenorhabditis elegans
  C elegans public gene name=Y56A3A.32
  genomic DNA homolog sequence=SeqID_340
MLLRAVGRQMTSVIFRQQTAVRSIAMSRVALGGGGHHHEPTPVYIPKPGSLDWTFFSRSHTKSAHEFEPYKPEIGAFIGAVAFIGLTLIAVVIKTDVFKKEDSHGHGHGHAKHSKKHEEKHEQKHEEKEHAEPEKKEEAKPEKPAEPKEPEPAQKQAEQPEQAEEKQETKDAEPKEQVDDRQTEEAVHARRAPAAAEEPAPSTSKADAVEEKRSEQQSMKPSESTEENTTTTSADGLLHCEYVIIGSGTAAYYASLSIRAKQAEAKVLMIGEEPELPYNRPPLSKELWWYGDETSATKLAYTPLSGKKRDIFYEVDGFFVSPEDLPKAVHGGVALLRGRKAVKICEEDKKVILEDGTTIGYDKLLIATGVRPKKEQVFEEASEEAKQKITYFHYPADFKRVERGLADKSVQKVTIIGNGLLASELSYSIKRKYGENVEVHQVFEEKYPAEDILPEHIAQKSIEAIRKGGVDVRAEQKVEGVRKCCKNVVLKLSDGSELRTDLVVVATGEEPNSEIIEASGLKIDEKLGGVRADKCLKVGENVWAAGAIATFEDGVLGARRVSSWENAQISGRLAGENMATAAADGKSEGKAFWYQPSFFTKFAPHLHINAIGKCDSSLETVSVHAEPDKDTPLEKAVVFYKSKEDGSIVGVLLLNVFGPSLDVARRIIDDRKKVDEYKEIAKLFPLYDPVKSDEDDAKSA

SEQ ID NO: 257 - protein, 413 aa, Caenorhabditis elegans
  C elegans public gene name=F55A11.2
  genomic DNA homolog sequence=SeqID_403
  cDNA homolog sequence=SeqID_1433
MSDFHNIRSRRRIPEASSYSTVDFDYDPDQKNHTSAVAPTSFAYSSLTTVFNASASQLWNSAQEALVSSYDTAEGTESIDADRSKVVETLESLSIFGNPLDHIIITMPSRDRTSEFRATAKSYEMKAAANGIRPQPKHEMLSESVQFNQLAKRIGKELSQTCAKMEKLAEYAKKKSCYEERSQIDHLSSIVKSDITGLNKQIGQLQEFSKRRAGNMKNQNSGHIQLVVVGLQSKLANVGKDYQSVLEISTETMKAEKNRRDKFSSGAAVPMGLPSSSSGANVRSKLLQDDEQHGSSSIALDMGALSNMQSQQTMQQRDSSLEYAQARSNTMATIEGSISELGQIFSQLASLVSEQGEMITRIDSNVEDTALNIDMAHSELVRYLQNISKNRWLMIQVFGVLMVFFVVFVLFLT

SEQ ID NO: 258 - protein, 114 aa, Caenorhabditis elegans
  C elegans public gene name=W09G12.5
  genomic DNA homolog sequence=SeqID_359
MQDNEPLMRELAKLIRVNEPDLVLFVGEALVGNEAVDQLVKFNEALANHASPGQKPRLIDGIVLTKFDTIDDKVGAAVSMTYITGQPIVFVGCGQTYSDLRNLNVGAVVHSLLN

SEQ ID NO: 259 - protein, 133 aa, Caenorhabditis elegans
  C elegans public gene name=R05D11.3
  genomic DNA homolog sequence=SeqID_487
  cDNA homolog sequence=SeqID_1336
MSFNPDYESVAKAFIQHYYSKFDVGDGMSRAQGLSDLYDPENSYMTFEGQQAKGRDGILQKFTTLGFTKIQRAITVIDSQPLYDGSIQVMVLGQLKTDEDPINPFSQVFILRPNNQGSYFIGNEIFRLDLHNN

SEQ ID NO: 260 - protein, 645 aa, Caenorhabditis elegans
  C elegans public gene name=C18D1.1
  genomic DNA homolog sequence=SeqID_395
MANAVDMQQLLMSMDPSSANQFNMMNKGGACVMATSGGSASPTSSSGAPSSSSIMAETDEKDMFMPSQLIQNGLANNQLMSMILQQQSNQADSNIADAGHNNSGAEKNIIELLMSGNADLMKFATQFAQQAKSVDQEPEEQRESSPSPPPAVSLNSTLASMVFPTTSTATECSAASTTSSVDSAPSTVIVNGHSNSQSNTDDDDVTQQPSAKKQRTGDETPLTPTSNNQLMQSLLAQMGLSNPLHQQNQKQMKDESMMFSGLFPQGLAGIPLMFQSPLHQQFAGMQDFEPLSALSTPNKGSGVKRQYSSNNKNFCDICNKEVCNKYFLRTHMLKMHGIVIDENKTVIANIDTSIKEREGELTFRCDTCRTMFKTRNQLRQHRQDVHGVLPLSTPRNNPNKSSVPTTPNGANNNSGPNSASMSEEKCALCDKRVSPSMMMLHMAQDHFGAAAANGDLNQMMAILGQRNQSTEEKMSSNLLECTDCSYKTRDPKNLDLHMERHIKMSEAKGRGDEDEDVALQLTTEAALQMVVQNQNQYDGDSTAAALNLTFKNDGTKKEIEEEKATGNHERNSHTSGSISPSGSIPEGFGKNIGEKAFPTQSFLIKCNDDSGEFLTEFLAQLPVRSVIDGPRQLVFNLHPAPPTTS

SEQ ID NO: 261 - protein, 314 aa, Caenorhabditis elegans
  C elegans public gene name=M03F4.7
  genomic DNA homolog sequence=SeqID_360
MKVLLFVGLLAATALASHHSSDPSKDGEHFKGKEHDKKYDHEQFLGKDTAAEFDELTPEKSKEKLAKLVPKMDADSDGFIEENELKDHINFMQKRYVNNDVDRTWKNYKAEKIVDGKIKWEDYREMVYGSADGAGQELSPEYAKMIARDEKRWAVADYDSNGALDRTEYGCFMHPEDCDHMRDVVVAETVDDIDKNKDGSVDLDEYIGDMYRPDDYPELNGKEPDWVQSEREMFKEHRDKDGDGKLNQEEMRDWIMPVGFDHAEAEARHLVGIADDNKDGKLNLDEIVAHYDTFVGSQATDYGEQLQKHDPAEL

SEQ ID NO: 262 - protein, 479 aa, Caenorhabditis elegans
  C elegans public gene name=C09H10.3
  genomic DNA homolog sequence=SeqID_350
  cDNA homolog sequence=SeqID_1475
MASAAVSLGARLIGQNVPKVAVRGVVTSAQNANAQVKQEKTSFGNLKDSDRIFTNLYGRHDYRLKGAMARGDWHKTKEIILKGSDWILGELKTSGLRGRGGAGFPSGMKWGFMNKPFDGRPKYLVVNADEGEPGTCKDREIMRHDPHKLIEGCLIGGVAMGARAAYIYIRGEFYNEACILQEAINEAYKAGYLGKDCLGTGYNFDVFVHRGAGAYICGEETALIESLEGKQGKPRLKPPFPADIGLFGCPTTVTNVETVAVAPTICRRGGDWFASFGRERNRGTKLFCISGQVNNPCTVEEEMSVPLKDLIERHCGGVIGGWDNLLAIIPGGSSVPLMPKNVCDTVLMDFDALVAAQSGLGTAAVIVMNKQTDIVKCIARLSLFYKHESCGQCTPCREGCNWLNKMMWRFVDGKAKPSEIDMMWELSKQIEGHTICALGDAAAWPVQGLIRHFRPELERRMAEFHKQVLAEQGAKQISQ

SEQ ID NO: 263 - protein, 221 aa, Caenorhabditis elegans
  C elegans public gene name=C56C10.3
  genomic DNA homolog sequence=SeqID_354
MSLFGKIFGGRKQEAPSTPQESIQKLRETEEMLEKKQEFLEKKVIDEKQNAVKYGTKNKRMALQCLNRKRNFEKQLAHIDGVLSTIGYQREALENASTNAEVLNVMGTASKALKAAHNNMDIDQVHDLMEDIAEQQEVANEIAEAISNPVGFSTAVDDDDLMRELEALEQEELDKELLDARAPPVTLPDTPNIALPAVPASRPRAKEADKDLEDLESWANA

SEQ ID NO: 264 - protein, 4280 aa, Caenorhabditis elegans
  C elegans public gene name=H19M22.2
  genomic DNA homolog sequence=SeqID_339
MGLRSRGLLLLSLGICYLQLFTLANVALNSNVRVKRQSGTDSLLTVEWEGIQTGDHADSEVKGFLVEYRPERSGEWQLHPGIIPYKGPNHQYRVQIPKLPTGISYLVRIKVIGENNEVLVETPEIRAHNEIVSIKCENDDLTAPRYPQVTEVAQYSLAIKWDAPDCGSVGDYQVELTGVSAPFDIHRQTVTQPHVSVTNLLPGTFYSVKVRAADRSRNVGPWNSEVLEAKTKGDALPISNNIQLLYRTDSELRVSWQPFTDPRLQHYEVTAVEVDDDSRRVERRRVDPALNSFALTGLRPNTKYTIGVIAFVDHEPKQVYQIEAYTTSGGIESWEEKPQVVDQGKQQFAVHWKLPTTSITVSKFILEYRLPNETTWRTSEQKGVADESGDYSVALSQMNAPYYTVRIVAIDDQNKVVARTEELTVGEAAETSCIGSAGVPTNIRSADVDGQSIKLEWDVPRCDETHTPIDGYEYIVYEASQSAPVDGASYVGAPHVIIKGLKQNVDYTFKVRSRSVNGHSQWSKDVIIETAVAGSVRSGELGEPNQLLRVKRQAKHLIKDSLNIFKLRIVLSPPCSFLVWTPLTQHSQIISKFKLMYKEVSSSKWIKLIGGMDHFRCPPGIADPEDYCYQLKGLFFGVHYISSISYKLTNGEELPSSNPLHFTLVQLDGSAAPSNERVTLTQPRIEQSASRSVAYWSVVGDRAAVTEYQVDIRSTDERSWRAVEPSVQNEQSQTHYRLPLGQLNVASTYLVRVRALDSSRATVATSPSASFSVLCQVPSAPENVRLERVSEQLVRAAWDSSQESGDCQSYFFITGQQNGQAINQRVPGSDRSVDIAGSSQGDWRVQVRGVNTAGSGTPSRDAIFASSAQQSRRSKRSVCDPRTDFWCKGEFSNSPLREPDSGEALCSTPRVLAQENDLIVKWKSEGDGRGVYGYHVQFRNENSGWKTYGQLVPYVRDNMEYTQTLTGLERGHAYFIHVQVLDRNSYVMYTSAQSSAKSSCSPPTHTPSHLQVAAPDASHVRVQWALPPQSTWGCSDIQFEIQPEEPRGQPAVVLGSHQTSHIFNSAPNQMWSVKIRAINSAGHSAWTPAAQTKTPPGGELIIGPDVSYRQGKPIISWRSKENTNDLIESFVLEWKSTTESSWRQHRNPIPYNGWQRPYSVDLGELPQGHTYQVRIVAKDPNRGNAYTSPVVQVQTQSQCKAPRRAPADVQVSPLGPTQIRVQWAPLHESEWNCDRLWYIVKHSTPQNQGFKNLTNGENFVVFDSDPYTQWNFEVQAANPAGESQWSRAQSAQTQGVAPGAVANLRVQPIGPDSLQCSWQPPVNPNGRITQYEVTYQLISRGNCDNNQEAPRTITVNGPHFTITGLHPHSKYRVGVAAKSNVGAGERVSLEIQTDQAAPSGAPLYLRTEDIRPTDVSISWQAPPCLQTNGEITEYEYEVTAGDRRQTVQKTTENIRGTRAKIENLQPQTRYNVKVRAYTARGAGPWSTEVPFQTSAGQQNVQAPGFVKVLHTGADNAQLVWQSPYPNPGYVDKYKCRYAPSGTQQYQERQFPAVSPCQQRQIERQNLPQSPPGSRLHCGRIENLRPEQTYDFQVSAHVKDSGWGPYSPPERTKVTESAVQVLFVKKIGGSENSLHINWDVRPDDKNRVTAFRITVVPQDGSQRSQTFNVDRATYQYRIDNLRPRTTYNVTVSAATHKEMCGGTAAVMTTDAAALTALSTAPRVIAEEPTSITIEWESRNREAGGFIVEYRLEGGAWQQYARRIPAHPSQTTYTATVDGLPTNAVVDLRVRVVSQQNEQSNPSPEVRARTKCSPPTSPPQGVRVDAPSTNEVRVSWARPAKNTWMCDQMNVEISYRVGNQPEKVLTVPGDQTEYTFPAEPNQRWVVKLRATNQVGSSQWSPEQSITTRQGAPGSVRDLRVKALSPNEVHVQWLAPLVQRGTIVGYDISYRLKHRLACPEEEPRDVSRDFVTVYNHKDLDYTITGLLPYSLYEVRVRARTTELGPEETKEVSTEQQPPSSPPLNLESTYALERSLSFQWEPVDCSQRHGHVVNYEYEILGQDDWAKLERQIANTSDLRVTIDGLTPYTKYVMRVKAYNSIGGGPNTENLVVMTAKAQAPLPPQDLVVAQEGTSFFMVSWLPPYPPYGPHDAYKIRYQQIPSDDWKEVEKGIKDPLLQCPGESPRFCYNATGLDSGQQFKIQVATRIEGGSYGPWSSLVIANTLQVLPDAPRAIHLIEKTDHSLHIRWVPPIDPKGYVTQYRVSIVSLDDVNDKKRTHIVNHPTLTYLFEELNPETSYNISISAGTKQGFGREIWTRYTTDPFNIPVVGTMPTVTPDGANALDVQWNAVLDPKNRVKGYIIEIRNSDTPVWQEIGGVTNHDAGKSTYFKKLTGLDSDTLYFIRIKVVDQRQRVGVPSPEAQARTGCAAPLSPPTNLNLASPSNVQVRVSWQAPNQNSWKCSAIRYKLEYINGTEGRKQIDLPSSSIEHLFDSKSNTKWTVRIRTENDAGSSEWSKELSITTSEGAPGPVEGLTAKPTGPTSIVARWKPPRDPNGVITGYTLTYQLKSIGECGPRSSTPIEKHVKNEEETLEGLLPDSTYEIHVVAHTSHAGPQSSVVTVTTEEAAPTGPPQNVRAGSVTSSRADITWTQPECEQRNGKITDYEYELWSMDTWADNSTGHNPTERLNLDQLIPYTQYQIRVRAINKEGDGPFSEWVPFTTSATNPPAPSDLQEEATFPHAIEISWLPPTPPHGNIDFYKVRYTPSGEANYREIRVETDRLECSDSNKKDRLCYRLSDLDPEQEYDIQVSAHTEGGGWSEWSDELTSRTQQQNIPVLERELEVTDKTSNSISLKWEGLPQDQATHVVGYVLEFKSEDDNAEWQEYNGVVKHRKTSSDYKITVKQLETATLYFFRLRVVGKNDKRGQPGPETKETTSCGKPEAPPESLKLESLDFETLKITWTPPEESTWRCDNVEYLIDFVNTTSRGNWTVSTDAPSELIVPTQPGTKWDVKIRTQTVEDSGKPQASRWSDRVSITTQSLPGEIFVTVEPKGPREALVTWELPDKDQKWNYGVDITYKLKQLGGCNEVQTGAKEPVTLLNVQEKQIPLENLQPGSLYEVSVTPRRPPSLHSSIVTPKTVRTFRTKNDVPTGPPQNLQSTVRKDSELGFKWDAPECIQQNGNITQYEFELVGLDEWNEGTREGVTPRQNTLIDQLQPGSLYRIKVRAYTAEGPGPWSDSLEIRTTGSELGPPRELTAVQTKATQIQLTWLPPYPEKAIVTAYRIRYSPRADDSNPTEVELSGDDLTCSGYKSPIITSANLCATIKGLQPSTTYRFAVQGQSSSGNWGEWSSDYFSTTRNDDNELLGGSLKLLSAGHDNLKVKWTPPAVIGEKIDKYDIFISVASVLDQNPKKFDVNGQTTDYHFRHLDSVTQYNVTVQGTSEGNKLWFISSVFSTTDFAEGLLNWLPAPTDLHLIEKSDTMLHVDWVPPEIFDPEQRELITHHRVTIAPFDPTTGKTGPSKNYTVPYPGNSIKFEGLRPETIYNITVQAGTNSGYGHILWGTYSTLAPGQRHILRLLNRTPTTLNVAWEPVWGRSHSGYTLTARTLYSVYGNVRLQQIKTFDVDASETEFVIRGLHPSTVYNVTLTPKDHNEVAWGAYATLPPGWFVVKNLKQCDKTDFAVSMSWEPVELDMASDYQVRYLRLKEHDGIWTEEEARPAKELLCPKDGCGRLCYLVFNLPHNPTEYVFQVRAKVDGEWNHWKSAPKKMTSSEPLSIRRSCCIVPPPYFVDNIGAPGTFWEVDVNPAATENNVTRYYVVVDERDPPGDTNWTELTDKVTANKMKIPYYVAASFNLETLPEPRKVRIGDGSVIGGYLNYPLVKGKKYNYEVYTIWNVTGAPLVGRLRDSNSWGWLFNRILLQWILLPLAAILLLICLIWCISKFCKDRYRSSKEHSRLVTNGQHAPLLEEQKAGMNENMRQLETRLDKMRGAVDGRARGDFEDGYMKGYKDANKLGSAHAARRRLDDDYGTRDDRFHEGYVKGLKDAGMTGMTTSMHNLAQRTGGGYSAGFAQGYKDGNSGIFGDRVTPSLISRLDEQYAGQEDFKQGYVDGFKEGASSRVGERSRFEDSRKLQQSLTELTERLTSLEKTKGDEIHSTKIYHVYNQQPEGATMSSTGAQLAQELEEIGSTSRRSTLRRHYTPGDYLKQDAEEGYNSLSRNRRSLSASALAANREDKSGKWAEQLIDLVSEPLDTTIARINNYTSSSNDRGQGDVVEEKYHRSYKEEHSSR

SEQ ID NO: 265 - protein, 365 aa, Caenorhabditis elegans
  C elegans public gene name=C41D11.2
  cDNA homolog sequence=SeqID_1405
MSTAVTITAPSVKHILLDSLVVMKIVKHVDSELHAGISEVSGDACAGVLTGLVFLEDSRLEITNCFPTVRNEPVMDDDANAAQQYEEQKQHEMLDMLRKFRTMNIDYEIVGFYQSHQFGAGFSHDLVESMFDYQAMGPENVVLIYDPIKTRQGQLSLRAWRLSTAALDLASKNDWRPELVKAAGLTYQNMFEELPIIIKSSYLNNVLMSELSLAKSCSSDKYSTRHFDLGSKKSLEKSVRAMMANVDELNKSIQSLTKYTIDKQRHDNMVFSLTQKRQQENESRVARGDPTIPMDDIKRIKAPQLQTRNGLLDELLASFDTNALADFSKTVTSENITKMFIAEAVAEEKVAGTKDRTLSSVSSTR

SEQ ID NO: 266 - protein, 132 aa, Caenorhabditis elegans
  C elegans public gene name=F26E4.9
  genomic DNA homolog sequence=SeqID_494
  cDNA homolog sequence=SeqID_1407
MAQLAKTAVAALSKKLVAPAAVARRTLATEASPEDYGYYPDPLEHATGREKKMLLARLAGDDRYEPKVYYRAEASTKQKPNLVPSHYDFRIIGCMCEQDSGHVNFMTIRKGDPKRCECGHWFKGVDADPESI

SEQ ID NO: 267 - protein, 798 aa, Caenorhabditis elegans
  C elegans public gene name=F37E3.1
  genomic DNA homolog sequence=SeqID_496
MSRRRQFDDEDEVQMKRRRGAPLIEDVEKKLQGVIGKVGENTGSSIECNLDKLTAFLHDDLEKYRASIIDIIAGCAIYLPNRVTVYTTLVGLLNSKNFNFGGDVVEKLISEQQDLLSKQKYQEAQNLAIFLCDLGNSGVLTAQSIGEYLESFIAAAFEENMPQVRNDYYIQTVLRCLPWIGKELTEKAPEQMENIGEAIGKYLELRNKNHVALLQVWREGSTDQKQEDYLESLSAQIEALRNADWVENHIPRHYSGFETTLQDALQHNLPSFQSPEHTSDMIYPYPLVVFRLFQDADCSAFSSKPLPGDSSIDRFLFEGEIAWIIEKNQFNRKACARELLAFAEENPSVPIGFLIFETIFGQMLRLPHAPYPAIFHCSLVLELLKLKPDDYPQILVQTVECIYRRADSMQPVCIDRMVDWFSFHLSNFQYRYTWTDWKDCLNKDAFSGSQIFVREVIEKCRRFGSYEKIIAALPQDFVKIHPCSPEVRYLIDEEDTALVQRAETFTQMFQERQPAEAFLNELKSNDENDELPYNINEFGLFVMVMLKMASKTYSHNFSALFRYQTTLKTVCDASELYQEKLLETLYSCWKTNQQMLMILTDKLLKMQVIDCSAVVGWLFDEKMWQEHDRQWLFEVLNQALEKLTRQINVVEKDIKELTEKTENKIKEEDDEESDIKMDEDETKEEKFKQDLEDLENNKEKLERMVTFQKGLFNDFLIAFIEEIKNAATSNTSEMDGSGDTPGTQTPKFMWLRGRFCHVLLAHAETLLKHSSNIADEVFSEGTDPSIIECFNQFQSLRL

SEQ ID NO: 268 - protein, 1126 aa, Caenorhabditis elegans
  C elegans public gene name=F12F6.6
  genomic DNA homolog sequence=SeqID_408
MSYQPPPNGQMPGYPQQQFNQQPQFQSNGFPPPAAPQKPAQVPGGFPPPHQQPNGQYQNGGLNGNSSHLAQSVNNMSIGARSTPSAQPPNPYQPAGYPGAPPQQLQQVQRQQTPQQFAAVPQSVQAPSATPAGPLQAMQQAPAPTPGIPQMNQGAHLPPQPHQIHQPTPLRPQIPGFPQAGGSPSSFQAGAPTSQNVQGYPGGPSSAPSAYPGAPQVPQAPNSFIPPGTGGFPPGQPTAGSFPPGPQVPGSYPSGPADIPQGPGMPRAFPPGASAPVAPGMPGAFPPGQGGPGMPGSFPPGAPGPGGPGMPGSFAPGAPGPGGPGGYPSGGPGMPGMQGGYPGGPPQQRQQRLDPNMMPSAVQVIDDDSSTRSGIFPTGYPNAELPPLVSTNSFAQDQGNCNPKFMRSTLYTAPQTNDILKASQIPLAVVISPFASLTEYEKEPPVVDLGPQGPIRCQRCKAYICPFMEFQDGGRSFRCPFCHARTSVEDAYFAHLDHTGRRTDIEMRPELCLGAYDLVATKQYCKNGIAPKEPAFIFMIDVSYNAISNGMLPILCQNLEKVLRNLPRESGQLESSMRIGLATFDQAVHFFDISSASPKMLVMSDVQEPFVPMVDGLLLPYNEALPGLRAALAEIPKLFSQSKTTETILQPVVQAGLDALKCADRAGKVILFSTVLPTYDAPGKLKSKNDRSLLGTDKEKNALVPQEDSYTKLGEQCVKSGVTVDLFLFPNAFIDVATIGQLSAVTGGSIFKFQYFSADKDGVRMLNELERHVSKKIAFDCMARVRTSTGIRPITFTGSFYMENSTDLELATLDESKAFITEIKHDDSLKDPASFIQTAVLYTSMTGQRRLRILNLCLPVTADYNQVYRLADPEALTAFMLKQAVQLNRDKGSSEMRESLSSRCAQFLATYREKCSEGAPLGQLILPESLKLMPLYVNSILKNDAISGGSEMTVDDKVWQMELIRGLRTENVMPLIYPRVMPISDLQINDTEEMKDLPKPVRASSEFLENSKAYIIDNGVILFVWVGSACPQTWVQDVFGVGATNQIDTESGTIPEKDNGHSRALRRAIQLLPRGIRERKTFVVVEKSGLEPWMKKFLVEDKAGPANMSYVDYLVDIHRKIRDLIS

SEQ ID NO: 269 - protein, 180 aa, Caenorhabditis elegans
  C elegans public gene name=R09B3.4
  cDNA homolog sequence=SeqID_1409
MFNLQKRINGNNEDGRYLETRIAVRDKLLAQELQQLETALRDQKQKLWHLEVPSTSCLHELELTVTPQEGIYRGGKFRFKITVPPEYNNVPPVVKCLTKVWHPNINEDGSICLSILRQNSLDQYGWRPTRNLTDVVHGLVSLFNDLMDFNDALNIQAAQMWSQNRESFNHRVREYISRYC

SEQ ID NO: 270 - protein, 195 aa, Caenorhabditis elegans
  C elegans public gene name=Y65B4BR.5
  genomic DNA homolog sequence=SeqID_425
  cDNA homolog sequence=SeqID_1348
MTGSTETRQKEVKEPQVDVSDDSDNEAVEQELTEEQRRVAEAAGLGDHIDKQAKQSRSEKKARKLFSKLGLKQVTGVSRVCIRKSKNILFVINKPDVFKSPGSDTYIIFGEAKIEDLTQHAQMSAIENLKPTREAPQLKTVEEDENEDVEEDSTGIEEKDIELVISQANTTRNKAIRALKEADNDIVNAIMSLTM

SEQ ID NO: 271 - protein, 386 aa, Caenorhabditis elegans
  C elegans public gene name=R07E5.10
  genomic DNA homolog sequence=SeqID_329
MQTDIHDEPVNLGFGVQFEPDDLYRLRSQFLPLGKIGGKPSWLNPKNLPKSADLLCNVCEKPLCFLMQVSANGGINDPPHAFHRSLFLFVCRNPSCSRTNDAANLKAFRCQLPRANDYYSFDGPMDPDLDGDVADPRAPADGPGLCRICGCSAAKKCAKCQVARYCSQAHQVIDWPAHKLECAKAATDGSITDEPKNPRNAFCFKEFGVEIDQEYMPANLFDGLSDDEGDEEEEEGNDEDETEEEKKARIREFEKFVKENKGKNADMTKEDLDEATAEQPKDIDFDKFNRLVNLQPDQIIRYKRYGQPLRATGLSELPEVVEPCELCGAPRRFEMQLMPHLLSLIDVDAIGQSIDWASVYVYTCSASCQIADDGYAKEFVAKQDFL

SEQ ID NO: 272 - protein, 928 aa, Caenorhabditis elegans
  C elegans public gene name=F32H2.1
  genomic DNA homolog sequence=SeqID_498
MSDLVMFEPGASTSTDVPTNTDQTAMSTTQVVDALECDTFEGLMNVNETYVEILDSALLSVQQHLDDNLKRQQQLKEEYRLYNRADITKRKVPVHLYMPPYFKDDNNMYPPMSSEAREKQVLKWFDPMMKEEKKWTPSEIKTLRTSVKNALVAHQVQPWCSRRDIVASKLRDADITTSNFDRRQWTMELEDLMRKIAYVREKSEEEVLTASADYTVVPWTAIANFDFKGSRTEWAVKSKWYNELNPKWNKEHWSNEEVEKLKYLRESPKFVSWPMLALNLGTNRTSYQCMEKYKTEVSQHSKEWSQDEDTKLIALTKITSINGHIQWDKVAQCMPGRTRQQVRTRFSHTLDASVKHGRWTDQEDVLLVCAVSRYGAKDWAKVAQAVQNRNDSQCRERWTNVLNRSAHVNERFTLVEDEQLLYAVKVFGKGNWAKCQMLLPKKTSRQLRRRYLQLIAAKLRLAAGFCNAVDAMKSGRRAPEEDELEQEDIVEAEQIPNELMKEVYEKFANENPDMNETPEEFYKRVSALERPAAARIRALKNKPDYQKIQDKINEIVQKHKNAAEIDKELHSSEILSSLTITEVDVRYMIERSKTLTRYYEARQFRKNVDQIGCRVRPIKIDLDPETMPTFDPNDAEDEKQMVIVESLCSVIRAHDVKEWGTKFWNEHRFTAPKYAKRFVENMVINKSKEVAEWYLHVNSKSCNQNDVHCPAKSTLPPTAASFDLHKMLQKARSGLNRLSAEHFYPLDVSLAQQFNFKNDEREGLDGDRRMHIGLSDEVTNSKEYANFYARMRSILLEPMRLGIARESSSDETKRLVRCLAEERACDEEQQVTCDQIRRRRMPDDEIYVTPTSISRELNNGMKIDTTELLANLDKNSAKKIRMKRKIGETVATVAARPARPPRSSAGTPTPSHVSIDTESNISLKVELD

SEQ ID NO: 273 - protein, 918 aa, Caenorhabditis elegans
  C elegans public gene name=ZC513.4
  genomic DNA homolog sequence=SeqID_480
  cDNA homolog sequence=SeqID_1418
MVLPPPNVTGKLHLGHALTVAVEDAICRHQRNQGNKAEWIPGFDHAGIATQVVVEKILAKNGKRRLEMTREEFVKECHLWGEKCSSEIRQQLTRMGASLDWTQSYYTLDSKFSEAVTKAFCILEQEDLITRGKRLVHWCPTLSSTLSSQEVNRIDVPSDGYINLSSSSGTRRRVKFGQMHVIRYNLVDSESEFIEVGTTRPETLFADVAVAVHPEDDRYSKFHGKHVWSPVTPGRKLFVITDSAVSVEKGTGAVKITPSHDALDYEIWNRWILNAGQNTIEEFACIDAEGKMTNSGEDFDGMDRFEAREKVIQKLSELGNYNGLMKHEGAQVNICSRTGDIIEPRLTEQWFLDCKDMFARSADAIKSGKIEVFPEYQSHRLADWFENQEPWCLSRQLWWGHRIPAYNVPGQSKWMVTTDEEEARRELGDKMQQDPDVLDTWFSSALVPLVKNGWLEGAPIQTPSLNVMETGWDISGFWVARMIALNMKLSSGETPFGKVVLHGLVRDNEGRKMSKSLGNVIDPLDVLDGITFEKMIERVKSSAHEKEEIDNAVKDLTKRFPNGISRCGPDALRFALLKYDVLSTDIPIDVSNAAIEGLHFCNKIWNLAAYYDQLAEKCEVIKDVDSDRLVDEWIMARLSTTVSTVDAHMNKFSLHLALSTLHKFITSDICDIYLESTKKALWNNDIARIREARSILQRVLQPTLVQLNAFMPFVSEYIYERIFKRETGSILFDVVKPSLFIFHRNEELEEAMKLITAMMAAIRSTRQTLQLPQRITFSGILEMAPTDTSPSELRILADEVTQTCGFELQKVCREVDEDIKKDHMACPVPGHDAKLWMRIDADCKEMFILSLKRQLEKTKTRQEQFQARIASYEAICENPNSKPSNVTKTKRKAENARKVVENAKEEAERIKQLILNQS

SEQ ID NO: 274 - protein, 654 aa, Caenorhabditis elegans
  C elegans public gene name=C27A2.6
  genomic DNA homolog sequence=SeqID_402
  cDNA homolog sequence=SeqID_1404
MTDSPSPIDSSFDASDVATPCTVIAAKISLRNRNGLEEDQENLDSFDAFTETHETQESKNIAHGEHEEDVSNIYVDDFSKEFGDTVSSVMEPLPKPLTFARTITKVYCHLDDQEHPYMVEVHVPPDCITLRDVKRKLMRTNFKYYCIALDPDTGLEVKAEVRDDSRRLYPLKNGRFELYLLTVEGSVHSDTSSGRHRRKQDGSSKGSSGSREYLRAAHHYDNPTPFSDDESQASSLPTYVKKAHAYNRKHAPQAYERHLPHMKHNNRHNHHRQNHYEESTFDVTTESDDHYRDGVTYYDEDEDDSRSINTDLTSVSQVHLKQKWRQQQKEMRNKWKRMPSISTASSSFSSITESSMGLEVITVRLNLETIPLGMTPSGHTNARGDAGLYVGDIQDRGAVALDGRIDIGDMIVGINEISLGNYSNKEAVQLLREAVQRQYLTLTIAKTGDPKQNAFPRNPRAEPIRPIDPNEWVKHATNAMKAMPSISEGSGLDIKDRYWFKIPIPMSFLGTDLVEWLVKHVQGLETKKKAREFAEEMLKLGYIRPGVGKQSFTKECYYVMGDECADYTQLRGPDGGYKYPQSHASSASGHSSNNLIFPPSMYPPQPPTAGAVQSSKFEGREMIREVKRVGVVEEAREGTSNYHGSLHHSAVGLV

SEQ ID NO: 275 - protein, 321 aa, Caenorhabditis elegans
  C elegans public gene name=Y110A7A.13
  cDNA homolog sequence=SeqID_1287
MVDESKLQCYHKGCGLLFDPKENDNEACTYHPGGPYFHDAYKIWTCCDKKSTDFGTWMNYKGCTRGKHSNEKPVDIVKVAAVKEIRPEKEEDVIVWKGLNKSGKLDSKDATKRIEQNLNVEVTPGATAAIEKKLKEISEAAQSADIQIGAPCRNNGCSTEFDGSKNKENCQHHPGAAIFHEGMKYWSCCNKKTSNFGAFLEQVGCTSGEHKFRNNEIVSKFREDWFSSNGFVTINVYCRGALPETANIVSDGHTVRVSMKHGFGNASVDLDYDLWDEVIPEESRVVIGERKVEISLKQKHGTGWPRLKFDPELDAKNDEEA

SEQ ID NO: 276 - protein, 566 aa, Caenorhabditis elegans
  C elegans public gene name=T08G11.4
  cDNA homolog sequence=SeqID_1401
MSSESVSEEQSDYQWPWCLMGHFGIQFLETDNSESFVEGDLSRAYIKDYELLKASKRPREEKSPEKLLQEEMDEISLKEIDTEPNGEEKLLDERDTPYEVLPKWTCDKRKMKKKKEKGRYNYRSFEEYWDVSSYWLHQITWLNDFGNQMTEENRNELTKQCEVMKPIYPIDQHKDILENPDYQQITKTMIEKNPESTFEDIYTKHCKLIKKQSENDFHDFQTKFVANRCKDMLSRIKRLGYAPGFEESQLPVFHSGAEQEIERPIIKDIRYTIDESYSKKFCGADPRDETSDEPSTSEESQSADVSSAVISIKNPAEIRFNFDPETEQHLIASNAEKLYANDPEISKYYYQRYRLFSRLDQGIIMDREGWFSVTPEAIAEHIADRVVRNNVSVVVDAFTGVGGNAIQFALRGAHVIAIDMDPVRLKCARENARVYGVENYIDFICADFFDVAATWQADKKLAPKVDAVFLSPPWGGPSYLKAKEFDLATGCCPNGIDIFDVSLKICPNIAYFLPRNTKVSQLVELATKAKSRMEIEQSALNSKIKTITVYYGKLAYREELSNSSKT

SEQ ID NO: 277 - protein, 205 aa, Caenorhabditis elegans
  C elegans public gene name=C17E4.5
  genomic DNA homolog sequence=SeqID_383
MSDNDIIDDDVLNIEDMTGDDADLSAIEGDLNEIEEEQKKLKAIQNEMVGHMNLNTSSQSNSSQSLLTPEEKAEADAKSVYVGNVDYGATAEEIEQHFHGCGSVSRVTIQCDRFSGHPKGFAYVEFTEKEGMQNALAMTDSLLRGRQIKVDPKRTNKPGMSTTNRPPFRGRGGRGRGNVIVKYVYAGGFRPRGRGARRRPGFAPY

SEQ ID NO: 278 - protein, 333 aa, Caenorhabditis elegans
  C elegans public gene name=C15H11.9
  genomic DNA homolog sequence=SeqID_367
  cDNA homolog sequence=SeqID_1451
MADKSTEVEKAIDPIIDLGNLLFIDREPIQGDASEGLEERARKNTQLLFNNIWQLEQKRVEEAIIVTLPPATYRLPREKRLPEKKEPTKWEKYAAEKGIEKRKKDKKVFDEATKEWKPTYGYRRGNDDTKDWLIEIPDNAEDPNKDFFAERREKKKERVAKNDMQRMKNLARQMKTTVKSGPSTEKMIGVGVDAKEKSKQQVRFAVDRAKLATASAGKFQEGLKGEKANVKTGKKRKFEANEAPVSGEKERALQILQRMKSKKAKIVEEKAAAVAGPLREKKEKSERKGAKDQTRQKSQIHRQQWFKNKVDGKKKGTGGAGKKGANKAKARKG

SEQ ID NO: 279 - protein, 727 aa, Caenorhabditis elegans
  C elegans public gene name=T01C3.1
  cDNA homolog sequence=SeqID_1481
MDFLHSTKARKRYLRYPSSIYEELESKHYSMPAGETDDHDTWVTARFSPHLNQEHILYMGDDPGNIGIFDVRKFQDRSVPLEERQLYFFPAHDGAIMDVVGVPQKESQIVSISGDSTIRCWDLNQSTLDRKSQVFFGHEGSVRSICFAPDDPNVFVTGGRDFQVKIWDMRVSTVKKMEEDCRMATITYKTAHPKPSKVLTSGTPKSKAKAKTIEGYKVTSVLFLDEHHVASASENADSGIRVWDIRKPTRNGEGQPARILKVPTSNKKSYGVTCLTLDRFGNRLFASCTDSSIFEYSVPSESVSPKFLVSHQLRKSQTNKSITLWHSMSCASTTLPTHVLDQYTKNLELSVNSYTGATIHNFYTQVACSPVSDVIACGSEDSRAVVWDLQDQYNYMNDRKLPDDIDKRRTKLPRFSCDGHLKQVLNVGWSSRGTYFMSCDEGGVRIWSEPRNRCTWKLNDEDDTSYPTTSQELGLSYEKIKKFELKESDEAMSCFDSISLSPRQRADSSGLSGSPQKNRGSKRPIFESPLKSICTNSPKPLRLNRSPRAKMSKLSFSPPSPLQPTNSNNQDLVGYRTPRQIRNKKKKNNPFYNEHPTEGLPNFVYDTFVKKLIGESSKSDIEDSGKSLSKTGQKRIEDWWQTKGENVATVTRARLPSVSEFGESACSKVITEDERIALHSPRKLVLKSSSTQSPCPSNSKPKPIPMTPRKPMDKRPTSRNLLHYFKK

SEQ ID NO: 280 - protein, 487 aa, Caenorhabditis elegans
  C elegans public gene name=Y47D3B.1
  genomic DNA homolog sequence=SeqID_421
MWAMKNIGDTFLRKDINTRQIILGSFWRDEREQNVDGRFAVIHFLGDGRIEHPLYCFSIQANNRYLITKATVQRIHRGKRASSDICSWAGHIAECDLDVHALKEFKISTTPNVEDAMLITPELPLREPRHDMVVCMAPMYIYTDWEILVTGIELWLAMGATKIVVPVQSASNATYRILQEYERKGLVIIRTWPKWPIMSDTNPNGLVLSRGIEESHVNCLFFVKPWSDIVVFSDIDDFLLPLDPSTISPGDNLQILKNIFAEHPQAGSLLFEHRDVQFVPPNRQGDQSLTNFNFEFLRSSKNKMNCNVWRMKTRVVVNASRVDSVNMHETGIHRFGYVQTRVPCRQAHFYHLRHSHNTVPSPTPINMSPLADMLNKQWQTRVEGFTGMKDEVLNKTNTEYLEDFDRCMGAINDEHWTMKVSRCLTPHVCFSRLRREVDCVAVASEYEFYRSGKGYFMNPINVRIQKAEVNCESPVPPFTSGNHYFAP

SEQ ID NO: 281 - protein, 1650 aa, Caenorhabditis elegans
  C elegans public gene name=ZK430.1
  genomic DNA homolog sequence=SeqID_501
MATSLTSQLENLRTSAARHLTVEKRHVSLLFDRKEANKLSNETAHRIGVAGLEQMKRIDPVFDTEFANDLFSEERVDFVRSMLEKGANEELNKQIEKLLLELSPYLQHFACQQVLEFLIHTYQIYSFNAETLLLTFLPFHETKVYSRLLRILDFDWKRSKEWQFMQQFTKTETPIPFTSIARATLSSKHSIITCITDHIRHAVEIVGSDYLEIKHPILFNFHAKLLLSMFTDPEKVDEMMLAKLMPFIENGIKSPMKSFRYSAMVVISQLVLTVKLKDEVLNSMCKLLITKMRSDTAAASLSTLMVVFQQQNVQSLSKNTLKKLLRHEEGIDVWKILKELSERTDTTKFFNVLWKELIVLSKDAESEDNTLAIDVLIETIEDASILTGDQAGTILKLILQEGMDGNIFDNKKKLKSNIRAIGMRFAKQFDAIHAELKAKDKKTLKNVLKEYQIEDIVQFASEAVAATQSEESIEIISEEAPSSKKIKLTASEKAQKLAQSSEFAKREVFSGDPINKATEWLNGEKWDKVEWALNEMAQRGEKYFSRKVEDDVEQFVLEIVKVVGVGGVKQIDGGSVKAALAGANLNPQFVADLLTKFDGVSEIAPKRTKGAQKKNLVEKTFGTEESWEAFNQRVVFVLDLLNARQIIPSSEKVLAALFAVVKQVNSKSDVESSSYQQHLAVNAIRKILEHPEKTKIGASEVDMDCVIETMRSTHNHHLLRDCLRLIVAAAKHTPNSVVKHVMSVFTFMGNGMLRKDNELTLSIVEKTVESLFSTIINSSGQAVLTKQQQTEKLIELARLFAASAIDIPAHRRARIAQAIARAVQAENASTVVLVLVSSFCARWQRSSDAAAQEAMKRGSDQDAYDDLAIELLSALNPFEQLSSVLEMCEYVRRLGGDKPAKSTTTKKDLDTMIFDRTAQTLPRIRHFRYVVVTLISRIFSNRVLIERLAAYDDEELLKNALPLGKRLIECSVELDEFANKEANDQDGSDPQAQRYWVAFASRTEVVSEKLRHLLPGGVAARLIADVLQECVNDKKMSYKMCEKVLQLANIKLGHDRYLFADSGINEKELITLAQALNKFIVAETKSEEKMRMCQNSAYTLKLIAKNLPSQSESLVLADTMQRCVSIVSQYQKLDENLTGNVLLLAGELIRSHNMRSTIHHATSLLKTCLATVQECIARFSKPQYDSAASPGSSVAGGRGNRGHRIRQQSLGGNKFGSDTLLICSLTCIQRVYDQFASFVVESTGDVIIRYCRLIARFGDPSELLALNQPSSSTTAAFQGGSQTSGFGSKTGIHHRLSLIRRSLLSIELRVLPAHIVKTVGELKTEKKALSALFNLLTGYIETQHQQKPEILRKSVIQLRRTFVSDVITPTLIVRSQERQSDQFENVEKLEHTVFNFVISIASILSEVEFRTVVNELVAWAEPGLEAKADLAARLRLVSLLHFANDLYTSFNSLALPYFGRILEISALVLKKCNATLLLGTDELLLSGKRGSIEALETDLALTLAIDVISNAARHRDFFTVDRCQLVSDVIVNELVNTKVEGHEKRCSDHLVPAIYRIGNADPDSFPELLNKIMLKTRDSRAKIRYRALIVLELLIKEIGDGVQPHLSILLPFLNELIEDENKQVEAQCQKVINSLQHKFGETFWSGGSSA

SEQ ID NO: 282 - protein, 410 aa, Caenorhabditis elegans
  C elegans public gene name=T23D8.3
  cDNA homolog sequence=SeqID_1282
MGKRKAFIDKKASQSFRLVPDNRERSERFKPTQEHLEEQQKYGVYYDDDYDYLQHMRAVNEPMKLENVHEEVEKTTIKTSGSSAFPPAPPLFGLVGALKKPEFFDEDVANALEEVTDDRNTGELEDNFITLAGGLLDERTTVYRSTRRGEDSEEEEDDDEDDEMYDDYNDDELFGEEAVGEIRVERADQRVIDNAFEELMDREYNTDQIGELDGDDYDVGGALEPNAGRLHKLINDKGPSNAEYDEELAKHYVRERMRLIEEGVIKDKEEYEIVEVDEGTNKKMKWDCESFATQYTNIYNHPTLIKEPRGLSRKALKRFDKAVEEMDIAEEDEDDDEDMEDDDDKESVFSTVSTFRPKNETPEQRSLRKKAVKEARKLRRVEKKANKTMFAEEKRKLAKGRIGQIKARPI

SEQ ID NO: 283 - protein, 130 aa, Caenorhabditis elegans
  C elegans public gene name=C27A2.2
  genomic DNA homolog sequence=SeqID_467
MVPKPHAKSAKKALRKKKVHLKFNVECKNPVEDGILRIEDLEAFLNEKIKVNGKTGHLAANNVKVEVAKSKVSVVSEVPFSKRYLKYLTKKYLKRNSLRDWLRVVAVNKNTYEVRYFHINDGEDAGSDHE

SEQ ID NO: 284 - protein, 277 aa, Caenorhabditis elegans
  C elegans public gene name=K02D10.5
  genomic DNA homolog sequence=SeqID_320
  cDNA homolog sequence=SeqID_1473
MSRNPFDDDYRPSAASSTMPVKSYTTMGHYSGEDEADYYEREIEKTLQESLDSTERSRRHLENSEKIGTSTAQQLLEQREKLENTEKNLDEIHRTTQMTQRNLNSLKSFFGGMFKNKFTKKPQEPTETPTVPQSKSASRLSETATNLSSGGGSATFSGPSGQRTLTESSRSAIKGTRWEAMDNQIDENLDMMSANLRNLQRLGADLGKEVDSQNEMLDRIQYKAERNDGIVRDQDKQMQKILGTGASTSQTTAESLTPSMDTSTKMSLMMKATSLWK

SEQ ID NO: 285 - protein, 122 aa, Caenorhabditis elegans
  C elegans public gene name=W01G7.3
  genomic DNA homolog sequence=SeqID_474
  cDNA homolog sequence=SeqID_1269
MNAPAAFESFLLLDDKKFYIEKDTKVPNAAIFTIMKEDHTLGNMLKIQLLKDPEVLFAGYKNPHPLEHKILLRIQTTNNTTPADALTTAITDLVGELSLLEHRIDAAIKKCTQSGDQERGYN

SEQ ID NO: 286 - protein, 89 aa, Caenorhabditis elegans
  C elegans public gene name=T26A5.9
  cDNA homolog sequence=SeqID_1461
MVDRKAVIKNADMSDDMQQDAIDCATQALEKYNIEKDIAAYIKKEFDKKYNPTWHCIVGRNFGSYVTHETKHFIYFYLGQVAILLFKSG

SEQ ID NO: 287 - protein, 622 aa, Caenorhabditis elegans
  C elegans public gene name=F55C5.8
  cDNA homolog sequence=SeqID_1470
MTNDVEMKSETEELPPFPTVHILQVVKDAQQQHGLRHGDYARYRKYCAAKLERMRKALKFTNSHNCQKKRKAKFVKKWLSVESVQNVQFLNFGIFESERRYAEAMIDKITLEDNPEKSRKKFSMINSLRKAVLHATNLEKIVQESERFDAPTKLEAQAYAAWMRGMCSFESRNWQKASESLKLAKTVYEKLAEATNNTTLSSIFKGRCREIQPQLRLCEFNIAESPGAVGTMTELMELRMQMGEGGDSSVDKLISEMRASATSAEVVTIEWGGAKSTVDDEKAKQVVQEWKQTEVELAQCQTPKEKMALFEKATADTRDAIDRISDIIRRKSSENADTTVLQSIKAYLEFLKMNGTASRYLAIIDNTKSEKKSKPQDLLRLYDSVIEIYKEVAEIPGADHDKNLIQAFEVKVEYYRAFRCFYMASSYSALHKYSEAAALFDRTVSRVQDAEGKLKKLKSSSFITNETQSSLNELRSEVESAKVTVRAARLASAAGDVKTDSELAKIIDKRPLLETVNEWRQWDVRNSLKDKKTIPVASLPPAFIPMPNKPIFFDLANFHLTMPNVDDRLEKLQKDRDATPKKAAKGSSAAAASSKTSNQEEEEQQGLTGMLSGWKKSFWGNK

SEQ ID NO: 288 - protein, 418 aa, Caenorhabditis elegans
  C elegans public gene name=C14A4.14
  genomic DNA homolog sequence=SeqID_373
  cDNA homolog sequence=SeqID_1458
MLQLKPRVSALTRLSAEVRSASQWIKASNSKTPDDINVEKLFVEKEVQKLLTDLTEIDLEHKVFRPRRTSIQQRSHFALMTEERLEKTRERMREEARRFLQFVPVKEPREESVQILAKDLELKDFDTSKFVFTDITFDATDQDRTVVVREPDGTLRTANPEEHDRMNRTYYQKPNRSVNPPPLFSDPNLQNALDKNDHEFVLDWACWFYEPDDPAYVRLSQLVFDRINESGKFHVVTSTRHFGPFTFYLALNDNIQKLLNYFGGLGRLSDCANLVRLQKAVRPDWRVTIAQGDSDEKIVKDFAKQNARFRDEIQDLLNFINNGKLKSDQEQTEHVRERFGVRVDKRKARITSANIRGADGPLGDLSSEYSVKVVKSEGSGREGGGGEENKKDEGGRGGGKGRWRSREKRSDDDGKKKE

SEQ ID NO: 289 - protein, 430 aa, Caenorhabditis elegans
  C elegans public gene name=B0035.11
  genomic DNA homolog sequence=SeqID_404
MSSSEGNSDASAPGTPVKSSTPSSRGSSPDSPKKQEPSKKRAILNESDDDDDSRPAPRQLSDSSDDNIHPRGGGEKSSPGAGGGLFGDLSGSSDDDSDREGKPKESNTRARLSDSDAESRGSLNDLQGIVMANPDEIDEDEKAKEHVHDTEMVTGRVTLEYAADPPHFVRMPNFLSVATHPFDPQHYEEDEDDEQAKLDDEGRTRLKLRVENTLRWRVRKDENGKEIRESNAKIVKWDDGTMSLYLGNEIFEVSLVPLNSNNLPHLYVKQPTLMSAQAVLTHRMTFRPHSTDSQTHRKVTLNMADRSRKNAQVKVMDDVGQNPEITRRENARKEEESLRAHIRRTQMVRNNFKVRGPRYAGQYSDDEDMPTSSRKGKKKEAPIIGASSESEDDHADTTKKSGSDSDSDEEYRKRKQQQKKQIVTSDEESD

SEQ ID NO: 290 - protein, 492 aa, Caenorhabditis elegans
  C elegans public gene name=T10F2.4
  genomic DNA homolog sequence=SeqID_352
  cDNA homolog sequence=SeqID_1400
MSFVCGISGELTEDPVVSQVSGHIFDRRLIVKFIAENGTDPISHGELSEDQLVSLKSGGTGSAPRNVSGTSIPSLLKMLQDEWDTVMLNSFSLRQQLQIARQELSHSLYQHDAACRVISRLSKELTAAREALSTLKPHTSAKVDDDVSIDESEDQQGLSEAILAKLEEKSKSLTAERKQRGKNLPEGLAKTEELAELKQTASHTGIHSTGTPGITALDIKGNLSLTGGIDKTVVLYDYEKEQVMQTFKGHNKKINAVVLHPDNITAISASADSHIRVWSATDSSSKAIIDVHQAPVTDISLNASGDYILSASDDSYWAFSDIRSGKSLCKVSVEPGSQIAVHSIEFHPDGLIFGTGAADAVVKIWDLKNQTVAAAFPGHTAAVRSIAFSENGYYLATGSEDGEVKLWDLRKLKNLKTFANEEKQPINSLSFDMTGTFLGIGGQKVQVLHVKSWSEVVSLSDHSGPVTGVRFGENARSLVTCSLDKSLRVFSF

SEQ ID NO: 291 - protein, 483 aa, Caenorhabditis elegans
  C elegans public gene name=W06E11.1
  cDNA homolog sequence=SeqID_1482
MEVDGASDDEQEQIIRKLVKKPEFLSDEEDDSVEDQVVWECDVVVCNSTPNTEMFSVSYPSSKRDAWDAKRFPIARYKKNVRLLEMRFMTDTQLGSYDKKKAELMYMDGDVPKKGHGIDALRANDEIYEGRAFIHDHPIVNAIGFFKNGEFFIHPLTGAFEMHRSIQGLNKKKKSDGKSGKSDEDSSGEEEDVKPSSAAVRVKFSRPETERQKKRREASALHREKKIASDMWIPMKVHLKDGDPVAEKIDGISQNGLLLDDPEASRMSIRALVNRAIICGVKEELVIESGKEHMLSKQRIDDLPDPNLQLKAHMVKSHVMKTSEMRRLIDPSAMSTDKMIAKLKECASLVQGVWVLDSNLMFKNLAPAHSNTAGKTDLYRAELWRNARDLALCLIDGGHRVTRLTLMTCFKLSERDSDEILSTFGVKCEATRSWRLRVERDAQFLEDPAMKKHVVEQKAKWVQKFNELEKSLQESPAKSPKKK

SEQ ID NO: 292 - protein, 690 aa, Caenorhabditis elegans
  C elegans public gene name=F57B10.1
  genomic DNA homolog sequence=SeqID_381
MDQDFDLDEGAGQFNLKTTLMMFTSNDSQNDDGIWSPGSPYQALEDPSFLDKHFVSDPDRYTADELYSALEKMDGKSDLIGMDDMDNDNCYSLSPPDSGSLPISPASTSPSSYHSSGGEDLMDCYPSIDILQQASEELLYSKDDDYEICSSGPLLAYTNANSVATSAVHQNQQQQQRRLNQAGFPHQNSNGLVRFKSSQPRVLNPASISLNAPSSSFNPQSTSSTPATSSSSSSSTNGGFVKSSTGERRKYPPLRLDEEEIKLCKKEGICLPDFFPLTKAEERDLKRIRRKIRNKRSAQTSRKRKQDYIEQLEDRVSESTKENQALKQQIERLSSENQSVISQLKKLQAQLGQNAKRTTQAGRCLAVFMLSACLLVSPQLSPLGNQDNQKVLECIEEACQPSATSMNSANSAQRAIAGVTAPSVVIPSGGPVMVSTNANRQMNRNAVLNHHNNSKYPASGNQNHHPIALEDLNHPPPTLQPKQSYQQQHQPSMYRRSDETIAMAMAKIGARKGSSTSSSSASSVASSTSTSSATSPIYRTSRTLGAFEDQCDASSDDSNCANMPSLVPMKMSAQPPKRKIVTMNGQPRVTYRAVPASSVNVEQAQYYKVPQQKVQYVTMDRPIKYEVLQLNDYIKMEEESTIRLPNSWSTAGPRLHPQVNASSRTVRPLTVATPVHYNGPSAKKIKTQMF

SEQ ID NO: 293 - protein, 573 aa, Caenorhabditis elegans
  C elegans public gene name=K09H9.6
  genomic DNA homolog sequence=SeqID_357
  cDNA homolog sequence=SeqID_1419
MKMKKGKKQRKSGAHNRGNVDALSQKDALYHQEKFVKKLQKQKFLENKEIELARQPHCLVIHRGDVGKYVKGLESDLRNLVEPNTAKNLKILKRNNIKDFIVNGAVLGVTNMMVLTSSDASLQLRMMRFSQGPTLSFKVKQYSLARHVVNCQKRPVATDKLFKSSPLVVMNGFGDGTQKHLSLVQTFIQNMFPSINVDTIQLGNLKRCLIVSYDEETDEIQMRHFAIRVVASGLNKSVKKLMQAEKTMGKNIPNLSTYKDISDYFLNPGQLSDSEFEGDQQEVELPQDISEGRGCGVGQKSNVRLHEIGPRLTLELVKIEEGIDEGEVLYHKHNAKTPDELIKLRAHMDKKKQMKKRREQESEQRVIRRLTIVKEQQDAEEAEVKAIRENAARKQAAATGQVEEVENQKEKDREIAMNRERDLKRANEEWGTSEASKRPRYEDSRGGFRGGFRGRGEDRGGFRGRGGDRGGFRGRDRDGGGFRGRSVDRGGFRGGGGDRGGFRGRSSDRGGDRGGFRGRSGDRDGGFRGGFGGRGGGGFRGGDRGGFRGRGGGGGFRGGRGGDRGGGFRGGRR

SEQ ID NO: 294 - protein, 870 aa, Caenorhabditis elegans
  C elegans public gene name=M04B2.1
  genomic DNA homolog sequence=SeqID_441
MVTADETVLATTTNTTSMSVEPTDPRSAGESSSDSEPDTIEQLKAEQREVMADAANGSEVNGNQENGKEEAASADVEVIEIDDTEESTDPSPDGSDENGDAASTSVPIEEEARKKDEGASEVTVASSEIEQDDDGDVMEITEEPNGKSEDTANGTVTEEVLDEEEPEPSVNGTTEIATEKEPEDSSMPVEQNGKGVKRPVECIELDDDDDDEIQEISTPAPAKKAKIDDVKATSVPEEDNNEQAQKRLLDKLEEYVKEQKDQPSSKSRKVLDTLLGAINAQVQKEPLSVRKLILDKVLVLPNTISFPPSQVCDLLIEHDPEMPLTKVINRMFGEERPKLSDSEKRERAQLKQHNPVPNMTKLLVDIGQDLVQEATYCDIVHAKNLPEVPKNLETYKQVAAQLKPVWETLKRKNEPYKLKMHRCDVCGFQTESKLVMSTHKENLHFTGSKFQCTMCKETDTSEQRMKDHYFETHLVIAKSEEKESKYPCAICEEDFNFKGVREQHYKQCKKDYIRIRNIMMPKQDDHLYINRWLWERPQLDPSILQQQQQAALQQAQQKKQQQLLHQQQAAQAAAAAQLLRKQQLQQQQQQQQARLREQQQAAQFRQVAQLLQQQSAQAQRAQQNQGNVNHNTLIAAMQASLRRGGQQGNSLAVSQLLQKQMAALKSQQGAQQLQAAVNSMRSQNSQKTPTHRSSKLVTTPSHATVGSSSAPTFVCEICDASVQEKEKYLQHLQTTHKQMVGKVLQDMSQGAPLACSRCRDRFWTYEGLERHLVMSHGLVTADLLLKAQKKEDGGRCKTCGKNYAFNMLQHLVADHQVKLCSAEIMYSCDVCAFKCSSYQTLEAHLTSNHPKGDKKTSTPAKKDDCITLDD

SEQ ID NO: 295 - protein, 139 aa, Caenorhabditis elegans
  C elegans public gene name=C53A5.1
  cDNA homolog sequence=SeqID_1483
MVVGKLFEAAKWTAETVKGAAVVVASPNAPIPATDLHPRMPARPWTAQEYLRMWSWRHCWKYLPIFRFYIYSGVILYGVYKFALPIKPRHMVQYSKGKEDHHHHEVEHWWGIRQKLADKEYFKKYNPLKKEGEVEVGHY

SEQ ID NO: 296 - protein, 477 aa, Caenorhabditis elegans
  C elegans public gene name=Y71F9AM.4
  cDNA homolog sequence=SeqID_1484
MLAECQYAYFAKRNLLLGPILESTLANLSGTHDDSTCRLTRDACTFMLRTCDDEYRLYRQFFVTRHTEERKLSTDGRISPAMSTITSVFTSAQSPQQVHPFETFSEQMCRTLYDMLRPRIVHNPHLETLAELCTMIKIEMIENRCSLQMVASILGDDASNDQNVSGLNPRAGFVSVMSELVGDIAERIVYRAGMYAQNDIAAYRPAAGDIAYPQMLQMIRKIENEQKEQQEKEPEEGSAPATAIDQHCLWYPTVRRTVMCLSKIFPCLDIGVFHSLARDMLFSCIDSLETASKAIMESPAPAKGWSKKLDAHLFVVKHLLILREQTAPYRQNVLSFRSDSLNTKDFSIDFSKFTNVLFDSKSKWFELSTDNALLELITTVPIEMREQEGDSRRVLDQQLRASTFRLAHEASLLMIRDLADWIEIAEDERMKEGFQLSGHPKLAAGVLKDVSAVAYRNVGTKFTEVNIYSNSTVLYII

SEQ ID NO: 297 - protein, 129 aa, Caenorhabditis elegans
  C elegans public gene name=T05H4.12
  cDNA homolog sequence=SeqID_1485
MFRAVQSVRSLSTTAACRQDLIQQTFVTKIREIAKNAGNLANSDPAVKKALQEELNRLATKFQLANADVVSKLPTNFEAAKVDSAVQSALEGQTLASLLEGVKKDHSEYVASRDAKKAEQAARNAALKQ

SEQ ID NO: 298 - protein, 366 aa, Caenorhabditis elegans
  C elegans public gene name=H43I07.2
  genomic DNA homolog sequence=SeqID_472
MVKKAAATSKQATYHSDEIEMKEEVVLNTYDECTDYVEYDDTKQFDINEYCDQIQVAMVNESDDGMTLEFDITRIEAPIANALRRVLIAEVPTMALEKIYLYQNTSVIQDEVLCHRLGLLPLRVDPRGFQFPKEKVVGINEKGVDCDEEPEGDPAKNLIFKINVSCTKNRNAVPTATDPKQLYHNSSVYSRAFEWVPIADQKTQFTEEAHPRMVSDDILVAKLRPGQEIEASCHAVKGIGRDHAKFSPVATASYRLLPTIRLNAEISGEAAERLKSVFSEGVIAIEKKGAKRIAVVKDARKDTCSRNVFRHEDLSKVVQLGKNKQHFIFSVESTGALKSSELVVEACKVMEIKCRSLRKQIEALIQ

SEQ ID NO: 299 - protein, 180 aa, Caenorhabditis elegans
  C elegans public gene name=F57H12.1
  genomic DNA homolog sequence=SeqID_392
  cDNA homolog sequence=SeqID_1403
MGLTISSLFNRLFGKRQVRILMVGLDAAGKTTILYKLKLGEIVTTIPTIGFNVETVEYKNISFTVWDVGGQDKIRPLWRHYFQNTQGLIFVVDSNDKERIEESREELHKMLNEDELRDATLLVFANKQDLPNAMTAAELTDKLGLHNLRSRQWYIQATCATQGHGLYEGLDWLSNQLSKT

SEQ ID NO: 300 - protein, 689 aa, Caenorhabditis elegans
  C elegans public gene name=C32F10.5
  genomic DNA homolog sequence=SeqID_321
MTELKFKGVYVEDIGHLTCGTLTLTENSINFIGDKGGKSVYITGTDVDKLKWQKLGNKPGLRVGLSDGGAHRFGGFLDDDLQKIQSFTSSNWSKSINQSNLFINGWNYGQADVKGKNIEFSWENEPIFEIPCTNVSNVIANKNEAILEFHQNEQSKVQLMEMRFHMPVDLENEEDTDKVEEFKKAVLAYAGLEAETEQPICLLTDILCTTPRGRYDIKVYPTSIALHGKTYDYKIPVKTINRLFLVPHKDGRQVYFVLSLNPPIRQGQTHYSYLIFEFGKDEEEDLELSLTDEQLDYFNGNLQREMTGPIYETISILFKSICNLKVTVPGRFLGSSGTPAIQCTHRQNLGLLYPMEKGFLFIQKPVMYIRFEEISSCHFARSDSGTVTRTFDFEIDLKTGSSLTFSAMDKEENNKLFDYLNKKEIKIRNSHRIDNKSAGYGSSDEDDIDPYKSTVKAEGREQDDDSDDESTDEDYDLDKDMKKQKNDKDSSEGSGSEPDDEYDSGSEKDASGTGESDPDEENIEPKKKESKEKKNKREKKEKPVKEKAVKKGKKTKDPNEPKRATTAYIIWFNANRNSMKEDGDTLGDVAKKAGAKWKSMSADDKKEWNDKAAQDKARYEAEMKEYKKNGGGVEKASGPSTKKSSDQSPGKQFKSKEHISDTDDSDDDEPLKAKKDESDAASESSGESD

SEQ ID NO: 301 - DNA, 2966 bp, Heterodera glycines
  genomic virtual cDNA Sequence=SeqID_587; coordinates=2743..2665 ,2621..2569,2320..2241,2171..2135,2094..2020,1976..1710,1667..1449 ,1403..1245,1199..984,922..852,768..570,527..396,347..198,143..48
  coding sequence=SeqID_839; coordinates=2743..2665,2621..2569 ,2320..2241,2171..2135,2094..2020,1976..1710,1667..1449,1403..1245 ,1199..984,922..852,768..570,527..396,347..198,143..48
  peptide sequence=SeqID_1079
cacaaaaagaaagtcaataaaatacaatatgtatgaaatgcaaatatttatttggcattgaaaattgggtatttggccattgctgtctcccaattcattttgcctttcaccaaatgcccgacaacttcaccaatttcactaacctataagcaataatacaaataaatgaatgactaggcaatcaattcaaaactcacagaaacacgaatttgttgcattgttggcgcatttcgcaaggtcacagtccacggctgcaactcagactcaaagtccaccgtaatgccaaatggtatgccaatttcgtcagttcgagcatagcgacgaccaatggaaccagaactgtcatcctaagtcaaacaaacaaattgaaaataaaaagcaaacaaactatttacaattttagaagagatttctcgagaggtcagttggtcccgaacagcaaagattattgggtcaagtcgctcattagaagaaatgggcaaaattgagcatttgatcggtgcaattaggggcggaagttcaagatactaaaaagttaaaccaaataagtgccgtctctgtcttcttacgcatcgcttttcgtccccctcacgttgccgaaaagaatgctccaacacagcgtaaaaaatacgaccaatcccaaaggaaggctcaatcaccgaaggagtcacttcttcaacatggacagtcttctcgaaacgcttaacttccaccattgacgagttcagctcaaaagtttttccctcgcgcaaagacaagcgatatttactgaaagggatttgattattattggttgagtcaattaaaaaatattatgttgtttaaatttgatctgatttgagtaaacaaacccattgcttttgatttcccgttccaattcctcgatctgtgcttcagttaaatcgtccaaagctgcaagaatctaagcacgaaagaagtgcctattcctttgaccttcctttaaactgaatgctaatgtgaacctgttttgaatcggatttgaattctttgcccagcaactgtttgtttggcactgcttcgaccacttcgatttgcttcggcgcgccgagtttcttctccgctacgagcttcactcccgatgccttttggtgctggtgcaagtcatagcaagctctgtccgcatttccaacacattcgatccatccgtaagaggtaaaacactccgcgtcccaacagtccttgaggaaacacggacagataaatgaaacaatatgattaacaacttgagcgtaatgggccatttcattggaaagatgttgccgaaagcgtagtttatcgggcgaaatgccaacagaaagaagaaacaaatgagttcgcgccatgtaataacccaaagtttcattgtttacgatacccaatttgactgcgtttccaattgaaatctgaaaaattagtaaaaacttaaaattggtattgtattagaaaaccttttggggattttttgattccatttgattgcaagcaggaaacaaagtaagttccaaatgtgcaattttctcgaatttgggatgtctcttgtcggtcgggtcaacaaagtgttcaatttcacacattgtaaactcccggacgcggataagtccttgtcgaggcgaaatttcgtttctaaagccagaaccgacttgggctgcagcaaaaggaagtcgtcccttaacagaaaaaataaaaaattacatcaaacaccaaaatacctggttaaattctaaaaggcgtttgaagttgataaagattccttgagccgtctcgggtctcagaaaggctcgctgatcacaggtaggtccaatttcagtgggaaacatcagattgaaagaaacgggttcggacaagtcaccgccggttaacggagatttgaaattgaatttcttaatgacttcgtgcaagtcatcacagctcatcccatcaagcataacaagcacattcataagttcggactttgctttttcatcagtttttttgtccttaaataaatttttagcaatgatggcttattttgcaatatacccgaatcaaagtttccacttgatttttaaccaagtgatcggctctaaaacaagcacccgtttgtttgtctttcacctaaataaatgaaatatcaagtcaatccagaacaacgaaccatccagtcgataaaccggtcaacatggccagaagctctgaaatctatgatttaatacccaataaaaaagtatgggtttaagcctaaaaatgaatggaaaagtcactttaagacgtattctggtgtaagtgaagtgcactcgacttccaacatgccttcctcgagaacaaaatgcgtgcgccaagcctaaattaaacaatcagattttgcccattgcaatataaacataacccataaaaatgaaagcccattaaaaaatccaaaaagaattttatgctttttttaagacctccaataggcgctttttgaaattattaacataaattttgatttttaatatttcaataagccgctttgcaaagtgctccgcctttctttaattcctggtccttttgtatatttttctacttattttagcgcctaccaaagaatacctgtatcatgttggcttttagtgcacaacccatcggaccgtaatcataaagtcctgttagaaacaaataaattaacaaaaacataataaaatgcaccagaaacgccgccataaattgcaaaactttggtcaaagaaaaaccggcgtttaagcaagtcttcaagtttgaatcggtcaataaaagtttccaccatagtcgcctcattggtcatggttatgggcttgttcaatttcttaattttctcaatattgttgagatgtaagtttagccttttggagaatcgattaagcgaattaatgcgaaagaaaacgcgagtaaaatgcatgcattaaaaagaaaaacaagcagtaatttggtaattaggcaggatattttgcgagcgagaatttgagtatcat

SEQ ID NO: 302 - DNA, 8155 bp, Heterodera glycines
  genomic virtual cDNA Sequence=SeqID_588; coordinates=251..539 ,1011..1226,1712..1880,2282..2355,3036..3201,3504..3611,3919..4127 ,4604..4703,4952..5067,5390..5514,5849..5992,6521..6589
  coding sequence=SeqID_849; coordinates=251..539,1011..1226,1712..1880, 2282..2355,3036..3201,3504..3611,3919..4127,4604..4703,4952..5067 ,5390..5514,5849..5992,6521..6589
  peptide sequence=SeqID_1087
catgcctgcaggtcatgtttttagttttttctttggggagggggtggcacaacattaagggattgggacggtgccgggatcgttactcaaaaaccatcaaaaaatacaacatttttttttggaaggcagcacaaatttagggagggcggggtgcagggacaccgttgtaagcgatacagtaaccttggtaaaatccattttcgaaacgattatggtaccaaacgccccccgcatttggcttccttcacaggtgttctgtgccatcaacgagctgggccaaaccaagcgtgtggatgaagcgctgtgtggccaaggcctggaggaaaagccggtggcacgagaggagtgcgtcaacgaggagaaatgcaccggcacatttttcaccagccagtggagcaactgtacggccaaatgcgacggtggcacacagacgcgtacagtagtctgcctgaactacgataaaaagccggtgccggaatggtgcgatgagaaggaaaagccggcggagcagcaggagtgcggcatggacaaatgccaaagtggggaaatggatttgaatatagtaataatttaatcattttaggcttatggagataatcctatcaccctgagttaatatgatttgtatgggttaattagctgatagcccagagttaattacgacagcgttcatttggacccacgcactaatcaatcgtccagagttaattacatcgtatggggttaattaattatttagattgtggtcaccaaacaataataatttatccaatcaccttgagttaattatattttatggttaatccatgtgtcatagaataataaatccaatttttcagagttaattatattaggcaggattaattaggctcatggtataatcaatcacccagggttaattagatagtacggagttcattaagcatttgggattcgtccgtcgtcctatcactttggaccaaaaagaaaagaaacgttcttgtttgacattgccttgccacacttcacagattgtaccgacagtgagttcggctgctgtccggacggcgagtcgttcgcctccggcccttacctcgagggctgctccaactgttcgtccgtggccgagtttggctgctgcgcggacaatgtgacggcgcgggaggacgctcagggcacaaattgtcctgaggcagcggccggcaaaaagggggtgacattcgacgaagcggagggcagcggggaggagccgaggtaagagccatggaaattttttaaatttttaattttaaagtttttttgatttcattggcttgacaaacctcggcttcggcttgggaaactcccgagtttttttgagcttcaaacttcgagctttggataaattactcgaagtttcgggaaaaattaacttcctaatgatgggctcaataactaagagaatgacacttttttctctaatttttcaaaaaattttgctgaaaatctggtaaccaatcacaatcatatttcaaaaaaatttaagtctaatcctgatcagaaagaattttaatcagttttgcattggtaaaaggcaaaaagcaattttttgggtccgatcatcgggctgatcacttcaatctaatcaatttgcattggtataaacgcatatatgatcaaagggaatcatttttgggtttccgatcagtcgggctgatcacttcaaatttgtgttacagtgacgctgaagaagcggcgccgccttccaaagaaatgtgcgcaattgaaactgtgggcaccaaggagaagctgcaaatcccatgcgcggaagcagccgccgtcacagaaacaatgaatgaaacggtgcaactgatcaaattggcgagcgccgatgaaacggcgccggaggccaaagaaacaaacgcaacggcgggagaagcggcgccggtggaaaagccttgctccaagacggagtgagtgtttttaaaaaaaattttattgactgggtccattactaattggcctaatttgttcgctaattgctttgacagcaccaatttggtttcgagagtgtcgagaaaatttttttttcgggagtttcttgaaaacttaattatgacagagcgcctcggttataattgttgaacagtcaattttattagagatcaatttaattctgtctggtcgaaaatggcgagatatttgaaaattcctaaaagttctcaaaatttatggaagaattcgcctcgagtttcgaaatgacaatggccaaaagcctgctcgagattctcctcaatcttttcttagtcaaatttgttttcagattcggctgctgcccggactggagcacaccagcggaagggcccaactatgcgggatgtcccaaatttgttcttggtgagtgtgtcggcaggcacatttaaatgggtgaacttcatttcaccccgccgtttccccccgtatcagttccccccccccgcatcgtttccccgccgagaaatttttgtattttgctaacttagaaatttttcaagaaaaaaatcttagaaagttttttcataaaaattctaagaaaaaaaattttcgagaaattctcagcgatttttggaaaatttttttgaaaaatcttagtaattcacctaaaaatttttcgaaaaatttttttttctagaatttcttatgaaaaaactttttaagatttttttcttgaaaaatttctgttagcaaaaattttttaaaaatttctcggggggaaacggcgcgggggaaacgagctgctccccatttaaataggtcacaaaggcacttacttaatttaaaagttaatcaatcattgttaattgttctccccgcccaattacaactttatggcaattagctaccccattagtgcattattcaataattatcccgccaaatgtccctaattgaatgatcattcttataaacaatccactttatccatgcataacaattactcttactttatgacaacctaatcggctattaacacctaattagtcgaatcgtagctcatttaaggcccaacaaccgaaatgcccatttctctgctttaggcaattgcaatggcaccaaatttggctgttgccctgatgaggtgtccatggcacgcgggccggactttgaaggttgtggtgagcccacctgtgccgcgtcaacatttggctgctgcaaagaccgacgcaccatcgcatttgggcctcactatgccggctgtgaccggtaaattttgagtcctccattttttcattgcagaaaaagcggcgcctttttcgtatctcagcgatacagtatttattgaaaataatgtaccgtaactgtactgtagttataataaatttaaagcattaattgatatgagaacaacttacagtaatttattattgtttacgggtttagactattttcaacatggaaaaaaatcttgaatcaattcctacgaattttgggactcgataaatttttaataattctcatacccagtaattagtcattcattaattagattaataaaatcactgcagttcgtccttcccttgtgagctgtcaacgtacggatgttgcgaggacggcgagacggctgcgctgggccccaacggcaccggatgtggtgccagctgcttgctgaccaagttcgtacggcacatttacagaaatgacaaggctgtcgagaatccgaggagtctatggatgagaatttcaagccttagatctctccctctttttttctttctctctctctcgccctctttctctctctatctttctctctctccctctttctccatttttctttctctctctctatctcctctttctctcctccccctctttcgctctctctctctcactctccctctcgcactctctcctctactcttttctattctcgacttatgctcccaaaaattctcgactgtaaaactcacgggatcacaggtttggctgctgcccggacggcaaaacgcatgcccaaggcgcgaacaatgagggctgcggctgtgagtacgcgcagtacgggtgctgcccggacgggcacaatgcggccaaggggcccggcttttacggatgcccggagagctgtgcgcaaagcaaatttggctgctgtccggacggcaaaacgattgcccgagggccgaacaaagagggtgagtcattgtaattagatgatggtataattatgccattaattagcagagggtgagtgattgagatattcattatccgtgtgctatattcgtatcctgttcttggcacattgaccgaattgtttaacattgatcagtgatcagaagtagaaagaaaatttagatactgagatcagactcattaggaaggttaggagctggaaataacacacagatcaatgagctgctgcgaaataccaaattattgcactgatcagaactgttaagctgatcaaacccgttatgatcaagaccaggcaatatttattactttggaatttcattaatcaaacagtctcagttgattacagttaatgcctcaaccatttgtcaaattttattttgatcaatagatctgtgtccgttcattttattctatgatcataatgatacaaaattgaaaatttaaaaaattattatttttttcattttcccaggctgtccatgtcagtacacgcgttggggctgctgcccggacggcgagacaaccgcgttgggcccgctcaacgaaggctgtgacgattgtcgttatgccaagtgagcattgccacacttttcatccccgttcccctctctactttatcaatcatccccgaaaataggggccccttttgggtataaggtaaattagtggtatttttgtggttctaccatactcctttgatttctaccgtactcctttggaaaattaccattttttggtggttctaccatactcctttagcaaattaccattacttttgtggcactaccgtactccctaatgtaccctctctgtgcatcaggtacggttgctgtttggacggcgtgtccaaagcgatcgggcccgactatgctgggtgcccgaccaccacgcccgcgccttacatgctcggcggtaccgtatcaccatcgtacattggtaagtaccactgatcaggcggctttctgccgactcttatcaattattttgataactttaatcaatcataggattttgattgctataatttcttatctctcttacaccgttttatcggtgttatcgatcaattcccatttcttgctgatcggtatagtattcgatcagttttaatcattgattgctctattccgaccgagatgctatattatcaattggcctgatcagtcactctggtcgaagtgatcgaaatctatttccctcctaatcaattctgatcagttttcaataaaaataaaatgaacaattatatcaaaatcagtgtcctgctcattgccgcaagaccagggccaagtgtgccattccggctaccagctggcgtggtattatgacatggtggagggcagctgctcacagttttggtacggcggctgtggcggaaacaacgtaataatgatgatcaagaaagaaattacacaaatcccccccccccccccgtatctctcccgcccccccaattcaagcaaaacaattttcaaaaatttatttagcgatcttttcaaattttatgatgaaatattaagtttttgcaaaaaaaaaactgttccaaaaaatagctaaaaaattttttaagttttttgtttaaaaaattttaaaaaaatttcgtggcgaggcagggaatgaagtgcacttgaaattaggtagaaaagccaaaattttagctccgaaaaactgagtcccagcagttcccccaaatttttgtgtctcaacccatttccagaaccgtttctccagcaaggagcagtgcgagcaaatttgtgtggagccaccacagattgggcgctgctatttgccacgcgtggaaggcccacagcgctgtgatcagttggcggcacgatattattacgactatttgacgcgacaggtgaaaaaatggcattgggtaattagcgttttaatgccaataattggcataatcgacaaaaaatcgcctatttttcgggttcacttctgagccgttttatgagcagggttgggaattttaggtgctgaattttcaaaaaagctaccaaaacaaatgctaaaagaagtgtcaaaatgggtgccaacctcataaccccccccccccctaagagatccgttttcgatttcgattgtgggtagaatttttagaaaaattaggtaccatttgggtccgatgatgccgataagcgttttttttattaatttttttattaaacatttttagtaaatggcaaaaataggtgccctagcttctccgtttgcattatttttcttatatttgcgtgacattagtcgtaatcattttaatttttatttatatttaataaattttggtaaaaaaataataaaaataaaaattcttaaaatatttttcaaaaaaaaagatagaaaaataatattttttaatgggaaaaaatgtgccattcagtgcgcggccttttggtggcgcggatgtcgcggcaatgccaacaactttggctcatgggaagagtgccaggtgagggcggacggaatcttgtgggtctctcccaaactaattatcgaatagtttgattctccaatttatctctcgaggcgtgtgattagccgatgagtcttggtctgatcgtaaaaagtcccattattgacgttttgataccaattagacccaagcaagtctaagcctaggcctagcctgaagcttcgcctaagcccaagcctaaagtcagtaacttttcttaaacaatcaaattaaataagctttggtatcatatgctagctttcagatcatgaagttatagcaatttttagacatttttggtaaaacttttttgaaaattgtttaaattttatgaaatttttcatgttgatagagaaatcccaagatctatcgcatgatactaagataatttaatttagttttgtttaagaaacgatatgacgaggtttggcacttttacggaacaccaagtatacggtgctctggtagcattttcgagaccaactgagcgctgacgccaattccgagactcaatttatgccacattataaatttgttctagagcttctgctcgtcggccgatgccagcaatgttgaagtgcagcaaccgccttaccaagccgcttccgcgccggcggtcgctgccgcggcgccaccgccaccgtcgccggttcatccccaggacattcaagcgcccccgccgtttacgcacgcgccacaaacggttgccattctgccggccggcgttgaagaaagtcagtaccatggtggggattttattgaacaatgaaatgtcatggctctaaataattgcttatttgtgttgtttggttgtgccgctttggcgatgcgtgaacttttacagtatgccttttggcgaaaatttgaaaatccgcgacaaatgaccgtatttagagttcggtaaaaatatgaggacacctttttgccgaacaaatgctacgatgcgaattttcaaagattttaactgggcttttgaatggtataaatgccaaaaatgccatattttaaaaaagagcttatgacgcatcgccatatttttttattttttgctttttggtgattaatttaagttaatgcttcttttttttgttttaatgcttttttgggttgataacaaatttaaaaaatgtacagctggtgaactgcaaaaagcgcccattttggacgaagaagcatgccgacagaatgtggacaggtgaggcccaaaacaatgtttgactcgatcagcaatcagaccaagtttcctgaattaatcactgatcagaagtcagtgatcagacattcttcaacgacttcctagatcagcgattagagttaatcactcatttccttctttaccattcaaaaaataataatttgatcagtgattagcgattattttcttcaaacggaaacgatctttctcttttccgaacatcccaatgatcggatttatataaaaatattattaaaaatcatttaaagtgcattttattttcagtggaacctgccagaactatgtggtgagtcacaattttgtttattggttaaaataactaattttttaaaatatttaattcaatt

SEQ ID NO: 303 - DNA, 4980 bp, Heterodera glycines
  genomic virtual cDNA Sequence=SeqID_589; coordinates=4845..4800 ,4292..4147,3933..3861,3811..3777,3377..3195,2799..2756,2290..2203 ,1964..1896,1771..1658,1578..1531,1088..967,724..659,360..261,91..20
  coding sequence=SeqID_881; coordinates=4845..4800,4292..4147 ,3933..3861,3811..3777,3377..3195,2799..2756,2290..2203,1964..1896 ,1771..1658,1578..1531,1088..967,724..659,360..261,91..20
  peptide sequence=SeqID_1111
attgtaaaatattttttacagctctctctgatgccagttcagtgttcaatgtttgtagctcgtgctccttttcttccaacaatcgttttgcctgcaaaattggtaccatattataagtatttgtatagtaatggctcaatctatcggtgcattttctccattcaaaaaagatgtttttagatttcgaaaaaaatcctctcctcattctttaaaaaaggaaatgattcgagggaatagtaagcggttccgcaagactccacctcattcaactcgtaaatttgatcttccaggcgccgaattcgcccttgtgctacttccaactcgcgctgcgcactttccatctcctctttcatggataaccttaattttgttttcatactatttttggctcgcattgtacgccggaaaaaagaagctgacaatgaaagttcatatctgatttgattatttataaactttttgaatatagcaaataattagcatccgttttccggatcagaggatgctttcaaattctgatgtgttcaattctccctcgccgtttcatgcaaaaaaacttcaacaaaaaaaaattcttaaatttataggaaaatcaaaagaaattttttttttgtaaattgttattataactcaaacacccatacataaacgtacgtacattttggcttcatattcatgttgtttctgttcagccgcttccctggcgcacatttctcgctgcagcctgtaaaaacaataaacagtttaatagagtaatactttgaggcaattacaaaaatgtgtaaaatttgaaatggaaacaatggggaggagctcagtgatcacgaatctgacatccccatttcagaatccctgatcagaatataaataaaaagttgaaaattcgactttttcgtcgatttaaggtaattaaagtgtcaataatatttctaatgagttttgttgaattttgctccttgaacgtgccgttcttgctccaactgtcgctggatgcgctcctccttggcctgctgcttcatttgttgcacctcaatagagtcgggcttccttcgtcgcatgtacagctcgtggtttcccatgcacaacgcctgtccaaaaattaaattgaacaaaaaccaattttgtggagtgcaaaaaaaaatacatgaggatattaaagttagaatttttaatgaaattggggtaacctttccgttttgcgtgcacttcattcccccctcgtcgcccacccctcggaaaattaaaaaaactttcaaatttgaaatttttacacgaaagaaattcccaatgattttttgtaaaattttgaaaaaacttagtagttcatcataaaatcttgaaaaaagcgctgaaaattttttaaaatcttttttcttgaaattttctttctgaaacacgacaagtggaacaattttgcatagcgaataaagataatgattttgatcaaaacaaaaaattgagtaaaatcttatgtattattaaagaagcaatattgttgattgaatgaattaatagacaaattttccacaccaaaatgcgtttgttgatgcgaagtcgaggcgcataaaacacaaagtcctggaaacaaaaaaaaaacatttatttttttttaaagtaataaaattttgtactgtaacacaacaacaacaacaaccacctgtgcctttttgtcgaccggtttgatcacaaatttcttgtcgttgaaagaaatgttacgaatttcggaccatgggaagccgaccttcggattcaatttgtcattttgatcatactgaaaatggagttagcgggaatataaatgatgatacatttgaaacaaattttataaaaaataaaattacatattaaaacaaattaaatcattttcattaattatccaatgcaattttacttacaattgtcaatcccaatgcgtcaacacccaaaaacagttcactgcccttcttatttcgtatggaaaagtactgaaaaatgccataaaaattagaagagttcaagctcagcagccaattggaacgggtacttttcggcgctcaaaaaatcgtaattttatggatttttgggattgccgggcctagacaatttgaagccagtttaaccggggtgcactacttttggctccgtataagtccctcccccccccgcatccccccgtttcgttttcgccgaaaataccatttccatgtataaataaacacccacattcacgccatattggtccaagtcttgagcaatcttcaaatattccaacattgccgtctcacggttcatccccctgtggtctgtccaccttcaacaacacgtaaattacattcaataacaaaattccaacaccttacaatcaatattttttcgtgtatgatggaccttttttggttcgactgattatggtcaaaaattcgttaaaaaattaaaacggcttttctgataaaatccaaacacagagaaaacagatgtaatggatagcgcaaaactccgacttctgacatttttttttgggggggggggggggcgggagagttagaattccagctccggaattgttgagctcatatttcaccatttttatgggcccataatccaatttcagaaatttttttgaggaattccgacttccgcaatttttgaggcctcggaattccagtaagttacttgaagcttttgaatggatatctctcatttgagaatagaaaagcaaaatgacgacaaaaaaaaacggatactgtgaccgtgtagtatttgttgtaaaacataccaagtcatcacgcgattttcccattcggacatgttcattttgaactgaaaaattggcatatttttagtgaaaatttgattttgcaccagaaaaagttttgaatatacactgatcaattgagagtattgcaaaaatgtatcatgtcaaagtaaattttttaattttaccgaaatttgttacaatttcaaaaaatgatgttaaacttttttattgtttgggagcaggaggtgggcaagcccgaggcttggagaatagtttcttcgaaaaattcagtgttcgaattttcgagaaacaaacaaaacttcggtttataataattgtgagcaatcagccagtcagtcccattagggaattaatgactggtggtcggtctttcactgatcagactcaaatgattgattcgccttataaaattaggtaggccggattgatgtattgcctggttcaaaacacgctgtggaatcagccgatcattggcaagactgcccgagctgtgttcctccttactgtagtcaccgtattttgcctgcattgcgtatgagccgagaagcactgcttggtccggtggacagtacacttcgtcggtcaaaatcaggtccttcacttgcaggtaaaacagacgctgtaatgattgatggtggaaataacacactaatgaattactaggatctttcaaaatttttgaaaaaatcgctaaaaaactttccttcaatattttattcttgaatctggggacctttctttgttagcccaaaacattaaaaatacgatttttcgcatgtttatggccataaatttgtgtaatttgacgaagcttttgcaaatttaacaggctcacattatagaaaaccattggcgctttcgaatgataggcaaaattttttgattttgttacatctatgaaattaatgaagctgtcaatttgtcatgcaattgtttacggtcatgtaaacaaattcagaggcctcaaattaaaactcttttttatatgattatgtttttttacatataatcaacctacgagggtcacatcctggatgatttcttcagcaacatctataaaaaaaattgtgtaaaattttgacttaaatttcaatttttttaccctcagggtaaaattttgcacggaatttgaactgcaaagtctgctcctttttgatgtcctgtttcagtactttctgaaaaattcagcaagaattatacaataaatgttgcgggaggttttccattttttgtccatggcgctgaaaatttatgtcaattgaaaaattttttggccaaaagagcaaacaaaggctcttcgggtgccacccccgaaatttttttttctggttacgggcctggcggcggtgagtgggaatgatgtgggacccgctccaactccaacccaccttgttcagcttcagccaggaggaaaagcctttggtgtctgtgtattggagaccaaaataccaaatctcgcgcaaattgattgtcttgaccacctggtcgaacaactgcttgccagttgtcgatggcagaatggtaaattctaattcttaaatcattcaaatttatttgcgccgtaaggcattacggcatattttggcaactaattaaatccaaataacaataagttggatcagttcaactgttggctctattgcaatttacgcgtccaatcaatgactatcttcagtttctttggtgcttgaacgcgcaaacagcagttgagcgctaccagccaaattaatgtgtcaaatgcaaattcgtgtaaaataagtttttttttttgaaatttaaggtttttaaaaaaacttaattctgaaacaattattttgccaaatttgctttattgttagaacctatgctgaccaatttgaaaagattcaaaaataataataattaggtaatacattttagaaaattttacaaaaaaatatactggcgaagttcacatttaattgtcccataatgtcttttttaaaaaagatgtggatcggaactggaaattcggaattttaatcccttaagtattattttaattaattcttggaaacttcacctgcgtccattgttatgactcggacattcaatgctttggaagacatttttgatgacacttaagaattttacacaaaaatttttgaagctaaaaattgaaaatttttattttatgacgaattatgactttggaaaaggcggattgattttcacaaagcaattaacaaaatgcagcgagggga

SEQ ID NO: 304 - DNA, 2771 bp, Heterodera glycines
  genomic virtual cDNA Sequence=SeqID_590; coordinates=79..221 ,911..1045,1093..1184,1248..1410,1513..1656,2381..2523
  coding sequence=SeqID_892; coordinates=79..221,911..1045,1093..1184 ,1248..1410,1513..1656,2381..2485
  peptide sequence=SeqID_1122
aataaatcccattagaatgggttctcatttctaagggtgccttttctccgataaaaatgacaattccaacatgttcagtgccttatgacgaggactccgagaattcaaacattttctttcttgatgctgattttctggaggacatgtttgggatgttttacaaagtcgcggcacgtgaaagaattgtcggatggtatcactctgggccgcgtctttgcaaggtttgtttaatatatggtaatagttatttctaaacagattttgtccaaaaattactgaatttgcagtttttttcgtttccgacattttcggcccagacatttgagcctttgtccaaaatcgggttcaaaattgttttttcaatcgccgatcgcctaaatagctttaaataagcgattgaaagtgattgtatccgatcatttgatcttcaaagattttttgaaaaaataataaaattttcaaacaaccaaaattattgatcctaatgaaccaaaagacatgttttcttaattttaatgctgattaggctatcagggcaagaaaaaattcaactttgagtccgattttggacataggcgcaaatgtcggggctccgtttttttggctcacatttatttatgcagtgtatttttattatttcattattgcactaaaattaatgctttttcaattatggcatgacaaatttataagaaaaacattatcacagtatttctttctttccttgagcgctggcattcaatcgaaaactttttcacatattattaattagaaaattttatactctttccttgattatttttagaatccgaaaattttgaaaaaatcagcatatttgggaatactgatttatattcataccaaataaatgaaaacctgcaaatacacaatacgctcctctataattcagaatgacattctgatcaacgaagtcatcaaacgctttaccccgaaccccgtgctggtcataatccaagcttctcaaggccgacaggatttggcactgccgacggatgcttatgtggaagtccaggaagtgcacaatgtgtgttttgattgaatggtaacaacaagctgacaagtcaattttaggatggttctcccccggtgaaaacctttgaacacgttcccagtgaaatcggagcagaagaagcggaagaggtcggagtggagcacttgctcaggcatgttcatattgcatatttgtgctttggtagtaatttttaatgaccaaacgcaattttcagagacatcaaaaatcaaacagccggcaccctctcgcaacgaattgctaatcagttgacgggaattcgtggtctcgagaaccatttggctggttttacgagctatttgcatcgtgttgcgagtcgagaattgcccatcaaccacgctatcatatttctaatacaagtcgctgggaaattttgaaattgttcttttaaagccctacgttgtttttatattcctctgcttctcaaacacccatttcgttcttatgaatccctttcgcaggaaatgctcaatttgttgccggaggtcctctcaccggactttgtcgacgcgcacaatgtgcagacgaacgaccatttgatgtgcgtttacatcggttcgatggtgcggacgataatcgcattgcacaatctgatcgacaataaggtgaaggaagggggatgaagccgtggaagagaaacagaaaagcatatacatttactatagtcaacccccccccccccccaaaaacggaaaaattttccaaaaaatttcgctacgcccgaagggaggggtacccacccgcaaccccaaatcctgggaccgtccctggttcctcgagacgtatcgatttgtatataattgtagaacttaacctggacctggatccaggcctggtttttttttctggattcggcaaactggatttttgtccaggtcaaatacgaaaatccaggtcctggcaaaacacgaaggaaactggaattactggacagcattttagaatttattctttcaagtgaccgatgtttttttcaagttttcaaaaaatgattaattgatttaaaaaccgattattattgaaaatagatatttttagatgtttccaagtaattaattgattttttcaaaaaatttgttggctttttaaaagaaatttcaaaaaatccaggcctaggtccaggtctcgaggagcctggattttcctggatgtttgtccagaaaatctaggcccagctccaacatagagtccaggtcctggcttttttcaaaatcgagttcatataatttgtgccattttttctggggggctgactatagttcagccataaacgagaaagtttgtttaatggacagattaagagatatttttgctctcacaattaaacagttaacgctgcaaaaagtggcagaaaaaagtgcgaaggaaaagacggtcaaagagacggaaaagaatgaagcaaatgacaaagagattgtcaaaaacaccaaataattgtatgaccattttgctggaaaatattttaaatcattgacggacatttgttgtagcctgctgttttcattttcaatatataacgtaaagacacaaactgctggggagtgttatttttattaattagataattaaattgcgaaaattattttcatggttttattgtgtcttctggtttaattcatattaataaacctaattgtaagatctaagtgcattccggtgtcttttccatttatcttctttctgccggcaacgaaattttttcccagccccattcggtgga

SEQ ID NO: 305 - DNA, 3349 bp, Heterodera glycines
  genomic virtual cDNA Sequence=SeqID_591; coordinates=2461..2378 ,2330..2246,2203..2116,2069..1904,1860..1752,1520..1202,1159..1026 ,932..769,725..641,594..430,319..197,146..1
  coding sequence=SeqID_963; coordinates=2439..2378,2330..2246 ,2203..2116,2069..1904,1860..1752,1520..1202,1159..1026,932..769 ,725..641,594..430,319..197,146..1
  peptide sequence=SeqID_1181
ttgatgcttatgaagtttgcttggcactcgcgtgcaattgctttcgcaagcaaagtttttccacaaccaggcggaccgtagaagaggacaccgcgggatggttgcattccgaatttgaggaacatctctgggtgttcaaccgggtactagatttaacaaaaaattgcacgagccgtaaacagtttagcatgattacctggaccaattcctgtaattccctcttcacattttcaaggcctccaatgtcttcccaagtgacattcggagtctcaacgacggtttcacgcaacgcggacggactgtttttaccgagtgcaaactgaaaagtgttactgcttaatcgaaattaattgcaagttataataagctttttgtctggattttcattaatcgttagtttgtcgcccaaagtggctactttcagttcacctgaaagtcgtccatagtaacagccaattgcgccaagacttccgcatcaatattttccgattccaagtcgatcagctccatcttttgacgaatttgctgcattgccgcctcagagcacagtgcagccaaatcggcaccaacatagccatgacactcattagcaatctaaagcattaaatgaccttttatgaaaaaaaccgacaacaaaaaccttttccaagtcgacgtcgtccgccaatttcatgttcttagtgtgaatgcgcagaatttccaaacgcccaattgcgtcaggaatactaaaaatattgttgcgatatcctattaattttatgttaagacccaatgtcaatctcgcgatcgaaacgcccaaagcgacgaagagccgggtcaatggaattgggacgatttgttgcaccaatgacaatgacattcgagcgctgcttcagtccatccatcaaagtgagcaattgcgaaacaatgcgacgttcaacttcgccgtgtgtctaaaaaattaattcgtgtcatcgatcaagaaaaccctcttaatcagggaggctgcagtctaactataaacattgcaaagaaaatgggaaaaccttttctcttttcggggcaattgcgtcaatttcatcgatgaaaagaatggcaggcgaattcttctcgcactcggaaaatgctttgcgcaaattcgactccgactcaccagccaatttactcattatttcaggtcctaaattacattgccattatttacaaaaaaaaatctcataaccattgagcaggaaaaagaatgcgccagtttcattcgcgacagcacgggccacaagtgtttttccagtgcctggcggaccgaacaaaagcattcctcggggaggtttaatgccgatggatttgaaaagcatcgggtggcggagcgggagttcaaccatctctttgatctgcgccaactgcttgcgcatcccgccaatgtcatcatagccgacgtcgttcagattgttctcctcgtcctcacgtttgatcggttccccctcacaatgaatgatcgttgttgggaccacaatgcaagcaggcgccggatcagtttcaatcacttaaaggagcaaaaattgtagtttaaaagggaaacagcatgagtaaaaccaaatattctcaagtttaaacaatgattctctaactttttaaagtctgatccgtcaacacagttagttaagtataccctaattttttcttgttttaaaaaaatctccatagtggatgtgatctttttatgtttgaccaggtcccggggttttattagattaacataaagtcaaaaaacgtatcttaaactcaacagttcgcattgctgcgttgacagtgaacgtgtcgcctttgtaaaccggacggtaggcctccaaaaagtagggcttaagaaacacctcgaacaagtttcttaagcaaaaagatagggaatatcatgtcttacaaggcttacccggtcagcccctcaacggtgtcatcaatcggaagcacgtgaatgcgcagtccatttggcgtatttgaagcggacgacacactgacgacatcgcccagtttgacgcggagattctgacgcacaactcgattcatcaagattttctcgggaggacaagtgtcactggctgaagagaattaattaatttcacgtagaaaacgaggccggataacctatgacaatgctagttgtctcacgacgttttttgcctttgagaaggatcgaatcgccgcgaaacaatcccaggtcatccattttagtctaaaggccataattagactaaataacgaataagtttcaaacctgtgccattagaacgctgctgttatcgtctttgggcgattggtccacaatgagtctgttcggcttcggcattttcttgagaatcctaaaacgtcatcaattttcaactccttagcatttttaaaatattacgcagttgccaactcctcatttcgtttcgttttctcatctttttgagttggaacagaagccattttgagagtctcagaaatatcgctaaacaggtaaaaatttagcttattgggggaagaaagtcaaaacgaaaaaacggctctatgaaatttaagtgagcgtccaagtctcgggaattaataaataaaaaatttatggcttaagaaactgttaaaatgatagtaagcaaaaaaagatataattcagcttatataaacacaaaatcatctgcaaaggcacgacattgtgtaaattcaattgtcatcatttcttttcgacgatgtgaaaaaaacgctaacgctaagtgttttgacgtaattaataacagaacgccaaataaagaaattcaatataaatttaaaaaaaaaatttaaaaattgtgttcgattacagtagttaattccatagtaaatttcaatatctaattgtttatggataagaaaaagaaaatgaattttattttcatttttccaattaaaagtggaaaaagtacaacgaaaaataaacgcatttaaatgataaaaaattgcactgacaagaaaaggcatcacagaaaagttttttaattgatcataaatggacagaatatcatatgcatagactggcgtttataaaataaatagacgatgagcgaaactcgaggtcggaaaactccgttcttatttatgcccaagagtttcgccacccatcgacgacccgaattggtattacaaaacacagtaggaattgtgagtgactgatcatttacagtaagaattgtgatttatgagtgagtgactgtgatcatcattgaccaatgcaaaatgtttatttatcccttcgctcttttggcattagatttgattcttgtcgtttgtgtcgatgggctgtggtgtcgtcatgttgaaaatatgcagtgcattggacgaatagaagaaatatttgctgggcatt

SEQ ID NO: 306 - DNA, 2401 bp, Heterodera glycines
  genomic virtual cDNA Sequence=SeqID_592; coordinates=430..469 ,721..842,1098..1257,1484..1566,1689..1819,2206..2311
  coding sequence=SeqID_931; coordinates=430..469,721..842,1098..1257 ,1484..1566,1689..1819,2206..2311
  peptide sequence=SeqID_1155
tccgggagcgggatcgtgagttcaaaattttccgggacgggagtcccgaacgggaatcccgtaaaaatcccgctcccgttaaaaatcccgttcaccgaaaaaagcgggagtcgggagcgggactcccataaaatcccgcgggagtcccgatctcgccggactctaaatttaaatgccttttttggcgttttgtttcaatttgataattcacgaatttgagtcttgcgtttttcaagctgtgattcaacattcaacctgcagcagagatccgacgctttattcaatcccttttgttaacatttaaatcgatcaaaataaattttttgaaacttttggaaataattggtttaacaattagataagttacacactattttattcctttttttataccgatttttacctcctctcattgcaccgtttgtggaaatgacttcacgagacgatgaatatgactatctttttaaaggtattttgtcttttactggccaatttttaaatagtgcgaggatttagccattctcgaacataaaaaaatacattcgggcagcgggggaacaaatcaaaaaaaaaaaaaaacgacacccaccggcgtgtaattttccatccctaatccacacttatggtcgttttgtttaactttgagtcccccccccccctctcccttacgcccatatactaaataaaatggtacaattttaacaaaaacaaaaaattcagtggttctgatcggcgactcgggcgttggcaagtccaatttgttgtcccgtttcacgcgcaatgagttcaacttggagagcaagtccaccatcggggtcgagtttgccaccagaagcatccaggtttggcttttttcattacaatttgcatacctatatgcatcgttaaacgcaaaattttttggaattttaggcataattcgtttttttgccccccccccaaattgtttcaaaagcgaaccaaatttttaaaaacaaagcctttttcttgtttttttgtgtctgtttttctgttcaaatgggtctgcatcggtcgattcgacgccaacaaaaacaactcaaatttaacaaaaattactccccggcattgcactttaggtggacggcaaaacggtgaaggcacagatttgggacacggcgggccaggagcgctaccgggccatcacttcagcatactatcggggcgccgtcggcgcactgctcgtctacgacattgccaagcatttgacgtacgaaaatgtggaacgatggctgaaaggttttcaatttttccccaataaatggcgccaatttaaggggcttttttcttgtacaggaattatgacggatatggccgcaattaaaaaaataatgaaattttcaaaaactttttatttttttagttggacggttaattgtccatttcggcacctttcccatttggttttacgcccgggccaattttacatttaaaggcacggcaaacattttttttttgtttccagaacttcgtgaccactccgaccagaacattgtgatcatgttggtgggcaacaaaagcgacttgcgccatctccgagcagtgccggtatgcacttttgcaaaactatgtaaaaagcgcccctaaactgcataaaaaacaagtatttataattcgaatgtgcaataattttctaatttacaattttaaacaaaatatttccctgccagaccgacgaggccaaggcgtacgcggagcgtaaccaactgtcattcattgagaccagcgcgttggacgccaccaatgtggaggcggcgttcaccaacattttggccgaaatttaccgtgccgttagcacccggtgggcattttaattttcgctgagtttttacaaattttcaatatctggaaggccggaattaggcccccgaaatgaaaaattttcgaaaaatgaattacaaattttacccaattttctcgctaaatttgaccttaagtttccgggattcccataatttttccaagattagtctcaaaagacaaaaaccccatttttgcaaaaagctctcaaaattaccaaaatcacccttttttctacggcgctaaaattggacctaaaggaccaacttttgaggttttgggtaaaattacggaaaaaaactcaggcgcgccgtcaacagagagataaatgttcacagcaaattttttaagaaaatttcattagtaaatttttgtataaaaacgcagacaagtgccgcccgaccgaatggtgccgatcagcagccagaacaacatcacgctgtcctccaccacggccaacaaggagaagaaggcgtgctgttcctccacctaattgtttgtgatgatggaaggatggtggtgatcagaggcagagacagacagacactactgctctctgcgctttttgtggatgttgtcgtgt

SEQ ID NO: 307 - DNA, 3900 bp, Heterodera glycines
  genomic virtual cDNA Sequence=SeqID_593; coordinates=3333..3161 ,3068..2803,2694..2596,2546..2422,2371..2122,1761..1571,1517..1420 ,1369..1240,1185..1035,991..819,762..454,219..1
  coding sequence=SeqID_950; coordinates=3333..3161,3068..2803 ,2694..2596,2546..2422,2371..2122,1761..1571,1517..1420,1369..1240 ,1185..1035,991..819,762..454,219..1
  peptide sequence=SeqID_1172
cttcttggcttgtttgtattcgtcctccagtttttgccgcttcataaatgcttcccaaatttcatcgaagtcgcgtcggtttctcagcggatgttccgtgaaccgctcttcgcacctttttagctcttccaaagactttttcagctgcgggtcggaaatgttcatgtgctcgatgggatccaattcgggaatgagttggtcgaagcgttttttcgtttcctacggggaaaatagctagacatcaaaactgatggaatatttcgaatttatgtcactgaaatttgtcatgaaaagtgtagagacatcagccaacaaaaacaaacgatgtcatcagttcaattcatattcacttttgcatacctttacgaagttcagtcccaacggtgggactgacctgtctgaggctgctctttccgaaaaaagacaatgttcaaaaataacaaaataattcaccagaatggtcttggccactgcttggaatgcctccttgctcttcagctcttgaggaatttttagccgaattgtgctcactgcttggatacagtcgaaagcgaagggcagcaccaccaccacgccattctccccgggcggcggaggtttcaccgcacatagattttgcgcgcagttctcactttcgcgcgagacgaacacagccacgtcgaggaaatatagcatttcaggagacaacggattcagtgggttcggctttttggtgtacctcaacagcacgccccagccgaagtccttgtcgaagcatttgagctaaagaatgcatttcgtttagttttagcgttaagcatggtgttcaaaaaagtcactttgagcattcggcctggctgaaagaagcggataacttttgccggcttcagtaccaatgctttgatggcatttctctgctgctcaatttgcttctccaatctgaaaagtccttccaattccgacaaatggtcgacatgcgcacttaggaaaagttgtcttttggtgttaagttctgaagaattcgagaaatcaacaattaagaatggcttttcaactctgcagaaggtccggaaggcgggaataattctgccactgatagaaggaattgccgagcataaactgcggattgatgtccggcactcgcaacagattaagcaccatattgtaagtgagtcggaattgggagttcagtggatcgctcgtgccctaaaaagtgccaaaatgcgtgatttcgaaaacaaccaaaaataaaagtggcacttttattatttgcatggccgtctccgcgctcatctgctggtccaccatcagaatgaccagtcccttctcgtctttgccccgtctccccgcccttccgctcatttggatgtattcgccacttgttatccatctgaaattgcgatgaaaacaaaaaaacggtctttgtaaactattctttacctgttactgacaccatcaaatttgcgtgccgaagtgaaaaggacagttttggccggcatatttatgcccatggcaaatgtttcagtggcgaaaagggtctaaatttagcaaaacaatgtttaatagcaatatttgtaagtggagcaaagaccttaatcaaaccctctccgaaaaggatctcgaccacttccttcataatgggtaattggcccgaatgatgaatgccaatgccacgcattaaatagggaagcacgtgccgaatttgggacagctttttgtcttcgtcggaaagcaggtcaatggcattgttgaagatcaatttgatggcgcgcttctcttcttctgaaaaccacacaacttttaacaatgtttccatcgtgtcccgacatttgcgcctttgtccaaaatcgggttctaaattaagttttttcaatctctgatcgcataaacagctttaaataagcgattaaaagtgattgtaaccgatcatttgatcttcaaagaatttttgaaaaaataataaaattttcaaacaacaattattgatcctaaacaaccaaaagacagggttttcttaattgtaatgctgtttaggctatcagggtttgaaaaaaattcaactttgagtccaattttggacataggcgcaaatatcagggctccgtttccattcggtttagtatttaatgcaaatgtttctgcctgtattaaaatcaatgtctttgatttcggaggcgtacgcctcgcactcctttcggctgaatgaaaagataatgcatggcaacatgtctcgctctcgaatggttctaatgattttcacaacgttgctcttctgcgtcgcgtcgttcgcgccactccgccgtccgtgctgaggccgcacttcgccgcccatcggttggcgctcctccaaacagctcatcgccttggcaaagttgtcctgtttaaactcgccctgaaaatgcacaaaatgtttggctgtaaattttaaacatttttccttgcctttatgttcacaacttcccaaagaccgtccgacccggcagaataaaccaaatgttggaggggaacaggccgatagtccgtgtaaatgatgttgcactgtttgtgctgcaaatagcaaatccattctgaaagtttgaattccaaaaaagaaaactaactaaatgtaaagccaacctgtgaattgcttggcatttggaatagttgcagaaagaaacaccaaattggtggttttgggcaataaaatgagagtttcttcccagacgacgccacgttctaaaaacgaaacgatagaaaagaactgaattattagaatattaaaacatcgacgagttccaaggtcccaatccgatgaaaatgaatctttgggtttcttttgcttacctttgtcgcgcatgtaatgaatctcatcaaagatcacccagccgacttctctcacaatttcacagcctcggtaaagcattgaacgcagtatttcggtggtcatcacaacacatgatgcatttgggttcagtgtcacatccccggtgacaaggccaacgtcttcgaactcttcaacaagttcacggtacttttggttgctcaatgctttgattggggacgtgtaaatcactcgctgtttgtcccgcaatgccatggcaattgcgtagctgaaaaaggacgacaattaaaaaaaagtaactcaacgattcaccacccgaaacgaaatgattgataaaaagttatagtttaataaacccacagggcaacaacagttttcccggccgatgtgtgagccgagaccagcacagactgttgattgtccaggcatttgagtgcctggctttggaacatgtcgagtttgaactcgtaaagctttgccggggtgttggtcttctttagctgttgatattcaacgtcaaaggggacgattgcctaaaagaagacaaaagccatgagaagtcaaaggaaaatggacgcaccacacattaaatagggagggggtcgacccccgcccctgactttgttcgtattagggcccgaagggggggggggtttgttgatttatatgactgggagacatcgtaaattttggtctccgacccccccccccccctactattttatatatgggacgcacctcgtggttgcaattcttctcggaagccacttggtaagaacgaatccgctgacaattctgaatgaactgattctcctcttcgtctcctgcttcgccttccatttcatctttgacgttaaattcagcagctaaaatagggaaaaataaataaaatgcgcctcattgtcagtcaataacgaaggtcacccttgccaaaaaaagaatatttttgctgttttagagcttgaagaaaaaaggacaaaaaactccaatgcaatttttaatcacaaaaaactcattcttttgaaatacaaaaaaagctcccccccccccatacatttgcccgtctctgaaacagcgctcaaatctttcaacaaattctc

SEQ ID NO: 308 - DNA, 1529 bp, Heterodera glycines
  genomic virtual cDNA Sequence=SeqID_594; coordinates=20..125,187..279, 371..400,454..562,614..779
  coding sequence=SeqID_961; coordinates=20..125,187..279,371..400 ,454..562,614..664
  peptide sequence=SeqID_1179
catttttaatcacttacagcgatcactctctgtcttggcaaagtggccgatgtttatctgatcgacgagcccagcgcgtacttggactccgagcagcgcttacatgcagccaaagtcatcaaacggtgtttttcttttgaatttccatcatttttatttttttgaacttttttctctctatttaagcttcatcctgcacagcaaaaagagtggcttcattgttgagcacgattttatcatgtccacttatttggcggaccgcgtcatcgtttttgacgggtgggaaaagcacagagagatcaattaaattattactactatttaattataattaaattaaatattactattttaattgtccttttttcagacaacccgccataaaagccactgcaaatgcgtaggaatcattttaatatatttttttattgcatttttttcaatttttcttagccctcaaccgctggtgaacggaatgaaccgttttctgagccaactgaacatcactttccgaagggacaacgaaagtcatcggccgagaataaacaaattgaattcgcaggtgcacaaattaattgagactaattaatttggttttatttgtccttttcagctcgacgtggaccaaaagacgagtcaaaattacttttatttggacaattgaattaccattttctctgttgttcttgtttttttggttgctgttcaattgcgccgttttgttgataatattaccatatttttaacttcttaaaagtgcataaatgtgaatggatttggcttacaattcgcgtgccaaatacattttcatgaaaaaagtgattaaaatttatccgaaactccaccaaatctttccatttctccgcctcttttttatccaaattttttaaaatttgtcactttcgcctgcgatggtttcgtctgttttctctgtgcccactcttttccgtcctttttatcttcctctactctatcttctctctttccttctctgctgctctctctctcttccccactttttcccctccccgtcacttttctctccgtccgtttcttttgtccatctgcagaaattgcacaaatatttaaatttacagaatttttggcgggtcttctttcatttttggtggactttttggcttcttaattcgatgcaccccaaaacgtcgtcggaagactttttggaccataactttgttcattgtcaatcaaattaagcattgttggtgttgttcgatagctctgtgtgtttattattaatttgctaattttcaaaaattttcattaagtttcaaaaaagttaaaagacaaatttttaatattacagttaaattttattttttaaaaaaaaatttcaaaaaaaaagatttttaagagtaaatcggtattttttttgaggaattttggaaaatccaccaagattctgtcatattttgtgaaaattgccaacaatcattttataatgttctaaaaattataaaatgtgcaacaataaatggcaaatcagaatctcaattaaaaaaactttt

SEQ ID NO: 309 - DNA, 3351 bp, Heterodera glycines
  genomic virtual cDNA Sequence=SeqID_595; coordinates=88..158,213..398, 548..715,862..995,1042..1213,1498..1563,1688..2063
  coding sequence=SeqID_988; coordinates=126..158,213..398,548..715 ,862..995,1042..1213,1498..1563,1688..1864
  peptide sequence=SeqID_1203
tatttttttgtttgtttttcttatcctccgttccttattttgatgtttttttgtacacctctaccatttgataatcatcattttagggtattcttttaacatcaattttggattccaacaataaaatgattggggaagagcttacggatgttgacaaggttttgccaagacaaaatttcattaattttccaattccattttcaaatttttaggctcgcattgcgtcagacattctgcttcagtcgccgccgggcgagttcaacgaggtgttcaacgacgtgcgcactttgttgcagaacgacgcacttttggaaaagggcgtctgtctggaggcggtccggcgctacaacaaggcacagtttgtgccggtcaaccccgagccgggcgctgaacacccggcacgttttaggccgaataaaaggggggagggacggccaaaccggtgaaaacacgaaaaaattaatataaaattgaaatttcaatgtttttgccgactatcactttttaaaaatgccaactaatattaataattggttttttttggcagactttgatcaccgaacacaacgaattgccggacggacgtttcgtggacccaaaaacgggccgtgttttcaaatacgaccatttgcgaaaggaggcggccgatgcgcagccgtcggggcccaaggaaattgacgaaaaattggagccatggcgaaaggcactgcaaaaagtttgctttttggtactttctccaatttaggacactttttgacgaattttagtattatttaatgagaaaaaattgcggaaaacccaacgcgaatgatttgtccagttcatccacaatcaatctcaattgtttgtttgctttttgaggagttggacgagtacatttacgagcatttccatctgaccggcgtcgccactgttttcacgccgttgcagcaccaaaaagagccgaaactcattctatgcattgagtcccatcagttccagccaaaaaactattggtttgcatcaatgtaaaatatctgttgaattttcaaattgctttaggaacggtcgttggcgttccgaatggcattttcccaactttgacggctcttcaaaaacggcggggactctccaaaaatgcacgggcaaattgcgtttgcaggtgcactattatgaagacggaaatgtgcagctgatttcggagaaagaggcgacggtggaagtgaaaatgacggtgagtcacagcacaaaacgatggatcaaatgaaataatgggtaaaacaaaccgcaaaattagggggagggaagcagggtctaattagcgttttaattgggtcaaagccgaggctaatgaaggcgaacgcgtcgcctttctgcgcgttcggtgtgctatggcctcgtaaagtgttttctgactttgataagccgaagtgactttattttctttgtgttggcctccggtctagaacagtcggacaattaatgtcgaaaaaaggaaaaaagcacccaattgtttagaatgaccgggagacgagtgcccgtgaactgttgcgggcaatttgcgaagcggagtcagcttatcaggttggcacggtgttagggtagttgctgctcccttttcaatttaatggattcgtttccataaatttcaaaattcaatctaaaaagacgagttttgttatttttcttgcccaatccccccgtttagacctccatccaggagtcccaagtgcaaatggagagcaccttcaaggcgcttcgccgtcagttgcccgtcactcgctccaagctgaactggctgaacttccactccttccgcatcactcaacaggacatgaaacagccgccgacgcccaccgtcgctgtccaacaacagtcccagtgaaaaacaacaaatgaacggactgacggacggatgaatgacaccgcaactaattggagagagacactttcgcgtcctcaccactcatttgtttagttgtactcattcgttcttcatttcattaggcttattgggtgcgggcatttattaaccgtttggaaatggtgctttgcgattccttccattaaatttgtccaaatttggtttccaattaaccctaaatttggtgttaatgctccgtcgtgccctgcctaattattcgctcatttgcagaaaaacatttacttatttctacagtaattggtgtactaaatcataatctgcttgtgtctgtttcatctccttcttcatttgtccgtgtgctttttcttcgttttgtgcccttcgtgaacattcgccatccaaaaattaaggcaagtgaaggcatttaaccgttcccaagtcgacttttacacttacaaattgaattttaattatttgttttgcagaatttggcgctatctcacaccacctctccgactgatcagtgatcagctttgtcattccctgctgctcgtattgactcatctccaccgtttgcgattgatttttgatggattttccctttcttttctgtttgtaaaacataccctcccccactcttcagcataaattatttaaactgagaacaacaaatgcagaaatacaaatttgatgtgtcaccccaaaattggacaattcgtcccaaattattgcccatttcagtatcgatgccataaacaaataaacgcgaaatatgcacaaattgcaaaacatacatatggaatacgtcctataagcttcaaaccaagctaaaaacatgttttcgtgtatttttaggcttttcacagttcagaaaaaacgaatgtccatataaatacaaaccctattcatcacacattttcaaagtacatccttgaaaaatttgaagcgaagaaagcccaaatccaagaacgtacttgaatcaaagcatgacgaattcctacactgttatggccttttgttcctggacaaattttggcacatttaattaaagcatacaaaatgtcatttggtgattttaaaagccgtatattctacattctatgtacatacttctgagtcttttttaatttgattcttgctgtttatttaattgtgccattatcgacaattggtttattgcctgggactgaattttacgttttttaataggcgtattttctgtcctaaaacagaagcattatttttcagtttcgtttctcgttttacacatatactaaaaatcttaacatatttactgcatataatttttaataatgaagagacgttttgaaaaaattccaccaaatcgaacaacttcgacttctaaaagtaaatttgtattgattaatttaaatttgctaatttttggatctttctctgttaagtatgcctaataacatttagatatacctatatatgtatatatacatatatacataccggcgcta

SEQ ID NO: 310 - DNA, 4700 bp, Heterodera glycines
  genomic virtual cDNA Sequence=SeqID_596; coordinates=343..482 ,522..674,841..939,984..1146,1201..1296,1368..1517,1566..1676 ,1722..1871,1916..2117,2164..2393,2448..2746,2815..3006,3050..3241 ,3307..3403,3482..3691,3742..3876
  coding sequence=SeqID_838; coordinates=343..482,522..674,841..939 ,984..1146,1201..1296,1368..1517,1566..1676,1722..1871,1916..2117 ,2164..2393,2448..2746,2815..3006,3050..3241,3307..3403,3482..3691 ,3742..3876
  peptide sequence=SeqID_1078
ttttttaaaattttcaaaaagtatctttaaaattgtattttttgcttttttctcatttttcttgtgaaaatttgccaaaaatggccaaaatatggactaacaaggcaaaaatggcgaaatatggatttattcccgaaaacccccaaaatatggatttatatggaccaaaaaccttcaccaaaccaaaaaatttaatgcagaaatgctatttttgagcccttttcttcatagcatatgcgtaaaaaatatgatatccatacaatttcgagccctaattatattgcaattgttgaacactctaactgattttattaaaatttaaaggctattcaattgcaagagaatggggcgaaggaggaaaattcggagtccgatttcgaaaaaatggaagaggaagcccaaaaggacatcgaagagcgcgacgcactgtccaaaaggataagggaaagggagaagcacaacacgcggcacgtcatgtcaaagtcggaagcgaggagcaaagcggaggcgacgaaacgcctgaacatttcagaaaaggacgacgaagccaacgatatgatgggcaaattgagatacgaaagtcggaagagttatttggcgaagcgcaaggaggacaaacgcatggaattggaggcgaaggttcacgatgatgagactatttttgcgaatgaaaagtaagtgcaattcaacaaataatttatttatgggtgcatttctactcattaaaaaaatctaggttttatttcgaacgaatgacaaaataattaaatgaaaaggacatattttccattttactaaaacataagtgaaattttaataagtttcaaactcaattttcaggcttaccaaacgagagcaattggatgccaagtacagaaaggaagtgcttcactatgtgaagcaatatgacgaggcggggaatgtgcttaaggtgccgaggtgaattggcactgttttgccatgttttacaatgatttccaaaggtatcatgtccccgatgcgagcagcaaaattattccaacggaatatgtggaggagaacgaattgcctggcggggacggacgtcgctgggaggatgagaaactcgggtccgccgtttttcattacggggcaaaggacgcgaaggcaaagccaatggaaaagggacagataccctaattgaaattggaatcagttcagaaagaaaccgaccttggacttttgcttgaggacgaacagatcgattttgtggaagcactgcaacaactcgaagggactcgcgaaactgaagtgagaaaaggggcaaatcaaagacgggtgaagtgatcgttgtgggaagctgtgctcattttcagatgaaggaactcaccattgaacaaaaaaggactttgtcattgcaagagacgcgcaaaactctgccagtttatgcgtatcgagacgaattcatcgaggcggtcaaagagcaccaagtgttgattatcattggtgaaaccggctccggaaaaaccacacaattgccacaatttctcttcgaatctgtgcttttgaacactcaaattattttctggttcataccggaattttagggattttgctcgggagacaaacggttgggctgcactcagccgagaagagttgccgcgatgagtgttgcggcgcgagtcgcggaagagatgagcacgaaacttggcggaatggtatccgatgcctcggaatcaaaaaagggtttttattgcttttaggttgggtacacaatccgattcgaagactgctcatccgaaaggaccaaaatcaaatatctgaccgatgggatgttgcttcgcgagtttttgaatgaacctgaccttgcttcctatagcgttttgatgattgacgaagcgcatgaaaggacagtgagtcattcttttggaccccggtattacgttaccatttacagctccataccgatgttttatttggactcgtcaaggacatcgctcgcttccgcaaggatttgaaattgctgatctcatccgccactttagatgcgctcaaattttccacatttttcgacgacgcaccaatctttcgcattcccgggcgtagatttcctgtccaaatttactatacaaaagcacccgaggcggattatttggatggtaactgttatttttcgttcaattgtccttattaacttaacaatagctgcaatgatttctgtgcttcaaattcacctgacccaacctcttcccggcgatattctcgtctttttaactggccaagaggaaattgaaactgtacaagaggccttgcaagaacgcataaaattgctcggctcccgtatcaaagaactgatagtgttgcctatttatgcaaatttgcctaccgatatgcaagcgaagattttcgaaccgacgccgccgaatgcccggaaggtgtgaaacattgtgtcgaaaaatcttccctttttcctccattttcatttttagtgcgttttggccacaaacattgcggagacttccgtgaccatcgatgggattgtgtacgttatcgaccctggctttgtgaagcagtcttcctacgatgcgcgtggcggtattgaccatttgaatgtggtcaccatttcgaaggcgtctgccaaccaaagggccggaagagcgggtcggactggcccggggaagtgtttccgtttgtacacagcctgggcctaccaacacgaattggaggagcaaccgatacccgagattcagaggaccaatctgggcaatgttgtgcttatgctactcaggtctcaatttattctcaaattttctataattgtaaacttttgtcggattattcgttgtcattgtttagccttggcatcactgacctcgtccattttgactttttggatccgccaccttacgaagcactggctgccgcattagaacatttgtacgctctcggtgctttaaaccacaaagggatgttgactaaacttggacgacggatggccgaatttccttgtgatccggcaatgtccaaaatgataatttcctcagaaaagtccttaatttctgttttacccggtcatctactttttttaaagatacgaatgttctgaagagattatcactatttccgcgatgctttccgtaaatgcggcggtgttttaccgcccgaaagcgatggtaatccatgcggacacagcgcggaaaggattttggtcgtccagcggcgaccatctgactcttctgaatgtgtacaacaaatggagagaaaccaacttttcgatgcagtggtaaatccagtgtctaaaataactcaaaatatagaagtaattagttgaatttaatttttatttaggtgtatcgaaaattttgtccaacatcgtacaatgaaacgggcaagggatattcgggatcagttggaaggactgctcgaacgagtggagattgagccggttttcttttattttaagctggatttaatttaatattgcatctttccgactttctttccatttaattaattctttaagaaatcttcttccgacacaatggccattttaaagacaatcactgctggatatttccacaacttggccactttggacaagggcggtcaatacaaaactgtcaaacaccgccacactgtccaagtccacccaaattcttgtttgtttgaagaccgacttcgttgggtgatttactacgaattggtattcacttccaaagagttcatgcgagaagtaagtcataaacaaactctcattttttaactaaacaaatgtacctacagataattgaatgtgacccgaaatggatttcggaagtggcaccgcattactaccaacaaacccaattggaagattctgtcaacaaaaaaatgccgaaacaaatgggaaaagcaaaaagtgaactcgtcgggagttgattcacgaatttcagttctcttacagtgtaaattcgacttttgttttttttagtttgccaaattttaatttaaatggattttccgtgtttcttattttaaatgttatcacattttttaaaatatctttacataacttcatcaagctgatttttgactgttcttacaattagacggataaaataagtaaatggcttaccacgtcgacctttctgttcgcccaaatagggcttttatgcaatttggtggaattcaatttaagtgtttcaacccttcggaagtgccaaaaattagtgttttggaggtcactcagacgaacacttttgacgaagtacttgcaaatgttcagtctcgttccctgttcattttcctcgttcttaggccggtttccccgttagaggtgggttgtacgacccgcttctcggcacctccgaaaataaccattgtgagacgtgcgggatgcaggggacgcactgtcccggccatttcgggcacattcggctcactgtgccggtgttcaaccctcttttctactcattcactctcaatgtgtgttttggactcatttggttttttgtatgttctttccattaagatgatgaaagggacttgcatccattgccaccgtttcacctgcaactccaattcggttgcagccaaagtcgtcattgccaaactccgggcctttcgttttggggtgccggaagtcttggacagggtcgagagtgggttgaaggcgaaattcgagaaaagagacgaactgctcactgaacgcattgatttgatcggagagagtgtctttttacgggaaattaatgcgttcatcg

SEQ ID NO: 311 - DNA, 2181 bp, Heterodera glycines
  genomic virtual cDNA Sequence=SeqID_597; coordinates=491..824 ,867..1054,1111..1236,1336..1380,1442..1796
  coding sequence=SeqID_897; coordinates=668..824,867..1054,1111..1236 ,1336..1380,1442..1714
  peptide sequence=SeqID_1125
tatatttagacaatattaaacccctcttaatagaaaatttacttgtcaaaatctttcaataaaaagacaggtcgtgtccgacaataattgctttctcgaatcatcagcaattcttccttattgtagcagcgatatgttgtcaattgctgtctagggacatccattttttctggacccaaatacttggaattttctttcataacaaatgaaagaagttagtatatatggataataaataatgtcttaacgtcaaaataaaagaaaatacaattttaaaaatggattaaattaattgagataaagcattaaatcaaagggaaagccaaacagaagaaacagatgaattttggattggtataagaaatgtgatgaagatttttgaaaatattttgcttttaaataaaacgccataaaatttaattaataaaatagaaaatgaaaaatagaatgattgagattgtttgacgacgtcattcaactaaatccaatcgataaacttaaaaattgggaggcattttctgaaaaaaaaaattcgaaaaattgaattataactttttgtacaagttcggtttcaatgttcagattggtcattaggcaaagggtccctccaaataacacgccctcaatcaacttataaagttgtatttagagacaaaaattatcgtaaatggctgtcggaaagaacaagaagatggggaaaaagggagcaaagaagaaggccgtcgacccatttacgcgcaaggaatggtacgacatcaaagcgcccgcaatgttcacacaccgaaacgttggcaaaactttagtgaaccgcacccagggaacacgtaaatgagcgtttaggctttctcaaaaattttttggtttaggcatttcaagtgactttctgaaaggtcgggtctacgaagtttcgttgggcgatctcaacagcacggacgccgactttaggaagttccgattgatctgcgaagaagtgcaaggcaaaatttgtttgaccaatttccacgggatgacattcaccagggacaaactgtgctccattgtcaaaaagtggcatgtaggcgtatcttatttatacaaagtgcccggaatggaattaaactcctattttagacactcattgaggccaatgtggcagtgaagaccaccgacggtttcttactccgactcttttgcattggctttaccaaacgaaatgccaatcaaatcaagaagacgagctatgcaaagacatctcaagtaagacttatccgcatgcgaaaattttaatctgttccttagaaaattatttctaacttctcattatacatggaatttaatattctaaaattgctttaggtacggatgattcgtgccaaaatggtggaaataatgcaaaaagaggtttggtcgtcgaatttattcccatgttatgttgtgtcaaatgtcttctttgctttgttaggtctcttccggcgacttgaaagaggtggtcaataagctgatcccggactccatcggcaaggacattgagaaggcgtgctccttctactacccgttgcaggacgtttacatccgtaaagtgaaggtgttgaagaagccgaagttcgagctgggcaaattgctggagatgcacggcgagggtgccggaacggtcgccactattacgacggccaccggagagaaaatcgaaagtcggccggacgcatacgaaccgcccgttcaacaaagcgtttaaatggtcagattgacaaaatggagatttatttgactgtttgcatccgaattgttttgctgttgttgttaaattgactttgttggatgtttttgtttcaactcattaggcttataaaagggcggctctagtacattctttatgagtttatcaattaatcataccaggtttttatacaataactttgtttatatcgaataagtcttatattttggttttatctgaaagccaagtctaaattagccaaaatatatataaaatctcaacgtttagttaatttccgaaaaggatatgattaaactatgatttcgtttttactttctttaaatgttaacattctcttgttttctcttattattactttattcagactacaaatttagggtttgttcgaacatgaacaatgttattgcataaagacccaggtattgttaaagattggactcataaagtgcatttagaaccaaaag

SEQ ID NO: 312 - DNA, 3541 bp, Heterodera glycines
  genomic virtual cDNA Sequence=SeqID_598; coordinates=2490..2440 ,2350..2168,1790..1731,1669..1558,1510..1419
  coding sequence=SeqID_857; coordinates=2490..2440,2350..2168 ,1790..1731,1669..1558,1510..1419
  peptide sequence=SeqID_1094
aattgaggatgtgctaaatggtcgctcgtcacttctttccctcgaccatgatcacgtgatatccgaattttgttttcaccggtggatccgtgtagattggcttgtccacgctgctcttggccagtgcaaaagccgcttcttggaacgggccgaccattgagccgcgaaccatccatcccaaatcgccctttaattccgaattttaaaaccggaaagatttccgattgtttggaaatagagcctctgtaaaactgactccgttccgcgctttgtcctcgctgtattttgctgccacttcgctgaatttctcacccgcttttagccgctctatggcctccaataccttcgattgcttctcacagagaatgtggcgtacctgagagttgctttttctttcaaaattaccagtcttttttcaaattacaatttattatattattaatttgcaattaatgggcccaattagtcacttttacggatgtccccgcccctttcgactgctcctttttgccgctgtcagtcgctcctccttcgcttgtgctgcccgcctcctttttgcccttttgctgcgtcgctttttttggtggcatttacataaaaaaataaaaataattagaaaaaagcaaagaaataattaattgcaaaataaaaagcattatcaaaaaatgaaaatttctattatatgtattaaagattcataaaatttatattttcagcttagaaatggtaatcacaattctttttttggatataattgttctttttttttcatttgcccttcgattggccattcgtttgttcgcttttcgtcaacggttcatccaatatttctttaagtccctcttatttttcaatgcttcttcttcttccgccattatctcttcgagtgctgtttttcgtttttggcccgctataattttaaaaagtaacattttgttgggatttatttatcctctcctcccataatatctttttctactcaccaactgctgctgacgttggttttgttgtccttccatttcccgctgcgttctgtcgggaagtgcccggtttctccgactcgcgcaaaaacacatttttggcatctgctaaaattaaaaaaatactatcaagttaaaattaacttttaatccaaacatacccccgccaattttgaaaaatgccgtcgttgttggctttatgtcggtaatcatcggcttcttcatgccaacggaaaatgcgattttcgtgtcatcgttgcgaatcaattcctgcggctctttggcgacttcgtctccgtcctccgtgccctgcttctccttggctctaaaggggaaggcttttcatacgaattttcggcatttaaatgcctttggtcaaccaatccatcccccgccttccgcttgcctttcaatttgtctctgcaattgttcatgcattcgttcctcgtcgtccttttcctgtttggcgcgctgctgcaacttttgacgacgtaactcctcctcctggtcaatgtattgaatgtgccaacctcaaaaatttgctaaaaagtgaaaaaactaatcccatccgccacacctttctcattctcgtcaattttacatttgccggacttgcccaaatacatcacaaagccggtcaaagtgtgccacaccgtcgagttcatgtgcacatggcctttgtctttaatctggggggggggggggggggtagggcgtgaagcaattatcaagtatgaccattaaactcacatattcctggtaaacttcgttggcacggatgcgttttgaaccaaaagtgtgacgaagaatctatcaaagggtaccattttattagaaaacaatcaatgttttggcagcagctaaaaagtgacaatttttttttggaaaacaactttttttgatagtaattaggtataatttttacaatctcggaaaccaatgtgccaaaattgcattaaaaattccaaaattttacctcgagtcgcctatcaaaccccttaattttcttcaaaaattggctcaaaatcacaaaatttgatgattttatgatggaattatgttaacaaattgcacttaaatttttccaggcgacgtctatcggctctgctggaccccccccccccactcccaaatttcacagctgcaaaagtgccggtttgtccatccctccgcccttttttgctcacgtgcataaaattggcctcaaattcgcggctgaactggcgcagatacgagttttggttctcagcaaaaagcaacagttgtcgctggtgactttcgctcatcatgtgacacttgaagccgttctgatcccggcactgtttctggcacatttggcagaaccatttgagcttttgcagccctttggcctgaaaagaggaatttaaatatgacatgactaaagacaaaacaacaaatcattgtccccactcccatttttgaaaatatgaattgtcacctttgcacggttggcaatttctttcggcgttcccttctcgtgtttcggcattctgagcagatgaaccaataaacttcctttgtttttgcaaaacaaatgaatcactggccaaattcatatttaattaattaatgcgtcttcaacttgtgggaagatagtaatatttatatattgaaaatgtttatttttaacacttttataaacataaaaaagaattcgactcaattcggttggtttgtctgtgtctctcactttctctttctcttccctctgttcttttccgtctgctgtctctttctcttctccacattctctcgcttcttctccgccctcctctccttcactgtttccaccgtttgcttccgttcctcccattttcgcttctttcgctgtttgtttttcgcctttctgaccactccctttttcagcaggtcaacattgtcctgaaatcattttcagggggttttcaagggtgttgatcacgaagctgaacttggatttttccaattccgagccacggacccgaattcgaaaaaaaaactcagttaattgttagcgcatttttacccaattaacaattaagttttttgcaacaaaataaattgttgttaaatgaattttggtacttccgggttatgtcgcccccccccctcaaaaaaattccaaaattcgtaatttggggtttccaacttcgctgatcacgaatatgatatttattttaacatctgatgacttttaatcatagatttgacaaaatatctatgattttagaaaaatatttaaaattcaattaaatcatgaaaagagtcagacaggtggcataaaggcagcgatattgcgcaaaatctcgtcaaattcatcaacatttcgtcgcttaacgtcctgccgccacaaaaaataatttatgtgtgaaaattgtaaaattaatttatgccttttctgtccccaattggccaaaactgggcaggggtagggggggggggggtccgatcattccttgcactcttttgtcccaaatcctctaaacaaccacaaaaaaatttggccaaaaatgccgtataatttcgaatctcttcttccgcaccccgcaaattaattgggc

SEQ ID NO: 313 - DNA, 3120 bp, Heterodera glycines
  genomic virtual cDNA Sequence=SeqID_599; coordinates=2761..2671 ,2568..2410,2047..1783,1738..1662,1616..1506,1451..1295,1241..1207 ,1153..1104,1063..900,856..750,674..514,453..352,310..202,155..62
  coding sequence=SeqID_865; coordinates=2761..2671,2568..2410 ,2047..1783,1738..1662,1616..1506,1451..1295,1241..1207,1153..1104 ,1063..900,856..750,674..514,453..352,310..202,155..62
  peptide sequence=SeqID_1098
taactgtaaacaagcaaattgtttttaaattagttattaaaatgatcattgattcactcacttggatcgacgggccccgtcgagcgtacttggaatttgtccgctatcatatgccgtaaccgttggtaatagacaatgccgaagaaaatttggacctggagatttgtcaatcaaagagcccattttccttccattctgaaccttcatttctcgtccatcgatccccgaatacatcgtttcattgccgtaataattgtatccggatttggccaggagtttcccgaagtgttcaatggccgtattttgctcacttaattttgaagggttgtaaagtgattttttaaaaatcacttgaaaacaaagggcgatgcatcgtaagaagtgccgtgcattgctgcggcctttccggccatactttcgatcatcattccaatggtcatacgggagggaaaactgcagaccattcaaattagtgactcatttaaattcatattcaaaaagaacagcaattacccgtgagggttaaaaataatgtcggggaccattcccgactcggaaaagggcatcgactcggggggccaaaggaatgaattgatgcccttttggccatgacgtgaagcaaatttgtcgccgatgatcggattccgttggattcgccattggattaacacgtgctgatggcatggaaaagggacaaaatgttcaaaatgaaaataggcaaaaatcgctgcacggcgcgaatgaattaccacgtttttgtttttgtggtccgcctcctgcacaattcgcaccaacccgcaataagcgggctcactgttcgtgaatttgtgctcgttgaattgtccgctgaccaaatctgaaaattgtcaaaagcattaaacaccccggggacactcaactgaaagtgccgtaatagcagtcgccctgctggtagagacggccttcaatgggcaggccgtccgcaccgatgccgtaattgcgttcgttcggcttccccaaaaagaccatttccgcatttttgctctgaccaaaaccaccggtggagcgatcaaccaaactgatccttgaagcaattttgtttataaaactcaaaaaattcatacctctgcactttaacgacagttccatgtgcaaagccacgctgatacgaagccttaaaacgggtttttgaggttgaacgggacaaaggcaatgcaataaaccagccttgttgatcaccattgcatcttccatgtcgtatcctgaccagacacattgtgtaaaacgccttacccattaacccttcccaactgaccagtgtacgaaataacggccacacacgcatttgtgcctagagggtattcgtccatttcgtatttgtcatgggcctccaatttgagtaaaggtttttgcgcagtttgcaatttgtacattttgttgtccgtacgcgtctgccaagcgtggactgggacctgacaataagcaaaaggggatgtttgtattgaatagcgcccttccacaatcacccccattgtctgttttcccatttgacattgatacacatttcgaggcgattggttgtgatcgggaaaaggaatcaaattgccagcgaatgagaacagagacgagggatgaagctaaaaattgttggacgctcatccaacccatgggcactttctaacttcttggtgcattgttacgcccggttctgcctcttcggggtcaattataatggaaaggtaaacttgttcaaaaattcctaaatgtaattaagttcaaaagggtaagtttaaatcagttaacctatttgctcgatttgatcaaataaaaggttcctaactggtctcatcaatcttccaaggccgctgtaaataaaaaacgcggcgaattgcatttgaatattctcagagtcgggtgaatgtctgataagcgtaagttccgtaaatgctggcacacgatcatcatgagaagcgactttcattgcgcgcaattgacgttcaataaacgcagcttttttgcgagggataaaaccaacaaaatcgccatctaacacaacagggtaaagcttaaaaaaaaatcaaacaatgtatttgatattaaagttaattaatcacttcgatatgggtttgtattcccttttcacaacttttattcttaaaatgaataagacaaaaaaagtttatgcgtcgtgcgggaatcgaacccgcccctactgcttggaaggcagcaatgctaccactgcaccaacgacgctccaaatggaacgcatttttaattattaaatcgttttataatttgtcacaaattggtttgagaaaaaaaatcaaaactttatatgcgcgaagaaaaaatcccttttggcagatttaaataaaagtttttcaaaagaattttgggcccgttcgctcttccattgtaagcaaaaagcaccgattctttagggtgataagtcagggcattgtgcgggatgagcccaagtgaggacagagtctgtttcagtttggttgtttccgtaatgtgcgtggtaacaccggccgaagcggtcaaatggttcaacagcccacacggcgacccatcgggggtatgcacctgaacaaaacaaccggtttaaaatataagtgaatcaaaaatttaaaaatatttttagaaatttcttttattttatattcctttgaatcataaaatgcttacagggcaaataaatccccatgcctccggcctcaactttcggacatcggttgtccgcatttctgtgaaaaatgctccacgatgtattgccctttaaaataaattgtaagaaagcaactgattgggtggttaaaatgcggaatgaataggtgttgaaagcatcaaattgcaataaaaataagcatatggacaaagtgcagagcagggatgggccgaggtttcgcttttcgcattttttggcgtttcgcatttcgctttttggcgcgaaatgcgaaatttccacccctaagaaatgaatatatttgaaaatttaatttttaaaacgaatgcttcagtttattattttctggttaacatactatattacactcaaaattgcataatggaaaaattcttcgaatttctccacacaaacgagaattaaaaaattttagtacatttttgaatataggc

SEQ ID NO: 314 - DNA, 4171 bp, Heterodera glycines
  genomic virtual cDNA Sequence=SeqID_600; coordinates=3848..3690 ,3650..3498,3444..3352,3276..3172,2974..2801,949..863,814..613 ,563..405,358..109
  coding sequence=SeqID_908; coordinates=3848..3690,3650..3498 ,3444..3352,3276..3172,2974..2801,949..863,814..613,563..405,358..231
  peptide sequence=SeqID_1135
ggggggttgaaatttgccaagtccctgctttggctccttgctcaggtaaatccacaactttttttgctcttcaaacctttcttgatgcgaatgagccccgggggcatatgtcttggtatcttttatggtatagaaaattcgatcacacaaatacgaaaagtatgaatttcatgtgaaacaaaatgacgtaagaattgtttacagtgggtcgctcccccatttgtccattctcacacaagtcctctcttctttttgtattcttccaatgtgagtgtccgcgagctgctcgtcttctgttgtgttcgtggtgcctgtgagtcggtaattggcggcgctctcaacgaaccgccgacgacggctaaatgtttaaagtcatatccaaaagaaacaacgattaagctcaccgggcatttttatgtcaatatttatgtcgattccatgtgcgttgaataaatcgtgagttgagggaagttgcacttttttgtttggagaggactccgacgaagacgacaacgaacccaacgaagaaaccatcgtgtccataacggataactcggcattggctagagccaaaggtattgtaaagaaggaaaagggatatcccaacactaccgccacttccttcgccggcggttttggacttcacggatcccgagaccactttcatccgcgccgacttccgtgtgaatgggtcgtcgtccttctcctgctcttcccgcaccattccggcaccaaggaatgtttgtttcatatggtccctattccgctggttgatggcactgatggcacttaagttcttcgttctttggtgttcctcaaaaataaccatttgtgtattaacacgggaattccttccaatcacaattttcttggccttctcttccaattcgttgacttgctgctgcaagtcgcgcaccctcgcgacatcgccgctttgttctgcttgctcctaaaacaattttttgtttttattatttctttgatttgtatcattttttaacgaaatgcccatcaatgacctaaatagtgaaaagatatcaatcttcccactaatcgtcggctgacaaacattccaatgcaaaatggatgaaggggatgaaggagatgagggggggggggcacttctcacataccatcacatttcttcttctgttaacaatgcatacggcaaaacaaagtcaaattaaataggagcaggaaaacagttaggcaaacaaaagcatttgaaaaagtcgagaggaaagggaggggggggggagcggtaagttcactcgccacccgccccccagcaatggcgcgttgttagtcaaccgcagcatttctttcccattccgatgtgaatatagcgcggcgatctctcaaaagtacccactgcaaaatccacacactaatcgatggatggtccacgcaattcaaccaaacacagaaatattgcacattttcaccggatattttgccaaagaaaataaccgcagcaacgagattaaaatcctccagccaactgaccacaaattttgttatagatcagtcctttcactaaaaatacgttaacaaactgttggcatttcacagtatcacccatttttcgcattttgttaaataggcaataataatttcccgtttttatagggaaacaagttaacgagcgctacacaaatccaaaggcaatcccgcctcagtcatcatcaatcattttaaagcatcgacagacaaattataaaccaaaaaatgctaaattcgggggatgaggaaatcgaaagcacgaaagaagaaaaaccgaaaatcgtagtgaaacagtcaaatgggtgggttcgtttgaaaattgaacaaacattcggtcgcaacattaagacaagaattaccgcatcatcaaactcctcagacgaaaataaaacactcagaaaaacatccccaaactaaatgctttggcagaatgaacgccaaagtgaaatttattcccgagtcacgaaaggggcagctcaacacacaatatctggccactctcccaggacttctcaaaatcgtggaattggttgacgaaatggccctaaatgtattcttgtcccatttttcagattctgggcttcgtcgcgtttattcttgcaatttgtgccagacgctcaacaaactccgcctgggtagaacacatcacttttgagacgacaattgttgtctccgttttgatcattctctacgtggtttttccacatttgacttttgctgacgaacgcacgcgcgaaggactcattgtcgtggtacgctccgaatgtgttagtgttctaatagaacacaaatttggcaggaaatgttcttttatggaataaacacactcttctttttcattggggttggtcagctaaaacctattttattaacattttgtattcagatttggctaatggttcatttgagtgcgagttttacggctgaaggacgaggagcggccattttgggatcggttggttgagcaaaaacatttgagcaaattctgattttccagattttatgcttggcactctgtgttatttatgcgggagaagcctatataaaattcaaagtgtggacaaatcccgcgggaaaagtgcaacaatcaaaaagccaagcgcagggacacaaccaagtgccaccagcaccgacgcattacgaagagaaaacaatccgacgaaatgaaatggaggaaagggcagtcgtatgaaaggcaacggacgaactttctttcctcttcactcactaaccaatattattattaaactcacaaaacaatttgtaataataaaaaaccgcaaaaacattggcccaccttcattctgagcaattccgatttttgaaaggcgaaattggtcggttgtcttttgaagcgctgcttttctttgatcagcaaattgatctccgcctcattgtatttgtagttgagtgcgtccacaatttccttccttttccggtcaacaaagtcgacggttagcatgggcgtgttctgtttttataaatattatccagaaaaacccagagacttataagctagaatgatgcaaaaaaatatttgggaatttttttaatctataagcaattttgctaacaacaaaaaccagcaatgttgaaaatttttgggggtgcaaaaagaactagcgcaatgttattataaacaaaaatagtggaacggtcgaaattcaccgaagaccgcattttgttgaaccaaaacagaaactcgctttccataataagactgttggagacgaactccaaccgatagactcgcattggctcgccatcgctcacctaaaaaaacgaaaatggcataataaaggctaaagttggtttatttttgggtgaattgtgttcacttgccattaccttgaggcgaaagcctttgtttgtacggatgtcactgttcggctcgacttcgtaaacttttgctgtctccacaacttcgactacctgagccgcctaaattccaaacagttcgctaagattatttccgtttaatataactgacgcactctgtacacttgcttcccatccgatttgttgggaccgattgaaatgcgaacgaagcaaccgaccactgttttagcgaagaacggagcatgaacaaatttcgcgagctttcgccggaaaagttggcaacggataatttcatcccttgttttaatctgaatgccaaaatataaattcgaaatgcgttggaccacctcttgtttgacttcgggagaaggagaacgtgacttggtcaagtcggggctggaggaacgcgaagaactcgtcgacgaactgctgctgccggccgattttccaccttcgttttcgttgccaaatatttcgtccaagtcgagagtcgccttcaatgtctccttcttccgcttttcttcggcttaaaaagtttcaattacatttcaattcatccaccgactcttctttctctccaattgccttgtattttattgcgtcgtttgctcaataagtcggccatggctttctttttactctgtttgttcgcgacttcggatggtttgtggtattccgtgtcgatttcgtcgtccgactcatcgggttcagctttaaccgcactcttcgaatgtgatgtctcttccgcgtcgtcggaactgctttcggctaaaagtttggcaaatgacataattagggccaatatctgggcaatcatggagtttactgg

SEQ ID NO: 315 - DNA, 4720 bp, Heterodera glycines
  genomic virtual cDNA Sequence=SeqID_601; coordinates=4678..4610 ,4563..4421,4364..4232,2774..2633,2557..2331,2144..1789,1725..1592 ,1543..1397,1352..1269
  coding sequence=SeqID_916; coordinates=4678..4610,4563..4421 ,4364..4232,2774..2633,2557..2331,2144..1789,1725..1592,1543..1397 ,1352..1269
  peptide sequence=SeqID_1248
ctaattaataatttaattaattaattaatcgccttgggtcgcatttagaaatgcagcaatatgttgaagaaaaatttttaccaattttttccaaaatcgttcttttttggtgttaattaattatataagtacatcataaaaaaatttaggccgaaccaaaacgaaacaatgttagtttaatatttgtgctaattaaaaatgtaattggacaaagttgatcagttcacttttcgtggtgatcataacatcaaaattgtttgaaatcaggtcgaaaaacgcctgggggttggaaaattttttctacaaaaagaaaattgagagaatcccgttttcgttccgcatatcacaaaatttccgttccatcatgaattttctcccaaacgcttaaacagttgcaacttttaattttcttttacagattctataaaatattatcttttatgataaaattaatcggattacttgaaaaaaatgaagatggaatttgttttttaaaaaaagttttgactgatttcagtcaatgaaataaacaaaattttttggaatttttattgtttgtgttggttgttatcacaattcccattaatcgcattttataattttacaaattaaaagcaatcacagaacaagataattttagaattttttggaaataaatagaattgaacaattttttaatccgattttagctcatatttaatgaattttctgctttatataaaaattcagtctcaaattatgaggaaacaggcatgttcggtggaatgaacatttaccatcaaaaatatttcacagtcccgcttcctgaattccgtccagaagcagctgcactcggtgcttcgactcactctgtttcacaaagtccaacagtttgagcatccgcttgatcccaatcgatacgccgctgttaattgccgatttaattagggcgttaaatacattaatttgattaactgaatatacaaccatatcaagaagttcatttttgtaaattagatttatttttgaacgttaattttggattgctgaaatttcggactttttgggaatccgtaattgcgcgtttcatgtaatcaaaagccgatttatttacagccctgatcccgatcggtgattcgaattcggatccttccttattcatctgttttttaattttattatttgatttttactctctgctgcggagttcgtcctcaatttgtttgatctcctcctcgctgaaaatgttgacctcctctagcaccgccatgacgtggttgcaacgcggatcactttgctgaacacgctgagcatgtcggccttgtacaaaaactgctcattcgacgtggtggccaagacaagcagacgatattctgaattttcaaatcaaataacaaatttaggagcacgaatttacctgggttggtcgtttcccaagcagtacaagaagcgtttgcaacaccatgttcgagtagcgtggtccaattggggagtaatccatcagtcgctcgatgttgtcgatgatcacacagctaagcggcgatttgtacgcgtcttcgaaaatctccaaaaataatttatttaaaaatttgaaattctctcaaatttaaaccttccgaattttggcacatttttccgcttcactgtacccaaccatctcttcgggagtgcaaactttgatgaacggaaactccgaatccttggcaatttgcgcagccaaaaaggatttgccagtgtttggaggacctcaattgtttaaattaagcggattaataaatctgctggtgatgatgattgactgccttttacccgctagcaaagctcggacgaacccgcgcgtgtcgggcgcagcggtctctttgatcagaaggcgtcccccctccaacactcgcgagacgcagtcgccccacaggcaaagaccgccgtacagcagccgattcagcgtcaattgcttcgtcgtccacctgaattggcccttcggcttttccttctttcgtccatttgtgtcctttacctgctgaactttgcctcccggtttgaccaatcggttcattgcggacgattgggcggcacggactaacccttccaactcggcacccgaaaaattcttggtcctttttgcgatctgctcaatgtttacgtcgctgtccaatttgttgtgttctcttggtgggaaaggaggttggaatttcttctctctctctctcactctctcttctctcactctctctctctctcactctctttctctctccctctctctcagtcattcctccctttctctctccctccatctctcactctttctctctctcacaaatcagtctcttatttttctttttttttcacacctcatcggtgccgtgtgaatgttcaggatttggatgcggccctgcttatccggcagtgatatttccagttgcacttccatccgtcccggtctcagcaacgcctcgtcgataatatccttgcggtttgtcatgccaatgacaaggatgttgttcagctgctccaccccgtccattttggtcagcagttggttcaccaccgtatcatggacgccagtagaagagccgccctaagaaatttgcacaaaatcctagtttaagcggataaaatggctttactgtcgaaatggtgtgactgtttttaccatggatcctctttgtttgcagttggcgtcaatttcgtcaaaaatgattatgtgcagccacgagttgggcccgcatcggcgccattcctcctcggcgtcggcgaacaatttgcgcatgttcgcctcagattcgccgacaaaccttcaatgtggtctaccgtatttgctctttttatatgccagtctccattaatctgccgtctccaattatatacccctttcgaactaggttgaaaaataatctcccagtctccatttatgtgccaggggggataaatagaatttttcataaaattttttggcacatttttcaaaaaaaataaaaaacaattcaacagtaaaaggggctaataaatgaacaattcgtcgtcatctccgactccatccatccctacatcatcatcatcagataagccggcttcttcgtgatcgtttccgtccatctttcgccgtttcatttgccctaaactcgcgcaaaaatttggtcccaatcggtccaattgctcctaccggcttgaagcaagcaattttttcttctcctgttccgtccaatggcgttgtcagcccacaaacttaaatatttaagcctttttcctgtatccatttttaactgaccctcaaatgatttgataataacttctttggagatttcctgccatgatcggtagatccaatcaagtagcacttgaagtgcaggtgccttagggttgcccgccgatgtgaacaccttttccgccccgttggacatccaaatgttgtagaagtgtcgaattcgctccttgaacggcttgttccacgagacatcgggagcctagggaagacaaagaatttcattgagaaagatgacttagcacctggatgaatttggtgcagccgccagggataaaaaccgtttgcactcccaattccttcacgaccttcgttgttctctcgctcttgtggctgccaaacgcatcccaaaccaagaggcgttcgccaacgaacagctttgcgccgatgattttgtgcaaatagtcctcagttgtgtcatcattcatccacaccgagccagcaaaattgatcaccaattttccagcaaattggtttctgagccttctgctatcggtgcattgccttcctcgtttgcgcagttgttgcacacgacctttccgccgaagccttcgttttcaactccgccagaatcgccacagaaggtgtggcacggcaatttgcagacggaacagctgtgacttcctccataaattgctttacaaacgcagcaaaacgattccatattttcttaaattttcattaaaaaagcaaatttttattcataccggaagcaagaaaatggcacatttctgccatttttgggtcaattttcagaagttcttaacaaaaatgcagtaaaaatgatttttttttgactcgatgacttttttggcgacatgttcaaaaaaattcaaaaattttccactaaataaatctaatctcccagtctccattagtttaccagtctccaattatctacccctttctgaggaggttgaaaaataatataccatggcatataaaaagagcaaatacggtaattacaaatgccaactgtttcggtcagacttgctcagaatttcgggcccattgacaatttttggttcgcgtgcgttgagcattttgccgatctgtcgcgcgatgagcgttttgcccgtccccggggggccgtagagcaaaatgccacggacatgcttcatcgctcaaggcaaaattacaaatggaaccccaaaaacagcaagggacaaatcatccaacccatttgttcgatgaattcaggcggaaaaacccgcgaggcgaaagcgcggcggaaaacggaggaaaattctttgtccaatccgccgatgcccaactgttggaagtcccaatctggattgaccagcgcacgatgggacgactttctgaaaagggaaatgatcaagaaaagcactgaacgagattaggcaccctttactatgaccgatcaaattcatctgtgaattttcaggccgatcgaaaatgaccacggcattcgggctgagcggaccgaacgaaagctaaaatatgtaaattaagtga

SEQ ID NO: 316 - DNA, 6261 bp, Heterodera glycines
  genomic virtual cDNA Sequence=SeqID_602; coordinates=1276..1390 ,1539..1745,2027..2184,2298..2405,2511..2597,2667..2786,2911..3015 ,3356..3547,3605..3739,4056..4193,4285..4374,4693..4761
  coding sequence=SeqID_917; coordinates=1276..1390,1539..1745 ,2027..2184,2298..2405,2511..2597,2667..2786,2911..3015,3356..3547 ,3605..3739,4056..4193,4285..4374,4693..4761
  peptide sequence=SeqID_1143
aaacgggcaagaaaggtggccaaattgccaccctcggagtagtggaaggcgcccaccaagcgaagaaggcccggcactcgcaaaagggtggccaaattggtggcaaatgtgctttcctgatcgtcttaaaaaaatgtagatgatgaaaaattgtagacctggcaaaaatgccattccttgctaaaaaattagaaaatttcaaatgtttcaacaaaaaaaaactcaaggaaatttatgtaccgtctaagcgcggcataaaattgaactcgataattctgggagaactaactccatccttttttctcaaattttagtaatttttaatggacgctaaattcgtcaaaatgataataaatgagatggaatttgaattataaaccgacccttgaattcgtaggacaggaacaagttcaagcagtacttgcaccgttccttcgacattttctgttgctgttccgccgccaatttgctcagccattgcaccgcctcgtccccaatgccatccatccaattttgcatgccataaatgctaattgagctcacggcgtccgctgagatgggcaaagtgccatcgctgttcaaattgaggcgctaaaatttgcattcgcgtatttcttaacaaaatttaaaaactgaggtaaaattgaaaattaaatttatatatttgactttttcaatttaaatcaccgttttctctccgaaattcgtgcccgagtaaatgcccactgttttcaactgttctttcctctgttgttgttgttgcaattttccatttgcatcgccttcatcaacatcaaccagcttgaattggatgctgtcaactgcctaaagcgacttttttttaattttcaaaaattttaatccgattccaggtttttggtatcccatgatcagttttttagacgtcggctgatatcctaggtttgagctattaaaaagctaacttcgctgtgctttcgtttactcatcgtagcggctgcacgtctggcaattaaaaatttcacaaaatgaaatttattgaaattttaattcaaaacgccacaatttactttaaaaaatatattttaaagttaaaggaagggaaaacaaaaaatcgtgtgattttcttttgttttgtttttttggttctttttttttcaatttttgcttttaaaatgtgtaaattttcttattaaaattccaatttttagagttttttaattttgtctcaaaaatttctcggtcgcttacattttttgggtttcattttcattttgcctccatttcttcctaggaatgcgcattattcttccttcccgtgcccatttattcgtcagggatgggttccgtccaattcatcccttgcgcagtttttctcggacggcgacgcaaaacagcagcaacacgacaggtttttgcttgactttataactcgaaatgaataccatcaaatttcaaatctgagtgattcagtaggtttggtatcagtgctacccagaaaatcccccgaaataatcatcccgtctttttttacaaattatacaaagagatattttcagatgtcgaccttgtcgtgattgggtccggtcccggcggttatgtggcggcaatcaaagcggcacagcttggcatgcgcaccgtttgtgtggagaagaacgacacgttgggcggcacttgtctgaacgtcggttgcatcccgtccaaggcgatgctcaacaattcccacttctatcacatggccaaacacggggatttgaacgcaagaggttattttgatcgcggaacggcgttgaaaatcggaaattttggatttaaaaaaataatttttgggttttatccctcctgtttttgactgttcaaatagcgcccgctgagaatttactgatttgttactctgtgcatggattaagtaacacccggttctaccaaattctcaaatccggtttaatatacgcgaatttacaataaaaattctataaattttgtataaatttacgctaccaataagccagagaaaacagcaaaaattttttcattattttcacaggcgtcgaagtgagcccgacgctcaacttggacacgatgatgaaggcaaagttggcctctgtcaaggggctgaccagcggcattgccgcgttgttcaaagccaacaaagtgacacatttgagcggtgttggcacaatcagtggacccaacaaagtaagggtttctaatcacaaatgggtaaaaatgtcttcattttaataatcatgcgaaaaaaaaacttcatacaaaaatcgattttttcgaaaacttcatcccttttttaggtttccgtgacaaaaagtggcagcagcgatgtaatggaagtgaacacaaaaaacattctgatcgcatccggctctgaagtcacaccatttcctggcattgacattgacgaggaacaggttcattgatgaattttttttaatatttttattttccacctcaaattgattttgaggtcccaaatttccgggtgcgctaataaattttacaaaaaatgttttcagattgtctcctcaaccggagcattggcgttgaaaaaagtgccacaaaaaatggttgtgatcggcgccggtgtcattgggcttgaactggtaaatggcaacattattttcaaatttggcccctcaaaaagatattaaaaaaagttttcttcgttttagggcagtgtttggcaaaggttgggcgccgaagtgaccgccgtcgagtttatgagtgccatcggtggcgtgggcattgacggcgaagtgtccaaacaattccaacgttcattgaccaagcaggtaaatgcctttttaacggaatttcatccaaagcatattggaattttttggtacatttttgcttgaaaatttaaaaaaatggacaaacatgagatttttaactaattttttacactttgtttagggcatcaaatttttgatgaacaccaaagtgttgggtgcgcagcgaacgtccgatggacaggtcaaagtgcaggtggagacggtgaaggacggcaaaaagcaggaggttgggtggggttttttaatgacattttagggccaatttttctattctctactcttggctaaatgtgtattttttgaccaatacatccggatgtactacttcattctccctctcccaccagaatttttttaaaaaaatattctaacagaattattcaagaaaaaagttcttttaaaaaaattttctgcacttttttggaaaaattaattatttacataaaatttaaaaatcgtaaaattttcctcaatttttttccttgaaattttcctttgaaaaatgggtgaaacgacttgctcagattaaatccattgtctctatacgccattctaacattgcccagttgaactgtgacgtgctgctggtgtccattggacggcgaccgtacaccgatgggcttgggctgaacaatgtgcagctgaacacggacgagaagggccgtgtgccggtcaatgaacgcttccaaaccgcggtgccgtctatctatgccatcggcgatgtgatccaaggcccaatgttggcccacaaggcggaggtgagagaggggggggatgactctttttaaatataaaaaattcactcaattttaaaggacgaaggcattttggcggtggagggcattgcgggtgggccggtgcacattgactacaactgtgtgccgtccgttgtgtacacgcatcccgaggtggcatgggtgggccgagcggaggagcagatcaaacaggaggtgaacaaaatgatgggttggagtcggggggtgggtaatcaatcgatcaagggtcaggaaaactgggccggactggtccaaagccttgctttccttaccctacaccgccccaatagtgtttccccgaaaaaattttaataaagatttatctaaattttatgatgaatacacccaaactgtcttttcaaaaaatttatcctgaaaacttattgcattaaaaaatttttgagatttttgtcatgagatttttttaattttcggggggggggggcgaaacggcggggtgaaatatagtacatccctcttccaatttcagggtgtcaactacaaagtgggcaaattcccgttcgtcgccaattcgcgtgccaaaaccaacaacgacgtggaaggctttgtgaaggtgatcggcgacaaggacactgatcggctgttgggtgtgcatatcatgggaccggttcgtttgcttcttttaattaaatattgcattcaaaaattttggcgttttgtccctaactccaacaaattttttttttttttttgctcagaatgcgggtgaaatgattgccgaagcgacgcttgcgctggagtacggtgcctcctgtgaggacattgcgcgggtgtgccatccgcatccggtcagttggttttgtttgcgtgtgccttgccgtccagggaagcggcaatatttgatccgaaattgtccttctattttcttttttggtgaagatcgagaagacaaaaaaaatttaattttgaaaattttttggagtggggcggctcgagagagagaaataaagtgcacccaaataaattcccacaatttaacaacttatcttggaccatggaactcttctaacgcttttttgataagtccggcttggcccaatggagcctgccaattcgttttccatttcctacgtccctctcatccattcattctcttgctgttttagaccctttccgaggcgttccgcgaggccaacctggcggcatactgtggcaaggcgatcaacagcatttgatgaatgaataatgcattcgcagcactgttcatgatatatggattgaattgtgacattggcacttttttgtttgttcgcgcactgttttagatgttagagatagcaaagagagagagagtacagaaaatgagacaaataaagaataatttaattttaattaaaaacataatcgttctaaagttctcttttttcttagggaccaaaaatcagttgacttacttgattcctgttgtatgtttgcttaaaatccacataaaaaactgttaacaataagtattttctatttattttaaagtggactaaaaagcaaacaaagtaaaaggtcatcagaaaaaatattgagcgtcttttcaatttcgtaaaaatttggcctctggggggtgggcacgatctttcgtattctgtaaaagcaaatttctgatcccgccctcttgtcaatgtacaatatgattgtaggtgtgtattaattcattttttgtcgcttcccattgccctaccaaacaaatacaaaaataaatgtatgtaatggaaagaaatgtcgacccatattgataaatgttgatatgtcccagggatggcattccgaggccccaaaaaagcatcacaaaattcctgttgccaaataaaattcgcaaaaatgtccattgaatgcaaactcggttgtccggggaacaagctcgtcaaacagttccatcacaatgcgtccaacaggctcaccatcgatgtgaatgtcaaaaaagcagcgccgtctctcggcctttgacaccgattttgaatctagtaggatggtcaatggaaaaaagtaggttgttcgagacattcatttctttacacatcaaagtattttaaattgtgtgcgatttctatcaaggatgagcggatcagcagggggatgagatgcaatgaaatacaagcaataacagtattcaatcatttcaaaacattggattgagacggaatcacaaaaaaaaaaatacattttatcaatgaattcaataaacaaaacaaaaaataaaggaaaatttaacaataataaatcaacaaaaaaatcactcttcatcgtctgctttttcttctactttttctagcaaaaacttcacccaaacagatcgtccatttttaaaaaaagaaatcgctttgttttcgaagtcaaaatggcacttataataaagaaattcgttaatgcccaatctaaaattattgtttgcagtttctcaattactttgacgtaaacatacgttaaagagtccttgtccttttcaaggacatcgcatttaaatcccgtatcttcgaattcacctattttgatgtttaaaccatgcagcctaaatttttagtttaaaaaaggattgttcacgaataaaaaacccactgtccaagggtttcttctggatcaccaaatgcggggttgaactgttttttttttaaattgatccaactgtggtcccaaaattgcacgatttgcattgaaaaaaggtccgcccataacagcatttgaac

SEQ ID NO: 317 - DNA, 2223 bp, Heterodera glycines
  genomic virtual cDNA Sequence=SeqID_603; coordinates=507..623 ,677..862,1016..1174,1243..1355,1401..1561,1609..1745,1800..1880 ,1925..2139,2188..2223
  coding sequence=SeqID_923; coordinates=510..623,677..862,1016..1174 ,1243..1355,1401..1561,1609..1745,1800..1880,1925..2139,2188..2209
  peptide sequence=SeqID_1148
cattttcgttttctctcaacaaatgtattcttcgtttctttaattattttttactactaaattttatttgtattcgttagaatttgtttcttatttgaaaaaacaacaaaaagctatatttgattatttattatctttttttccgttttccccaatgcgtatttatgtacctattttactttttgtcatcaaaatcaaaactaagtcccacttccacaccgtcttcccccctccatatgaaaataaaatttttccttaaatatcagaattttaaagttattataatttttattttccggcactttgtagttggtaggaacgatttggggaaaaacagaagaaacaacaggacagaccctttttggactgcttttgttttttcctaaaagaaaatttgcaaccaattttgggttttttaaaataagctcatcacacacaactcaaaagtgccaaattttataaaacttgaccaaagccctcaattttttccttttagaagatttgctgtgatgcgttctccatcaccgaccgataatgacaaagcgcgttccttaaatgcgtacagacgtaaattggccgaatataaagaaattgagaatcggcttaaggaattgcggactaaggtgggtttttctttccaaatattaatttttttggattcgacttcatttctcaggaacgcgaaagtcacaaattgttcgacaagtcggaaaatgagattaaatcgcttcaatcggtcggtcaaattgttggcgaagtgcttaaacaattgacagaagagaaattcatagtcaaagcgaccaatgggccacgatatgtggtcggatgtcgtcggaccattgacaaggagaaactgaagcaggtcgaacggaaaacaaacttggaaacgccattatattggccaaccaaacgaaagtttaaaatttgtgacaatttttgatccacataagatggccacccgcatttgcagaattgacaattacatttgccattttaataaaatgtgcattttcagggcacacgtgtggctttggacatgaccacgctgaccataatgcgccaacttccgcgcgaggtggacccgttggtgtacaaaatgagccacgaagaccctggcaatgtgagctatgccgaaattggaggtctctccgagcaaatcagagaactgagagaggtaagacaatttgagagcgaaaatcgaattgaaatttgtgggaggaatctgttggaccacaccttaaggttgttgaactgccgctgatcaatccggagttgttcaaacgcgtcggcataacaccgcccaagggctgtcttttgtacggaccgccgggcaccggaaaaacacttttggccaggcacagcgaatttaattagcgaattggcaaaatccgtttcctcagggcggtcgcttcgcagctcaactgtaactttctcaaggtcgtctcgtcggcgattgtggacaaatacattggagagtcggcacgaatgatccgcgaaatgttcaattacgcccgtgacaaccagccgtgcatcgtttttatggacgaaattgacgccatcggttaaatttgttatatattaaatttttttgatttgtcttattaaaaggcggacgtcgtttttcggaggggacttcggccgaccgcgaaatccaacgcactttgatggagttgctgaatcagatggacgggttcgactcgcttggcaaagtcaaaatcatcatggccaccaatcgacccgacacggtcccacgattttcttttccatgaaacttgcaactcttcacataatatgttcagcttgacccggcactgctccgtccgggccgattagacagaaaaatcgaaattggactgcccaatggacagagtcgtcttgaggttttttctgtgtcctaacggtactgagcttttcccttacccaggtgctgaagatccatgccaccaaagtgctgaaaaaagaagaaatcgattacgaagcggtggtcaaattgtccgagggattctcaggggcagacctgcgcaatgtgtgcacggaagctggactgaatgcgatccgaaaggagagggacggcgtggtacaggaggacttcatgaaggcagtccgtaaagttgcggacgccaaaaagttggagaccaggcatgcattcttaccgtttttgttcgggttatgagaattttgttttagtcttgactacaaacccgtgtgaaagggctgtaagca

SEQ ID NO: 318 - DNA, 2757 bp, Heterodera glycines
  genomic virtual cDNA Sequence=SeqID_604; coordinates=70..228,329..538, 964..1107,1163..1268,1302..1324,1577..1664,1761..1837
  coding sequence=SeqID_948; coordinates=70..228,329..538,964..1107 ,1163..1268,1302..1324,1577..1664,1761..1837
  peptide sequence=SeqID_1171
actggttttgttcattataaattttacaaattatcaatttttcatttcactcttttcccatattcccaggtcattgactcgtccgatgtcgtcatcgaagttttggatgcccgcgatccgatgggtacgcgatgccgccaagtggaacagttcctgcaaaaggagaagccccacaaacatttgatccttgtgttgaacaaagtcgacttggtgccaaattgggttacggtaaatgcatttttcaaccggcacaaatttataatttattccaaataattcggtcacgctttattttgtaatttatagcaaaaccttaattacattgcagaagaaatggctccaaattctgtccaaggaaattccgaccatcgctttccacgcgtccattcagcatagtttcggcaaaggcgcattgatcaatttgctacgacaattttaccggctccaccgcaaggaacggcaacagatcagtgttgggatgatcggttatccgaacgtcggaaaatcctccgtcattaacacacttagggccaaaaaagtgagtgaagcgcaaagggtggtcattgttgggcaagggcgtagccaggggcccccgaaactcaaaaaagtaaaaattttcagcaaattttatgcaattgcatatttttgaaaaatggacctcaaaatggcaacaacaaaaaatagccatttggcgacaaacggttacaaattcctgtaaaatacccccccccctaattcgggatttctaaaaaagaaaaatacgcccttaaaatcgaatttttgagttcagtccccccccccccccctcgaagcaagaatctggctacgctcttgttgttgggtactaaaaaaacgccaaaaaaatttaaaaataaacttaacttccttgcctaattgtagaaaaaaatttttgagaaaataagcagaaaagtcaaaatatgttctgaatttgaagaattttaggtgtgcaaatcagccccattggcgggtgagacaaaagtgtggcaatatgtaatgatgatgaagggcatttacctgatcgactgtccgggcgtcgtttaccctccccacggggacacggaaaccgatttggtactcaaaggcgtggtgagaattcattggtttatcacttggacgacgagtcacatgttttgtttgtcaggtccgagtggaaaatgtgcccgatccggagaatcacatccaaacagttttggacagagtccgtcccaaccatttgcggaggcactacaattttgtgaaaagtgagggtggcggtgcgaatggcgaacgcttttggacaaattgcgaggattttatgaccaaagtgagtgggtaaaggcaagtcgtcataccctgaaacgttttcgggggggggggggatttcaggcggtgatccgtgtcctcactgtcaatagttttattaaaatttatacaaggtttaaaaagcgcattcgtttttcctcaaaattttttcatttatttggggggggggggcgacgcgtgccctccccacccaatggatattgggcctggcctggctaaatgggtttttgttattattatattatcatttaagatcgctctttcctctggccgtcttctcagaggaggagagcccgacttaaacacggtggcacgtcaaattctgaatgattaccaacgtggtgaggcaatagtttaaaaaacgcgtaaatcaaacggattcttccaaaccaattgatgcgcagagatttcacgtttataatttgtccgctaataaggcaatctcccgcattatgtggtgccccccgggtgcgagcggacattggcagacgacgacgacactaaaccggacgaagttcaggaaaaagacgaagtaaactgaagacaaatgtcgaaattggccaatgaactttgacccgaccccgaattaatgacgaaacccaaacaaatgagcatttataatttctctttgtttccgccatggaatggaaccgaaattcccttttatttgccagagacccatcactgttgtggaggaagatgagagagcacaggtgacagactcggaatatgaagacggaaagggagtggaagaagaaggggaggaggaggacggagaagaaaaagtgaaggaggaagtggaagaggagggggaggaggaggacatggacgacccgagcggagagagggccattttacgagcaattttggagaaaaataaaccgaaacaaagcgaagaaggggaaatagtggacaaaaaggaggaagagcgggacgagacgaaggaagacaaaggcaaagagagggaagaggagggggaagaagacgaggaagacggcacatccagtgtggtgacggactttgaatttcaggcatattgaaaccgaaaaattcggaaatacgttgctcaattacagttcagcacaacggatgatgacgcggaaatggagagcattggttccgatttggagggaaatgggatcggaaaggaggaaacgcggcggaaaacgattgggggcaaaagggcgagggggaaacggggtggcacaaaaaatgccaacaaaaaacaaccgcaaaacagcggacggaccgggagagcggcagcgattttgggggcaacgaatgccgaaaaagtaggagaaagcatcgaatggcatggcaaattgagatgaataaaattgaatttagacaaaggacggcgggcgggagaaggaaggagtggtcagttttgagaggtccaagcacagtgttccgcgcaacatgtggtacaaaaag

SEQ ID NO: 319 - DNA, 4861 bp, Heterodera glycines
  genomic virtual cDNA Sequence=SeqID_605; coordinates=42..158,206..331, 486..676,795..1125,1177..1353,1499..1588,1647..1810,1912..2070 ,2181..2310,2417..2595,2653..2799,2848..2959,3013..3221,3300..3625
  coding sequence=SeqID_977; coordinates=42..158,206..331,486..676 ,795..1125,1177..1353,1499..1588,1647..1810,1912..2070,2181..2310 ,2417..2595,2653..2799,2848..2959,3013..3221,3300..3474
  peptide sequence=SeqID_1193
cggtctgaggcacaaaaataaggggaaaaccctaaagttcaaatcaaatttcaggggctattgatgtgattgttgtggaacaacctgacggctcattggcctccactccatttcatgttcggttcggaaagtacggcgtgttcaactacgagaacaaagtcaatatttatagactaaaaaaaacatatacttacgcatttttcagtacgtcgacattgaaatcaacggggaagagattgacctgaaaatgaaattgggagagaacggagtcgcctttttcttggcaaatgacgaagagggaattggcgagacaaaaaacgcggagggaaaggtaaattgaaaaacttattttaaattggctaatgctttcgagaattaaattgctttttttggggagggggagggggtgaaaatggaaattcgaattttggcatgtttagaaaaagcaaactgttagtattttaagccataaaatcatcttttaggagtttttgagagaatcgcaaaacaaaaagtggagcgaagacacacaacagaacaatcggccgtcagcaattgacctggaaaaccaacggaaatgctcttttgcgagcagtagcagcagcaccagcagttgcacttcccaaccgcagcacaatgaatgcccaccaacggcgacgacaacagccgaaagaaagtgcgctttaaaacaatggaaaatggattaagttcacaaaagtaaaaacagctttaaagaggcgtccggcggtgccggcgatttctgccggaatttcttatggcttcagaatttgcaggcaatcgacgccgccaaagcggtcaaaaatgttcaatccgtcctttctcaaccacaaggcgtccgtccaacagaaccgtcagcgactgcctttttcgtcgtccatttattcgtgccgaaggaatcgctctttgcccgatttggccaatttgttgtcgccttcgtcgaacatctacgactctgaaactgttgctgaagaggaggggatgggccgacggaagggcacaatgagcagccgaatggacgagttgagaaagtcggacgggacgccggaggtcaacaacgccctgaagcattccaattccgcatcggtgccgttgaagagttattatgtgagtgagagggggacggactgaattcgaaacgcggcatttttgttttagaaacacgagtcagcaaaaactacccaattctcctcccctgacagtgacaagggacgggcagagggagaaaagggacagcgggcagaggacgacgagtcgaagagttgtgccccgtcgaccagcgaattggcggacggcgctttgtccgactcggaggtggacagacacggaagcattgtgagtagcattcggtttagttggtagcatcggcagaacaaatttaacaggcaaatcgctatttgagagtttcaagaaataacgcaaaattgaagaatttgccggttaccattggattttttaaattaattttgtaaattttcagaaagatccagaatggaaatggggcgaaatccccaaatccaacgggaaagggtcgaacaaagcggacggaagtgcatcgaggaaaaaggtggtggagaaaaacgcaataatttatcaatcgttaatatatcaaaaatggtcgttatcagagtcgatgggactattggtttggccgttggtcccgccaaaacaaagagaaggaaacggagggacggaccggcggtggcgaaaatggtctttcgttggaggacatcggcaacaacccggtcaaattcggcctttacatcggcccaagcaaaaccgaggccatttggtacggaaaatgaaatttttctttaatgggttggaagatttctctttctggaagtttgaatcatttaggctttttaattagagttccctttctaattgtagcatttcctcaaaaagttcggacagcggaaatggaccttctcttggcaccagccccacaatgtcattctcgccggtgcttacaattagcgaagagaatttggcctccgaattcgcaaaaggcaacgtaacaattgcggacagacgcccttcgaatgcaatgtgaatttttgagatgttaaaaaagttaaccaggaaattacaggatttccaaaaaatgctatcttttctttatggattgtttgacgcatttattatacacaaatatttagggacttcgaactgtttgaggagaaggcaaaagagaagcggtcgttgcgtctctcccgtgaccaattggacctgttgaacttgaactacgggtcgaacgacgcgcggttcagcatcacaacaaaatatcaggcaaaaattaagggggtgattagggattcaactgataaattcaaaaatgggattcaattcaatgcgcacagaaaggggtcatttttaattatgcattttgttttagggaactgcttggtgttcttgtcacatttatttgctcaaatggtatgacaaattggtcatctcggatatcgacggcacaatcacaaagagcgacgtgcttggccatgtcattccagcaattggtggcacttgggcccattccggggttgcagagctgtatactggcatcaaaaagaacgggtagaacattaaaaaaacaattgtttttagctagaataccgtcattcgccttttaagatatcaaatggtttatttgtcttcgcgtgccattggacagtcccactacacgaaaacgtacctgcagaacttcgcccaggggtccaggactttgcccgacggacccgtccttctctcgccttcttccgttctgatggcattcagaaagtactgtctcattatttacttacatttcacattgaattgtatatccagggaggtcattgaacggaaacccgaggagttcaaaatcgcatgtctcaccgacctgaaatcgctgttccccgtaggacagccattctttgccggatttggcaatcgcgaaacggtcggcagtttgacaaagggactaaactcactcactcccccctcccctttcaggacgttaaatcgtatcttgcggtccaaattcccccggaaaggatcatgattattgacccgcaagggtcgctcagaagggcggacaacaaagcgggtggttacgtgtccgattacccaaccttggccatggacagtgtcgactacgtgttcccgcctcgggtggacatggacggcatcgacattaggacgaaagaggacggcattttgaggtgggcaaatttccttcgtccggcttatcatttttgagccttcaattacaccccctgatgaattcttttctcgtgcagtgaattcgtcgcatggcgaactgacgctgaacaattcgatgcgctggtggacgcggaattggaacagtacgaagaaaggagcaaacgagcgaaagcaattgtcgcggggacgacggatggacgaggggcggacggaaagaagaaaatgtataggaacggaagacgggcaaagtgatcagagcaaaattatggatgattaattgacgaccataataggcggaatgcgggagaccaaccactcttttgtttggtttatgtaattaactagcctttgtgtcaactgttcaaatggatttgtctcatatcattaaaatttaattgatgaagtcggtgcagcaattccaatatttgttcggtccctttcacttttgtgtttcatggaccattatttattatttttgaaattcatttattcaaaatatttgggttgtttttgttttgaccagtctcaaatggattgttgcgacttcacttcgtcacaaagtctccatcaaatgttgttttctcagtcaaagtccgaatggcttctcccgtgctgtcagaagcacaaatgtacaatttttctcatggaataataagttggaccaattaatttctctgattagcctttttgaccgaccattgcatttgcctcgtcgtcgatgagtccctccgttgttcagctgatgcgcctcgtgtcctccgttgctcaacgcttctcacccggatcagttcggttttgctgtacgttttcaatcccttttcaaacccacatttcgttgcccccttttcagcgagtttcgtgccttcccttccgactccgttctgtccctttgcctttcccattgcctccgctttttcgactttccctccgccgagtccattggctatcagtgcgtcgcccttttggtcaatttggtcgaattgcattccccaaattgcggtgtgtcccttaatttcgactttttcttctcctaattcgactgctttttcagtccattgccaaaatgtcgacaaaaactgcgcatggcttctctctgtcggccattcgttgtgcggtgcgcacaacgaaatgttcagcaaaatgcgcatcaaagcattggtattgccatttgctacactcattattggcacttaatttcctctctgttaaatttttaaattaaaatctttccgaaaatgccctcgccattctttttggggtcgttaaattcctgtccatactttgatctattttcggtacttttccattttgatgccacacccttcaaaaaagcaataaagctgttcaggatgcttataactagacttattttagggccataaatgcctaaagtgtgggttgggttcgaaattcgaatgggagaacaaatatctctccgtctttctgttttgaatttaatatgcatttcttacggctttgttgctctttttttttaatggggtgtggcatccatcaaaacggaaacgtaccggcgtttgtttggatgtttgacatttcccacattgatttgtgtccccttttctcagcactctctgctccattgcgcctccattgagggctctcttccgttccgcgaccg

SEQ ID NO: 320 - DNA, 2440 bp, Heterodera glycines
  genomic virtual cDNA Sequence=SeqID_606; coordinates=2196..2112 ,2039..1897,1520..1346,963..550
  coding sequence=SeqID_1016; coordinates=2196..2112,2039..1897 ,1520..1346,963..800
  peptide sequence=SeqID_1223
gtttttggcatcaaaaaattgggcaaaaaatgaataattaattattactataattaaatagatgatgaaattagggtttttccattaacaaacaattacttttttttcaaaaccatgaaatttggaaaaaagtcatgaaaaacggtggttgaatgaatcaaatgcttcttctcaattaaaataataattattaaatttatttttatcttttttgctggatcttccgcgctctcttcggcttttttcccccaatttaaaattgcccttttgttggttaaattttaatttgttccattatttcgcatcgatcaatgagtggtggattatttagttttaacaattttaagggcattttttggccttaaacgtcggattgtttagggtgttttagtggggtttttgggcaattctgttttgaattttcttaaattcaataccccactttatcaagaactaattaatagggatggaattgtgtccgtccgaatgaaagaaattattaaaaaaggattaaaatcaacattttttaattaattcttcatttttgtttatttatttaaccgattaaatacaaaggtcagtgagcggtggcagcggtagaaaaaagagagagaaattgggacaatcaacgaaacaattgatcatccatcatcaatcatcattatcaataataccaattaatttggggggtcgtcaaaagtcaaatttcgtcttaattggtcagtcggcacagtgccatagatcaacaccatcacattactcattcgttcattaattaggcgtgttaattggtcatccattagccgagcaacttccgcatttggtcctcctgcgagcggatgacgccgtcgttgcgctccgtcttcttttgaatgcggtccaacatcagattttggtcctgcacctcgtcgcccagcgcgacgccaaacgttctcagtcggcccaaatgggcactcatcagatctgagtggtggaaaaagtcgttttttgatggtgtttcaacatttctcctcgaggctccaccccattctcatggccgtagcccagaaaactctaggcgttacagaattgttcgaaaatttcagcgcctgggagaaaaatattgagatttttaaccgtttttcgctgaaaagtgaccattttttgccattttggagtcaaagttccagaaatatgacaaaatgagggttgcggcggtgccaacaggctccgcccaaggaaaattttacaaattttaatggaatttatattaaaatatttaagctttttggcgttccaagttcctttttttgttgaaaagagaggcacggcacatttttacaaagaatttgtcaagacaaattacccaaattgttgtcaatttcgtcgtccatcgcctcccaacgagtgccctgaatgtacgcgcgtgacgaggagttcagcgagtgctgttgcgggggctgaacaccgccgcctccgccaccgatggccccggcaaattcgtcagcagacgactgcaccaaatgggcatgcagcggacgcttaattcagaagtcaaataacgctaattacttaattgtcacagaatacactctccccagccccgaaatgcaaaactttccaatttccttgacaaatttaaattttccggcagtctccaaacattttataacgcaattagccgcagcgggtcccttttttaaacctttgtttgattcaaaaaattctaagaaattctatgcctggacaaagggagcaggacaaaaggtcaccaccgaaacgcctcgggacgaaacgtcgccaaattttttttttttattttcttgaaatttttgaaaaatttatatattttaatcggatttgttaggcctcccataccccgaaatatgtgactcttttctatccatttttgatcacctgctgatgttgttgctgcacggtctgttccggttgttgctgctgattgttggcattggcatttgccgtgcccaacccttttggcgctcgtgaaagtttgtttctgaccagcccaccaaaccacgatttcaagctgttcaggcctgggcaaataaattgtcaatgatggtgaatatacaaaataaatttaaaatttggcctaaaaaaactctcactgcgctgtgtgtgctgagtggtgtggtgaatggtgtccaaattctgttcggcccgttccaacttttcccgttgctccaacaattcctgaaaaatcatcgccattaaatcaatgaaaatggaaattttaattaaacgaaacctttggaggctctagaaaaattaaaaaatgtaaaaaaaaaaacttggcgtccaataatggcacatttgccaaacaaaatgccgagtgggtcccatagaccgccaaagatcaatggaacagttcaagaccgctgccccagaaaacccatgtttagacggaaagaggagaaacaattaaaccaattaatgg

SEQ ID NO: 321 - DNA, 4751 bp, Heterodera glycines
  genomic virtual cDNA Sequence=SeqID_607; coordinates=3998..3942 ,3895..3710,3670..3565,3460..3267,2912..2676,2306..2209,1838..1710 ,1664..1443,1399..1249,1200..865,594..472,349..143,95..63
  coding sequence=SeqID_1025; coordinates=3998..3942,3895..3710 ,3670..3565,3460..3267,2912..2676,2306..2209,1838..1710,1664..1443 ,1399..1249,1200..865,594..472,349..143,95..63
  peptide sequence=SeqID_1232
tacaccaacgaggaaaattgaaagtttcagcgaaaatgttccagccgagacaacccgaaagtttatttgtcatcctttttcgggttaatacattcacaaaataataatgaaaatgtaaataaataaaatgcaaaaataattaatcggaatcggatgaattgctgctgtccacaaattccttcgagatgggctttttgctggggctgctttggctcttcttcggctgattttgggaactggtctgtcccgcggacgatggcccttcgcctgcttcctttttcttgctttggtattcgctcatctcccgttcgtatcgctctttgtcctccttcgccttttgctcgtaaggctaaaaagaaaggagtaattaattagtcagctaataacggacatcactttcacaatttatttatggaaacgtgttaaaattcccaagactctgtttccattttaaaaagtacggttgcccacctgtttctcctcagcgctcaaagccttccacatttgcccggcccttgccgccgtttccgtcacactgtcccccggctttttgatctgcggtcggttttcgatttgccagatgaaaaaggcggactgaattgaatggtttttaattggttctaaggttattattgcttctctcatctaacaataagcatattcttggttttgtttgatggctttaatgtttaatttgatgttatggtccaaaaactcatccggcgattttctcctaagtcggtcgttacccccctcctgtataatttttactttgcggagcaattctaacaaacttgggtacgactccgacccgtttttgagttccgttttctccctttctctccttctcttctctgttcccacctgatttcgtttcggtgcgttcgggtccttcttcttctcgcccttctttccctccttttccttcctcttttccttttttcccttctcttcctttccctcctccctgtccttcttcctctttttggctccttctttctctttttcctttcccttatctgtccccatcaaatcgtcggatacatccgtcccatcgtccgaatattcctcgtccggttctgagcccgacccctccgacgagtccttgtccgccttgcgcttcttcatctctttctccacgttgaagtcctcgtcctccgagtcgctttccgacccggccgctctctctcgtgcgtcgtcctttggtcaattaacaaattagcccaattcaaatttcgaaaacattaccttaagcttctctttgtacgggtccaactcttcgtcactgctgccagcaaatttgtccgcctctttgtacgctttctcgcccaatctctgcgcatttcgtattttcagtccctttgtctgtacgtagtcgaagagactgttatactcttccctaaaattgcattttaaaacttcccctttctttttgcgcttactttccgatgttactgaatatgatcgactgtccactcttctgcacaatttcaaagtcgaaagagcgcaaagaaacgtccgaccgcgcgaagtgaacattgtcaacttcttcaaaacgcatgtaaagcgccggtttgtgtacgtacacaaagcccttctccagcggataaagaaaacccatcgactggcgaacggcgcacgaaattgcgggagtgcccgaggcactaaaaaggcacacaattacacaaaggaatgactgaaaagccgaccccgtgaagttgccagggacgataatgcgcgaattaacaatcacacggaatattttagccattatttcaaacagataacccttcatgtgcatgtccaatttgttgttgtattgctgagcgagttgttccctggcgaaaaccattgtaaaacttacaagggaatcatccgaaatgtaagacggaaaatggtataaactttataccatttgataaagtttggtcgatttctttgtaacttttaataagcccttatcaagaaatcaaaaagttatgaggcctcaaaagtcgaaatttaggctgtgatttcctttcagcaaataaatgattttttgggcctcatatttttttgatttattgctttaggggcgtaatattaaatatttaaaaagtgatagaccatgctctgccaatagtatcaaattgattcccactttaaccgacttattttcgagtggtttcccagttataattataattgtgttcacaatctgtcactcactcagtgcagcctaattcgagctcaatgtagtcctcttttgagcactcgagcacaagaaaagggtatcgagtttggccctgccgtaccgccgggttcacctgaaacaaagacgaaataacgacaaacttcataaacaaatgaatatttatatcgagtctctaaacaggtattaaagtctcctaaagttcaaaccacttaaaaaattgtctaaagttttgctcatgcatttttaaaatggtttttataagtcagaaacatgaaatagtactaaaaccgagagaaaatgaaatagaagttttattttaaaacttgaaaaaatgcattgaacatcgattcgaatctctttttactaaaatgaagagatagcacagatttgtttctgcacaaggattgtgccctaatgccataaaaagggtttttttttgtggttttttcctttttttcctccatgattttgctccacttacgtgcaatacaaaatacatgtggcgtccgtctttgtgcggtagcaaaaacattcgtgttatcgttttaagcggcactttgtaatcgtaagactttccgtgaaaggataaatggttctgaaacactttgatttcgtaacgaccgcggggagtggcgagaagaatgtcagacaaagtggcaatcgcttggccggcttcgctttccacctctgcaaaacgcagcacttctttgcgaaactcctaaacgaaaaaaacaccaatcatttcaggaactcggcttgggaaaaccattcccgggagacgatgggttttggagctaaagaaaaagcccggcgcataaggtgtagcttacaagtaacagaatttttaccacataaaaagtgattttgttgagttagaaatatttagaattaagcggatttggcggcgttaagaaaattcagccaggattaggtataaaatatttgaaaaagttaaaagcttttttatccttgaatttatgcttgagtgaggggaggaattagggtatacgcatctcccgtctccgattcattcccctccgatttcctctcatctttcatagcttttttttacctcaactacatcttggtcctcattctcaggatcgtaaggaatgtgaaagcgcatttcagtcaattggacagggcattcctcgttaggatgaaattcgacgatcgcttccgattttgcggtttgacagcgcatgacatttgaaagaggaatttcaaacgccactttttcagccacattgaaaaccagattttgaccttaatcaaatgcgagtgacctttgttaagtgtttgtattaaattagcacatcaattgggaataaactgccaaatatcaccgattagataatgaaaaaaataaccttcaaattccgcgtcaccgtaattccatcctttcagagacaattcgttcttctttagagtcttttgccatttcgcattcgtaaaagcggaaaccctttcatagtcctaaattcaatgtattcaaacgctaaaataattacaaacgttttctttgagaccgccaaaacgatggtgcacccctgaattggtcaccactttcaggccgggcttattccccagtttttgccatcccaaatggtcaatgtccgattcagtaattgtcaacactttcccagtgcctttattcttgaattgcacattctggcgtgataatttaagaaagccttcattctgagagggaaaattgaaatttattttgaagggaaaagggacttacgaatcctcccatctcttcctgaaaaatattggagaactccaaagaatcgcttcccatttaaaatccttttgactttgcttatctaaataaaaggtcgcaatttttagttatgaaaaatctcgaaatattaacataattaatgaggaaaaatgccaaaatagtgacaaaaggtccggaatggaaaataggctttataaagtctcataggagtgtaaaaattagggcggggaattatatggaaatccatattttttttcctggactgtgggggcctgaaatgcacgaaaaacatgtttttagcttggtttgaagcttctaggatggagttccatatcaatattttccatatttcgcgatttatgtccatatttgtccatattatggcatttttatccatacatattttatgtccatattttggcatttttccaaaaaacctctattagaacggcccccagtagctaaattggcctttttgagcccaaaaaccggaaaattttccaaaaaatcattttttcgccaaattttctcgggaatattgaataaatttaaattttcataaaaattaataagtttatgtcaaaaataagcaaaaaagataaaatttcacttttctggttgatttttcgctaaaaatgagtaaattttagttttatcatgtttttttcttctaaaatgatttttaataccatatttagccatttttgaagggctatattaacaaatttaaagaaattttgggaaattataccctcaatttaaaaaatttatgtccatatttttgccattttatgtccatatttcgcgatt

SEQ ID NO: 322 - DNA, 3380 bp, Heterodera glycines
  genomic virtual cDNA Sequence=SeqID_608; coordinates=85..194,281..452, 819..932,1010..1136,1192..1453,1778..1888,2188..2381
  coding sequence=SeqID_850; coordinates=85..194,281..452,819..932 ,1010..1136,1192..1453,1778..1888,2188..2381
  peptide sequence=SeqID_1088
ctccctttttcctcttttgtgcatgtgcagtgttttgctaccctacttggtgtttcctctcattgtttgtgttgatttgtttaggcctttctgaagaaagtcactcgggcgcgtgccaagcgtgagcatttgaagttggagggactgctccgtgccaagcccaccttcagctatgaccatttggtgcgcgaaaggtttgtcgtgattctgtcaccgtttttttaaatctcactttaataaatttagatttctaaatccattttttcctcgcttttctaaggtatccgacttttgcgtccgctctgtgcgacttggacgacgcgctgtgcctttgttttgccttttccgcactaactcagtcgaaaattgcgcggccgcgaacaattggccaatgccgccgggcggtcaccgaattcatgcattttgtgattgaggcgaaggctttgcgaaaggtttgcgtcactttggcatttcatcttacaattagccttgcaagaagcgctggcactcaattttttgacaattttcctcgagaaaattcctaaaatttttctttcttttttttcgttcgacatcctttattcgtgctttcgactaattctactggaagagattcatcgaacacaataagaggggctgaaaaactccttaaattttgaatatcctttaaagattacattaaaaattccaagatttttccccggcgccaatcggcacctgccgggcccaaaaacttaattttctataaacaaaaattgtctcggaattgcaaaaatgttgcttgtacgagatctgtttctaactaaactcatttgcaggtgttcatctccatcaagggagtgtattatcaggcggagattttaggcgaacgcgtcacttgggtggttggacacgaaagggccgtcggacgcgccaacgaattggacttttcggttggtgggcctaacttttgttactcggaatttgcaaattttttctttcaccgatcattttccgccctttctgctaggtgatggccaactttgtcgacttttacctctgcatgctttgcttcgtcaatttccgactttacaaaacgctcggccttttccatccgccgcaattgcgccgccagcaaatgccatcggaaaacgactgtacgtgctgcttagcatgttgccagtttaaattccaaattttgaatgttttcagtttcgtttgaccattcaaatgagcttgacgagcgcgtctattcgctggcgtttccgctcaaacgcaccgacaaaatggacgccgacagttgcggcgaaccgtccatcattgacacatttgcggaggacgacgccgaaggcggtgaatcgctggcggagaaaatgcgtcaagcggaagtgcagaaaacactgtttgccaaatgcaaattcttcctgaaccgggaagtgcccaaggaggcgcttgcctttgtcatccgctccgggtgagcattaaaaagtcggggaaaccctttggaatcaaaattttctcggcgtcattttataaagaattatcggtctgtgttttgcaaattgaaaaagacattgaactgagtacctaagcctatgtacgagttgtcatgacaccaatgaaaaatggtttttttcgtatttgacaatttttgagattaccgttgactcttttttcgtttcaaaggcgcggtttcttatacaacaaaaattttaattttttcgctttttaaagttttcctcattgaaattcgagaaaaaaaaatcctagcatgataattataagttaactcttttagtgggggcttcgtctgttgggacggatgcgccccgaattcggttgacgaacacagcgaacagatcactcaccaaattgtggacagaaaagtggagaagaccaacattaacaggtcatccataacccatctcttatgaaataaattcttgcggttacacggtctgtggataacacacaaaataattcgtgcaggcgttgaaaaaccgagttttgacccttacaaattagtttttcaaaaaacctaaaacaactaaattttttgaaattaaaaaaaacaaattttttttgttccgacatttagtctcggcgacgttttgaggtgtacccagggtagggaacgtaatgcactttgcccagttcattcattgccctgtcaccccccttatcaaattgcttattcgccctgttcagagtgtacgtgcagccccagtgggtgttcgactgtttcaatgcgcggcgcattttaccgccggccaaatacgcgccgatggccacgctgccgccccatctttcgccctttgtcgatgcacaacatttggaagtcggcgccggtgcttacattcccttggagcgcattgaacacgcaaaacaacagaatggaacgggtcagtcactaacaaccgtatttgctctttttatcccccatatccattaatcccccaatctccaattatcccccagtctacgaggcgtttgaaaaataatcccccatgggggataaaaagagcaaatacggtaatcaagttttgggcaataatttttcaaaaatttttttgggacattaaaatttagtatttaaataaaattccaaaagattggacaacaagtttttgaaaaattctgaaaacattggctagttttcctaacaaatccataaaaaactcaaaaaaaatttcccagcggggcgctaacggcactgccggactccccctcccacggttcctcaaaaggagtgtttgtttttggcaattttttggttgctaatttaagagtggaactagcgggtgcgtgaaccgtcggctatttagctgggaaaaagcgcttcgcgctttgggagcttcgctacctagataagcattgagtttttttagagatttggaatttattttaaaatcttaaggggttttaaggccgcttcgcggcctcagacgggcgcttcgcgcccgttttttaaattgttgagctcatacgggcgcttcacgcccgttttttaaattgttgagctcatacgggcgcttcgcgcccgtttttaaattttgatgtgcattttcggccgcttcgcggcctcagacgggcgcttcgcgcccgtttttaaaattttgttggaccttttcggccgcttggcgcccttttccaaagtttgttgagcttggacgggcgctacgcgcccgtttttaaatatggtttggaatggacgggtgcttcgggcccgtttttgaaattttgttggactcatacgggcgcttcgcgcccgtttttaaattttggttatcagaagaggtacaaaaatgattagaagaggtataaaagtgattatgagaggtacaacagtgattagaagaggtacaacagcgattagaagaggtacaacagcgattagaaga

SEQ ID NO: 323 - DNA, 2401 bp, Heterodera glycines
  genomic virtual cDNA Sequence=SeqID_609; coordinates=757..884 ,926..1139,1190..1272,1317..1452,1495..1636,1678..1797,1848..1932 ,1982..2032,2083..2180,2226..2345
  coding sequence=SeqID_859; coordinates=759..884,926..1139,1190..1272 ,1317..1452,1495..1636,1678..1797,1848..1932,1982..2032,2083..2180 ,2226..2345
  peptide sequence=SeqID_1239
aagattgtttgattcggtcaataatttcaagagttatattgactaatttaattttttttttctccaaaaaattctccttcttcaccattccctactcttttctcacccagacccccattcttaccagtgcaaatttttaccggcggtaccggtactagacaaaccggtaccgatactttgatttttgaaaaaaccggtaccggtaccaaaaaaaccggtaattaccggtcggtaccggtaccgctcaaccctaattattaggctcaatttgtacggattttcatttaaaaaataataaaatatatatatcaattaaaatatttaaagaatatattaatatattttttaaatttttccctttaactctaattttcattctctaatttttcactcagacccctattcttaccagtgcttgtttttcccggttgccctaccgggaccgggacctgagcttttcaaaatccgggaccgggacctcggataaccgggaattcccggcccggtcccgttcaatgcacccggacagaaaaattaacaaagcccatcagaattttcgagtgaagccaaatttacccgaattcgactattttaaaatatatgaggaatacgcctaatcgatccaacgcttgacctttcattaaagttcatatttctcttttttgtcctcttttcaagactgatgctaaccaaaggcattattaactgtcctttgtctattctcaattttgtttttaaccaatctctgaatttaagacatgatcggaggtctttttgtttataaccacaagggtgaggtgcttatttcaagaatttatcgcgacgacgtgaatcggaatgccgttgacgcctttagagtttcagttatacatgcaaggcaacaggtaatttcatacttcaaaatattttttggttttgctttcagattcgttcaccagtgacaaatattgcaaggacttccttttttcacatcaaaaggggaaacgtttggatgtgcgctgttagcagacgaaacattaatgcatcgatggtcttcgaatttctcaatcgttttgcagacacaatgcaatcttattttggaaaactgaatgaggaaaatgtgaaaaacaatttcgtcctcatctacgaaattcttgatggtaaatttaaaaatatttaatctgttcaatgtagttttttttgcttttagagatccttgattttggttacccccagaataccgacccaggagtattgaaaacatttataacacaacaaggcgtccgaacagcggtaagaaaattatttaaattttatctcttactttgttattacagagtaaagaagaacaggcacaaatcacttctcaagtaacaggacaaattggttggcgccgagaaggcataaaatacagacgcaatgaactctttttggatgtcattgaatatgttaacctcctcatgtcgcagcagggtcctatcaattaattcgctaaaataaattaattctttgtaggtcaggtgctttcatctcatgttgcgggaaaggtggccatgaagtcttatctcagcggaatgccagaatgtaaatttgggattaatgacaaattgacgatcgaaggcaaaggcaggactggcactgacgacccctctaaaacgtagtgtcaataattttgtttttgtaatttttgttgttaagatcccgcgcttcagttgcaattgatgattgtcaattccaccaatgcgtgaagttgaccaaatttgacaccgaacatgctataagctttatcccaccggatggcgagtacgaattgatgaggtttttgcactttttttttgtcaaaaagcaaagcatcattttttgttcagataccgcaccacgaaagacatccaattgccattcagagtcattcctttagtgcgcgaggtgtcaaggaacaaaatggaagttaaggttggagtatttattagtattaggatttaaaaagaaattctttggttaggttgtgatcaaatcgaacttcaagccgtcgttattagcacaaaagattgaggtcattaattatgctacggattatattttcaatacttctctttttcgtaggtcatcattccaacgcctccaaatacaagcggagttcagctcatttgtatgaaaggaaaagccaaatacaaggctggcgagaattgcatttgctggaagtaaagtttatttgctttgttttttttatttcactgctttgaaaggattaagcgtatgggagggatgaaagagtcgcagatttctgcagaagtcgatttgctgaacaccggaaatgccgagaaaaagaaatggaaccgtccacccgtctcaatgaactttgaggtagttttcgttaaaaagccttttgagttaatttggaagtggggtactactatagttt

SEQ ID NO: 324 - DNA, 4171 bp, Heterodera glycines
  genomic virtual cDNA Sequence=SeqID_610; coordinates=527..616 ,1719..2021,2345..2521,2566..2654,2903..2949,3033..3370
  coding sequence=SeqID_880; coordinates=527..616,1719..2021,2345..2521, 2566..2654,2903..2949,3033..3370
  peptide sequence=SeqID_1110
ttttccacaaaaatgcaaatgaccaaacgaagaactgcactttcaactccaaaacaaggtaagaacccataaaaaagataacgcgaagaacggcgaatgcaaatatagtaattattctcgagtttcgctattatcacaaatgtttggctattgcatatcaccaattttttgttaaggaaatgattggactttccgctcaaactgcttaaaaatttatacaaatttgaatttttaaccatctttgacaaattttttatgaaataaagtaaattttgctgttaccgtaaatccgctatttgaaggcccggccttctaatggacccatcaattgaatatggcaattcaactaatttagtaaagcctcgtttcttattcatttgttcgaataaaattatggcatgaaaaaaagtaatgatttgcggaaaagttttcacgcatattctaattttagttacactagtgtctttgcgtgcgatgagacagctgtttgagtgttttaaggcggacggagccataccaaattttcatgaaaattgataaaattggcaattatttacaagatgagagagaaaaagagaagagagcgaaagaagtcaaaaataacaaaaaaaaagaggtctggtagcaatttatacaaatttgaatttttaaccatctttgacaaatttttttatgaaataaagtaaattttgctgttaccgtaaatccgctatttgaaggcccgggccttctattgttcaacccctccaaaaaggggcttttaattggagggggccttctaccagagaggggccttcaaatagcggatttacggtaattaccaatatatttgtggtttaatggttagtgcttcaacactaacagtatttcttgttaggagttcgacaccggttgacgttttcatttgaatttatttttatctgattaatgcagggtttctttatgttcttatttctgagaaatgttctgattttagggctaatttcatccaaaagaatgaaatttctgaaaaatttggctttctttatgttcttatttctgagaaatgttctgattttagggctaatttcatccaaaagaatgaaatttctgaaaaatttggctaatttctaacaaaattcataaaaaaattttcccccggcggcgcctgtcggcaccaccggcccccaaaaaacctattttttcttaaaaaattaacataaatcaataaatttggtcattctttagacaaaatctgtgtaattatgccaaaaggaattgaatcgaggcgatacatcgactaaagaaatgtggagccaacacataattcataaaaattaattttttggagctaattcaaatcaaaccctcgcccccgtccccgcgggggcggaattatcgtgcccccgccaccgcccccgcgactttgacctccgccatcccccgcccccgcaaaaagccacccccgcccacggggtccgaaccctagttccaactaaactgaacaaatttgatatataaaatttctaagcaaatactttttgctttggacgcacaggagaaatattatgaaattttcaacaattaattacgttataacttaagtcctaaactcctgatttcaatcaaaatgcgtaaagaatcatttttctattgattttctaaatgttcaaagtgattttgtacccttataagctatcaaaattattaggatttgcggttacccactttgttcctaaaaaccctccaattttattcgtaattttttatccagattaatgcctgtgatgacgtctgaacatttggctactgattcaaaatgggtggaccgggagcgtgtgatgttgctttgttcacgaggatctttggccagaacacggcatttggtaaatgacttcaaaaggcttatgccgcatgttcatggcgaatccaaatatggaaaaaacggaaaaatggcagaagatttgaacgaaatgtgtgaactggcaaattgcaccacatgtttgtattttgagagtcgcaaaggccgtgacatttatttggtaagtttagtttttactttgttttatttgtacatttggtaatactgccgatggtccccccccccccttttggagaaaatttttttcaattctaaaaagtcgtgaaaacacgttttgtggggggtttttagagtcgctgatcacgaatctgatattcgttttgaccaatttcgaatcccggattcgaacaaaaagtcgaaaattcaaaattcacttatgttcgaatctgtatagaaaatttcttttggcggaatcgaaaaaaatgttattcacttccttatttgctgctcaaaataacatttctaaaataccctgatttttagtggctctcaaatgttgacggtggaccatctgcgaaatttctcgtttccaatgtgcacacgatgagcgagctgaatatggtcggaaattgcttgaaagggtcgaggccaattctctcctttgacccggaatttgatggaaaatcgcacttgaggctcattaaagaacttctcgtcaacgtaacatttcattaacaaatgcagaagtaattgctgtaatttagacattcaaaacaccgaatcatcacccgcgaagtcagccgttcattgaccatgtgattaatttcgcagtgaccgaagatggaaatatttggtaattgggctctgctacactagcagtccatccatcaattcgcttggtttcgtggaccataacttttcttcgaatgtcgagaaccattcattctaactttcatatcagaccaacactcgaatgatgtcaaaaacataagggttgtaaaaatatggtccacgaaactcagagtgcttggatgattggacagtaaactgcaatagagccggatttacttgcgatgtaaataacaagaattgattccacaggttccgaaattatcaagttgccgaaaataatgaactaatggaaattggtaatctttctattgctagaaaaaaagaaaaaaaaaatctagttgaaaaattgtgtacgaattttcatgacaccatttttaaggcccgcgatttgtgcttcaactgatccgtttgtttgacaattctttttgcggagccgtcctttatgacaacccgaattaccaaacgccaaatgcgatcagaagacaaatcaaattgcaaaaggccgctgaatttaaacaaagacaagggcaaagggaagaggggaaagtcaaagaacggatgatcaaagaagtggaaatggaagacccactgggggaagtgtttgacacggaagaaaaaatggaggaggaagagaaaacggaggaaaaagaggggaagaagaagaagagggtgaacgcagcaaaagcactggagaagagaattctgaagaagaacaaaaagaaacggaaaagcacggggacaaagtgatgcaaacattggagcatttgtcacctttttgttatttgttttactaaagcaatttgaatcgaacaaatttccgtaaatttcaaaaaaattttcaatatcattagttaaatttaattttacatgaaaaaatttaaggaaattctaacgaaaatggatggtgctgaatcagtcattttgcagtgcgcaactgagaaaggaaatggcgttggtccatcagtcgcggccgattgtgaggcgaacaaattggccgaagtcaccgagggattggcgagaatcaccgcgacggcggagggcggcgagactttctacaaccgagtgcaggagttcaaccgagacttgacgtaaggcttcaaaagccgagcgaagggcgcgtctctttccatcttaaggagtttagggtcgtcgttttgagggcattcgctgccgaaatacccaacgaaaaagagccgaaaacggaagaggagggcccaaaagccaaacagaggaaaatggacgagggaaaagcacccgaagcaaatgcagcgcaatccgtaagcattttttagtcattgaaagtgcccattttcgcctcccagcagccccgtgccttttctgtgctcgatgccttgtccgcttctggtctgcgcgccattcgcttcgcgttggaagtgccaaatgtgacgcgagtggtggccaatgacttctccgagaaggcattcgaagcaatccgtcggaatgtgcagctgaacggcgtccaggacaaagtcgaggcggtcttttccgacgcaatgt

SEQ ID NO: 325 - DNA, 4131 bp, Heterodera glycines
  genomic virtual cDNA Sequence=SeqID_611; coordinates=444..501 ,545..591,672..702,748..922,1146..1293,1349..1465,1510..1539 ,1586..1681,1725..1881,1935..2194,2749..2896,2967..3237
  coding sequence=SeqID_891; coordinates=444..501,545..591,672..702 ,748..922,1146..1293,1349..1465,1510..1539,1586..1681,1725..1881 ,1935..2194,2749..2896,2967..3124
  peptide sequence=SeqID_1121
aggctgtaaattagtgtgccactatttcggcattttgcctcactattttaattaactatgtcgagaattttcgtaattaaaagtcgcagccctactaaaaacagcactgataatcaggcggcctatttcaaggcatatcaaattttaaaaataagtccacctaccatcatgcatttaaaaaaggacaacatcgaatatgtacctaacttcattttctgttccttctttgcattggttatttcgttgcacaaatgtgaatctgttgaaaaatgattttgtccggggttcagaattggtcaaaatgagtgttatattctgatcagtgaccatttttaatgattttttaaatttcaaaaagttgttatatatctatcatccactatttaaccaaattattacttttatttgctaaattattgggcaaactaaactaagcgtggataatggtatcgacaacaaatgagcaagatgaagaacaacaaaattggttgatgaaacaaggtgcgatttggtcatttagtttcaaaatattttttgtttaaagacttgcaaaagctcaatccggaaaaattgacaccgctgacagaagaagtaaaaaagaatacttaaagggggtctttcgtaaaggcaatgattgaccctctcctgtacactttgattaatttaaacaggtgatcagtcggcaggcaaccataaacattggtgaaaatttatttttccctgaatttaaaatttattttctgacagggacaattggacatgtggcacatggaaagtcaacactcgtcaaagcaatttcgggagtgcatacggtcaaattcaaaaacgaattggaacgaaacatcactatcaaattgggctatgcaaatgcaaagatctttcgttgctccaatatcaaatgtccccggccgcattgctacaggttaatcgcctgaggttgggccgggttagttcggcgccggcaaacaattttggtgtctatgaaatattgttggtaaacttatcgaatatgttagtgctttcgagtgttactcacttgataaaattattgcctaaactaaaaagaatcttcctgtttttcttggaatatttaatttttttcttctacctcccttctcgcctttcaactttcttcccttttttaggtctgctgggtccagcactcccgaccgtttcccatgtgaacggcccaattgcggtggtgactttgtgtgtgttcgccatgtttctttcgtcgactgtcctggccacgacattctgatggccacgatgcttaatggtgctgctgtcatggtgcagttttggatgttaaaaatgggacattgtcagcaatttcactttgacttaggatgctgcgcttcttctggtggccggcaatgagccgtgccctcagccgcaaacttcggagcatttggctgctgtggagataatgaagcttaaacaccttctgatcctgcaaaacaaggccgaaaaagccgtttatttacttttacgagtcccttcgtttagattgaccttatcaacgagtctcaagcaaaggcaatgaatgggtggaataggaaactcgaaaaacgccaacctttaggaccagcatgatcagatcaagagttttgtggaaggcactgtcgccgactcggcccccataattccgatttctgcccaacttaaatacaacatcgacgtaggcttcggcttctttattgctttcccatttccatttttaggtcatttgtgagtatttgtgtaagaaagtgcccattcctccgcgtgacttctcttctgacgctcgtttgattgttgtccggtcgttcgacgtgaataagcccggctccgaagttgagcatttgaagggaggcgtagcgggcggttcaattttaaaaggtctttaaatagaccattcatttggttttcaatcggtaattattttaaaacaggcattttgcgagttggccaggaaatcgaagtccgacccggaattgtcactaaaagtgccgatggttctgtgcaatgccgtcccatctactcgcgaatagtttcattgtttgccgaacagaaccagctccagtacgccgtccctggtggccttatcggagtgggcactcaaatcgacccgacaatatgccgcggggaccgtttggttggccatgtccttggcgctgtagggactctgcccgacatttttactgacatcgaagtaagtttttaagggtattaaagaattaactttaacaaagcataggtacttttcggttttgaaggcgcaccccaaaattttaaaaaagagagcaacaaatggcgcacgtgcgatcattaatttatgcagaagaggactggaaagcaggccgaatacaccggcttttaatttatgcgatgggaaaggacatttttacactttttatcctttgctgctctctttattaaaattttggggtgcgccctcaaaaccgaaaagtacccaaatcgtatttgagctttaagagagtgaccccaaaaaattcttcggatgatcttttcatttttaattaaattaaaccttcctggtattgttagatatttcagtgaatttatatttactgttaaatttaaaaaaaacaaattacaaataatctatggacaaatggccactaaaaatcagtttttgagtattagggtcctgacttttttctaaatttggttgaaaacggaaaaagtatggtccaaaaactcgtccaatgttttttgcctttcgactagacattgcgttttcaggtttcctaccatttgcttcgacgtcttcttggagtgcgcactgaggcagggaaaaaagcggcgaaagtgagcaaacttgccaagggcgaagtgctcatggtgaatattggctctctctccaccggaggtcgtgtaattgcagtcaaaggtctgactccttctccattccaatttatatttaaattatgcatttcttatttaatataaattaattttaggcgatgcggcaaaaatagcactgactgatccaatttgcactgaaagtaaccaaaatattgcattgagtcgacgcattgaaaagcattggcgtttaattggatggggcaccatcagaagggggacgaccatcgcagtgccccaaccatcgatcggataatttaaaaactattccaattgtaaacggtttttaataatgtgcgtgtttttgcttcctttcatgcatcttatttttgtggaaaggtactttgttgatcaaaatatacccataagaaatgaaaaattttctcaaaaattcaattcttaagtttatttatttattttcttgataagaatttccgtttaaaattatctacatatttcgattgttgccagagtgcgtatttgatgcaaaattgttgtccaccgctctgtcatcgcgcgtcccaaaagtgttggcatcggatttcccatcaccggcacttcacactccgtcgtgctgccattgaccaattgttaaaggccaacgagcgtcgcttcatcctttctgatgaccaccagcagtcggtattaagagtggacgttgcccaagtcgctgcaaaccgaccaatcgaggacttttactccgcttcaaagtgtctccattccaatgcctttttgtttggcatttttgatggccatggcggagcggcgtgtgcaaggcacgtgtgcacaagggtaagaggagaaggaaaggggcaaaacagaagggtttttattcatttttggtactcgaatatttagattttgtgggtcacaaatatgaaaatggtaaaataccttctttccatgcactttcagttgttcgactatatttgttgctctgcgctggacaaacaccgagtggtgcaaatccccgtgggggaacaaatccaatggcttggggccaatgccccgcacagtcttccacaagagaaggacgacgcccatctccgaaatgtgcgcgagtatcacagaaagttgttgcctgccccaagtgttgtccatgccattgccctttaggttcagaagcggcgtctcccccgccaccaccgtccgttcgtcccttcaggcggcctttttggcgttggacgacgacctttcgaagggtgcgatgcctgaccaaagcgggcgcatttgcaggtgctttccgaatttgcccacagcatc

SEQ ID NO: 326 - DNA, 3701 bp, Heterodera glycines
  genomic virtual cDNA Sequence=SeqID_612; coordinates=162..294 ,359..456,510..859,907..1063,1123..1230,1278..1364,1492..1713 ,1761..1865,1910..2002,2366..2489,2544..2596,2641..2865,3019..3219 ,3275..3456,3532..3601,3664..3701
  coding sequence=SeqID_920; coordinates=162..294,359..456,510..859 ,907..1063,1123..1230,1278..1364,1492..1713,1761..1865,1910..2002 ,2366..2489,2544..2596,2641..2865,3019..3219,3275..3456,3532..3601 ,3664..3701
  peptide sequence=SeqID_1249
tcattcatggcattctgccatggcattctgttcgtttttacatattcatattcgcttttgcgtgattattttttgccaatggtttaattttgccttagggtattccaccgaatttgtttctttctcagccgccctctcctttcccctcttctcttctcgagatgggcgtgctcactttgaacatcgaatgtcgcgagaagggcgtcaaaaagacaatgcaattcgaaccgcgcactttggtgcacgacgcgtgccgactgatcagagacaaattggggcatatgccgggcaatcgtaagtaccaaagggcggacaatcgaatcactgatttgtgagcgaaacgactgttgggctttagcgaatgattatggcctttttcggctggaggacaacccgacaaaatgtgtttggatggaaaatggtcggacattggaatattatctgatcagaaatggggttggtccgccactctgtggccaaatgatcggttcaaattcgacttgccacaggacactttggagtacaaaaacaaaatccgccccctccgggtgcgcactttggacggaggggcaatcaaaacagtttttgtggacgaatcgcagcccgtttcgcagctgatggtggtgatctgctccaaaatgggcattgccaaccatgaggagtactcattggtaaggggagcatcgccggaggggacggacagcggagcggagaacggaatggccaagggcgaaagggaaaggacgccgtactcaaacggcggaacggacgaagcgcggccgaaacagcgcagcgggttggagcacacgttcatgaacacaatcggacggaagaaggagcggcaaattcagcagctgaggtgcaaagccatgccgaacattgggccatttcgccgccttaattaagggccaaattgcacacggacgccgaaattaattgggtggaccattccaagaccctcagggaacagaacatcggggaggaggaggagctgactctgcgcagaaaattcttcttctcggacacaaatgtggacaccagggacccggtccaactgaatttggtcagtttttgttgccgtcggcatcgaattcttggccaaatggtgacggactgattaagctgtacattcaatgccgggacggcgtcttgcgggggcttcatcccgtctcgagggacacggccatcaaattggccgcgctccaatgctacattgaatacggcccttacgaggagggaatccaacggagtgttgagtcagttggccaaatgttaaccgatggaggaccctcgcttttagtgccaaaaatctgttgccgaaagaatatgcgaaggccaaggaattggagaagaatattatccaagtgagcggaagaagggaatggcggcgaatgaattggaatgactaatgaatgaatgacctcctaattggactgacgaatgaatcccctcccctaattagactgactaatgaatgccctccccctgaaggagtaccgcgagttgatgtatgaagactcggccgcgcccaaaaagaaatactgcgaattgtgccaatcgttgcccacttacggcgtcactttcttcttggtaaaggagaaattgccaggcaaaaaccgactgataccgcgactgctcggcgtcaacaaagattcggtgatgcgagtggacgaacggaccaaagcggtgctgaaggaatggccgctagaacaggtcgcccccctttttaaattggtaattattggacatttcttttttaggtccgtcgatgggccgcctctttcaaaacgttcactctcgactttggcgactataaagacggatattattcggtgcaaacgctcgagggcgaacgcattggacaggtaaagaggggtaattaaacagaaacaaaggcactgttatttagctaattggcggatatatcgacatcattctgaagaaaaagcgcattgtggatagtggcggaattgagggagacgaaggggcgacgatggtggaggtgaaaaagagggggggggggggacaaatgagcaatcaacaaacgggggtggacaaatgatcaactaacgaagagtatggcgtttgacttttccgttatgggccgctcttcaaattttaaaaaagcaaaaggaaagcggcaaataacaaaaacaacatttgtgccaacaatgggtcaaaaataatctttggcatccattgctaatttatttatttttgtggtaaagaaataattttgtcatttttcgtggcccaaaaaaatactgacaaataatcaaacaaaaaaagaagtaagaggacaaatgaccaccaataaatgtgaagaatgaaaaaagacacacaaacccattcgctccctttgaaggacattgtcgcgccggccaaagcgactctcctcgcccacagcgatctcgcgccgccttaccccgcccccgaggggtatttgccccacggggcattccgtccgaccgccgaaacaccggctggaggttaagcaattacagacacattgtagcaattgcctattcatttggtcggttcagctccgcagtacggcggtgtcagtgggatgataatcgcacaagaaattccaaaagtgggggaaatgaaagcgaaggggcgaagggccattttatatagggggaacgaattcgctatttggacgcacgagagcgaagtcaaaaggcattggtcggaacgatcgaagcgacaattcgagcggtggaagaagcggaggaggaaatccaaaagccaccgcaaatcgaattgccacagtttggcgaaacgcaacggcactggcgagtggaggtggagaaggaggcggtcagcgaccgactcgccgcgatgggagccgcgacggcggaggtaggccgaccaattaggcagtgaatgaggggaaaagggaagggaaggcttaatccgaattagccaaggggcaaaaaaaaacgtctcaacaattaagcaaataaagcacaagaaaaacgaaattggcctttttattctttgccatttgtttaggttgttcaattgaccgcaattcccgaagaaactttggacacgcgcgttgggcacgcaattgcaacaattggctcgaatattccggaaatgggccgcggggtgcgccaattggccgccattatgccggacgaaagccgtgccggcgatttgatggacgcggcgcgaaaattgtgcaacgcttttggagactttttggagaaggtgaattccattggggagaagcaattcagagcgaaatggcattactaattgtcaggtgcacccggagaagcaggagaaacgcgcgacgattttgtcggctgcgagcagagttggcgaactttcgcacgacatgatcagcacaatgcacgaacagacggaggaggagcgtactttccacgaggaactcaaccgcagggcacgcgcagttgccacgagcacggcacagctggtgcttcagtaagtggggaccgggaggatttgggctgaaggatttgagatggaatttcgaatttgaaatccatctatgaaaagagccaaaacggtgtccgccgaatgtgaggagccggcactgaaggaccaagtgattcacagtgccatgaaggtgggtcgggtgggcaggcaccgttcgcctcattttaccggcattcccccccccccgctcagacggcatttgccacttccgaattggtcgcgtgcactcg

SEQ ID NO: 327 - DNA, 2421 bp, Heterodera glycines
  genomic virtual cDNA Sequence=SeqID_613; coordinates=169..229 ,365..464,536..571,635..800,988..1099,1154..1357,1402..1538 ,1600..1788,2049..2150,2205..2285
  coding sequence=SeqID_982; coordinates=169..229,365..464,536..571 ,635..800,988..1099,1154..1357,1402..1538,1600..1788,2049..2150 ,2205..2285
  peptide sequence=SeqID_1198
gaagggtgccgggtcggaaaatggcgaaaccgactcggcacatattcgcccattctgagggacacgtcgaaatattttgccaaatcaaaattcgatcgaagaaagtgcctgattctcgagagacaaactttccccctttttccaatcccactttttgttgtttcagcaatgctcgttgtcatcatccatccagaacaatggaacggcggctccgaccgatgcacaatcggtgggccaaatacacctaattaataactaattaattaattaatatttattcattgatatttaatgattttttcaaagtgacttttgccattcgttgtaaaaatgcaaaattacggcaatgcttatttcttttaaggattgctccgacactttgtccaagccggtcataaggtgttctggctgaccacaatgattgacacttattgggcatccgaggatttccacggcgttggcacgttaatttaatgaattgaaaactaattaaaaaatgaatcggaaaatctttcatagaaatcatcggcccatctctgttcgcccatatgcccctccatccgggcgattggttcgcttttactttttttgttatctttttaaatttattccccccgccccaccgttcgtccaggtacacacagaacaccgccttggccctttactatctgttctccaagcgtggcatgggctcgcccgatttggtggtggtcgaccattccgcctcgtgcgtccccctgctcaaatggttcttcccgcgctgccgcgtccttttctactgccatttcccccaacaactcgtaaatttgggattttcaatattatttattttcaaaatacccataaatttcgaaaaaaaatctaaataaaaatgattaattattgcgaattagtcattgttcataagttaaatgtttccggatttgaataaattaaatctttgtcccgcccaaattgagtatttgccaatttccccttatttgttaggtcactccgtcccgctttttcctctaccgttggtacgcttatctgatgggtttggtggagggtcgtctgttcgaatacgtggacattgtgttggtgaacagcgaattcactggtcagcaaaaagagagagcattgcaacgtaaaaagttcccaaaattcaatttaggtcgccaatttcgccaagtaatgccaaccgtttcgaatgccaaaatccgcgtcgtttacccgccgtgcgacgtcgactcgctgcgttgcgggtgggtgcgtccgattagtcgtgcggaccgtccgcccaacgaacgataccttttcctgtcaatgaaccgtttttggcctgagaagcggctggaaattattatagaggcggctggtaataacccacaaacttttttggcatttcatttccattttcagctgagttaaaacgccgcgggctgcggccgcgcattcaaatggccggctctgtgatgccgcacattcccgagtctcgaatatactaccaagagttgcaaagtcactgcaaacagttggagctggacgacctgatcgaagtgatgatccatttaaatttaaaatttttcaatttaatttcgaatatttccaattcttaagtttctgcctgacccaactgatgaacgcaagttcgagctgtatcggcagtgcgattctgtgatttacacgccccccaacgaacactttggcatcgtgccaatcgaagcgttggagcagcgacggcccgtcattgtgaacaacagcggagggccagccgagacggtgttggaggacatcacggggacacgagtgagtaggggaggggggggggaatagagcgagaatgggttgaatgacgaaaataatttaaaaatatttattattattaaataattaaagggggtcacagggatactaaaataactaattattacaaattacaaaccaacagaatgtgtatttctcgattttttaggttttatattgaaaaaaccgatcgaaccctttgtttggtttttgatacaaaactaaaaattaataatttaaaaatcaaatcacctgctgatcagattgccgacacttgcggtgttttgctggccaatgcaatggcatcgcacatgggccgcaaagaatggccccaactcgacaaggacgaactttacgcgaaacaggcaaacaaagcgaattaattaagccaatttaaatggctaattgccctcttttagcgcattcgcttcgatgaaaaatttagttggaagggattcggacgacgcgtggacgaagcaattgccgaattattttcggtggaccatccgccgacggaggaaatggcgcaaataatggcggaaaggcgtccccagcaaaatgaaactgtgcacgtgcacatcaacggggtaactagcaaaactaattatgccaattaattatttcctggataattca

SEQ ID NO: 328 - DNA, 8723 bp, Heterodera glycines
  genomic virtual cDNA Sequence=SeqID_614; coordinates=292..387 ,786..903,1385..1483,1552..1657,1789..1889,2086..2129,2195..2332 ,2437..2488,2844..3078,3424..3684,4152..4239,4588..4867,5361..5597 ,6315..6452,6804..7061,7606..7847,8446..8560
  coding sequence=SeqID_985; coordinates=292..387,786..903,1385..1483 ,1552..1657,1789..1889,2086..2129,2195..2332,2437..2488,2844..3078 ,3424..3684,4152..4239,4588..4867,5361..5597,6315..6452,6804..7061 ,7606..7847,8446..8560
  peptide sequence=SeqID_1200
ttttgaagtttaattttttcagaagtctgatatctgatcatccaatttccagaacttgatttatggcgactttattcagaatcggagtttcaatttcccatttttaagacattaatgtttttcataatgtttttttttcgcggaataatcgggtccttccttcactgaactgataacacaaaaaatcaaatttttatctgataggtgaaaaattttaaactctattaaatggaaatttcaaaaaaaaattaataaattaaaaaataattaaatttgaatgataaaatttagtgacgaagaaagttgtgcaccacgtgaaggccattgtgcacaagaccagttcaagtgccatacatcgggcatttgtataccaggcacatggaaatggtaaataaatatttgttttaaaattattattaattgaattatggttaattcaattaatttttctgtactatgcacgccacctacaatgtaaaacacatcgctcaaatttattttgatgcaaaattaaaactgatttcagttttctcaatttcttcgagtatttttttagtaataaatttttttattattttgaaattggattttaaaatacaaaaaaaatattaataaaattcttttaaaaaactatttttaatttcttacaagaagaaaaaagtcataagaaatttaaaaaaaaatcttttaaagtaattttctgttatgaatgtacaaattaataggtacataggtatgccaaaaattctttaattaattgattatgtcattattattaattacagtgatggccaattggactgtgacgatggaagtgatgagccccgagcgacctgtgaggagatgcacagcacatgccccgctggtcatttccggtgcaacaatggacggtgcattttctcggtgactattgaacaattaattaatttaacatatcttaatttatgttaggtttaattttattcaaaaaacatcaaaattaaaattatttttttaattgcttaaaaaaatttgtaaatcaatttcttaacaaaaatgcattaaaaattcaaaaatttcccggaacctccattttatcttatttttttaaattttcgatagccttttaaactccattatcctgcaaaatttctcaaaaaatttctttaacttccaaacaaatttttggagtttaaatttttgacaatttgcagtttcatcttctggttttctgcatttttcagcttcgagttctagttttactaattgataagagtcattttggtaattaattccaaatttccaattattatttttcatttaaaaatacatatcagttaaaagagacaaatcatttacattggatcgagatgattatgtgcccaatttgaaaactatttttcagacatggatttgtgatggtgaaaatgattgtggtgacaattctgatgaacaaaacaattgcccgaacagtgcagcaacattcaaatgtccatttgaaacagtgcgttttatttcattaataattaaaattattttttatttattaatttaatttaaattttttgtcagatttcttgcaaaagtgccccggagcaatgcattccattccatcagctttgtgatggaaaacaacattgcattgatgggtcggatgaaggtggtcgatgctcacgcggtaagcgttgaaaatcgaggcatgatcaaaaaggatcagttttgtgatactcgagattctcgagcgatttatcagtctcgggtctgatcatgtttatcacattattgatctgattcgattgattattgcagatttgtgtgtggctgatcgtgccgggtgccaatacaaatgccacaattcacccgaaggaccaatctgttcatgtccgttgggcgaacagctgatcaacaaggtcaatcaatttaaaattttggcaaatttaaatgacatcgaaatattatttaattttcttaaaatctcccatctcgtaaatgttgaggatggcaaacaaagttttaaaaataattactatttccaaaagcacgataaattaccgtaatgagagtgaattttaatgagtttccattaaaaatatttgctttttttagacaaaatgtgagccagaaaatgagtgccttgacccaagaacatggtatgtaattttgcaaaaatattacacaccgtatgccaataataatactaccgtattgtgtacagttctcaacactgtacggacgagaagcacggtttccggtgcagttgtgatccggcatatgagcttgagccggacaagcggacctgcaaggtgacagaaaaccgtgcggacatgcgtgtgtacgtgtccaacaggaatcggcacgtttttagtggctattggctatgttaattattaatttaaaaaatcaatttaaataattttattcattttctttttttttcataaatttcttccgatttagcatttattggtcggacagttcgctggagaattggcgcacttttgctgcacaagtgaagaaatgattgattaatataataagcatatacaaaatttcaaatttttttctcgatttcaaatagaaatttttaaaattaacaaaatttattttctttttcaaataataaataatttagttttttgaacctttttaaagagaaaatgcaatttaaaattttcttaacaaattttgctaaaatttctaaaaaaattttcatgcggctcctatcagaatcaccaaaccatcctttgatttttttcaaaattttaccctaagttttaaaattttggaaaatttaaagttttataaaaaataaaataaaaattgagttttgccattaaatacaatcatggtggcacaacatgcaggtggagaatgcggtggcattggcctgggactcagtggacgaccgtatctactggtccgacatccgggacaaacgcatctacagtgccacccggaacggcaccgacgtgcagacattcatcggcatcgggctggacatcacggagggcattgcggtggactgggtgggccgcaacctgtactgggtggactcctcgttgaacaccatcgaaattgccagcctgcaaaagccgggaggtgaaatataaaaaattcaaaaagtgccagaaatcgtgactaggcatgtataaataaattcagtgttttcttggcctttgtccaaaaaatagaggcctagagataaagcatgaaaccatagaatttaaatccctggatccagtgtgacatgcctggtttttcaggacctagacacatgcaagcctacaggctttttttcaaacttacacattttcaagaagaaagaaatcagaaatttttttaaaaatattttctgcgatttttaggaaatttttttgaaaaacttagtaattcatcaaaaattcttttatctttctttatatgcttaatttgtttttcgaacagttcgtgccgttctgctccatgacgacattgatcagccccgagggttggccgtcgacccgcgcgtggcactgatgttttggaccgactggggccaacacccgcgcattgagcgtgccaacatggacggcacgggccgaaccattttggtgaacacaaaaatttattggcccaactcaattgcgctcgacttcaccacaaatcgtgtgtattttgctgactcaaagctggactacatcgactttgtcaattatgacggaaaaggtacggtgtgtgaaagccttactataatcaatgagttttccatccaaaatcaaaaacaaatggattaggattaaaaatgttattcttcaagacatatgacaaatcaggacagattttaaaaataaaaatcatttttaaattgactaactcatgctttttcgaaattaaagttacaacaaaaattaattgcgaaatatttggagaaaaatgggggggggaaacagaatatggaagaataaagagaaatggtaattggaaaattctataaaagaaaaaattaagcaaaggaaagaaaacagcaaaaaaaaaagagaaaagaatggagaaaaaatgaacgaaaaatcggatgaaaattaaaaattgaacgacacttataaacggattaaagagttttggctttttcaacggcgccagaattaagcaaataaataatctgaagaaaaccctgtttttttttttttttgcaggtcgtacccaagttattgcaaacagcaaatttgttcaacacccacacgcaatgtcaatctttgaggacttcatttactacagcgatcggtgcgtttgagtttgttccaagttatccctgaaccctaaatagtgttccacttttttttaatcccgacatttataccaaaaatttccgtcccccggcatctctaatatccggcatttatcccttaaatttcggtcccagtcaaatctccgaaaacccgggaattttttaaaccgaaatccagtcccagaaattttatccatcaattatctccaaatctctgacattttcccaggcatttttccataaaatctcagagtttcagaatttatccctgtcatcggcattttaatttccaaaagctgggatcaaaccctttttcattcatgtcattgattacaacaattcagacgactgcaacgtctgcaactgtatccgaaatacccgaacggcaccaaccaagattatccgtcccacacattctccaaggcacttggcgttgtcactgttcaccccgttttgcagccaaagctgatgacaacaagcgcatgttccgtctcgccaatcccatgctcgcacatttgtgcgcttggcaacaacggcacatacacatgcatttgccctagcggaatggtgctggacacggacaagcaccgctgcgttgctgaccatcgtccgttcctgttgatggtaagttttcttggtggggaaaacttggtgtgatcggacaatgtcaaaaaaaaaaaaatttttcatggcacacacacacacacacacttattgttattcgagagtctcggtcaggactcgaataaggtctctctgttttttggtcttgactcaagaaagtcctgaatattttggtttcggtctcgagtctcgacttgagcaaaggttggtctcagggccaaatatcggtctttcattttggaaagtttgtagtctcgaacggctctaataccagggggaatggcttattaaattcggagaaatctttgttttttagtttttccatcagtttctctcaaatctttttttcaagtatacagtatccgctttgaacttattaaaccaccgtaattactgcaaaataaaaaaattgcctaggtcacgaaagtcatattaaaattagatggattcgagggctgattatttcaaatattactaaaaacaaatttcacaggtattcaaaacgatgatcaccggcacatcgttggccggcggcgcaaaagacagcacggcaaaacaacgtgccgaaatggccggcattacaccaatcagtggcttacagaatgcgcatgatgccgactttgatgcccaaacacagaaattgttccacctggagcatggcagcatggcaaggctggtcatggccacagtgatctcggatgcacgaatttacaaaagtgggtttcttggagtgatggatgcttctaagtagtatttcggcactctaaatactgtattgtatcaggaaaatatggtatgtgttgtgtcgtgcgattggcacaacaaaatattagaatacaatatttattcaaaaagtaaaagtggagaacgaagtgatgagtcagaggaattaatcaataactggtgaaggagcagatgccattgctgctgtgtgtgttgacaaaatgaatgaataaggaaaagaccatgagtgaacgaagtccacttattaaatggacaataattgggtgatacagtataacaataaatgatcatcatttggcgtgaatttaaatatataataaattcactacacaacagtatgtatgattcagtaacagaattaagtaacgttttgcactacgaaacgggaaataaccttatgatattcaggaatattattataatagaggaatacaataatatcacgaatgggaatacagtactattacaatttgtatatttggatgaccaagaaatattagatttccacctaaactgttgatccaggcctcaatttcctgggtcctttccaatttatttttttcgtcaatcaagggttttttaggtctggattttcctgtattttttctgtccaaaaatccaggcctaggtccaatatttgtacaggtccaatctaggcttttttgtctaatatttaaataatttttaagctgaactgctgacaaacaatcgcactcagctgttgacggctcaaattccgaatgacccattttgcatggcgtacgattggaacgggcgcaatttgtacgtcggcaacaaaatttcgcaaactatcgaagttgtgcggacggaaggcgaacaggtggaaattaaaaaatttattaaatatttcatatataaaatttgtaaatatttggaaaaaaatggttctaataaaaactaataatagttgaaataatttctttttttttttttgttttcttcattaatttataaataaattaggaaattttatataaaataatttgcgaaaacaaaatctgatttaagccaatcaaaaaggattcttattttcaaatatgtcctgatttttcagcttgtccttcggaatatgaattttataaaaaaattttctgattcaaaaaaggttatattgcaataatattttattgattttcaataaaaatcatcctctccctctgatcaacaacagttccgggcggtgatcctgcacaatgatcaaacaccgaccgcggttgcgcaacccattgccattgcggtggattctgatcggggcctgctgttttggcttgaccaaggcaagggcggtgtggccacaaaggtggcacgtgccgacatggacggcggcaacccattggtgttggtgaacatcgacctggccgagctggaccacctggcgctggacacggtcaaccaccgggtgtacttcacggaggccaaagctggaagataaggacactaaaactaaaaaaaataatagcttttaagtcaaaatgcccatttcactcttaacagggacaaattcaaaaaaatttaaaaaaccaatttatacaagagccatttcccctaaataataaattattaaaaaatattttttaatatgtacttatttcgatgatttaaaaatttcttcgttaagttgtgcgtttccttgaattttatgtccttgaaaaaaattttttaggttttttttttgcaaaattaaaaaaaagttcattcttttgaaaattaaaatcggtgaataaattgttaaagcaattttaatttcattttacagaaaaaaaaaaattcttattttaaaattttataccatttttttgccatttttcgctttttttgccaatgttgtcattatttaattaaatatttttgggcttttgccactgaaaaccccacacctttctcatcaataacaaaaacacttaattaagggtttttaataattttttcttattcttttaatttttaatgatttgtatttttgcatttttacgatcaccagcgtgtcgtatgaaggacaggacaagcactatttgctgaacgatccggcaaaacagccgcgtgccattgccttcttcaacaaccgcattttctactccgactcggcatttgacaaaatatttgccggcgaatttgttggcgatgagcaaccgcccgaattttccgaattccgtgccaatgttgaacagttgaacaacctgaaaatcatccaccccagcacggaaaagcatccttggtaaaaaaaaagaagaagaaaatttttgtgttatttgtttaatgtccatggaaaattacttggcttttatatacaagggggaggggttaaccaaaatttttacatttaaaaattcaaaaaaaaaaattggggaaggagggccgaggggggggggggcggcagtgccaacaattgctgccggaagattttgaaaattttgctacgatttattaacagacttccagcaaaaatgtcaattttaaaatttttggaagtttgaatccgtggtgccttagaaaatttttggaattttttcaagaaaatttacttcttgatttggttgagtttcttgcctaatttttaaaataaaatcagaatccctgataaaattctgacagagggtcctgtctttttagggctctactgtcaactaatagccatattaattataatgggcaattaaattttacggataatatatgctatgaaaaagctaggatgagaataatgccatcatgacatgaacaaaataatattattgtcttcttccttacaattttttaccgtaattcatcaatttgtacaccgactttaccgtatcctccacccattttttaagccatgaaaacaacggtaactgtgatcagctctgcattcctggacagcacaaaaaattcacatgcttgtgcggtaccagtttcacgctggacgaggacaacaaatgcaaggtgtttgttgtgtgatgacgagactcaaatttctccgagagttgagacgtcaaaaaacacgcgtgtgcgcatatacgtctaattttttttttgaaaaattttccggatttttacgtaggtcgacacctgaaattttcgggaaaaaacctggactcgaaaataccgggaa

SEQ ID NO: 329 - DNA, 2826 bp, Heterodera glycines
  genomic virtual cDNA Sequence=SeqID_615; coordinates=2056..1886 ,1837..1724,1660..1433,1389..1305,1186..1026,995..537
  coding sequence=SeqID_1007; coordinates=2056..1886,1837..1724 ,1660..1433,1389..1305,1186..1026,995..537
  peptide sequence=SeqID_1217
gcgattttttaaaatttaatgatgaattactgtttttcaaagatttcaaaaaaaatcgctggaaaatttttctaacatttttctcttgaaatattttaagtttgaaaatttttgcctcggctgagtttttgggtggtgcaccgtcgaaccccaccgtttcttttttacacacaaaaggggcaaatttggaaaaaaatataaggtatcgaaattttctgataggaggtccataagtatgcgagtacacaggacatctcaatttacccatgtacaaatgacctacaaaaatcctctaaaacttattggtcacgtgaaaattcatattaaacaacttttctattttttgattttgtggcattgaccctgttcaccagtagaaagctgaggaatcgggtttttctctgttttttgattatgggcctggcctaccgtaatttttaacaatttaaaataacacgatgaaaaaacagcattttatctggcaatatttaaaaaagtgaataataacaacaacaatcaataacattttcttcccctcaacactttttcttatttctccgctctttcgtttttgctccgttttcctccgtttctgctgggatgacaaagtcctgcttgaacacgaattccctcgcgtattcttcccccgggcagctgtctccgcaagtgtacaccaaaagcgtggcccaatcgacgctttgtcccaccgagtccaattccatcagtgccaccaaattaggcatcaattgcatttcgaattgtcgcggttcgccgcatcgttcgcacgcgggcacaacggacggtggaccgggcgaatggtccgtggcgagcaaagggacacccgcgcggcggtagcggaggatttgctcggggcgaagggcgagcgccgcgctgaagcgggcgaaggcgccgtcgcggcgactctcttccaatccgtccacgtcgcgggcactcactccgttcgcttccgccattttcttaacaattccgaatttcattttcgtttcgtcccatggctttggcacctcaaattcggccattttccgtctgttctcctcctcctccccctcttcttcactttcgctttcctcctccgattcttcgtccccttcgttctcttctccgtccccacttttttcctcctcctccgcctccaattcgatgccaaactctttgagggtgaagccgtgcctttggcgcagttcggctttttcggcacttttcattgattggaatgcaaaatctaagggtgcattcattgccttttcaatgccatcaattagtgcttaattgccactaattaccgtccctctcgtcgccgtctttcgccgtcgccccattttctgtcgacttctgttcgcatttgcctttatgtgccgtattccaatccttaaacaaataaacaattcatggtttttcccccatttcccacaattatttggtgctctctgccgcaataccaccgccgggcacagcgcgcgcatcggctggcggcgcgacaaccgcagaccacgcaaaggcgcgcgaaaagggaggggtcgaagaaagggtcggacacttcgccgacaacggacggacaaagggccgactcagcggagaaaaaagcattttcacgggacaattggcaacgaaaggcggcgaaatttggggtggcatttatctgatggaaagagaaatggcatttataaattaattgggagaaaataaatgaaagagtcccaacttttgaacaattccctttccgacagacgaaaatgaaaatggtgcgatggaatgcgtgggagggttcgtcgggacaataaacttgcagcagaaatgccatcggagagccgcaaacccaaaaaggaaagggggaggttagatatattttgggcaaataattcacttggcatgccaattctgcactttgcggaatggtggcggggttaagccacgcggggtgaccgccgcatttgcccagggggaggaaatggcgttccaaagagaaaagttgggacgcatcgaccggacggggaaggcccaaatggacaacggaagacggagaaacagcggacattcgaaaagggaaaagacagcgaattaaaataagtttacaaaaaataattaacaaaagaaatcaaatgaaatcagcagaaaagtgccaacaatttgttaatttgttgctttttattttcgtaaaaaataaatgtacaaaaagcaaaaaaaaacaatggaacgaacacacacattaattaattgatcaattaggagggcactcttttggcgcttctctctttgccgcgttcggtggtgcctttccctcactttttgatcacttggacaacgtcttcgtcgttcagcaaatgggttttgcccacactttgcggattgtgttttacgctgcttccccagacgagggcacttaagcgaacaattccttccgatttttcacaaaatcaaaaaaaaatttaccatttgaagtcctttgacagacttttgtgaattttcataccttaattagcaaattcatttaataatatgtatttaaataaattaaacgttacataaatcgtcgagaaagtttttttctgcgtttaaaatgatcggtgcgttataatccggcaattggccctttggctttgtataacttaaattattaactgataaatcaaaaagtcagaagggggtccctcgctcacactctgatcagattcaaataggcccaaatcttttccaacaaatcgtcaaagttccatttgtgatgtgccgagattggcacacaatgcggcacagtgtaaagaatgtccaactcttcgacgctaatttggtcgattttgttcagcacgt

SEQ ID NO: 330 - DNA, 8009 bp, Heterodera glycines
  genomic virtual cDNA Sequence=SeqID_616; coordinates=118..351 ,696..839,921..980,1014..1121,1187..1279,1619..1813,2183..2314 ,2380..2607,2685..2801,2997..3065,3189..3297,3365..3542,3825..3975 ,4046..4115,4177..4211,...
  genomic virtual cDNA coordinates=4516..4690,4752..4864,4929..5084 ,5333..5497,5740..5910,6331..6721,7110..7300,7759..8009
  coding sequence=SeqID_856; coordinates=118..351,696..839,921..980 ,1014..1121,1187..1279,1619..1813,2183..2314,2380..2607,2685..2801 ,2997..3065,3189..3297,3365..3542,3825..3975,4046..4115,4177..4211 ,4516..4690,4752..4864,...
  coding coordinates=4929..5084,5333..5497,5740..5910,6331..6721 ,7110..7300,7759..8009
  peptide sequence=SeqID_1238
cttgtccatctattgaaaaaaatgtttgaaaaatgcggagaaacacggattaagccatggttgaagcaaaatgccgttacgtcaaatgctccctccccctcccatttgtcttgtcagtatttcatcgtcgaagtgaacgcgcggctgtcccgctcctccgcgttggccagcaaagccaccggctacccactggcatacatcgcggccaaactcgcgttaggcgagtctttggtcacgctgcgcaacaccgtcacgcgggacaccaccgcgtgctttgagccatcattggattactgtgttgtgaaggtcccgcgctgggacttggccaagttcgcggacgtcaacagaaaggtgtgggcaatttaggaacgcatttttgggagggggggggaaatttttggtaaatttgccaatgttactaccatgcctgcttttggaaggcatttttatgttaccatgccgactttggaaggctttttgggaattttttttcgtaaatttgccaattttatcatgctcggaatttttgatgtttcacttaaaaatgcaacgccttcttgctatatatctaatttcttaaaggcaaaagccgtttgtataatacacatatattgtaatacgaaaacacatttttacctaatggctttttaaattttatccggcaattttgcatttgaatttttctataatttcagattggttcctcaatgaaatcggtgggtgaagtgatggccatcggtcgttcatttgaagaagcgttgcaaaaagcgtttcgaatggtcaacgaccacaacgatggcttttccccgcacattttcaaggagaaagtcactgaaaaggtaacaatatttttttttaattccaaaaaatttgtttttaatgaatttaataaaaaaaattttccaaaaattttctttaaggacctttgggacccaacggacaagcgaatgcaggcggttgcacgagcactgtacaccaacgagccgaccattgcgggcacggccggctgcaacgacgaatttgtgcactttttgcaccaatgtacacgcattgacaaatggtttttgtaccgtatgaaaacaattgtggacatgtaccgtacgctggagggccaggaaatggtaaaaggaatttgagcacacataatttttggcattcgttttttttgtttgtttgtttttaggatgaatatgtttcgccggatttgctcctccgagccaaacaattgggcttttcggacgcccaaattggcacatgcattggccgaaatgaggatgaggtacaaattgggtgtcaacaatatccaattttttaaattttaaatcaaaaattcctgacaaaaaaaaattatttgcagacaaatgagaacatttggaaaatttgaaatgcatttgtaaagaaggaaaatttatgaaatctaaaaattggtctcttttataggaaaattttaatttaaaaccacaagagaaaaaagcgtacgggttgtcaaggccgcaaagccccaattttgtaaaatttatgaaaatttgagcaaaaaaatgcctgtaccggcaagcccatggttttttttaataccgtaacttcttttttaattaattaattaatccactctatttagatccgtaaactgcgccatctccattcaattgtgccgatggtgaagcgcattgacacggtggcagcggaatggccggcaaagaccaattatttgtatttgacatacaacggggcagaacacgacattgagtttgagcagaaaaagagcaacagtgtcattgtgctcggctcgggcgtttatcgcatcggatcatcggttcgagaaatttttttttaacttttttgaagataaacaagccatttaattgtgtggcatagttttaacaaaaaaaatggattttgacccagatacaagccgagacagcctacaatcaggccttaaattacataaaaattgaaataatttttttttttactaaaaatgtatttcaaatttgatacaaaccgagacagcttgggcctttaaacaaaactttgcttcattttttgaaattttaaatattaaagccatacagataaaaaaaagtcagtaatgggtgccaattatcctttaatgacactcaaaaatttccttttttgaaaaaaatttaaaaaaaaatattttttcgaggatttcaacttctaggtggagtttgatgcttgcgctgtcggttgtgtgcaggagttgaagcggttgggcttcaaaaccgtgatgatcaattgcaacccggagacggtgtccaccgactacgatatgtgtgacagactgtactttgaagtagggctgaggggggggggagggtgaaaaatcattccaaaattctaaaaaaaaaaattttccaggaaatttcgctcgaggttgtgtccggcatttacgaaaatgagcatcccaacggcatcattttggcattcggtggccaagcggccaacaacattgcgctgtcgcttcagttggcatcgccaaatctgacggtgccaatcaaagtgttcggcacaccgcccaaatttgtggacgaggcggaagaccgcttccagttcagtcgggcacttgacgagctggacatttcgcaggtgaatcatggcaatttaaaatagtcaaaatggtctaatatcagtgacatttctcgctttaactattcataattaagcccaaatggaaaaatgccaaatcggtggaggaagcggtcggccaatgcgctgccgaagtgggcggctatccgtgcctgattcggccttcctacgtgttgagcggagccgcgatgaaagtatgggtttgaaacgaaagaaaaaatggtcattggccacgagtcgagaaacatggcgggtcacattcggaacgagaaaattggcggattgtcgcgattcgttcaaaatggcaaaaaaagggaggtcacattgggcaacctagaaaaatgatgggtcgggattgtggggcggccaaacattttttgtttttaaaggtagcgcacaatgaggaggacttgagcaattttctctctgaagctgcgttggtggcacgtgacaagccggtcagtcgattaatatggcaaaatagaattaaaaatttttttttaaatttcatttatgtcggggacctttcttttttttaattttcaagaaattaatattttttgcgcttctgtttcgtttaggtggttgtgtccaaattcattgaaaatgccaaagaaattgatgtcgatgcggtggcaattgggggccgtgtgttggtcagtgccatctctgaacatgttgagaatgcgggtcggtggtcggcacatttttgaaaaaaacacctaattcaagcaaattttctaattggtttttaaaggcattcattcgggtgatgccacactgataacaccgccccaagacctgaacgccttcaccactcgaaaaattcacgaaattattcgtcacattgcgcgacgtttcaacgtcaccggaccgttcaatttgcaactgatcgcaaaggatgacaatttgttcgtcattgaatgcaatttgcggtgagcagtcatgatgaatgaatgagttgggtcaataacaaacaactcgtactttttgagaaatttttgcaaaacccgaaaaaattttcttgaaaaaggtacggggttgttcatgacacttcaaacttcagaaaaaaaattttatggatttttttttttaaatttattgacaaaataacccatccacccttcaaatttgtctgaaaaaattacattttatcaactaccaccataaaaatatcaaaaattccttactttatgattgcatgctcatggtttcagagtgtcacgcagtttcccgttcatctccaaaacgttggacatcgattttgtggcgttggcaactcgggcaatgatgtggacgcaagagccaaccaaattcatccaatccttcacccgtcctgaacagtccaacaacaaagtgggagtcaaagtgggtatttttttttgccaagttttttttttatgttttattttccatggttccaaatttatttttttaggtcccccaattttcattttctcgtctcaccggtgctgatgttgttatgggggtggaaatgctgtccaccggttggaacttttaatattattattttcaaattaatgaggccaagttttaattcaattttaggcgaggttgcttgtttcggccgcacacggagagaggtccaaaaattttatattttgggtttggtcatgcccccccctcctcatctgaatttttttctaaaattttttccaatgataattttaaacaatacgaaactcgctttaccgaatcccctaacatttgtttgcgtgaaacaacaaatcaaaattatagaattacatctaattttagcgcctaaattatgctagaaaaaaaacctagaaattttcaatgggaagcggagggtgggtgtaacgactttgaaacaccaaaatttttagtttttttaaatacaatgtatatattttttccccatttaaggcctatctgaaggcactcctatccaccgggttccaattgccaaaacgggtcatttttctctccattggctacaaacaacgggccgaaatgttggagagtgtgcgcatgttggaccgacttggcttcacactgtacggcagcaaaggcaccgccgattattacgcctccgaaaacaacattcgagtgaggggggggggtggaaatttttaaaaaatgtaaaatttttccccatttcttaaagattaagaatttggaatggccatttgaggagaaggacaattaccatgtgtacggtgccaaaatgaatacggtggccgaatttgtggagaagaaaatcatcgatttcatggtgggctgtctggggcttggcatttataaaaaatttaaaaaatgattaaatcatttttgtgtagatcattttgccaatccgaggcagcggcgcgtaccgtcccggcgcataccgtacccacggctacaacacccggcggatggcaattgacaacggcatcccgttgatcacggacatcaagtgtgccaagctgttcattacggtaatgtcatggatgagcgtaaatttaaatagttccagaggtggggaggaaatttatgtaacttttttttgttgtttttatgccactttttgcggagcaattttttaaaaatagaatttttccagaaactagtctttatagcccctaaaattgacaattttgtttaaagattccccccccccattttccaggcactttttgaactctaccaagtggaacatcccatccttgctaacgacaacaatgccaacatcaacggtgccgcccgtttgcctccgatggacgccagcgttgactgtctgtccgccgagtcgttggtccgtctgccgggcctcatcgatgtgcatgtgcacatgcgcgagccaggcggcgagcacaaagagacgtgggaaagcgggacacgggcagctgttgccggaggcgttacgatggtgaataaaaaattaaaataaatttttaataaaaatataaaaaagttcaaattccagggagcaaatgctccctgccttgcccatctaaaaaaattgtatgaattttcaaatagttctgtttgatcggagaaatgacgacctgaaaacaatccattttatatcttttcatggctcctgaagtcatgtctaataaaaaaatttttaaaaatttctgcgatttaattcttttttttctcgcccaggtgctcgccatgcccaacactcagccaccgctcgtcgatgaacaaagctttgccatcgttgaacaattggctgcccgtgctgcactctgtgactacgctttgtacatgggagcaaccgagcaaaatgtggcacttggtccaactcttggaccgaaatgtgcgggtttaaaagtgagtaaaattaataattaaataaatactaatatttagaaattaaaatgttcaaaggaaataaaaagttcaatttttaataaaatatttgcaaagaaaaaaaacaaaaattaattaaaacgaaactaaaactgagtaatcaaataaaatctcactttttttatccaaggatttttcaaaattttatgatgaattactaagttttttcaaaaaaatttttaattgtaaagttttaaaaaatctaattgaagtttgaaaattaaaaaaatatatgttcggggatgggacgccctgctccgatacaccatattcaccaaataaattcagtgtaaaatacaaataaaagttcctaattttgaagaactcgacaaaaaaccgtacattattccccaattaatcaccccccacccatttttcaagatgtacttgaacgaaacctttgccgcgctccgtctcagttctgttgaacaatggatggaacacctgcaccatttccctgcccatcgcccaattgttgtgcacgcggaaggccaaacactggcagccctcctcttcgccgcccgcctgtgcgagcgcagtgtgcacgtcgcgcacgtggcacgtgcggaggaaattgcactgatccgtgccgcgcgccgaaacggccagcctggcgtgacgtgcgaggtgtgcccgcatcatttgttcttcacggctgacgacttgccggagggcatgcgcgaagtgcggccccggctggccaccgcgcggacggactgcgaagcgttgtggcgacacattgacgacattgactgtttcgcgactgaccacggtagttgttgttgttgttgttgtctcgatttttcttttccaaattttatttgaaattagaaattttaaaataaaaaaaattcatcagaaagtataaaggaatcaaaaaaaaaactaaaattcaaacaaaaaattggactatttttataagaaaattttaagaaaaaaaatactggaaatatttagcggtaaaaattttccaaaaaattgcttaatgtttttcaaattttttccctgaaacttcaaaaaaaaattctatgattttttatcaaaatttttaagtttgtaatttaattatccaatttctaccgattaataaagttgaatttattgggattatgccaccatttttgcatcaccattattatatcaacattattgtgctttagccccccatacacgggcggaaaaatgttcggacaatccgccgcctggcttccctggcattgaattcatgctcccattactgctccaagcggtggcggacggtcggctgaccatgcagcaactcgttgaaaaactgcatgacaatccgcgacgaatttttggcctacccgagcagcccgacacttacattgaggtgattgtggatgaactctaacaagggaacatcccgaattgtaaatgtgttcgactcaacttttaaaccatttttatcgaacttttttttttttgctccggcgccagaagtgatcagtcagaaaaagtcgatcaaagttttgaagaatcaacaaaattattaaatttttaaaaattcatagccatcaactttaaaaaaagaatgatcagcgaaactttctgaattttggcaccaaaattaaacttttttttgagtaaattctaaaaaacccaaaaacactaaatttcaacaaaaaaaacaatcgaaatgcgttttgaaacccttcatctttttttccttggttttctaaaagtctaacgaaagatttttttaaacaaacttttggaagagctgattttttttaaacaagaaggctggaaaaaatgtgttgacttcacgaataaaaaataaattcccaggtggaaatgaacgaagtgtggacaatccctgagagcggtggctggagcaaagcagggtggacaccgtttgctgggcttcaagcgcgtggccgcgtgtgcaccgtggtcatccgtggccagcgcgtgtatgacgagggccaattcctggttgggcccggctttggccacaacgtgcgattgttgcccggcgccatggcggccaccgcctcaaatttgccatcgccgtcgccagcagctgaattgacggcagc

SEQ ID NO: 331 - DNA, 4431 bp, Heterodera glycines
  genomic virtual cDNA Sequence=SeqID_617; coordinates=4431..4392 ,4319..4026,3932..3853,3771..3640,3594..3285,3131..3031,2981..2855 ,2801..2580,2439..2197
  coding sequence=SeqID_876; coordinates=4431..4392,4319..4026 ,3932..3853,3771..3640,3594..3285,3131..3031,2981..2855,2801..2580 ,2439..2302
  peptide sequence=SeqID_1107
cactcccttttcacaattccctctctgcacctgattgtccctggtgcgcacattcactgttccgttgttcttctcctgttgcccgatcaccaaaatgaagttgaactgggcgagttgggcattgcgaatgcgtttgttcagcgtgtccgggctgtcctcgtcaaattccacctcgaagcccgcgtcgaaaatgcggcggaacactttgctcgcgtagtcactcaccgaatggtgcacaacgataatcattgcctgtcggattggcaaataagaggagaaatagtaacaaaattcaatgtgcccacctgacgaggcgacagccaaaaaggccatttccctccacaattttccgccaaaattgccaccattcgttcgattgaaccgtaaattgcacgatggatcatcaccggacgaagacgctctttgttctcactaattttaaatgtataataaatatttgacatattttgagacgacgcactcgtaataggaaaggtcgaagcgttggggcagttggaagtccaattggatggtggcacattgccaatgtctgcccaacgcatctttgatttgaatgtcaatcttaattgttcatcgtgtaactactaatgtatgtaaatgtattccatcccttggactggaaaagaaaagaacaacggagaaatcttttttttggttagttgattttttggcatttctaaaagcaaataaatcaatcagtttccgcttgccaacctttggcccatagaatgctccgtcgcccgggttcagttcccatttgagtccgctgttgtccaatgcctgtttcagctgtgtttctgccgcgtcccaagtggccaagtcgcccaaatagccctcttcaggccgcgtgctcagatggagacggaaggaaaagccgaacacttccacgtagacaaaattcagaaaatccaaacagcccgaaatctccgacaatatttggtccttccggcaaaaaatatgggcgtcgtcctgctgaaagcgacggacgcgcgtcagaccggacaaagcgccgctcatttcgttgcttaaaacggacaggaaaatgaacaaaaataaaatttaaatttaccggtggagtacaccgaagtcggcataacggatgggcaattcgttgtaggcgtgcggtttgtagtcgaacatcagacagtgtccaggacagttcatcggcttcagtccgaactgctccttctcaatttcgaacctaaaaatgattaaagggaatgccgacttttccactctaatcatgctccataaattacattaactctcccaaaagacttaccggaacatattctccgcataatggtgccaatgcccggactgctcccacagctttgcgttataaatattcggagaaattacctggaacaagggaaaggctcaatcgaaaacctctgtcaactcattcatttgtttttggtagtaaggcaacattcgactattgaatgttctgacctcctggaaaccccggcgtcggtattcgcgtcgcatgaactcgagcagtgtgttgtaaatgtgcgtccccttcgggtaccaaaaggcagtgcccggactcagcgggtggaacatgaacagttcctggtcgcggcccaatttgcggtggtcccgcttggccgcctcctcctgccaaatgcgccattgcttcaactgtttggtatccgggaaggaaatgccgaaaattttttaatatttagtcatgaaaatttattccctgtggttcttggggtccatgacctcgaattggatgtcagattcgtgatcagcgacctttaaaaccccggataacaaattttcatggatttttatttcaaaaaaattttgcaaaacaaaaaggtcccccctgttgtttttgatagaattcaaaagtttactctttttaaatagcgcgcctttccataaatctgttgcaattgcgccaaaatttttttgccttggcacttgttaatgatcccgccaactgatttttaatcgcaaattgatatgaaggccatgaactgagcaccaaacgaacgaactcttcaatttgtgcagtattttgcgccataagttaccttcgtgagaaccaaatatcaacaaacaatcaaccaaattgatttagtataaattctaatgccaatgaactttccaaattaatagtttttgtgcacatagcaactttattttgaaattatcatctgggctcacaagttgtaattaacaaacaaacaaaaaaccagatggaacatttcacaatttgttaacaacaaaaacccgtcgaaaatgaaattgcaatgccattgttcattttttgtcatccaaaatttctttttgttccttcgggccttcaaaagatcctgcactttctgtgtcttgggcaaaagtgtcgcggaaaatttggaacttttggatgagcgcatcgacagcaatctcaccgcgtacctgaaaaagcaatgtcaattgagttgactcaattcgatgatttacttttttgaaattcctcctcctctctcacatgcagtgtttctcaccccttccatgtctgcctctaacactcccttttcacaattccctctctgcacctgattgtccctggtgcgcacattcactgttccgttgttcttctcctgttgcccgatcaccaaaatgaagttgaactgggcgagttgggcattgcgaatgcgtttgttcagcgtgtccgggctgtcctcgtcaaattccacctcgaagcccgcgtcgaaaatgcggcggaacactttgctcgcgtagtcactcaccgaatggtgcacaacgataatcattgcctgtcggattggcaaataagaggagaaatagtaacaaaattcaatgtgcccacctgacgaggcgacagccaaaaaggccatttccctccacaattttccgccaaaattgccaccattcgttcgattgaaccgtaaattgcacgatggatcatcaccggacgaagacgctctttgttctcactaattttaaatgtataataaatatttgacatattttgagacgacgcactcgtaataggaaaggtcgaagcgttggggcagttggaagtccaattggatggtggcacattgccaatgtctgcccaacgcatctttgatttgaatgtcaatcttaattgttcatcgtgtaactactaatgtatgtaaatgtattccatcccttggactggaaaagaaaagaacaacggagaaatcttttttttggttagttgattttttggcatttctaaaagcaaataaatcaatcagtttccgcttgccaacctttggcccatagaatgctccgtcgcccgggttcagctcccatttgagtccgctgttgtccaatgcctgcttcagctgtgtctctgccgcctcccaagtggccaagtcgcccaaatagccctcttcaggccgcgtgctcagatggagacggaaggaaaagccgaacacttccacgtagacaaaattcagaaaatccaaacagcccgaaatctccgacaatatttggtccttccggcaaaaaatatgggcgtcgtcctgctgaaagcgacggacgcgcgtcagaccggacaaagcgccgctcatttcgttgcttaaaacggacaggaaaatgaacaaaaataaaatttaaatttaccggtggagtacaccgaagtcggcataacggatgggtaattcgttgtaggcgtgcggtttgtagtcgaacatcagacagtgtccaggacagttcatcggcttcagtccgaactgctccttctcaatttcgaacctaaaaatgattaaagggaatgccgacttttccactctaatcatgctccataaattacattaactctcccaaaagacttaccggaacatattctccgcataatggtgccaatgcccggactgctcccacagctttgcgttataaatattcggagaaattacctggaacaagggaaaggctcaatcgaaaacctctgtcaactcattcatttgtttttggtagtaaggcaacattcgactattgaatgctctgacctcctggaaaccccggcgtcggtattcgcgtcgcatgaactcgagcagtgtgttgtaaatgtgcgtccccttcgggtaccaaaaggcagtgcccggactcagcgggtggaacatgaacagttcctggtcgcggcccaatttgcggtggtcccgcttggccgcctcctcctgccaaatgcgccattgcttcaactgtttggtatccgggaaggaaatgccgtagacgcgttgcaacggctccgcgttcacattgccctcccaatgggcggacgacgatttggtgacggcaatcgcctgcaggtaaaaacgggtggaacaaagacgtggaaattcgatttcaaaataagtcatgtgccaaatgctcaccttaactttgccagtgtcccggacatgcggaccacgacag

SEQ ID NO: 332 - DNA, 3021 bp, Heterodera glycines
  genomic virtual cDNA Sequence=SeqID_618; coordinates=729..862 ,913..1007,1058..1244,1837..1939,2003..2304,2353..2444,2492..2717
  coding sequence=SeqID_924; coordinates=791..862,913..1007,1058..1244 ,1837..1939,2003..2304,2353..2444,2492..2666
  peptide sequence=SeqID_1149
taccttcataagctagcttctcaatttttggttttgatttagcataattttcgttaagccatttaaatgtgaatttttctctttcgagtttgacactaaaacgaaaaaaaaatataggtatacacgcactcaaacaaatatttcttacaaatgtattccatcaatgccataaactttgcaatatataaatgaagccatcaggtaatccgattgaaaattctgaaactttaggttctcttatgctaaagtcattcgtaagacagttcttatagatagacacggaaaaaacgaatgggggtaaaaatgaatttgataaaaaggatttttttctaactgttttaattggtaagtgatcttcaaatcataattttaattggttacttctagaatattaggtgattttttcaattgtgatttatgagaaaattgtatttttcaaatactttttaaatttgaatttttatttattaacaaaaagccaaatttttcttttttttttacttcaaaatctgagatctataaaattttaaaatacaaaaaaaaaattttacccgctgtcttaatttttccgatttatgatgcttgaaaatccatgcgcatatatattttacagcttaagcttctctttgcagaaccaatgaaaataaataataaacctatcaatttttgtctttcgactcgcttgaaacttctaatttattaaaaatatacattgttcagattacactcacaatcttatctacctagttattttttcatttgatcaactacacgattaaaagcgtcaatcatgggcaagggattccaaaattttatgtccaagaaggacttccatccaagtgcatggtggaacttaaaaagggtaattcctcacaatcagttatatttggctattattttaaaaatttacagaaatgggaagctgagcaaaagaatgacttggagaaaagaagacaggatgaattgcgtgtccaatatgagaaggagcaagaaattctcaacaataagtttgtttaagaaaacattttgcagcttacctaaattaatttttctttagggcacttcttggtgacgaaaaagcgaggttgggcctttctttcatgtacgatgcgcccgctggcattaacaaaaagaaggaggaagggccggaaccgaaattcgaatggcaaaggaaatacaatgcaccgcgtgaagaatgggcgaaaggaaatgaactcatccaggaccaacctttcggaattcaggtgaaggggaagcaatacactcatcttgtaacaaaggtctagaatttcggttttggacactcctggcgattattttttattcacgttctttttcattgtgtccttacgttcttgtcttcattgtcaagcgagatatagtccaaaggataaaaatcggtactagtggactttgggtccgctttttttttttcgcatttttcagtttttttttacttttttattgtcacaattgctttaaataacaaataaaggagctttatgtgcttattggatacaattccgcgatttgggtccataaattaaaaaaaatgtccggtcctccaaattgcctacgccacaaaaaagaagcttaagttctctgagccattcttcgaattcttcgtctggtagagccaaaactttgaataaagcatcatgttttaaatttttaagtgtttccattaatctaaaagcaattgtgacaataaaaaagtaaaaaaaactgaaaaatgtgaaaaaaaaaaagcggacccaaagtccactagtacctaaaaatcaatataccaccgaaataataacaggcgaacgtaatataataaccttctctaattaggtgcgaaacgttcgctgtgtcaaatgtcgcgcgtggggtcatttgaacacggaccgcgaatgcccactgtatggtatgagtggaaatgctgaagaccatggctgtgagtgaatcattggcatttaaatttattgttggttttgtttatgtcaatccattttttcagatgcaaataatccctccgatatcattcgtgatttaaatgtcgaaaagaaaacaaagactgtctctgatgtcacgaccaatgagcagattgatataaaaccgaaaattgaggtgcgcaaaagctacgaagagaagaaaaagaagcgacaccattactcatcggaagaagaggaagaggggacggaagaaaagaagccggaaccgatcgatcaggaacaattgctggtgaacatgcgtgaggagcacaatttgaagttcaagaccggcattctgattggtcttcgagcggacgaacacataaaagtcggcacaactttgaagtttcgggcttatcaatcaattacctttcagaaaatgtcagcgatggttggaggaggagaggaaaaaacttttgaggcttttctgaaaggactggatgagaaaaaacgaagaaaattaatgaagtaaacacatggatgatagttattaatgtacaaaagtcaacatttagaaaaatcatgaagactgaagtgagcgatgactccgatatcgagaaggacaaaaaacagcgaaggaagcaaaagaaggaggaaaagcgcaaggcggacaaaaaacacaaacatcgcaggtcgtcgagtcgggagaccagcagaaagcggaaggaggggaagcaccaccgccactgaaaaggggaagcggactcattcttcggattgccgccatttgtataataaaatgtaatcgcttttttctgtctttcatttacataattattttatcgacaatggtttttctattccattacatttattttttacgtattcactttgcttggatcgatttagcagcgtgaggatgactttgaaaatagttagttctcttgagaatttgatcagattgactccggatgtccattcgattcttgtcctcgatggggacggagttccggttgtcagtgcaggcgaagaggtgcacagttcaactttggtataatgatttatttcggtgttaatttagatacgaaatcggtcccagtattca

SEQ ID NO: 333 - DNA, 4483 bp, Heterodera glycines
  genomic virtual cDNA Sequence=SeqID_619; coordinates=4483..4354 ,3952..3834,3511..3349,3174..3073,3000..2926,2573..2467,2413..2222 ,1865..1623
  coding sequence=SeqID_957; coordinates=4483..4354,3952..3834 ,3511..3349,3174..3073,3000..2926,2573..2467,2413..2222,1865..1623
  peptide sequence=SeqID_1255
aagcgaaacacggcggaagtgacaatgagaaatggcaacgcaatggcactgaatgagcagtgggagtttaaagcacagccgcaagaattggacagaatggcagtggcgataatggcaagaaaaacattggcatttgtcacaaaaaacattcattggcatttgctgtttttttttgatggccaatatacaaaaatgcgtctttgggcctactaaataaaggccatctctgctgaaggtgcaattgaaaattggtcaattgctaccacccaaaatcctcacttttttttcctattttgggacactccaaaccccaaaaaggcgtgccgcctttttaaacactaattgtcatgcatttaaatgtttaggtgatggactcttttggtgaagtgggccattgcattttgggcgatttgtcgggcgccgatgcgacgggggcgcagcaatggcacgaagcgatcgaccgacctggccaaggcgtgacggaatggcacccactgagtgccaattggtgaaagctgtcgcaaatgatgccctttttgctcttttcaaatttatttggttaaataagaattttaaagaagaataacaattagttttgtgtttgatttttctggtcccaatttcgaccaaagaaaaaacaaaacaaatatttgtccatttcagtttgtatgtaaaaatatgtaaataaaagtcccgatttttgttcgcaaacacaaaaaagaaagtgtttttcctactatttagatcatggagaagccaggaaaaaatatgtatttacataaaattgacagccatagttataagttgtatgcactaaaaaatgccaaatatgcgcataaaatatgcactaaaaacccccaaatatgccctaaaaactcgaaaaatgcccaaatatgcactaaaatatgccttaaaaattacccaaaatggcttctaattctcaaaaaatgccaaaattgtgtaaaaatacaaaattgaatttaaacatcaaaacaatggctaaggagcgttttttggataattgcaaaaaagtttgatttttaaatttatatatgcaatttcgaattttaaaatttttatcatacatatgctaaaacaaaattatatttttctaatatcaacaattttttttcaaaagttcttacaaaaaattcaaaatttttcgcttttcaaaggtatattttttaaattccaaaaaggtcgatccttaggggatgtatttttcatttttattgcatttttttatgaatatttgccaaaaatgaccgaaatatgttctaaaaacgcaaaaatggcaaaatatgcatttattctcgaaaaccccaaaatatgcttttatatgcactaaaaaccttcaccaaatcaaaaaattttaacgcagaaatgctatttttgagcccctttcttcattgcatatgcgcagaaaaaatatgcaaaatcatacaacttataaccctaataataacaaacaaaagaggttgcttacgagaagataaatctttcaaaagaaaaattatgttttttggaatttttaaatatttctacaactttaaaaaaatcataattttgacattttaaatcccgaacgaaacggtggaggaggcaataaattgtacaaaaaattaaaattcaaagcctacataattttttttttttttttgcaaaatttctataaaattttttttgacaaatttttcattttcaaaaataatttttgcctctttgatgttgtgactgtcggtgagcatcatggtcagccggtcaatgcccatgccccagccggcggttggtggcaacccgtactccaacgcggtgcagaaattctcatccaccgcctgggcctcgtcatcgccagcctcacgagcctaaaaaaaaaaaattacaaacttacaattggtgggaagaatgaaaaagtttacaaataagccaattaattttgctataaaaatggaaaatagatttgtaaaaaaaaattttgtacgcaacagtaggaaaaggaaagattaatatgtaacacggaaaatatgaaaaaaaattgttttttttgatacaactctaatttttaggacccattagaacccatctatcgtcaataaagaagcggaaagcaaatttccgcttactatctctactcgagaatcgtgagactcttgaaaaacggcaagaaaatactaaaagagcgacgggggaaatttttcagtaaaaaaaattctgtgcccactttcgcctgctgttcaaacagttcacgctgacgcagcgggtcattcagttcggtgtaagcgttgcacaattctttggtgcatgcgaacagctcaaagcgctcggtgaggccgggccgagagcgatgccatttggccaacggagacataatttgaggatgcccagtcaaaaaggtggggttgatcagtttgggctaaaaaagttacaaaatttaaataattttttttaaaattaccaactactcacctcgatgaactcgccgatcagcttgtccaacaggcgagcacagctgcgcggctgtgtacagtccacgccgtgttcagtggcgatacggtcaaaaaagtcgcgtgcctctgtgcaaaaaaaaaatggaaattcaaattgggaaaacaaaatgttacattaataaataagcggcaaaaaaaacatgacattcgagtaccaaggggatgggacgatcgccaaaaaatattttttttaatgcttaggaagtgcgaaccgaaatttttgggcatccgaattcacaccttggtgcacaacaacacaccagagtgcaatttaaaacgatcaaattatatcattatgagagcagaggaatacgatgtcaggcataaagggagggaggggggggggaaattctagcgaaaaaaatttatttttttttgggggggggtgagagaacgaagcagtgaaagaaaactgtaccaggcgtgtccagcttgtcagcgtcgggcaattgaacaccaaggattgtgctcaattcgtcataaatgttgatgcctataatcgtgacaatgtgttgaataagaaacccaaaaaaaaaaaaaaaaatttttttttttgttgcaatacgtttgaatggaggcgtaaagtcgagttcatagaccggctctttgtcagtgccgttgggatggtacgtcaatttgtgggtgccaaagatggagtggaccatttctgaaaaacaagcgaattatttaatcgtggtggtccaagtaatttgaaccgggaattaccatatgaaaaaaaaatttctagcgaatttttcaaaaatttatgatgaattacgactataatgtagcctttcgcataaattttccaaaaaatcacaattaaaaaaaaacctcttactagacaacaaatcctcagtgatgcgcatcaggtcctcgtagtcggcaaatgccatgtaaaattcgcaggaggtgaactcggggttgtgcgtttggtcaatgcattcattgcggaagaggcggccaatttcgtacactcggtcaatgccaccgacaacgagcatctgcagattttacaaaaatttgtgtgcttttttcgaatttttttaggggtggcgaaataataaaaaatcattttttaaaattcggtggcataaatttttatcgcatttcaggtacaatattctctttctcttcaccattttttacagctccattcctcaatttaataaaatgaatttgactcataaaaattaaaaaattcaaacgccatagattttttttcaaaaaattcgaattttggtacaaaaatttttggaaacgggtaaggggttaaaaaccaattgctttgccctagaatttttcattaaaaaatataaatgctgccttgtggtacagctcgggcgccacgcgcaagtacagcttcatgtccaagtcgttgtggtgcgtggtgaacggtttcgcagtcgcaccgccagcgattgggttcatgatcggagtttcgactaaaaattccggaattttttttaataaaattttttaaaaatcaatttttcgtaatttccagttttggatcctaattgactcgaataattcgggtgaatttttttcaaacatgcaaattcggacatgctaaaagatcggagcatgtcacttccccctttccccgatttgaaaaaaaaattttcaaacattaatttcaaaaaaaaattttaggaaattttttcttaagaaaatttctagaatttcttttttagaaaaacattcagcgctttgcaaattaaaaaaaaaatttcggatggaaaacgacggggggagggaatgaaatgcactccaaaaaaaaacaaaaatttcttgtataaaattctaaattttcgcaaaaaaaaaactggaaaacaaaaaaaaccttcaagaaagccgagcgcgtccaaatatttgcgcaaaaatgtgataatttttgcgcgcgtcacgaacttgtcacgcacttccgggttcacgatcagatccaagtagcgcatacggtagctgaacggaat

SEQ ID NO: 334 - DNA, 1381 bp, Heterodera glycines
  genomic virtual cDNA Sequence=SeqID_620; coordinates=1210..1100 ,687..533,299..57
  coding sequence=SeqID_973; coordinates=1171..1100,687..533,299..134
  peptide sequence=SeqID_1190
ccccattttaattttaagtgcccattcattttgtttactgataaaacgtatcagaattttaacatctttttatccaaccaacaacagcaataacgaacaaagacattttcttaaacaacaaacgtcggtcacatcagaaaaagaaaccgagaattttccctcccacgtgttttctacgtgcctcctcgtggtccataatgccagccgaagtggtgagcaccaaaaaaccgaactgacgcgatggaagtaaattgctggtccatttctccaagtcggccattcgaatgtcgaaacgaggactgaaatcgaaaaataaaataataaagtctttccgcctatgattaaacgaagtcatttgatttcaatcaaatgtctattgtattttgcaatattgtgaaaaattcagaaaattaacgagatgaaggcatttggaatgggaaacaaatctacagaatttgtttaataaatcccataccagtaaaaaaatatttgggtgggagtatggccactctttcttttcatgtaacagaacctgatcacttggcatttgttgatccgtccagtgagattcaccacaattttgccggcacgatggtcatcaacaatttcgaattcgccaatgtagccgtgtttcatcatgaccgtgaggaaacggatgatcacctttgaagacggtcggatgatcacctgtataatattaatggaaagagttcgtttactacgcttaggatatttggcgcaataataaacaattaaacacatagaggtatttgcggaaaaaactcatccagtcccatctgtttgatttaaaaagcgctattcaaataaaaaccgcaacaattacggaattttttatagcttgctaaaatttaaccttctaggtatcaattgaaagcttagtcccaggcatttataaatacaaaagagcaaatattgacatagtgttactgagaatagagggtttaaaaagtatggtttaaagtaaatagaaatagtcattgattatacgcctatgtcgattggaagcctagtgcattagagccctaaattcatgtcagattcgtgaatatcgacccaaacccttttttgccacaattacctgtctcttgccacgcttttcagcattgttaattgactttaaagcgtcggctaaaacattcattcgcaccattgtgaatgttgccttatttttgattacaaaaatactatctgagaaatgaattaacttgacaaaaaggaataatagttaagtaacatattggaaaagcctttgagagcaaattgatggttcttcaattccaacaacaacaaatattgtaaatcagaacaaataaatgatagcatcgccttccgttataattgtctcattgtcttagtgtcc

SEQ ID NO: 335 - DNA, 1780 bp, Heterodera glycines
  genomic virtual cDNA Sequence=SeqID_621; coordinates=1320..1089 ,803..514
  coding sequence=SeqID_993; coordinates=1272..1089,803..619
  peptide sequence=SeqID_1207
ctaatcacgaatatgaactcggatttgcccaattccgaaccccggacccgaattcgaacaaaaacttgaattttttttcttcaaaaatatacgttaaaatcgatcaaattttggcgtaaaccgcggatttttatccaattaacaatttgaagcattattttaatcaaaaaataatagttgttgcatgaattagttttttatcccaaaaaaatgcattcttgaaatttttttttcaatttttgttcgaactcgggtcaggagttcggatttgggccaatccaagttcagattcgtaatcagcacccttgaaaacccttaaaatatgaattttaaataaaaaaaaaattttcgggaccacaattccgaaagattgccctttcaaactatctttaatctaaaaaatacgaaattctagtgcgttaataactgaacagtgaattccgactgaaccagcactacgcttatatagattttcgataattagtcttgccgttccgatttatgcattgcgtcgagtaaccccattttatatcagaaaaataaatgagatgttcagccagtggtttgaaatgaacaacaacaatagacactgatcccttctcccattgtggtccatcatcagcgtcgtcccccgccgccgccgcgtggaggccctccgcggcctcgtccacgtccgcgcggcccaccgcgtcctccacggccaccaaatcggcgttgagtgggcttcttgcgcggctcgtcatcgatgagcaaagtgtccaatggcaaagaatccggaagaacaatatagcgaatgttgtttcctgaaaagggagtatgaaatcactaggaaaaattttttttttcaatttttgttcgaaagcgggtcaggagttcggaattgggcaaatccgagttcaaattcgtaatcagcacctttgaaaacccctaaaaacttgttttagcccataaaaattagggacccccattcttcacattcttcaggattgccgaaatagatatcagaatcgaattctacgacccagaaaacccataaaaatgttatctcaagtttgtatagtgtttgggttttgagcgaataaactaacctctgatggagagtgtgtccaaactgatttgctctcgtccacgcactgtcatttttaccgagcgcaaatgaatgttcatggccacgtcgacgccctgaatagcaccgctcacttgtgtgccgttcttcagctcgatggtcacagactcatgggacaatttcatcaaaaagcggacaagcttcatcgcgcttactgaccgttggctcttggaattccaaaaataaaaattgagaaaaatctaaaaattaaaaaacgttaaaattaagattgtcctttcatcaacaaaacaaaacgaatccgcactgaaattcaaaaaatcattatgccattttaaaatttaaattttttgccctttcaaaaataaaaacatatagattctgacacttcctaaactcaaactcaaatatccaatatacttttttaaatttttagctggtgcttcttttaatgtctgaaaacatgggtgctatttttgagaacattgctttgcatgactttgtcgtgaaagaagtgataaacagtttcccggacaaaaaggtggcaaattacgtcaatttttgtaatttatttctctaagagcatttttcttttacttgcgaaatccgatgagaaggctttgctcatctgtaagttttttcgcgtatggatatgaaaaataattggtcgccaatttcagttagcaaaacatgttt

SEQ ID NO: 336 - DNA, 2166 bp, Heterodera glycines
  genomic virtual cDNA Sequence=SeqID_563; coordinates=2136..1910 ,1835..1763,1712..1595,1541..1339,1282..1169,1105..831,706..612
  coding sequence=SeqID_803; coordinates=2136..1910,1835..1763 ,1712..1595,1541..1339,1282..1169,1105..831,706..643
  peptide sequence=SeqID_1234
aataacaaaaaatgcctagattttaacgctttttaattgaatgctttcgccgaaatccatttctagctaattagccctaattaatgttagttattataataatgcgtagacacaattatttattgcctctaattttcataaatttggtgattaaatgataaaatccaacatacatatggtaatctattgtctaaaagttcacgtgcaaatggcaattaagctccctattttttaagaattggcaaagtcaaacttccagttttaatttttaaatattctctggctaactgttgaacaatttgagcctttattctcgcaaaaaatgaaactatttttcggggagtgacgacggcaaaagtgcagtcctagtggcattggcctaggattggcaacacttttaacacatcaacagaagaagcaaagggacgaagaaaaactagcaaatttgatgaaaaattggaaaatgaaatttgatggggcgggaagtgagatgagaaaatgaaaagaaaagccataaaaacaaaaaaaaatgtgattggatgccattgctctttttggtgttcgtgccaatccccgcactccgatgctcttgatgaaaggcattttctgctctcctcctccgtgcggtcgtgcagctgctgctcagaagcacttgcggtggacaatggacgggcccgactcgtcgtactcctgcttgctgatccacctgagaaagggcaaaagagtgctcagagggggaaaacaacggacaatgatcagctaattgggcaactgatcagagggggaaaagcattggtgggtcagatcagcccaatgcaaccacaactcacatctgttggaaggtggacagggaggcgaggatggagccgccgatccagacggagtacttgcgctccgggggagcgatgattttgatcttcatggtggacggggccagcgcggtcatctccttctgcatgcggtcagcaatgcccgggtacatggtggtgccgccggacagcacattgttggcgtacaggtccttacggatgtcgatgtcgcacttcatgatcgagttgtaggtggactcgtggatgccggccgactccatgccgatgaaggacggctgaacagagccaaatcaaattgtgccgttgccataggcacgcgccctccgccgggcactcacctggaacagcgcctcggggcaacggaagcgctcgttgccgacggtgatcacttggccgtcgggcagttcgtagctcttctccagcgaggaggaggaggcggcagtggccatttcctgaaccaagacgggaggaagggtaattttggcatcaaattggccaaatgtccgacctgctcgaagtcgagtgccacgtagcacaacttctctttgatgtcacggacgatctcacgctcggccgtggtcacgaaggagtaaccacgctcagtgaggatcttcatcaggtagtcagtgaggtcacggccggccaagtccaaacggaggatggcgtggggcagggcgtaaccctcgtagatgggcacggtgtgggtgacacctgtgcatggagattgatagctatgatattatgccaacgatttggctgcataccatcgccggagtccaacacgagaccggtggtacggccggaggcgtacagggacagcacggcctggatggccacgtacatggccggcgtgttgaacgtctcgaacatgatttgggtcatctgaaaaggggagattccgtcagtttcactgttccatttggcagatggaccttttctctgttggccttcgggttcagcggggcctctgtgagcagcaccgggtgctcctcgggggcgacacgccttaaagggacggattggccaagtgaccgacggcgagtgccaatgccaatgctgacgttggcaccaccactcacagctcgttgtagaaggtgtggtgccagatcttctccatgtcgtcccagttggtgacgatgccgtgctcaatcgggtacttcagcgtcagaataccacgcttggactgcgcctcgtctcccacgtacgagtccttctgtcccatgccgaccatgacgccctgatgacgggggcggcccacaatggacggaaacaccgcgcggggcgcgtcatcgcccgcgaaaccggcctgaattaaagcggaaattcaatccaattt

SEQ ID NO: 337 - DNA, 4031 bp, Heterodera glycines
  genomic virtual cDNA Sequence=SeqID_568; coordinates=262..264 ,311..525,640..857,960..1273,1319..1606,1694..1877,1926..2031 ,2085..2298,2343..2810,2873..3055,3112..3283,3337..3655
  coding sequence=SeqID_795; coordinates=262..264,311..525,640..857 ,960..1273,1319..1606,1694..1877,1926..2031,2085..2298,2343..2810 ,2873..3055,3112..3283,3337..3530
  peptide sequence=SeqID_1038
agaaaaatgaatcgtttcatttctacttacctcactaattctattagctcaatttttccgttgggttaaatttccctttgtgttgttagtctccgtttgattaaaaaagttaattaatacggtctgtataaaatgcttaaaattgcttttcgtccttttctcaccctttcctttgaattcgcaagttttaattttgtcttttaagggcgttctatttatttgcttgttaattcgttgagttcagctcttagtttgttaaaaatggtaaagttttcttttgtttctttcaaaataaacaaatttgtgttaggtgaactttaccgttgatgaaattcgtgcccttatggatcggaaaaaaaacatccgaaatatgtcggtcattgcccacgttgaccatggcaaatcgacacttaccgactcgctggtgtccaaagctggcattatcgctggtgcaaaggctggtgagacgcgcttcactgacacacgcaaggacgagcaggaacgttgcatcaccatcaaatctacgtttgtttttgggattgtactagattggttttttctaaaagtaaaacaaaatctatttttcatggtatgcaaatccatcctttacacaatgctttgacttcgcttaaaatttagtgccatttcgatgttctttgaactcgaacgcaaagacttggagttcgtcaaaggcgaaagccaagcagacattgagcaggtcgacgggaagagccaaaagtacaacggtttcttgatcaatctgatcgactcgcctggccacgtggacttctccagcgaagttactgctgcgttgcgcgtcactgacggtgctttggtggtggtcgactgtgtgtcaggtttgtcttgaaaactatgttttttgatttgcacaaacaaattcgcggttgcattttaatttcaagtgcactagagccactatttctacatccgctctttaggtgtttgcgtgcaaactgagacggtgttgcgtcaagcaattgccgagcgtatcaaaccggtgttgttcatgaacaagatggaccgtgcgctgctcgaacttcagcttggccaggaggaattgttccagacattccagcgcattgtggagaacatcaacgtgatcattgccacttacggagatgatgatggaccgatgggtccgatccaagtggacccgtccattggcaatgtcggctttggctctggacttcatggttgggctttcacattgaagcagtttgcggagatgtacgctgacaagtttggagtccaggtttgaacacagcttgatattttgttcaaatttgcttatttttagattgacaaattgatgaaaaatctgtggggcgatcgcttcttcaacatgaagaccaagaaatggaccaacaaccaagagcccgagaccaagcgaggcttctgccaatttgtgttggacccgatcttcaaagtgttcgacgctgtgatgaacatcaaaaaggacgaagtggcgaagttggtggagaagctgaacatcaaactgaccttggaagagaaggaacaggagggcaagccattgctgaaaacgatgatgcgcaaatggttgccagccggtgacactatgcttcaggtttgtatgggattagcccactttagtcttttttcgtcgggaatttcaaaataacagaattcggttgtaaatcctgtttttatgcagatgattgtcatgcatttgccatcgccagtcacggcgcaaagataccgcatggaaatgctatacgaagggccgcatgacgacgaggcggcggttgcaatgaaaaactgcgaccccaacgggccactgatgatgtacatctcgaagatggtgccaacctctgacaaagggcgcttctacgctttcggttttaccttttcacaaataatgaacaaacaattttatgaaaactcaggtcgcgtgtttgcgggcagagtcgccactgggatgaaagcgcgtatccaagggccaaattatgtggtcggcaaaaaggaggacctctacgagaagaccatccaacggcaagcaacaattcatttctggttttcatttacattcaatccccgttttctagcacaattctaatgatgggccgttacattgaaccgattgaggacattccggccggaaacattgccggactggtcggcgttgatcagtacctggtcaagggtgggaccatcaccacctacaaagacgcacacaacatgcgcgtgatgaaattctccgtgtcgcccgttgtccgtgtggcggtcgagccaaagaatgcgggcgatttgcccaagctggtccgacattttcatgtttcaacaaatttaatttcagatttaaggtcgaaggattgaagcgtttggccaagtcggacccgatggtccaatgcattttcgaggagtccggtgaacacatcattgccggcgcgggcgaactgcacttggagatctgcttgaaggacttggaggaggaccatgcttgcattccgctcaagaagtctgatccggtggtgtcctaccgtgagacggtcaccgaagaatccgaaattgtgtgcctgtccaaatcgcccaacaaacacaaccgtctgttctgcaaagctaggccgttgcctgatggactgccggaagccattgaacgcggcgacgtcaacccgacggacgacccgaaaaatcgtgccaaaatactcaccgagaaattcgaaatggacgcgaccgactcgcgcaaaatttggtgtttcggaccagagggcactggtgccaatttgctgattgacgtgacaaagggtgtgcagtacttgaacgaaattaaggtatgaaacgtttaaagaattcgattccttttttgctattactaattttaacggaaatttaggattcggtagtggccggcttccaatgggcaaccaaggagggcgtgctctgcgatgagaacatgcgcggtgttcgtttcgacatccacgacgtcacactgcacgccgatgccattcaccgtggcggtggtcaaatcattccgacggcgcgtcgtgttttctacgcttcggtgttgacggcaaaagtgcgtctgtgtcttcatactactgctaccaattttacaaattttgtcccatttagcctcgtctgcttgagcctgtctatctcgtggagatccaatgtcccgaagcggctgttggtggcatttacggagtgctgaaccgtcgccgtggtgtcgtctttgaggagagtcaaattgccggcacaccgatgttcattgtcaaggcacatttgcccgtcaacgaatcattcggtacgttttttttacactctaattgtgttttggactaatacacttttacgcaggattcactgctgatttgcgttccaacactggtggtcaagcatttccgcaatgtgtgttcgaccattggcaagttcttcccggcgatccgtttgatggcacttctcgtcctggtcaagtggtcactgagacgcgaaaacgaaagggattgaaggagggcattccatcgcttgacaatttctatgacaaattgtaatacgtggatttaaattatggtggtgtttttgtttgttggctgacacaatacacttgttgtccttttattttgaaatcattgtgggtcgtatgtaattttatcctgttgttaaaaaatttaatgttttatttgaaaaacatggtttcttgttatcgtatcgcagattgagggaattaaattgccatgactgggttctcaggaatgtctcgaatttaatgtcttcgggatccagcataaatttaagtgaatattgaaaaagcggttttaatgcactatgagtccgatcgacttttatgagtccaatcaactgcaatatctggtttttatacaataactttgttcatgattgagcaaacccctatctttttggtacattcgaaagcacaaagtctaaataatgtaataatacgagaaaacacgagaattataacatttcaagaaagttacaaacgaaaataatcaacaattacttaatttttaaatttctaattttcaataaaa

SEQ ID NO: 338 - DNA, 2821 bp, Heterodera glycines
  genomic virtual cDNA Sequence=SeqID_578; coordinates=2821..2681 ,2631..2377,2102..1851,1644..1503,1372..1221,1037..870,806..672
  coding sequence=SeqID_820; coordinates=2821..2681,2631..2377 ,2102..1851,1644..1503,1372..1221,1037..870,806..672
  peptide sequence=SeqID_1060
cccagagagaaaaagcaatgccaaatttaaattaacgccaaattatcataacgaaagcaacatattaattttaaattccaacgctaaattacaaagaaacattttgctggcggccaggggcggagcaaaagccgtcaaaatagctaaatttcaaaatccattgtgtaaacgatggaaaaatggtaatttatcgtttcaaatacacccctattttcccagcgtcgctggtatgagcaaaaaaaaaaaaaaaggtcgttcgggcgaaagtttttcaaaaatacacccctaagaattgacttttttgtcaacctattctaaaattggttttttgaacttttgtttcaaaaatgcgttggtttttcggtggtgccgatggtccaccaagaaatatttttaatgcaattttttttattggctatagccctggcgacccccttgcccttctcacccaccccctggcgctcatccgttcgtaatttggcttgacgcacttttttgcacataaatgaaatgataggtaaggaaaacacaaataaaagacgaaagtaacgccgaaatgaatcggaaaaaccgagaacataaatgaattataggctctatgggaatcactgatcgatataatctatttttgaattttgccattcttttgcgactgactgatcagtgagtgatcagagatccaacagaatggtcagcgggtcttccaccgcctgtttgattttgcgcagaaaagtgaccgcctctctgccgtcgatcaggcgatggtcgtaagtgagtgcgatgtacatcatcggacgaatttcgacctaaatcaatgcgttatttttgctacaaaacaaactgaattgtccgatcttttctcgacttgcctttccatccaccgccacaggccgatcgaaaatgccgtgcatgccgagaatggccgactgcggtgggttgatgatcggagtgccgaacaacgagccgaacacaccgccgttgcttatggtgaaagtgccgccctccatgtcttcaatcgccaatttgttgtcacgtgcctaaaaacatagcaatttaaatttgttttttcatttcttgaatctcaaaatggcagaaaaaggcattataaaaagatggtcgccccctcacccacgccgaaattcgggactgtcccttgaacgcggttaaacccatggcggcggctaaccctcacccatccgaaattcaaatcctcgccgcaccttcactcccaaatcgccaagcgtcttctcaatgtccgcatagctcatcgactccacgttacgcaccaccggcacaaccaaaccccgcggggttgccaccgcaatggaaatgtccacaaagtttctgtagacaatgtctgcgccctcgattactgaaggggaggggattgaaatacgttttaatttgttaataaaagaaattgcaaccaaaaatccaaattccaacccgtttcgaaaacccagtgcatttttaaaattaaattccatcctttggctactgaccagcattaaccacgggcagttcctgcaacccaattgcggacgcgcggacgaacggagacatcagacccaacttgacaccatgcttcttcgtgaacgcctcttggtactgcttgcgcatccgtaccacgttgtacagatcgacctgaaaagagcaaggaataaaaatgtttaaaaagataattattctatcattcgatttgtttttttattagaatttttgttttgttttttgtgatgcaaacggacaaatcaatttattaagatttttaaaaatagcaagctgtataaatgtgtgactcgctacaaacattcactcatgtcacccgcctcccccccatttgtgttgacctcgttgaacgtggtcagcatggcgctggtgttctgcgcctccttcagccgctccgctattctcagtctcatccggttcatcttcactcgcgtttcgctgcgttgtccagtgatggcggtggagtcgccggcgggagcgtgcggtggctgctgctggaacttgggcacttttatttcggagacgggctttgagctgatcggctcctttggcagtggcggcattttcgactgcatgggaggagctgagaatggaagcactctttaaaaaacaaacgaaaaaagtattggcaataaatcatcatccaattaggccaatgggtcccatttaattttgagtattttctaaattcctcgaaatcttttcaaccattggcattagagatcggataagggccgggcccgtatacgggttttacgggcccctaacccgtatttttttcggccgatacgggtttttacgggttaagggtttttagcccgtaacccgtatcgatgtcaagcccgtaacccttacccttacccgtacaatctgaaaattccgatctcttattggcataccttccgttcgctgttctgcttgcccttgctcctctctcttcggttttggcacttctccctcctttttcggcatttcctccttcgcttctttcgccggcccttcacccccctcggctcccttctccaatttgtatagcttttgtttggccaatactttcgctccttcctccaccaaaagctccacgattttgccggcaaatggggctggcacttcgactgatgtcttaaaaagcagtccatcatacgtaattttggaggccaaatgcccaaaccttgtccgtctcaatttccgccacgatgtcgtccgtcttcacaaagtcgcccacttgcttattccagcggatgtcaccttcggagatcgattccgcaaaagccggcccttggatttcgaccacttcaccgcctgaaatgca

SEQ ID NO: 339 - DNA, 8477 bp, Heterodera glycines
  genomic virtual cDNA Sequence=SeqID_747; coordinates=8102..7921 ,7851..7737,7675..7352,7307..7060,7009..6943,6809..6628,6425..6102 ,6043..5690,5639..5576,5528..5074,5024..4836,4717..4474,4399..4218 ,4165..3915,3552..3441,...
  genomic virtual cDNA coordinates=3395..3179,3039..2988,2930..2705 ,2648..2594
  coding sequence=SeqID_1002; coordinates=8102..7921,7851..7737 ,7675..7352,7307..7060,7009..6943,6809..6628,6425..6102,6043..5690 ,5639..5576,5528..5074,5024..4836,4717..4474,4399..4218,4165..3915 ,3552..3441,3395..3179,...
  coding coordinates=3039..2988,2930..2705,2648..2594
  peptide sequence=SeqID_1213
gagtgtacgactctcgcagcaccgcctcgcgctcgtcgctggcgatgccctcgagggaagcgcccgaatagtggcgctgccgctcttcagcgaaaaaagcacggccaacggaagcgctttctggagaagttatgggaaacggggaggttcacacggcaaaccgagaacgaagagggaaaagcgagaaaaacacattcactcgggggaagtggatattgtataatcgacttatgaattcggtagacacggcaatggtcccacactttcagttcacggggtgtgccagggcgaggcccttggcccttacgatgggtgtggcgcaggggggtgagtacggaggaaccaaattttcatacgacggtccagattgttcccggccaagcttttttttatacctttttttgcggcgcgcttttttttcgaaaagatcaaatttgaaattttaggggaattttgggaccggtggagccgttaggcccgctgggaaaaattttgaaactttaaattttcaattccctctttcggaccttagtgcaggacaccctttagcatctgtgcagcgttagaaaagctcgtccaagctcagttgtgcttacccctgcccagcgccgacgcgctcattgtgcgtcgtcggccgagactgtggtactcggcgccggaaccgccgtcctcgtaacgcaaatagtcgccgggcgtatagtgccgccgcagagtgctgcgacggctctgtccgctggccaactcctccaactcgctgaccaactgttggccctgggccaacagctcgggcgattggttgtacacgtggtaaatcttggtgttgtgcacctcgtcgcccttctccttctccaccaccttctcaatggtggtcagtcgttctgtcaattcggtcagactttgctgaatgcggcgggagtcctcgaaggtctgaaatggccaaactgggggattataatggccaaaatatgtccccgttggacagtccgtttaaccactcattcactcacgcgtcctccgctgactccgtctttgaacccgtcaatgtaaccggctctgaactcctcgttgtccggatactgctcctccaaccttcgcaacagactctcgctgatgcgatcaccgaaaacgcccgagtttccgtcccggaagccctgcatgtatccggaggagtagccgaggcgctgggtgggccgttgtgccaagttggccatggatgtgctcatcccgcgttctcccgcgtcgcgcaacccttttgcgtacccctccttaaacatcggattggtgggttacgcgtgccgatccgctgttcctacccggaatgcctcgtccctgccccggtagtcctcttcagcgcgtccgcctgccctcgccgccctgtacccgtgtgcgtatccgtcctcaaaatcgcctcggcttcgttcgtaatgttccgtcttttcgtccctcaaaagtcgttctctttctcttccgttcacatatcgctggcggcgttttctgaagagagaagtgaatgaaacaaaagaaaaattaaaagggaaattgggaaaggaaaagtgaaagattattaggggggtaattagtgaggggacagtgagaggatcaatcaaaggctaagacggcactttgctaaaagccacgcgagcagacagcagaggagcaggcaaagaagcaggagcagaaggagcagcaacagccaccaccagggccaacctgcggcgaggaacggagttgctgtgagaggggaggtaattaaggggttaatgagggataatgaggggagggagaggcgggacaaaaccaataaaaatgatagagacgataagtattatggaatggaaaataaaacagaatcaaagacaagaacggcggaccatttgcacttcttaaggagcgaagaaattccgtgctaatgattgggttaactttgtttaatggcaccgatggaaaagtgatttggtaagtgatttgtgggcaaatgccaattacaaaaacggaaacagcagcaacaacaacttacgacggaagtgcccagaagaccaaaccgagacaaaagaccagcacaatcaaaacgggaagaaccagcacaaagccatgccgaagggacaaacggtgcggagacggcggggacgaagcggcaacttctgtcggagagatcaaaggggacggaatggccggaggaatggggacaagaagaggaatgcccgaggggacaagaaaagatattgaaatgacaagaaaaagaagaagcacacagagagaagagggggtacagtaaaagaaatacgataaaaaggaaaagcaaatacgatagaatactgtaaagccaagggaatgcaaagagtgacattttggaccaactaacaaataagctccgtcccccccccaattaacctttggcttaccgtcggctctgatctttttgttgtaagccatggattaaaagcgtgaatgagaaagaacgacaagagaacaaccaaaggatgagtggtggtgaaagagtggtcgtagtgaatggtcggtcggtcatccgttggatttggctcccaaattgcccccatttccccccccccccccccccccctctttttctcacctctcagtcgtgcgatcaccggctgatctccgtgcatcatccatttggtgtataccttaagcgagtgagtgagtggtgcttctcccccagcaatcgttctgtttcgcccacttcgtagttgtacttcttgtccttgtgcagcggatagttcagatatcctccgatcacttgtccgtctccgattttcacgtgtgtcggtccgaccaatgtttcggtgctgaacgacgccgtcacgtaataagggatgtgcagccgatgggccgtcactttgtccgtcagctgagtccaattggtgtcccccggggggtcacgttcgtccaccacaacgtaataacgcctggggggagacaaaagtgggtgcgcgtggcctccgcttgctcctccaataactcacgtaatgttccgatcggtgggcgacggtgcgattgcgtattgccattgggtatctttgggatttgctttttgaatttttgttttgtttgggcatcagttcccccctttggcaccctttcccccatcttcggcactcatttactattttggcattttttcatttcccgtcccatttcgtcccccattttccacctgtttgtccgatgttatccacatggtaaggcggtggcacaatgcagcaattctccttcacttccggcgcttcggccaccgtcggccgtcccgccaatttccaattgttccatcggccgtcgaccttcgcgcgcaccataaaagcgtattcctccggaggatttgccagattgaacaccaaatagcaaagcctattacacggatctttggggcacagctaaactcaattagcagatcgaatataaaagaataaagaacggaccaattctttgcggtgcctttccggctcctccacccacaaagtgcgaatttggtgcaaatgaatgtaccgcacttggtaatgcgtcgccgctgcacccaacacgggctcccaactgaacgagggggggggcattcattcactgtggaaaaagaagaagcaaaggaagaagcaagctcatgagctgttcgtgccgacaaacaatgctcggatcacagatcaagtttttcaatccgaaaatgttgagttttgattctcgggtttgagtctatcaaatcatggaaatgtctggggggggggtcgttccccctgattttgttcgcattgagtctggtcgaaccctcattatttcagctgacccgggggaaatctcagtctttggaaaaattcagtttaaagaatcacagtaattaaggaatctgacaagtgcccgtcccaaaatccaattatgtcggcgccgtggccaccattcttcacctcattgaggtggcgtgcggtgtctggtcgcagtgccgaatgtcgccgggaaggaagcagcccggctgcagcgtcgagtagattgaccacgcgccatccatttggtcctttagctgcaacgtcacattgtacgtgctggtgggctcgagtccgcgaatggtcagctcagtggcggtggagggcacgtcgacggtgcgcatggaaccgatgcgaaggtgcggatgggtggaatggatagccttggcggtcagctgaaaaagtcggggaagttggagcagtaccaccaccaaaccaatcactgacgatgtatccgcggtgcgcaatgccccagaccgggtcccactccacggtcagggagcccggcgtgcggtccttcagccggagaatccacgttttgccgagcgacaatgttgcccatgagccccatacggtagcaccgtatccgctgtccgttccgccttggacggtgatgttgtatatggtatctgaaagacaatggcattttgttttggtatttttggtggccctttggtctgtcaacaaactggcactgactgacctggttgcaattcggtgaatttgatggaattgcccggtaccatcactgtgtaatttttgcgcccgcccgccttcatcgtcagagagtccaccggtgcaatggtaacgcggtaatgcgtcagcaagtcgcggtactccggctcgtacacgtcaggtggagtccaagtcacgtgcagcatggagtccgacttttccaccagggtaagcggagaacaccacgaagacagccaggcgagggacggctcctaaggggaagcaaattcaaatgccattttcaactcggtttgcatttggtcccaactctcgggaatgttcgtttattcgggaatggcattactgtcccttacccctcccctttctcacggatatgtcagtggtggcgaagttgtcgctaatcctccacaggctcttcccctgctgtgccagtccttgtaccgttacgttgtacactgtcaccggcaccaaccctttgaattggaagtccgtctgactgtccggcacttcgtgccgttgtggcgcttggacaagtcgttcggtcggttggatgtgcaactttaaacaaataggtacagttgcgaatctcgtcctccgccttgtccacctcgtattgttcgatgtgcgcaacaatcaccggcggtgccgtccaccgcactcgcaaaaagtcgtgccctgcgccgatcagtcgcaactgtcccccctccaccgccttcagttcgggttcagtggtgccgaaactgtccgaggtgaacgggccccaattgccagacgaagactgcgcctgcaccgcgaagcggtacatcgtggccggcttcagacccgtggccgaagtgcacaagtgttcgccagtcaaaatgcgcgactcgtagtcggcacagctgagttcgtcgccctgcagaatcacttcctgcggccggtaagtgcctgcggcggggccgtaacggagacgataagcgaccaccggagaagtttcgggatggggcgggagccaggccaattggatggcattctgcagagacttaatgggcgagaggtcgcgaggcggtcccaactcggagccttaatggttcgctgttttggccactttctgatcactgatcgctcacccgtcgtgcgcgcgtcgatcggctctgaccacggtccgggcccggcagaagtgaacgctctgacctgccacgggaatggataggacaaagcgctttcttggggaagcaccgtaccctgaagcggtacagtgagccgggcaacagttcgccaatgtctgcgcgtgtgcgtgggctgacgccctggcgtgtcccctggttccactcgtccaacccgttcagctcgtactcgtactgactgatctcgccgttctgctctaagcactccggcggttcccatccgaatgccaatttggtatcccatcgtccctccactcgcaatttgttcggtgcgccgctcggcggctgatccgccgtttggaagcgttggactgcctttttgggcgcgacacggcggtcaacgccgggcggttgtcggagagtgacggtcacttcgtattccgacccgggatgcaaattgtcgagaaggaccttcaacggcattggcccattaaaaagtgcccaattggctgcccaatcgatcggtcacctgtttgtcctgaacattttccatgatcaccggctccgtgtccgctttggacagcttccgacaactgcccagcctggtcagccgatactgcaagtccacgccccatggccaatcctcgtaatccgccggcaaatcccagaaggcgtccgcctgcgtggggtcatctcgcggcgtcactttcaagaagatttcggttggcgacgagcgcgtgagcagaaccgcgcgcggactccacttggagcgctgaggctcctcgcccggctcaacgctttgcgtgagcattttggcctcccatcgcgtgcctggcacggaatcgaacaaagcctaaacggacggactcaaacggaccaatgagtagacgagaacatagttttgctgatagaaagaattaagctgatcgaagggtggaagcactcgagattaaactcatccgccctcaatttgctttgtcggttctctgatcatctttgatcagtttaccccttcccccaggggtggtcccaattttgtcttgcgatttgcgtgcctcgcgtggtccgtcgacggcgaatgtttgcgttcgcggtgcccccgttccgttcgagtagtgaagcaccaactctacggagtcgcatttccacgtcaattcgtccggaggctcccaactgacgcgcacttgttgaaagtcgaccggctcaatgtgcacattgcccggaggctcttcaggctcttaatgaccataattaggtacccaaatttggcacattttgccgggagtatcgtccaaaatggcattgaaattttaggacccgtgtgtcgtcacaatgtgtcgactgtcctcctctacccgaacccaactgacttccgcatttggtcatcgccttcagctcgggccctggccctccccgcttgtcccctttgccgaccacctgaacaatttgcaaatgccaacggcacttttatttccaccaccgcataccctcaggcggaagaagtattccgtggactcggtcaatcctttgacatgcgctcggtagtcaggctgccgcgcccggtgccgtaccacgccgttccattccttccagtcggtgtccgtctccgacttgtactccaacgcgtacccggtgatgtgctcggccaggttttcctccaacccgcgccatctgacgccaatgctcgttgacttggcaaattccaactccagcggatgttccagcaccggaatgtctgaagggacgcgtctgtcattgcgtcgccgcttcctggctcaccttgctccgtcgtcttggtcacaagtggctccgaccaatccgaccaatcgccgcgttcggtgtgtgccgccgcctgaatctcatactcctgctccggctccaatccgctgattcggtagcagaggcggccacgcattcgcgagtcggaacactccaactcaaaggcgggcactcgctgctctcggtagttgaacttgccgtgcacagtccaccggatacggtattggtcgagaatgccgttgggcggatacggcggcagaaaagaaatttccaaggcgtgggccaattgttgctcctctcgcaaatcggtaggaggcggaggggctgaagaagaatgaaaagtcgaatatgaaaagaaaatgatcgacagaagtaatcaactgaccggccgggagggttcggaaccgaacgtactcagagaagggtccctcgccccggctgtttttgccgcgcacgcgtgctcggtactcagtccacggggtcagtccgtccagagacacctgacaaatgagaattggtgggacaattacgagtaattaataagccattcctgctgctgatggactcactcggtgtgtgctcgactgtcccgaagtattctgtccctctccccccaaatcgtccaattcgtagtcgtagccgaggatgcgcccgtggcgaagttcacagtcaatttcattccacagcaattccgcccgcgtggcggtaatcgaagagacgcgcacatttcgcggctgtccactcggagctgaagggagaaacggagggaaagatttgaacaatcaaattgaaaactgtgccaggtttcttatgctaatctttcaagagtccccactgagtcactgatcacccattcactttccttttattccctgatcacttcccttattttctcatcagtttcccaattccctaatcacttcatacatttttaggggggggtacatttttaggggggggggttccaccttgcacggaaatgttgtacatagcattctgaaatacaacggaattttggtttggaatttttgacagaccgttggtctgtcaacaaactggtactgactgacctggttgcaattcagtgaaatcaattgaattgcccaccaccatcactgtttaattt

SEQ ID NO: 340 - DNA, 7156 bp, Heterodera glycines
  misc_feature (15)..(15): n is a, c, g, or t
  misc_feature (6602)..(6602): n is a, c, g, or t
  genomic virtual cDNA Sequence=SeqID_764; coordinates=3146..3032 ,2949..2692,2644..2571,2531..2342,2247..1967,1868..1658,1553..1492
  coding sequence=SeqID_994; coordinates=3146..3032,2949..2692 ,2644..2571,2531..2342,2247..1967,1868..1658,1553..1492
  peptide sequence=SeqID_1259
tgcaggtcgatatantttctttaaattatgttgtttgagtctctccccattattacgccatctgtgacctcgttacaaattgacggaagcactcgctcctcccaattggtgccgagcatccggcagatcgtctgcagctgccccgggtccggtcgggacagcacacgaagcccgatgttaaccatttgcaaatccttgctgccggtcggcgaccgaatttggttgggacgtgcacgaatgtcgtagacaatcggatattggaaccatggaatgcgaaagtgcagtccttcccggtacacctcgtcgccgagcccaccgattcggttgaacattatcgcacgatggccagcctcaactgaaacacacaattatacttgtgtaataaatttatgagaagcattaggagccattgtctgcgcaaaaactcactcgtatacatcgacttgtacagcgcataaccggccaccgcagctgcagtcatcaagccagcgccgactccggcacctttgctcggtttggcaaacttgttgaagaaatccttcgggtctatagaagccatcggcaaaattgtaagcaattaattgacaagcgttataaaaaaaattaataggaaaaagaatgaatgcatattgaaaataatgaacgattaaaacgaatggataattaaagaaaatgcaaacgcaaaaattttcagcaaacaaacaaatcgagaaagtctcaaacaaaaatggttgtgctggtaacgataacaaagaaacaaaaaaaatctcctttaatcgccacgggtccgccccaatcgaccatccatcggtcactgtgtcatttatcatccgtcactctttggtcagttaatcctccctcctctgatacgcctccacttccagttcagtcaattctccgccaccggcatttgccctctcttcttttgctgctgttttcgtctctcccttttccctctttttgtcctcctcgtcatcttcgctctcccaaagttcaaacagttttgcacattctatcgccgtgcgttcatccaatcgttgagcgtcgcggattaatgtacgagcccattcttcacccattcccaaaatgttgtacagcagcacgccaactacaacatttgttgttggttcggtgtagaacacaacagcacggagctgaaattcaaataacaaatggaaattattgtctcaatctactctgatggatttatagtccaaaagtggaatttgaagagggaaggaaatacaaagattctatggtagcacaaaatttaaaactaaaattatacgggtagccaaatgccaaatgtgagtcagtgccgaattcaaagttccgtaaaaaattacagcaaataaaaaaaagaatgaaaggaaggtgccggctaaaaaagggcaattcaaaccatagattcattcacctcatcctcagcatcttccgcaacttcttcatctcgttttgcaaatattgttgtcgtgcttaaactatgcggatttacgtcgccaactccacagacatgagcatatgggccgaacattgagacgaacgctcccttaccattcgaggaaaaatgaaaaagtacgatagtgggatgggttaatcaatttgtggacatcggttccaaaaagcccaactgaccacaatccggttgtgtctctattaccaaaagtatcaatcacctgatgggtgtacgttttgtgtccatccgtcatattttctccggcaatccgtcccgtgatttgtgcgtgttgccaatgggtacagcgacgtcgcctttttagaactgggtctacgaaagaacagacatcgccagcggcccacacattgtcacagacacgcaaatgctcatcagtcataacgccaccgttcgcctgacaaagaacgagcaaattaaaaatgaatttgatgcaccaattgtccctcccttccaacaaaattgcaatcaattagtgaatttactacggatcactttgtccagtttaatgctgctcttttcgtccaccaattcgatgttcggttcggcgcccaacgcaatgattacaaagtcggccataacttgcttcctttccttcggaccgtcgcttgtcgttgctgcagttgtgttgagacaaattcggcgccttttctcatcccttcccttaaccgatgccgaatcaatgcgagtgtccgtcagcacttcaattccttggtatcttagcatatccgttgaataatcgctcagagcatcgggcagaatttcggataaaattcctgaaaaagcataaaaatgaatcaaagaaagtataaatttagacccaattaaactccaatgccctccgtgaattacaccgattctcttccccaccgggttcttggcacagctgcacaattttcagcgcagggttttcctggtcacgagcgtaccgtcggttcagcgagtaggccaattccgtgcccaaaagaccgcctcccaaaacaacaataacattttgtgtgccgttttcagcgacagccattttgtcaactttggaataaattttccgaaagtcggaagccttaaattcgattttgttaatttcttctcactaatcaacctttccaagtgttgtgacaaagtcatccagttcaggaaggtgttcaagctgtgtgtgcaaccacgcgtcactccctgagcattaatttggcacaatttgccaacagtttgcgtgccctcacctgtcgcgataaggcatttgccgaattcgatcttccgtccatcttccaacagcacaaagcttccctcggtgtccaccttgacgacctttgcgccacgtattagcccaactccgccatgttcccactcatcaagcttgtccggtggcaggtaaaagccgtccgcctcgtaaaaagcgtaacgcctccgtccggtgctactcgtcggatttgtgtgggacagcgagtcaatgctcgcctcatcggcaaaccaccaaagctcttgaaatttagtgttgaaaaggttattccgaagctaattgtcccttcccaccctttcattccctgcggtgtttccccatacctttggacaatggtcctcttttgtacggtgtttcatgctcgtccgttatgatcaaaactcttgcgtccgggtccctcgcacggattgacaacgacgcgtaataactcgcagtgccaaaaatattttttcataattcgaactaatagattttataaattgtcgccaccctcccaccaatatcgtggtgaacatgcttttagcttgttgccacccctcaccctaaatttgtaccatttgaggctttttatttctcgattttagggtcaatatatccagaatcaaattaataccctatattctactaaatttttatgaggcacgaaattggcaataaccatgacttaccaccaccaatgaggacgtatgggacgacacttctcaacacattattcctcaggcgtgggaaattaattgaagcaatgaaagcacgtctcataaaattcatttgtgcaaaacggaacaaagtctggaatttcaaaattattataccatgttaaaagagtgaaatactacaaagaatttcaacaattaattcagtcgtaacggcgatttattcgaaaaatttatcctttaaaaagcttttgttctccaacttatcctatcaaaatcaacaatatcggaatcatcgtcatcagacatttccacagggtcaaagttcggcttttgctcaaatttggttgccaccgactcgacaatgttttcctttttcttctcgagttcgttgaccattttccaccgttcgatttgttcgtcaatcatttcgatgtccgaacggagtgccgactgttcattctaaaatgactaatcattaaaaaagcaattaaatttaaacggaccaattcctcgtgttcatcttctcgctgaacctccaattcttcgacctctttgtaaaatcggtcaatttcactggtaattttcttttgtttttcaatggtttcacggacctaaagcaaatgataataagaaatcataagagtatattctactgactctgctgttcatttgttcgtcgtcaaaaaatccttttggcactccttcgataacatttgctccggcattcttttcaatctcctccctttcgctgttctgaacatccgcttgccatggcacttttgtctgtccaccgatcactgcttcgtcttcagctaaacaacaaatttgaattggacctatccttgaattcttatttcatattttatagcctttcccatcaaaatacttcgttttattttcttttcactcctcccataatccgcaacatcaaattctgtcggttgtttgcgctttaagtccgtttcggcaccgtttctgctgttgatggcatttacttcgcttgttgtttcctttgcctttttcagcgaattgtctttgtccttcaattttgacaatacttctctgtgcttccgtccatttatgtgtgccgtaagtgtctgaatgaaatttgaaatatatttgtccaaggaagtgccaaatagtcaatcgtctttcccctcccttaatctacaaataaagttgctgggatggattagttatttcataaattgctagaactctaggaaatgatttcaccttagttttaaattgcattgaacaaagttgacaaaaagaattcccattctttaaatctttgacgcatgatgatgatccggaagacattaccaaaataaaatacctacttttggtttttattaatgattagaattgtccggaaatgtatacgaatcagacaaataacatcatcacaaaaataaacaaataaattttaattttaaaatgtgaagacgatatctttaactagagcccggattttgcgggatcccagtccgcaatcattacgggattatacgtcccgcaaaattttgaagttccaattccgcagcggcgggacccgcaaatttgatttttggtgcgggatcacgcgggatcagcactatgggtcaactccactgtgcagatgctcatattcacaatgccaaggttaaaaatccgcatatccctagctgtagctatggtagctgcagatcgattaatctacagctcaaaacccgtattccgaactctgaatacgactggggatagttcgatccccagctacctatccaaaagatacggataagccgctacttttccctttgttagtgtattctttgtctagtgggtagtttgttagttttctaacaatatctatgcacctctaagaattgaaaaattttctcaaaaatgaattccctaaaatacatttttttcagataaacttttgtttaaaattttcggcgcccccacaaagtgtccaagccacgaattgtccaagccacgttttgtccaagccacgaattgtccaagccacgaattgtccaaaagagtaaaaacccacgaattgtccaaaagtctaaaaaactcatagaaagccggagaatgggtctattttagggttttcggggtcgctgaataccaatacgacatttatatagccccttgcctaaccctagacccaaatataaagattaaatagcaaaaaaatattcaaagctcttacaaagggtgctgatcaaaattcgtacaagtttagggctcctatgtgatccgaattccctctatagacccaccctcagcttcacacattgaaaaaataattttattaaacattcaataaaattcattacgggacatggacaactgaatcatcaaaattttcaaatccttcaattttcctgcatatccctcaatttgagagtgccggcggaattggaaaatgtggtgcccgaacgatttcgtcctcccatgctgtaaatgaatctttttattgagtttaaacggtttaattgattaaagaattctgcctgaaggcgctgtcgaagtcgatagcgaactcaacaaatattgaacaagctgctcacgtggactcacagtggttggccatgtaagagttgatggtgccggtgagccggtgccgaactctaggggtagccgcatagcttgttccgagttgatagtcaaaattattgtcccgagtgtagctaaaaattttaatttttggaaataaatgcataaatctaacaaacaatggttgccggtgggtgaaaattgagtggattatctcaaaatgcgttaacaccatccaacatctggcgctgtgtcaagccgatatatgttcgagagaagtaaaggaagaacattggcattccaggagaagacggccaagataattgagaaaaactcgatttgtgcatcttcagcgatttcctgagtggtgtgtgaatctaaatcctgaatagtttggaaataaattttttgcggtgcttcaaacatacctttcaaccatagacaatctcacccaaaattgatttttccgcgctcaaaggtcattgttgaaagttcagcctcgttcaaattcggttgttcaacgctgtcagaaattctcacggcattcggttcgacgaatttcactcccaaattcacgtcctcctcagttgtgtttgaaatgtctgacaaataacgcttcttccgactttcttgtagactttcaagtttattacgaatcattttgttcgatcattgaataacaaaatcntgaagacaaacaacagcatatattttaaccgagtttttagatttttcttattcgggtgggtctagggttaggcaaggggctatataaatgtcgtattggtattcagcgaccccgaaaaccttaaaatagacccattctccgcctttttatgagttttttagacttttggacaattcgtgggtttttactcttttggacaattcgtggcttggacaaaacgtggcttggacaattcgtggcttggacaattcgtggcttggacaattcgtggcttggacaatttgtgggggcgccgaaaaatgagttaggtaactttaattaaatttattatttaatttatttaaaattatttggcattctatcttagaaaaattttcaaaaaaatcaataaaatcccgcataattccgcacaaaaaatcaaatttgcggatcccgctgcgggattggaactcaaaattctttgcgggacgggatcccgcgggattaataccgaaaatcccgcattttccaaaaaatgcgggattgcggactgggatcccgcaaaatcccgcgcg

SEQ ID NO: 341 - DNA, 3608 bp, Heterodera glycines
  genomic virtual cDNA Sequence=SeqID_640; coordinates=2106..2044 ,1771..1523,1102..886,405..284
  coding sequence=SeqID_919; coordinates=2106..2044,1771..1523 ,1102..886,405..284
  peptide sequence=SeqID_1145
tgaaaagttgaaaatttgagaaaggaaaacatttttatacgcttttccacattaaccaaatgcaaaaatattttcaaattcaaaatttacccccccgctaaaaatgttttgcgtataaaaagttgttgcaattttcaattaaataattaaaatatatttttgagggtcaatcagtgatttttctttttccttttacgtctgtgcgtgtcgcgcccgccctcctccagcagcgcactctctctctctctccctcggtcggtcagtcattgcgccaccgctcgtctcacttggaacagcacgtgccgcgccgctgctgtgccgccgcctccgccgcggagatgtccacgccgctgcgtccgtggcccgacggaccgccgccgccctccgtctttggcagttttttggctgaaaggggacaaaattgaaaaaaaataaaaaaatgaatttaaatttgaaaatgctgaaacttttatttttctatatgatcgacagatgatgattaaactaaatcagaacgaactgtcaagttcagaatatttcagtgctaattttgcttattgacaactcgtgatggcaaattatttgtatataaccacattcatgttgtaaaaaatctttattgaaaatgggctttttttattcttttaacaatttctcaaaaattttcccgtcggcgcctagcggttcttgttgccggaacagtattggaaatgatcaatttgaaatggcattcaaacttcaataaataagcatcgaaacggagaaatcgaaatggggtgctgtcgattgaaaaacaaagtctgggattttagtttgacatttaatgataaatttcgggtgggatagggaagacgaaaagcactgaaacaaaaaaaaacaacggaccaatggcaaggaaaatgtcgttgacattcatcgacgacttggcactggtctccatgaacaacagtccgttgtcctccgcatacgcttgtgcctcctcgtactccaccatgcgtttggcggccaagtccgccttgttgccggccaacgcaatcacaatgttcgggctggcctgccgctgcaactcgcgcacccaattcctcgccttcgcaaacgattcctgacgaaggaagggacagagagcgttttatggaagcaaaaaaaaaggaaattaatttataaaaaaatataaacatatttatagagcataatatgaattcaggcctggatcctgtccagaaaatcaaggtccaatatgggataaaatccaggttcagatgcaagtacggcacgaaaaaactggcttttctctacattttgtatgtcggttaaatgacgaataaggtccaagtaattaatagacgtaaccgtaacgaaattcactgagaaaggtcttttttgggtagtagtgaaatatgggccacaaatccatgcctattaatttttatgatcactaaccaactgaaatttgggaccgcaaatgttagatttggacgggtttttgcaagagcccaagtccaccactgggtttaaaacaagcctggttggtgatgtcgtagacgacgatggccgcctgggccccgcggtagtacatcggtgccaacgagtggtagcgctcttggcccgcggtgtcccaaatttcgaatttgaccgtcgcgtcgtccaggcaaattgtttgggtgagaaaggcggcgccgatggtggattcttggtactcgtggaactgacccttgacgaaccgcaacaccagcgacgatttgccaaccgcactttcgcccagcagaaccaacttgagggggaaaacagtcaaaatttgaaaataggcgggggaggggaaatatttacaatttgaaacgaaaatcattatagaaatattatagcgcattacagaattattttatggtcctgaactgcaataaaaccccctgctcttcatcttaatttagtagcgcaaattcaatggaaaatcccaaaattttgggggtgacaaaatatacaattaatgccaatatttataagcattcaaaatgggtcaacaaatggattaaaaatgttttaaaccttgaattgacaagttttcgtgggcgctcctccgttccccgggcgtgtgcgctgcgcagacattttcagtcaaaatgaaaaattgcttagaaaaataagaaataaattatttgctaaacaattttaaatgatgcaaaagaaaaaatggaaaatatgcgcagaggaaacaccaaaaataaataaatagaaaacgctccttaagaccagattttttgtaaaatctgattgtccaaaattcattcagcttcaaatttcttcaacaatattttttctcaatgagaaaaaatggaatttattggccataaaatccgggccctattcataattaggtaattaatttttaatttaatcgaataaaaatgcaaaacttccgactgcagaacagagagcccccaacagaaattgaatacataatgtgataaggggaagaaaggaatctaatcgaacttttcaaataaacaattgaaaaaagagatgagagaaaaaaagggaggaaatgtgcggtgaaatgaattgaatgacaacagcggaagagaagagagggacgcgcgacacaaagggaagaggcgaacggaagacatttctaatacatagcgcagcagaagagattcatcggattgttcgaattgcactccgacagttcgaacacggtgattttgcttcccaagaaaattgaaatggagtgaaaactcgaaacgaaaaaccaacttttaccatcttatttttaatcctcggcttaactttgcacaagttacgcccctctctaacaaagcatttgcttacattaaactcttcgttcaaataagttcgtctttctttgttaaatgataagcatgaagaaaaggataatgataatttcgttctacgaatttttttcggaaacatttccggtttctaaaatttttattttcttttcattttcaaacttatttttatgtatgttttcgcgcaactctactggggatggacggccaaaaatcgctgcttttatacacttttttacattgcatttgcctacatttacagaagagtgactgctgcaaaaaattctgtcttttacagaccgagttgatttgtgtttaaatatgccaaaattcagcaacaccttcattttctcatttttttgtctccaacttctcgactattctctttgcaattgctacgctccaacccaactctccattcatttaaagccttgttttcaagtgacatttgctcctttgacttttgcgtctcgaacatttgcgcccaaaacaattacgcttaattgttttcggctccaatgttcggactcaaatgtccgagttgctaatgtacgcacactcactgttctcgccatcactcatcacggctttttttttcttctcccactctcagttttcccttcccgtgtgccgacaaaagaccaacccgacaaaagaccaactaacacaaaaatgacaaaagaccaactcacccaaaaacgacaaaacaccaaccgacaaaagaccaactcgacaaaagaccaactatgctaaaaaacgacaaaacaccaacgccaataaaaaacgacaaaaaaccaaccc

SEQ ID NO: 342 - DNA, 4842 bp, Heterodera glycines
  misc_feature (109)..(109): n is a, c, g, or t
  genomic virtual cDNA Sequence=SeqID_645; coordinates=2679..2564 ,2499..2409,2323..2081,2007..1769,1724..1566,1514..1400,1199..1081 ,1027..899,725..657,613..490,444..227,29..1
  coding sequence=SeqID_846; coordinates=2659..2564,2499..2409 ,2323..2081,2007..1769,1724..1566,1514..1400,1199..1081,1027..899 ,725..657,613..490,444..227,29..1
  peptide sequence=SeqID_1237
cgcacgtttgacacctgatcatggcaaagctaaaagagacgcaaaggtaatatataaaagtaatgccaaaaataatgttcgaaagtaaactaataaataaataaatttnacagaatggtgggtttcaagttttttggattcatcaaaaattgcatactagtggaaaggaaccccctcctttattcaattgtaatttcgtttccatctataaatgttttgaagataccgcttttatcgttgggaaaagttccttcataattgcgtcgttgttcaatgcttcacacaaagtgttgaaacagaagagacaagtcatccgacgcagatagttgctgtcagaagcaagttcaatcacacggggcaaaaccatagtgacggcccattcggcaccgaatttctgcgctaattccttcaaaatgtttgtggcagcctcgcgaatggcataaacttaacaatactacaaaaatgatttaaaaaaaatatataacccaccgtgatccgtcaaccaattcatgcacagtttaagcaatttctcgtcaaaaaatttctggccaagttgtttggcaagcaacggcatgtattccacgatggccaagcgaactcgccactttccatcctaaaaacgaacaaacaaatggaaaagacattcaattgagtacttgtgctaagtcgatgatggcgggcaaaagtgagtattggagctcatctgcaccaataacatcgctgacctgaataaaataaacattaattgtcgaaaaaagaacatttcaaaagaaaaaagatcacagcaagttattggaggtagttagggttcttatgaattttcattcttttacccatattactgtataatgaagttttataatccgaaagttataataaaaacacttcggagacttaccttttccaatgaagaaatgatgttcaagcgaacttcgggtgtatcatcacgaagcattgacaaaaaaataggcaacaaatgctcaatggtgcattggttgccgagcagaggcgccaatcccatcacaaccttaatatagtagatttactttactgaattaaaacctatttagttaaacaaacctgagccaacgcaattttgacatgctgattcgcgtcagttgttagtggtcgaatcactggcaaaatttcttcaatgattcccttttttcggccttcctccgacagagcagcacagaatgctaaatgaaactttggttcatttttataagatccgccaagaaaagggcataggtttatggtaagccacgttgtcagagagacttttaaaatcaaaagtcatgcaaaaattgtcaatagattcgcagtttcggtgaccaaagcgttattggaagagaatgaggtccgagttaaagctgttaaaatattatcctataaatacattgtagtttctctgccgctgcatcgcgtacttcgccctcgcagtccttcaaaagtccggtgtaccatccgacaatttcttcaatgccaattttggtaccgaatgcttgctgaatctgtaattaaggtacttactatctttggttgtatacttgtgaatgtgttacttgaacaattttatcagctgccatataacgaacacgccaggatttgtcctgcaccaacgaaacagcgatcggtttcacttgggccaattttgccgagtcttcggacaacagaccaacgatcacaatgccagcctcaactgaaagcagtcgaacagagtcctaaatagagaaactaattagacaaaatttcatcaattcttcacttgttcgtccttggccaagtcctcaaacatttgggtgatttcatttttcaaatagtcctcctcctgcactttggcaaagtcgcccaatttggatgcggcagcacggcgaaccatcggtgtatcgtcgcgacagaggcaccggaatgcggcacgtaattcagttttttgagcaggattggcacgagcgtatgccacgctgaacaatccgcaagcggaggtgcgcgaagtaaaccaatcacctgaacggagaaacaaacgcagtcagtggaggaactaattaagacaaatgtgaacaaaatgcaaattactgaccagctgacaatcgcagaaccatcggaatgaaatattcctcgagttgagctgcactgtgtttttctgctattttttgcaacgattccaccgctttgtcacgcacgacagtctcctcaatgttcgccaaattttcaagtggcggcagcaaacagtgcacatactcaggtccgccaaccaacggagtgaaattccccaattgttcggccaatgccaatagaacttcatcctcgtcataaatggtgtctgaatttgtaataaatgtagaaaatttatttatgcaatatatttttatgtaattaggtaatcggattattagtattaaaataacctgtaaggaattgaatcaattctttgcgcgttcgttcaacgcccaatgccaaagcaatcgtcgacaatttacggattgagttgagacgaagcttaaaattgatcaattacaattcctgaatggttacagcgaacattcatatcaaaagaacgaacctgaacatcttcgttacgaagctcatcaataagcacagcgatagggtacaaactgtcctcaccctcttctgtcgcaataggcgctgtcgtagtcattttagccaaaatcagaaaagtatttagctaccttcgtttgtttttaaatgaaattatacaataatgaagcattgtggggttaaatgcttcaatctttttcggttttagacgtcctatgggcttttatgtgtttcttacttggtcaatgcttagattcctggtatcaatcaaaaacttaaaaattagtcaattctaggctagaatttctcgtataactgaattctaggctagaatttctaggcttaattaagctaaaagcagcagacaaaaaattacttttgaatgtattcgaattttcgattattttcacaccgagtcaaaaacgagagacgaaccaataaatagagagtgcggagaaaaaaacatctctcttatttttttatctctgataattgtgaaaattaattcacttcactctaagagattattatgaaaatttaagttacaaaaaatgcagacattggccggcttttcccgcggccgcggtaatcacgctaccgccgggctattattatacattcgcatttttattttttatctttttttaatgcaatttttttacaaataggtaaataaggagaagcaactttgattaatccaatggaaaagagattgaatccatctgcacttcctacgcttatgttatcgaatttcggtggttattcggtggagacactttgcacgcttgggaaggagttcgtattggaacttatgactcggatgattaggtaagtcgtcacttacagtttaatagctaaatttatttttcatactcttattgaatttggaattcggtcccacccttggagaaagattaccgataaccaagcaattaattttaaatcttttcagcattgtgagcactttaaaaatggatattaaaggagacaataaaaaagtaaattttaattttgatttaaaattcatttgcctttcaaggatctagacattgttcgaattcaacttgattattctcgtctcatttttctctgtcttactgaggttttctcattttgtacactgatatttctacattgaaaatcgtttttattaggtccgtcttcgcatcgatttaaaacttgctgagggaattggagagaatcagaatttgaaagatgttcgtccttctgatgaacggctgttggagctcctttcagagccgaatcaaccggaagaaaatgcgaaaaaggcaaatttggcagagagattcgaacaaaacagaaaggagttaattcgattgaattgtcatttaaaaaaattggattggttgtcagttaatgcggagaatggagataaataattctgcgactttttgacttaatcttttgttgtttttgtaaatacactaacttattccttactatttgtctttttatatattatttgattaatttagtgtcacattttatggcgttaaataattgttttactgagaatagatatccaaatgaatgcattctttcctatggctcgatcgctgtttcggatccggtatgttctggcatttactatgctcaatctcaccctccgactaagcgattgaggattttgcttggataacaatcccccggttcatttccggtttgactttttcattcggctttagctcgatgcgttcgtttgttgtcgtttttccatccatgaacaccaggagaacatctgcgcatttggcacagaatatggcagagtagtgatttgcgatgtgacagctccgattaagggcgaggattttatcaaacatcgtgagttacttctattagtctacgacggttgaaagaaattcatcaaaattcgaaaaatttggatgcttgtaaaaagttatgattaaagttcgtgtaaactacaatataatagataaacttttgctttttttcgcacaggatttgccactggaaaaaatgctgtgttcgacttatgtttcattcctgatcgccctaatttattactttctctttgtggtgcctcaaacctagagcttttggacatcgaacggtcgtcgtccatttttttgcttggtcatcgtgacacggtccgatgtgcttccgtgtggcctgaaaatccctgtattctttgtttgttttttcctgtccaacctcttcaaatttcagtttgcgttttgactggttcaagggacggtgacattttgctttgggatttgcgtgaaaaaccatgaaaagagaaat

SEQ ID NO: 343 - DNA, 4828 bp, Heterodera glycines
  genomic virtual cDNA Sequence=SeqID_646; coordinates=2979..2923 ,2872..2782,2741..2530,2477..2279,2208..2003,1927..1749,1706..1571 ,1523..1380,1250..1095,1049..864,805..618
  coding sequence=SeqID_829; coordinates=2979..2923,2872..2782 ,2741..2530,2477..2279,2208..2003,1927..1749,1706..1571,1523..1380 ,1250..1095,1049..864,805..719
  peptide sequence=SeqID_1069
ttggtgcttggggatgacggaaggtcaattggactcctcccgggggtcttttcttttgtcctttttgagtgtacgacggaggtcaaaaggcgtgaacgaatacagatacaaattcatccgacaaataattattcggacttatttgttagggaaaagggcaaaataaaattgaacaatcggaggaacggcaaaagcaaatcagccaaaagggagtaaatcagcggataaattaatcaacctcaaccgaacaggaaaacatgaattaataaagaaatgaaaatgagaggaaacaacagccaaaaattgattatattaaattgtcattgcctttttaaacgctttttcaaaaaaaaaaaataataatttaaatattaaaggaacgaagctcccttggcaaatgtctctgctccctcttttctcaccattcttcacccaatggcatataaatttcccaacccaaacatctgtaggacctctgccgttgtaaattggtcataaaaaccattgacggattagttggttttattagaatttggcgacttggacttttaaaaatcagttgttttgtaagtagaagagatttttttatgaaattgggcaagaaattaactgaatgcattactgaaagtgtatttacgtattaaaattaacaaaaatgaagcagcaacaatactttcttaaagcaaaaactcggcaatgagttctgtgactgtgctgattaagccatcccagtgtcatcgtcgtcgtcgtcctgccctttgggtgcccttggctttatgccgcccatcggtttggccatgattatctaaatagaatgaatggccattaattgacaaagcgatgctcccgcaaatgtttgtcacctgatcaatcttcagcacagaaatggccgcgttcgtcgccaattttaatgccaacgatttcccggagtaaaggtcgaaaatgcccgcttccatcgcgttgcacaactttccactgaccgcgtccactccctcccatttcgaccccttttggtgcgctgcgtgtaaatcggtgagtgtttcagttggctaaaattccttttaaacgatttgtcacttttaaaaaatgttcaccttaagccctgcattttcggccaattgttttggcaaaatgtccaaagcagtagcgtattttttgatcgcatattgtcgaagtcccgattccttctcgccaataatttcaatttggtggcttaattccacttcagttgcaccagcacccggcaacagctgaacaaacaaatgataatgtttcattcgagccatcaaataaagataaatcgaatatttaaatccatttacaaatatagaatgaagacccccccccccctctcgattaattaggcggaattggctcactttgttgtctcgagtcagcgctttgtaagtgttcaccgcgtcgtcgattgccctctcaatgtcatccaccaacgactgggaagacccacggacaacaattgtggcaactttcccaacttcgcttttcttatcgaaaaccacaacctataaatttgttatggtctcctcgaactttttgcccatctttccacctgagtgtcgccaatttccttaagaaacacttcgtcacaatggccaattgcttcttctgacggtgcacaaatgcgcgcctgcgcctgggcacccaaagttcggcaaagtcttcgcaaatcgaatttcgaagtcaatcttaaatcattgaatggcttccgaaaacttctatcgtcacaccttacggccataattccatatttgttcaaaaaatgcacgtaaaggtctccaaatttgccggcagcgaccacaacattaacgccgacatccgaaagacttttcacttgggcttccacttcggactcctctgtcctgctgaattgcaacaaatcatccgccgtgttcatcaaaatagtcccctaaaaggaatccgatgcttttaattaaatgcaaaataatttgtttttttttttcatttttgcccaaaagcgaacctttgtttcggtttgcgtaaggtcaaatggacacgcgaaaacgaccacacgcgcatttgacgcgcctttaacttcgccttcagcaccacggcgaaaaagcattccatttgtcacgtacgaactggccactccggcgccaagaattttgcagattcgaatgttatcgacattgaacgcagtggtattgttttttggcattatttgaactaaaacaacgagaaatggagatagaaaaattgtaatactttaaagtttattaaataagtattaatttaccacaagctttcgcaacaagatcagaaattaactcgtaatggtccgtttgttttgagataagcgacgatttgagataggatcgaactttgacaatgtcatataaatcctcagcagtggaaacaaccaatcccggcaagagctcctcgactttttgaagcgcgaattcgtaacccgacgcaatttctactgcggtgattccctgaaagcgatacaacttaaattgtttaattaatcagcagaaaataacaaaccatgtcaagcaattgcagtgcgtgctccagaaacgatgcagccaaaatgaccacagtgttagtgttgtcgccaatttgcttttcctgcatttgtgcagccatcaccaaaattcgggctgccggatgctgcacttcgagttcattgagaatcgaaacggcgtcgttggtgacgaaaagtttctccaaacgattgatcaccattttgttcatcccttagagagtcaattaaaacttttaaatgaatttaaataccatttggtccataagcagaacgcgtctgaagtgcaagttgcatgcaagcttcaatatttcttttcactgcttcttccaaccctttgaagtgctaggaataaacacgcctcatagttttgttagaaaatcaaaataacaaaccatggccccctccttcataaagcgggaataccctgactttggaattgaaagcgccatattcctcaataacaatacgaagcaaaaagttttatcctgaacaagcaaaaattagagaccggaatttccaaaaatgccgggccgggccgggctgatttttccagaatcaaccgggttccgggcccgcctctcaaaacccggtcaacccggttagcccggtcaacccgggtttccccaaaaatcgccgggccgggttgccgggcccgggaaaacccggtaccgggcccggcccggtccggtctctagcaaaaattatgatttattgaaacagaaaaaaacttcctttcaaatttaaacaagcaagcggagaatttcaacttgaaatgtacatgggcaaaaacgaaaagcctatttaaatttattttgctggtgatatgtctgtctagctcttctttaacttatttgttagagttaaagcaaaaagagagacaagaaaaagagatgaacgatggatggacggacggatgacttgagaaggagtccgccgaggtgacttaagctcaaacgaagcattggaggaacgagcaatggacggagaaaggaagcgaagagcaaaggcaaagcagcggttgtagggaaaatatgttttaactgggctatgctatgccttcctttctgtttattgaaggtacataaggaagggaaatgttgtgttaagaaacggaaagaggattacggggtgatggcgagggccgggcccctgggggaggggcgattggatattgtgggtgaagaggaagacccaattttctatttacctactttccttgctgttgcccacattctcacaaatataatttgcccttgagataaattttcccattgcctgtgcctgtcaatttgccttttgccatacataaatattattgactttcaattttaggttttcactttttcaatttttatcaattacaaagttggaagtgaatatgcctaaacaaaagcctaaaaatgatatcaacgaactcaagcaggaagtgtccatggatgagcataaaattccacttgaggaattgtttcgacgatttggaagctccaaggataaggtaactttaaatgacctagtcttttcaattgttactatttcattcaaatggttactgttgcttatgccagggattgaccaaagcgaaggcgaaggaggtgtacgaccgcgatggtcccaatgcgctttctcccccacgaacaaccccagaatggatcaaattctgcaaaaatttgtttggcggctttgctcttctgctttggattggtgctatcctctgttacattgcgtattctgtcgattgctttaccatggaacgaccaagcaaggacaatgtgagttcatgtccaatttagttttaaccaatacatttccagctttatctgggcattgtgctgatgtctgttgttatcatcactggctgcttccaatattttcaagagcgcaaaagttcgaagattatggaatcattcaaaaatttggtgcccacttacgcattggtcattcgtgatggggagaagacgcaaattccgtcgagtatgttggtggcaggcgacgtcgtggaagtgaagggaggcgaccgcgtgccagcggacattcgaattgtgtcggggcacggcttcaaagtggagtgagtgctgtgtttgtctaattgctaatggttttggtgcttttcacttgaagcaattcttcactgaccggagagtctgagcctcaatcgcgttcggcagagtgcacaaatgagaacccactcgagaccaaaaacattgcatttttctcgactaatgctgttgagggaaccgcgaccggagtggtcatttacactggggacagaacggtaaggcaacttgggaagtattgata

SEQ ID NO: 344 - DNA, 7183 bp, Heterodera glycines
  misc_feature (3058)..(3058): n is a, c, g, or t
  genomic virtual cDNA Sequence=SeqID_647; coordinates=5075..4930 ,4886..4789,4508..4376,4312..4293,4240..4104,4039..3717
  coding sequence=SeqID_841; coordinates=5056..4930,4886..4789 ,4508..4376,4312..4293,4240..4104,4039..3796
  peptide sequence=SeqID_1080
aatgggacagtgccaaaaggtgggggagtgagaggccgaagtaccgtcgaaggtttgtctccgcatattcgaagagaaaagcggttgagaggggtcggaggtccacgaggagggcgaggagagtgccgatgcggcacagaaggcgaagcagccgttgtaagcggacagagcggggagaaggaagttctgcaatgggatttcccctcggtaggcaatgcgcggcaatgtcagtgggccctttgcccaccgtgttaaagccacgcgtgccgtaggcggacgccaatttttgttgttgctgctctcgctgggagtcgaatggcgacatcacaaccacactcccagcggcaatttgcattctgagcagcgaactctgctgactgtccgtgccattgatgcacgcctcgagttgcactgggcacacgagcagaaccatatacgactgtgagccgaggtcgtcaatttggagggaattcagcatggagccaaggcggacgaaagtgccgtcgatgaggaccactgaatgccaacactttctatagtgggcggtggtgatgctcgagagtgcgactcccgagtctccgctattgtcgttttttgtctcagtctcgagttcgatgcaaaattcatactttctctgcgttagtttacctttggtggcggaacggagtcgaagccgtgcctttgtccaactgtccacgctgttctggtcgacttcgacagtgtccgtcacattcagtctttgctggattccgttaaagcgttccgcaaatacttgtgacaaactcttccacaaaggcggcttttcaatgtccgtattgatcggaccgaccaaaacaatctgagcggaagaattcgattaaacaaatatggcctaaaacatttaacttcgctttggttcatcgcgccaatgaattgggccaccgcttgggccattccgtacacatttgtgtctgtgacttgtacgacagtggggaaaagctctcgacgaagtaaagcaatgctggtgccgacgcggttaattaccggcactaatgagttaaaatattttcaacaattagacagatggttttgcctcgccagaaacgggcaagtcggcccaactcgcgcgcctcctccgcacagcgactgcccacaaaagcttgcacattttggtagaaatacaactcgccaacgtggacagtgccaaaggaggcgcttttgttttggttttcactgatggacgaaaagtcggacaaagtgccacagccgcaagagacattcatcattctgtggggggggggggtgaacagtccgagggctgtcgttgtttctcctccgttggtttgccttcgcattgtttccccccccccccccctaattttttgccatttattttttcaatttttccaaatattcactcactgaatctcttccgtcgtgcattttccctgcgcgcgcgcgtcggtcaaagcctggagacagagggcgacgagcaaagggtcagattctacgaggccgactttgagcaaggacagaacataagggaggagaaggagaagttggagcagtaccacggaaaagggcatttggtgaggaaaaattcaacgggagaatggacaattggggggggggggggggcttgagcgcggaaaaggtaaaataagtcggaaaagtgggggggggggattacagcacaattcgcggttaattgccacgcagggggacggacgaaagggtgccaattagtgagctcatttgcgcaaaagccatctccacaatggcaaacaatgcttcatcaaagtttattttgcattggcttcattttttggttttaaatcactttttcactgattccattcacaaaatcattattttatttaactgcccttttctgttttattttttcccctttttcatttcgacatttttgccactttttcactcgttaatttcttttcgttgctaggcaaaaattgtgccattttcatttccatttatcgttgaatacaattgttcttttcaatgcgctttgcttctgattaatgcccgtgtttggactcgttttgttctcgtcgttaacaaaagtgcttttgccactttttccctgtttttctgtgtccgttgccgcttttcctctcatttttaaatcagtgacttcgtcccattgttcgttctgctgctgcttttggcaatgattggcctttgattcttccgatttccctcccaaaatgccattatcccctgtcctcattctcttccgcttccttccgcttttccttctcctcctccttcccccagccgttgttccgcttcagtgttttcaaactcagcattcgctttccgcttctctgcagggcaatgccctcagctgtccctcctcctccctctcttgcaccaaatccaccgatttcaacatgcaaatcatcgcgcgcacctgtcaaagcacaaattgcacggtgagaaactaaaaatacaaaaagaaataattaatttctttgcggttggccattgattgattaataattacgtttagttccccaacggcactctctcctccgtgccgttgtgcttcaattcgtcctcaaatacccagtcgtattgctgctgctacggcgacagttgcaacggaatggcgaaggaacacaaaaatggactaatgaccttcttattgttgttcttttgcattttaatgggagcgatggcaatgaaaaacaaaatttgaaggaaaaaggcaaatattaacagagataaaaatgataatagacaattcaaatcagtagggaaaagtaaaactgatcagaaagagaaatgtacatgatcaatcgatccaaactagaattgaatggtcactgatcaaaataaaaatcaccgataagtcttcaaatgaaaatgagctaaattagtaacgacagaaaaggaccgaaaaaagcaaattaattggtggtgccctaatattgtcgtgttatacttcaaccatatatcgggtgctttcatgctcttatctcattttggcactcaataacaagtaatggctctcaagtaataccagacatctcgcccccagcggatggcgaagtgngcgaaggtggaacactttcggaattggacatttgcagactttccaaaatatcattaaaaggaagcaaaagaaaatcaaaaaaataaattatagaagaataacagcagtgaaaggaatgaagaaaaacagtgtttatcattctgcaggcaacaaaatcaacaaaagaacgccgcatccctgtgaagaatcaacgttcacaaattttgcggaattattccatccctctgagccaagcgcagaatgcaatcatccgactcgccctgcgaaaccgaatttttttaatataaatcccttccaattacgaacgactgaccatgaagcgcaactttccacaaatggcgtacttcgtcgttttgccggtaatcattcgcccagtcgcctggtccacctcgacaacctccaattgaatagaagcgtggtctttagccgaaatgattcgagaagacgacgaactgacaagaaagaaaaataaaagtaaacaaaagattcaagaaagcatttaccatttcctcgggacatataaatcaacgaaatctcccgcgtcgttttgcattttgatagaagtaagtaaagctaacaagataaaaatggtaccgtataaaaataaacaaatatagtacgtcataaaatcataatgacaataaagcagaaggaaatattcgtttatactttttaatcattgtatttaaactgacaatgagtttctaataacttggtttctattatattgatacaaattacggttttttggaagcatcatcaagctttttggcctcaattttgcctgccttttgaatgacattgtatccggaggttatcgattcgtcacgaaatgcagggaaaacctcccacggtgtgttcaagtcaaacttccggaactcttgtgtcatttcggttggctcataaatcactcggttcagctcgtggtcccaacgcagttcgacgtatccggacaatgggaagtcttttcgctggggatgactaaaagtgacaacgccataaacaaatataaatacaaaaaggaaaatgaataaaataaacttgcccttcaaacccgtaatcggtcaaaatacgtcttaagtctgggtggttgttgaaccaaaccccgtacatgtcgtagatttcacgttcataccattcagcaccggaaaagactggagtgatggaatcgattggagcaacctggacaatgaatcgaatttgttatggtgaaaaaccaattagaaaaacgcacttcgtcagtgtatgtccgaactctaatcctcgcattgaatcgatgcgacaaaagagcgtaaattacttcaaaacggttcttacgcgtaggaacgtccaagccacaagcgaaaataaaatttgtgaattgggccgagtgatgccctttgaggaaggccataacgggcaggacaccagttgggtggatcagaacttccaattcatccccaccagcaaacttaaacacaaaattttcttgcatatctgatcatctttttcttcaagcacttaatttaaacattatcggtatcaaccgacagctctaacactaaaaattttctattagtgtagaaaggttgaaaaaattcacttaattttcaaaaacatatgaccaaaaacgcgaaagaacctttaattttaattcttttaaaaaaagttatgaagcattgaagttatcatattattttatggtcgtataaacgcaattgttgcttggtatatatcgtgaatctgttcacctgaacttgctggacgaatttgggcatacatgcggctacatattgaccgaagagagtcagcttctcccgcttttgttcatcaatcacgtattttgtgcctattttacttttttttaaacattcagcaaaaaagttgcgtacttgtctgtttttttacttcctgtgcttgtgcttcagtaccaggcgcagcataacctccggtctgaaaacggaatgctgttctggcgttatatatcggttgaagtgtttttatggttttcctgagcatattcggtcgctattcaaacatctaaaattgaagtaaagtgaaagaaatactcctctccctctagatgaaaagtgacgttcaaaattgaaaaggattggagacgaaaatgttattcatccacttaaccctcagattccaaaagctgtgcatcagtgtatttgatttatagtacaaacataatgccaataaaggaaaataaatttttaattctttttttttccttagctagtgtataaaaggtggaccatttttgagttcttcatactaacattttatgcaactacctattttcttttgccgaaaagtgaggggcgccatcggtattattgttattatttcgaccacttcatttaatcgcttcatatattcgtttaatcattttttaatgaccattcctaatttagccaaatattcaaatataaataaaaccaatggctgtcaaagacgacccaccggaaattaggggtaagttgtgggcaatcatgaagattatttgtcccacaaaaaaaaaaggaataaaaattcaaaaaacacttttttaggggttatttggtgcgctgagcacgaatttgaccttcttttgacttaatttcgaaccccgaacccggattcgaacatttgaaaaaattcaaattttcaatttttgcaaatattgctgatgcattgccattggtggcaacttttttcagttggtatgaaaaccgggacatgatcaggggactttgtaagattttcattgtttaaaaccaggataaagagaggagttaggatgttacccctgaaatttagtaacctaatgttttcgaaagggtgaatttaggaagttccatttagaagctgaagagacttttcaatctggcaaaccatttctactcccatcgtctaattacctctggaaaaattttcgcgaattccgtttccatcctttggacaaaatccaaagaaaaatggcgtttggccagctccaattctttcagatcattatcgactaaatttggacaaaacttgcttttgtgaaacttttgtgtgacttacacttcactttcgtctcactgatcaatttgtccaattcggccattttctcagctgaaaagttgtgcttctggcgcaccatttgacttaaattgcgttcaatttttttactaaacagacaagagaaaatatatatgaatttgtttttggaagggataaacaattatgtttaggatttaacctttttagggatcgtattaagaagcgggcaaggatttcttgggaaccatattccccttttcgggaaaaactggaatgttgtcgcaaaaaatctgcttatcaattctcgatacacggtttttaaagtttaaatttaaatttaacttcgatattattttggcgtaatgttttccttccatttaaatttttttcttcgttcctttcctcaagactatagagttgtacgggatcgggaattttggacaaaccgggaccgggaccaaacgcatgaaaatcagcaaaattaaacggagaattgctaattttcaaattcagaccccccccccttactttttcccaattttgtcggattggggcggcgagtgacgacgaaatcccaataaaaatgattgaaacggaaagcatcgacgagttggaggaggctgcatttggggagcatagtgaacgcgcggagggacaacgccctggcggacggtcggacgacgccaatttttacggtccctccgcgcggcgttcgccttcctcaatgaccagcggtggcagaggcacaacaacagtccacacacgcaatttgctcgctttttggtgagttatttgttcttgcattttcaaaatggaaatttagcgattccaccgtcaattttagtgtacaaaaaatcgcattcttcacaaattcgatacaaagcaatgtagaaaaatccaaattttaggctcttaggcctttgcaacaatttcggttacgtggtgatgctcagcgctgcccaaggacattttggaacggtcggcaacgctgcaaaacgacacggttctatgcattataaaacgaatcaaacttttgaatttttataaactttttttttgcacttttggcccctctacgcgttctcgaaaaagaaatctgattttgcgataaaa

SEQ ID NO: 345 - DNA, 11823 bp, Heterodera glycines
  misc_feature (19)..(19): n is a, c, g, or t
  misc_feature (10227)..(10228): n is a, c, g, or t
  misc_feature (10235)..(10235): n is a, c, g, or t
  misc_feature (10283)..(10285): n is a, c, g, or t
  genomic virtual cDNA Sequence=SeqID_648; coordinates=9609..9548 ,9499..9405,9352..9224,9161..8954,8828..8733,8679..8476,8288..7916 ,7846..7605,7561..7229
  coding sequence=SeqID_837; coordinates=9609..9548,9499..9405 ,9352..9224,9161..8954,8828..8733,8679..8476,8288..7916,7846..7605 ,7561..7428
  peptide sequence=SeqID_1077
taaaatcaaacgattgttntggattattttcccaaaaatattttccttaaactcttgaacatttcccgcccaatttactctctactcatttgcccgttatcatttcatttgggagtgatctctcgttgtccattcccacccaattcattcaacaaacaatcgcccttccctacggtgctgttggaattggagtcgcaatttgaacaaattgtcacccaactaaaaaaccacaaaagaccattaggaacaatcaaacactaattgccatgtccatgacgagaaatttgaaatggtccttaatcattccccggtcgaccaaagcgcagaaatggcccaacttcgctttgttggccgccctcagcacaacgtaatcctttgagaacattcggtgggaaaaggattaatgaatgggacgaaaaagtcacgacaaatggccaccatgttcagcgcgttcaatgccgccattccgcacacctccaatttggcgagcgaacatctctgtgttaatatgtgactaatgctttgtaattgccctaatttggtcattttcttcccttttccactaactattcccatttttgcccggcacaaaataccccaaaagatttctcactcacttccgtccctcgtccgcaacacctaaatttaacattggcaagtccgtgcccatttccattgttggcatttcaaagtttagtcttcctctcccatttttgtgttttaaatttgatgaaaatgaatgttttaaatacataaaaaagggagaacaatttgcccaatcatttttaacttcaaaacatcaaaatttgtgaacaacaaacaaataaagttgatataatgtcaataacaatgataaatggtcaatttcgtccctctcttcctctcgccgtcttcttttctaaaagtccatcgccccctctttttctcgccgtctccactacccgatcatgtctctcttgcgccccctgcgccgaacttcgtccaatttgagcagcaccggtttggcattcgttccgtcctcgtcccctccgcccccttctgttttgtatgcgtccaaaatggcatccatcattttgcccatgccaatgtgcgcactgcgattgttttctttgtccatttgctcaccaacattgtttgtaatactcacctccgaattgccctctccagcacatacaaatccaccgctttgtcctccggctttgacgagaattgggccaacccaaagtcaatcagtgccaattcgactggtccccgttgagtcaggacgagcacattggacgtggtcaggtccccgtggatgagattggcgtcgtgcattgtcctcagaattcttccaaattcatgtccaaattccgccaattgagccttagggagggagaaaatgaatggcaccaacacacagatttttatgtaattattataatcataggaacgtgggaataacccttcccaaaattaaaaagaaaaatcggactaaagtttgacagctgcgtaaatccaaataacaaaatgtttgttaacatagccccgtccttttgtcatggcattagtgcttcttctttcactactcactgcaaattgttcggcattgttcgacgccgattcgtcccgctgcaatttgtccagaaaatgttttgcggtcggtgctctgtcgctgctgccagacgagcaaattagttcgaaaattatccgatttttgagcgggtccacgaagaaaacggatggcacgcgaatgccaatctgagagaaaagcagcggcaaagttatgacaaagcgaacaaagtggaaaagttcaagcagtcccccccccccccgccaaggcacctcttggcatttgaggatggccttcagttcggcccgcgtcctctccttcgccagccgcgcgtccaattccgcgtgtctgtaccgcttcacaaaccgctctttcatcactgcccgacgacggaggaaagtgcacgcgaacagtcgcgcctcggccccctggcaaaagggcgtcgtttcccattcgtaaagctcacaatcagtttgggacacaatggcatccaccgtttctgtcttctgtagcgcaacggaagcaccttcggagtcggaagagacttcagcctcaatgcctaaaatgggttttgtgtgaatttcagggatatcgcccagccgaagaaaaatgcaataaaccccaaattatccaacccttaaaaccaaataaatattttaattttgccctatttacgattcggtcggtccgtactttctttccccactttttcattttccgtcccttctccgttttcctcatcttcggcttcttcgtcttcttctgatgacgaagtgggatatttgactgtcctttctttgctccgtttggcttccgcctcaattttttccatgaattggcgttgacatcgaatcacttcgtcgcccgatgagcactgaaattgtttttccgataaaacttaagaggtcccaaaacattaactttgcgtaagcggataacacttcggcattcagagccaaaaagtttgggccccatttgaagggtgccaacacgcatttggccgcttcttccaagccgacaatgaaaagggcagcggcgaatgcttccacacaactcaacttgaacggcatggcgtagttgaccgggttggcagccaacaaaaagggcagtaaacgatgttcagacccctgaaaacagaaacttggccaaaaccgtgtggactaacaaagcaccttcgccttgtgcattggcgttgtgtccaggcgattccacgaacagtcgaccacggcgaggcctttggccatgaccaatggtcggtcgacgggtgaaatggtgacggatgcggctggagtgagcaaaaggccgggaaaacgatggctgaaccgttgcacggagacgagcccaacgcggcacagcttgcggcccgaacagcgcttggggtcgcattggccaaagtcgaacatggccaaccgacgggggaaaagggcgggcagagactgagggtgaagaaagaccaagaaataaacaacgcaaagcaactgacgaaaaaacggaaaagtaggcgccttggccctggctaccccctttcagacatatggactcgagctgaaatttgccagtttcgggttggcttttcgaaaaatatcaggactgagaatcccggcaattgcgattacgtcagtctcgttcacccatccttaaactctccctccctttgcccaccttttggtgctcctccatctcttcgcaactttctccccccatttcttccgtcgtccgttcgcttcgcttttcttcgtcgctgtccccccgctgtgctttttccgtccctttgctgctcccctcgaactgctcgccgtcgtcgtcggtcgacaattgcctcatttcctcgaccattcgttgtcgtccatgtcgcttatttgccttccctttcattttggtctaataaaaataaatatatgcaagaaatgctttttttaatatcaaattgacaagtttcaaatattttttaattaaaatttcaccctttccaataaaataatttatgcatcaataaaaaactattatttatagaaacaaaaaacatttcgcttttttccctcagtctttttccggcgttctccgttcagttttcatcgttctgagcatttctttgtcccgtcgatttggcgagcgacggcgttgctccttctccaaagaatcctaaaatattgcgccggtctaagaatttgctgattggtcagaataaatcaaagtgaagttggactcgagttttgtcccagaaaaagccttttatagacatttattaggggtaatgaattgttttttattgaaaaaagtgtggaccccaatgccaccaaacaaaagtcccacgactgactgcttgactcttttcaccttttctcgttcgctgctccgtctctccgttttgacgtcctttcggctcggcgaccgatggtggcccgaggaggacgaatgctttttgtccttctttttcttcccctctttgtctctgtgactgctccgctcctttcgcttctcatccttttctttgtgccttaaataaccaactctttgggtttgtccctttaaatgagtccattggtcaccgcaccttcgacccggcgacggactgcgacttttggagcgcgagcggcgcttcttccgacgcggcgagtcattgtcactgaaaaccaaagagcattaagtggtagaaaacaacgaatagatttacgattcagggcttcggtccttgaaaaaggggcgtccgccacctctgaaccggtcggagtggtggaaacgaccggcaaaaccgccgccgcctccgggaccgccgaagggattgcggaaggaatggaaaagcggcgcaggacgaatgccacccatttgctgttgcgagggatgatggttaaacgaaatgccgggaggaccgaaggacgccgaggacggcggaggaccggcggaagacatcgaagagggaccaagagaaaattggctgaagttaaggcataataacagtgagtaaaagaaaggagttggacaacttggtggacgaaggctgaccaaagttcatccgagagggcggaagagcgtcggaaatgccgggaggaccctcaacaccgggcggtccttcggcatcctcaacacccggcggcaagtccatttcaagcgctgaatttaagcataaagggcctatgaattcttgggtatttctatgctatacggacctgctgatggcctagtagccaattgcggaggcatttgcaccgctggcactcccaccggtgccgccgcttgcgtcgattgcggtggtggaagggtttggctcggctgcggttgttgcatttgtcgtggcggttgttgctgttgctgcggttggggttggccaggcggtggcgcactgacaatcggcggcggaattgcggggtcaaaattgggcggaggcttcgagaaatccatcggaagctgagtgagcggtggtggaccggccgaagaaccaatgacactgatgttttggatgggcggcggcggggcggtggacgcgggcggaccggaggtgcccggaggcggcgtttccgaggcgggcggcgggggcagcgaatggccgatggaaataggcggctgaccaacgacacctatcatcgatgaagagcccaacgaagtgatcggctgagggagggcaccgtcggcagtcgtctgttggcccatagacgaggacaactgaacgaaatcaaattgaaaaagacgatgtcttctaattgtaactctgataaattaatcggtttacctcagaggatgattcctgccgagtgatgatgcccgatccgctgatcacggtccgactgatcaaagacactgactgggactgatcagaaagcgatggaggtggtttgctcaaatccaacacaattttctgcactttgttttgttgctgctgtttgctctcctgcccaccgaccaaactgacgagttgtcgcccgccggcaaaggtttgaagtccgacttggacagggccgctgatttggatgttcgaaagaatagctttgttgatcgccgcctgatcagtgccgaattcggcacgaaactttcgttgacgctcgcaatattgattccaagtatctgaacgaacaaaactcagtcgtagttgaacaaagaggagaacattgacgagttcgaagaatacagtttacctaatccccccccctactttatccaccttcgttgaagccataattgaaatagtcagtaatgtccgctcccggcttcctccatggcttgtcctccatggttgccaaatcgatgtcataaatttgcgaaccatctttcagtgtcgggttggcgtccaagtcaatggtggcacccccaacggtgcccgctctttgctgcttttggaacacattcgttttgatttcgccaattgtcacaacaaaatcgtcctcatcactctcatcatcgttcaaaaaggccggtcgatcatcttaattatttttcatttaaatgaaaatggcagacataaaaaactattcttaaacaattaagttatttaaaattcatttacagccgaacaccaggcccaaactaaaacaaagaaatgctaaaagtttgaagcttcgccaagcaaagctattaatactttgaaactttaccagttgaaccctttccgggcgccgaatcatttgcttgttctgctgcatttggttggtcgccattttcaacattcaaattaggcgattcggccaacacttcctcttgttgttgttgttgttgctcactcatttattatgagtatttctcaaaaaataaaattaatactattaatacccctataaaaatggaaactccaaaagaaacaaactaagaaatagataaatgatcagcagatttttaaaattcgtaatagtcccatattttacttcctctatgaggtaatgctttgcttatatggcaaatgcttttcaactcgagatcggctcttgcatttttacaagagaaaaccccccaaaaaaattttataattatgccaggttttggcgttctgattactgaataaaaataatctttataatttctctcactttgacgtatactatttcttatttttaaaattaaaaacatttaatttttatgtgtagcatttttcccctatgttaaatctgcaccaaattacataccctttgagaaaaaattctttttttaagttgtacatcccgtttttgtagtagggttcaaaaagtaaaaatacatttctttctcattttggtgaactttttcacgtctctaacatttgctcgtattttgcttagaaacaacagcctatgaattggaagttatgacgtaatgaaaatttgcaaatcaaaacttttttctgagataataaattgcttatttgtagcattcgcttagaaaaaaaaattttcgttacaaactttttttagataccaaattatttcaattacttgaaattgaatttacaaacaataaatgtcgaacaaaaaacgtcagccaccataaaaaatttattcggattctccaataaatgccataataaatagtatttggtcaaatgatagtgtttattactatataatgggcaatacagtaggatattgtgatcacaaaatgctttgattatgttttggaagactgagaaaggcaattgaaaggaaacaataaatgaagcaagcaagaacctctggctgttgagaaatcttagacggcgaaaattatggaaaaagaatcacaaaatttaactgagcttcatgagataaaattataaaaaataatttgtcatctatagaaattaaaaatggacggaaggcggggacaattggaaagtgatgggacaataaaattattaaggaccgacgccatccttaagggaagggaatgtcatgggatttcgtcgaatattgcgttttttcttccctttctgtcatcactcattggcatcatcaatttggccataaaagcgtctctgttttgagtcgatttctcgcaaataaaaggtcccggcaaacattggaatgccatcactgcgtttgccatcatcgggagtttcgatgtaagtatctgtaacataatggttcgttgggcggctcgtcaccaaactgaccccctccagcgacaatttgctccgttctctccaatgcggctgtaaactgcttggggctgtgtcggatccgctggtccaatcgcgcgtgtgcctttttcgcgctttgtttaattgcgccgtaggcagccatcagtttttccgtgtacaaattgaaacgaagtgagtacattgcggcgatacaaccgctgccataagaaaatatgaggatccgtttcccgttcgatttatcggaaagttcagtgctaaaacggatagaaaaattagttcgctaatgacctttgcttgctgttcctcctcctccccccactcacttcagaaagacgttgatcagctgagcatataccgacggcgtgtacatgttcccaatgcgtcgactaaactccaaaaatggattcagtttggcatccgctgtccgcgaactcatccgcaaaattttgtcagtaaatcgatcgccgtccgagcgagtttttgtgcgttccaccgcaaaaatctcatggagtgatttcgatttgtatgcgctgagttgatcccaatcagacacatcatcatcatcagctgtgacaccatcgtccatcattccccgtttaaagtcgacgaaggacagccaagaaaaggctttttgggtgagacgagcgtacggcgagtggaaaatgacagcgacaaaatccgaaagagagcaaggggctgaaataactaattgaaatgtaataaatcattaagtgagatgattgagtgtccaatcgtttgtaaaacagttgcattagtcacgcaaatcgaaaataacagaaaaagtttatttcaaattaatttataaccaatatttcgcaatcccttttttagttgatagaacaaaatacgatgaatgacttacgccctgtgcagaatttcttgttccatttctcacaaaatcgcccgtaacacatgtcaacggcgttcaaataggtctccacactgtttggcccgtccactcgtgggaattgcgtgctaacgcctccaattggcttgtaaaagtcgtaaacattttgagaatggcatgccctaaggccacgttcaagtgcaatcggtgcatttggtcctgaaatagaaaatgaaagaataaatgcctaaattggcgcaacaaaatccaaccaatcagaaaggccactgcaccggcaccgcccgtacatcgggcgggcccagccgaataaactgccacatcagcacagacaacgatggcaaggcgttctgaaaattaaaaacatgccaaatgaaaaagcgaagtgagaatgactgaactgataacctaacgattgcgcaattaaatgtttccacaactctttgaaaagaaggttttaggaccaattgctcactttctgttgcgtaattagcgtacatccaatcgacggcatgaaacaacgcctgggtcccaccgaaacacgcgtttttctcgtcggcgccctccaagtccatgttgcccgaatcggcaaacaaatccattaacactgacttcacacttttgcttttgtcgaccaatgtttcggtgccaaccgcgagaaagccaatgtcctttggattgaccttaaattggaaatttaattgcccttaatgccaaaataaaataataattggctaaattatgccttgtaattgtccatcagtgcagctgcaacagtcagcgaaagtgaacaaacatcttcattctcatggcaaaagcacatttcttgttggccaagtcccagcacgtatttatttgatgtaacattgtcaaactgaaaggtaaaggtaattgccaagcaaagaacgtaaaaattcccaactcactttttcaaggtcttcttggttcacgtaggattttggaaagtaaagttcgatgccaataataccaacgtctttaatggactcagaaaagtcatcagcttaattgatgaatgagggaaagaaacaattaaattgagtgaattcaccgaaatgtgtcccattggtcaagccaaagccatttccatttacagttggatgatggttattcattggtaaaatttatttaagaaactgctaaaaaatggaaaattaaaatataaaaacagaaattatggaagaaaaggtgaatgaacatttatttataaacaaacaaatgcgtacaaagtccaaatcggcagaagcaaattgaaaaggaatgggaaaacaacggaaaatgtaacagcgacggatgaaagggaagcgacggcgggaaagaaaaatttaattgaatgtaagggacagccaaagtgactgctttttctcaatggccacctcttcccgtccctccccccccccccgcgttttaatgtattttctgccattatttctctttcgttccacgagttcggccaatcactacgacacatacatacaaagtatgtacacaaaaaattaaaatgaagattgtatctgcaaagaatgcatcagcaaaacagaaaaagaagaggaaattacctagtctgttcctatcaagctgaaattttaccaaccattagcttccccaaaatattatgaagcatacaaattcatagtgaggaaacatttttcgtgtatctctttctgtccatcacattcgtttcccacgaaaaaaattttccaaatctaggaattttttttcaaaatttcnncaattcnaagtcatttggtggcggtaggggtcagttacgcaactggccgttcgtnnntggtggtgcaattaactttgatcgttgtgccaatttttgtgaaaaaaaatcaaataaaaaaaattatttttttacacttttaggtttttgtggtcaatgggaagaggttgaaatgacaaaaattttgattccattttttcttgacccctttcatttttggttaaatcatccattacagtctttaattaacatgaaaatgcaataaataataatacctgttgttgtttgatttaagttttttatgatttgcttaatcacttaataatacatatatagacccccctaaatgctatgaatcgcaaaacgcaaaagcacttgaggaagacaaccgagcaattgtcctttagaagcgatgttccgggaggaagaaaaagtgggatttgtgttggaatgcttcaggacgcgtaaaatgtcggaattagaaacggccgaaacatcctccttgcttttttctttgccttcctcaaccctttaattaaccaccactaaatttttcgtcttaaaaaattgcatatgaaccaaataaagaagtggaactctccggcgtttaattatatccatctgctggcggttgattaatgtgcagttcaaagtagggcatcagacaaataggtaagtagtagcacgaacgatgattaatggaactcgttcatttaatagcgattaaaatgcatttgagccgattaaactattagctaaattttgaaaaatttaataattcaatgcctcggaatgtgtgaatactttattcgatttaacccgataagatgaacgtttaaattaaatagcaaaatgagcaagaaaagagaaaattgttcaacttggaaagaactattgataatgatgaatgtgaggcttaaaatacaacaacaaaaagccaaataaatttgggtaacaaagtgtaaaaacaaatggttcttgctaacgcatgaacagccgcccttttctctgatgatgctcagacgaccctcacaaaatgagcattctcagcagaaacatcacaatggcactcataacaccggcgattggcagggtaacctttaattaaaatgaattttgaaatttttaatttatgctctgtgcttcttcaatagtaattttctaacgcctcaccagccaagagagagagatattcctgaacacagtccaatggaccaccggatgtgcttggaccagtccgacggccaccacactcccaacctagacaaaacaaagcgatcatcttctctcatcaaatcgtcaccttgcactgagtggaacttatcggtagacccaatttgctggcgaaaagaactgtgagagcggcgccaaattcgatggaaaagccgctgggaggagttatcctggtcagattttcgccgaccgtgtagatcactcggtggccgagcagccaaagcccaacgcacattccggcagcaccgtaaagcagcaaatatacggaagtctcgcccttctgatggacactgccttcatcgtaaatggtgtacagtgacacgagcggagcaatggcattgcttaagggaggggggggggggggg

SEQ ID NO: 346 - DNA, 7605 bp, Heterodera glycines
  genomic virtual cDNA Sequence=SeqID_657; coordinates=2060..2101 ,2399..2439,2501..2570,2905..3123,3854..4024,4440..4573,4631..4779 ,5534..5784,6227..6334
  coding sequence=SeqID_844; coordinates=2060..2101,2399..2439 ,2501..2570,2905..3123,3854..4024,4440..4573,4631..4779,5534..5784 ,6227..6334
  peptide sequence=SeqID_1083
ctaggaaggcaaaacagttgtgccgttcgttgacccttctgctggagagttacatggacaaaattgcgccccaactgtccaacatcagcgagttcatgctgctgcgcacgcaagacaacaacgaggagacggcgctggaggcgtgcgaattttggctggcatttgcggaaaatccggacgtgtgccgccaagtgttgcggcccattctggcccaactgttgccggtgctggtccggtgcatgaagtacaccgagacggacatcattttgttgaaggtatggccggcaaaacgcgtgtcctcccaacgcgtccatttctccctcccattaaaaaaacgtacgaatcttttcataagaaaattcaagtaaaagttttcaatgattttatgaaaatttatgatgaactactaacaataggttattttcaaaatttttctttgtaagatcttttttttgaaaaatttcgactgaatatctcgtttttataactttttcacaagttttcatattttattaaaacggtgagaggtggacaaacaaaaattcacgggttaaatcaagaatgagctaaattagaaaaaaattttatggtttttaaatttatattcccattttcccctccacagggcgacgttgaggacgattcgaatgtgccggaccgagtgcaggacatcaaaccgcgcttccaccgggccaaaacccaagggttggccggctcttcttcgtccgcgcccgcgctgcccgtcgatttggccacgggactgccggagcaacaaccgccacagcagaacaacagcgagggggatgaggacgacgaggaggagggcaccgacgacgaatccgccaccgagtggaatttacgtaagtgttgttagcctccacgtctggcatttgttgattgttgaaagtccgggacattctaacaattttttattttcttttttttgagaactttggaaaattaaattatccttttaaaattaaaaaaatggaatgtaattcaggcaaatgtgccgccgcttcgatggacgttttgtccggcattttcaccgacgaattcctcgtccatttgctgcccattctcaaccaatcgctgtcttcggaccaatgggaggttgtcccattccccccaatcttgaaataataattgaatttttaatttaccaattgtaatcaaactttcattcaggtgaaggaaagtggaattttgacgcttggtgctattgctgagggatgtgtcagtggaatggtgggtgaacttttttaaaaatatgacccaaatttttttattttgacaggtgatttttttcagaaagaatcttatttgttagggagtttttcctaagctttcaattaaaagaattttttcttcaacgataattttacgatgattttttcaaaacttttcaaaaaaaagtcacatttttttttgcttgaattttttataggaaaaaattcctaggatcttttaaaattgcaccctaaacaatgactttcccccgtcagactccgcatttgccctggctcgtcccctttctgatcgactctctccaacatccgcgttcgctggtccgctccatcacttgctggacactgtctcgctactgtcactttgtggtccaacaaccgcaaagcgaactgttcgccaaactggtcaaggaggtgagctaaaaaaaggggaggatgtgcatatggtcgaaccggctgacaatgagcattccaaccacaattcatttccaattgaaaatggtctaactgataataatgagacacaccgagcacatctcgagagaaagtgcagatatatgaaattttgaaggataaattgtcgaaaaattatgatttgttcaagaaaaatggtttacttgtgaatcaagcgtaaatttaatgtcatggagcttaacggtaatgatgggattgattcctgacatttattgggccattggaaaaggcaaaagtgaaatttgaaaagttaaaaaagtttcacgctttctattccccaatattgggaggcaacaaatgcttaaatttttttgatattaatcacttacttttctgcacagctgttggctcgtgtgttggacaagaacaaacgcgttcaggcatgtgatgagtaattttgatggccagtaaaattgtacaaaagttgggttaaaatgatggcggatgactcaatcatgtgttgtggcatggctcgtgtaaaattcactgtttgactcgagtcaaaacattgctaaaagagtcaggggaaccggtgcaaaaaggcagaaaaagcaagaaacgatgcttaaaactcccgagcacaaaaaagacaaatataaaaaaacatttaaatttcataattatttaatttattttaagtttgttcatttattggagaggaatttctcttttttcaggaagcggcttgttcagcctttgctacattcgaagaggaggcgtgtaagtcgtcttttgtagttctttgatgttctcaatccttttaaattatatgtgtttttaggccatgaattagtgccttatatgcccgagatactcggcactcttgtggaggcgttcaaaagatatcaggtgaccattttgtggaaaggggtcacgcatgaaaaacggggtggggtcaacaataattttgtcagtcttattttgaggcaaaattttcgggccagaactttttgtttctaaatagggcaaaatataacaaacttgatttatttgaaagctatttgaatttatttattgtagaagtgattgtttatcaagttcgtatcgatccaaattcaattagaaaacaaaggggacggacccttaaatttaatgtaaattatttccggttttaaatatttctttctcaaaatggaattattttgaaatacaatatttattgtcccttcccacacttttttaggccaaaaatttgctgattttgtacgacgcggtgggcacattggcggacagtgtgggcggcaacctggcagagccaccatatgccgaaatgatcatggacccgttgatgtccaaatgggcccagttgcgcgacgacgacaaggagctgttcccgctgttggagtgcatttcgtcggtggccaccgcactgcacaccgccttctacccctactgcgagccggtcagaacagccttattgcataaattgggaaaaaacagggatagagtataattttatttggttctaatatcgggagcagttcgtcctccccgtatcgtcccgccccggaaaattcaatttttcaagaaaaaaaaaattagaaaatcttgtgtaagttatgaattttatttttatcgcgtttttctagaaactttgaacagtaatcggttcaaaaacaaatttaaatagaacttatacgacatttatgaatagagcccggattttgaggcatatgccttcttttttgctaacttgctatggcctaatacgcacgaaaaacgagtttttaacttggttagaagcttctagtttaaacttttttgtgccttttttgcaattttggtgccttatggcgggcacgtaattttggtgcccttttcatgccttttttagtattttatgcaaaaaatggaaaataagtgcctatttgagaaattttcatgcctaaaagtccgggctctatttatgaaacacactacaattaatttacttaaaatacaatcacacacacaaaaaaaaaattaagcaaataacagatattagccaagaaaaattttaaatttatcagttttatttttctacaggttttccaccgctgtgtgcgtctcatttcccacacactcgcaatcagcgaggcggcgcatgaatttagtaaatcgaatttacaaaaattttctttccattctcggagaccaattattcctttttaaaagaccgagaagctcaacacgatcagccggagaaggactttctgatcgttgcgctcgacctgctctcggagttggccgaagcgttgcgcgattacattgacccgttggtggcccaaagcaacatcatccagctggtgtacatttgtgcacaggtggtgaaaggggccggaagactaaatacaaatggcaaacaacgacaaaacgcactctaaactgcttaagattgtgcaaaaattgacaaaaaaataacattttcaaaattagggaaaaattcaagaaaataatttcggcaattcccccactccgtgatttcattagttaggttaattattttggttacgaattatgtgtacaaggggtggggattggaccgattctgtaaaacaataaatattttaaaaaaatcaaaatattttttgctttctatggaaagcaaacgcaaaatcgggatgcccattttgaatttattttttgagaggagtggaattttctccattggctttccttggttttttataattttaattgcaattttttggtaatttcttcactttctctgccccttaggacaccaccaacgaagtgcggcaaagcacctttgcactgctcggcgacctcgtcaaggcgtgctatgcacatttgcagcagaacatccatcaattcatcccaattctggcacagaatttgaacccggattttgtgtaatataaaattaatattatttaatgttttaaattaaatgttttttttaaatttaggtccgtgtgcaacaacgccatttgggccctcggcgaaatctccatgaaaattggggaccaaatgcggcagtacgtgcccattctgttgccccagctgatccacgtgatgaacagggataagccgccgaagacactgctcgagaacactggtcagtgttttggagatcatccagaattattcgggtttaatggacgaattccattgtttttgagcaattttcttgtttaaaattcaaaatattgctggaaattcaaattttaacctatttttttaaaacaaattccactaaaaaaacattcgcggagcaagtcgttcccccgtcattccaccccaataagtttgtagtttttttaattttccgagggaaaaacgacgcaggtaggaaatgatggggggggaattaaatgcacccaaattttggtgacattttttacagccttaagaattcttcctttggatgtgtttttcatttctactagagatcgacattttgaaaaaagcctggacctggattccatgttggacctggaccttgatttcctggacaaaaatccaggtccaggaaaaatccaggctcctcgagacctggatccaggcctggacctggattttttgaaatttattttaaaaatcaaaaaactgtttgaaaaaattaattatttgcttagaagcatctaaaaatatctaattaataataataatgtgtttttaaatttatttaatctgtttttgaaaatataaaaaaacatcggtcacttgaaaaaataaattctaaaattttgtccaggaaaatccagggtttttcctggtttgcctggacatggacctggattccaggaaaatccaggcctggatccaggtccaggtcgatctctaatttctacctattaaaaaatgttcagccattacgctgggccgattcggcattcactgctctgccgaggtgtcgccctttctcgccgactttgtccgcccctggtgcatgtcgttgcgcaatgtgcgcgacaatgaggagaaggagtcggcattccgtggcatttgtctgatggtcaattgcaacccgcagggcgtcgccgccgcgttcattttcctctgcgacgcgatcgcctcgtggcagacgcccagcgaagagctgcgcttcatgttcggcagggtgagccccactttctcccacccccacccaattagtgttcttaattgggtaattatagcataggttacctcaaatttttcttagttttcaaccaatttttaataatttgtctcaatgtgtagcctaactacatggagacgggcattttattgtagtttttgtaaaaaatttgaattttttttatttgaaaatttaaacaaatttagtttttggaatgaaaagattggaatgcgaaaatcaaagaattctaatgcatttcctaacaatcttttctgcaaaattattgtctcccgtccaaaatgtaaacatttttcgacggaaagggagaaaaacgtatcaattcgcattttttacgaattttgatgaaaattcactaaattaaatgatagcaacaatacatcatattaaataattatttgccacatttttattttattttcagattatttacgccttcaagtcacaagtgggagaggagaattggaacaattttgtcgctcaaattccggaaccgttgaagcaaaggctgggcacacagtaccaattgtgatcgtcgacgagccccgctgcccacgactcacagacacagaaccattctcaaaattcattccaaatttcacggggacggacgaaattcggaatttaatcccccgccatatcggaaagtcaaagttcggaaaaacatggacctttctcaaaacggagtcaatcaaaaagcacactctaattttgataacggaaaatgcaaatttgcaattggaattttgaaatgcgaattttacggcaacaaaatatgagaaagttgacggaaaagtgccgaaactgcttttggcacattattcgagaaacgtatcccaaattcaaatttcgtgaattgttggaatgggtcctaattatttcgtccgtctcccctcacctccccagccacacacataccatcacattttgtgttactgttattttgttgttgttgttgctgatcagcttggatcattttgcatccgttgtcgttctgtccgtcgctcgccatttttactttgttttttgtcctttccgttttcatttgttttttgtttatttattattttttttacttttttgttttgtttttgtcccttgtcctttctcagactttttatgttaactcattcatttttgtactttgtttgttcctttgttttgttatgtgttgtatttttttgttgtcaattttggcgagcgacaaaattatttctgtaaaaaagaaatactgttgaatctcactaatttcgagaatggtctttccgacagtataattaagattttttgggtttgaacgactaaatggcaaagctggtgctttaccaaacgttttttaaataatcctattgttacaggagtagggtcccaattatccggggaaggccttcctgcaaaattgtcatttttcaaatccacaacaaattttattccatcattaattttacaaaattaataattaaaatttgatcaatgtttcctccgaaaaaacatttcacatcacaagtacccttgttctttgtcttcgtattcctttgatgctctcgctgaataagccaaagctggtgcgcacggcggagttaaagatccgcatcggaagtgatgaagggcgacacggctgatccagcttctgcgagcgacgtccaacgggatgatgttgcgctcgcccggctcattcaagcggagtccactcttgtcgcagcattgcgcgcctgcgcgtagaaccccaacgaggactctgtcccctgttggctcactaaataattaatttatggtatttacgggtaatgtaaccaatttttg

SEQ ID NO: 347 - DNA, 8034 bp, Heterodera glycines
  genomic virtual cDNA Sequence=SeqID_659; coordinates=2896..3021 ,3091..3270,3365..3512,3685..3743,3794..4357
  coding sequence=SeqID_894; coordinates=2896..3021,3091..3270 ,3365..3512,3685..3743,3794..3844
  peptide sequence=SeqID_1246
ccatatttaaatatttttatttattgttcgattagcaattttaacgctgaatcacttaaaaagtttattcatatcagttgtttcttcgctaataaatttttgcagaaatttgaatacaattttagcttatcatgattcatgaacaaagcagaacgactattcaaaaaattttgaaaaaatttaaatcccaaaattttgttcgttcaaaaaattaattttcggtataatttttttgaaactgttgcattcaagagggttttttgagaattttgcataattgattgatgattcaagtgcagctcttgcactatgggtacgccccagtggcagacaaaattgctcataacgccaaatagcgcatttggcgtaattttttgcgcgctatttcaaaatttacactggaaaatgcctttttgtattttgatctgccataactcgcttcattcccaattaaactgaacaaatttggtatctaaaaaagtttttgaaaaggagaatctttttctaagcgaatgctaagcaatttgacatctcagaaaaaagttgtgatactttcaaatttttatcacgttataactcaagtcctaaactgctgttttcaccaaaaatgctaaatttattcttttttctattgattctaaatgttcaaagtgattttgtacccttataatgaaaattgttagaatttacgaatttctattttttttcgtgtgttagagatatgaaaatagtacgccaaaaggagagaaaaagaaatgcaaatttattatcccataaactctacagttggccttatttttgtattaaatttccttattaatcgatgcagaatttttttctctatcgatatgcaaaaattggtgaaaattgtatgagtagaaaaaaaagttatgtgtggcgaagtaaatgttgttttttacataattaaaatgaagagatagaacgccaaagtgagagaaatcacaaagaaaaagaaaaacgacgagatagtactaggcttttctctgctcactggggcgtacctatagtgctcttgcatttctctttctaatctataaattatctgccgtccttattgcaaattaagcggctttattcggtataaatgcggacggtaatagaatctgggaaataaaaactcggaaaatcgttgatgtagcctaacgctcaaatgatatgtaaatttttaatttaaaacaataaattttaaggaaagaaaatttaaagcaatctggggtaaaaattaattgtgtgagaatttcgcggtacgggagcctaatgcagaaatcccgcaaaaaagtagctaagccaaaaaggatagtggcgagaggcatataaaatgtgccgctaccaatataccacaaaataagtaaaattgtttttatcttagacatgcccaaggggatttactcaagtctacacaatggcagttgtcatcgatcattgtgcagttccggcagtttatggtttactgcccagcaaaactctcgccacatacacaagattcttcgaaacaattcgtcagtctgttggcaataattggttcccgtaccgtattatgagcgatttcgaatcgggagcgatcactgcagctggcaacgtctttccaaattccataagaaccggatgcttgtttcactttggacaagcaatttggcgaagaattcagcgattgccaaatttgctcacgcgatatcgtgacgatgaagttgtcagaacatccttgcggtctctacaagcgctggcttttgtccccgtcgactttgtctacaactatttttgcattgccatgtcaattcttgagccgactcctgagcttcaagagctgatcatctatttcattaacacgtggatcgggcctcgccgaatcatgcaaaatgaagaagttttggttcacgatgcaggcggagtagctgataattggattcgagggagaattgaggcgcttaatttggcacagactgacgctctttttccaattgaattgtggaatgtggtggacagagtagcagaagggcttggaagaacaaacaattcgcttgaagtgtggtgggatgtgaccattttttcatgtcttttcttcagggttggcattcaacttggaatgtgcaccttagggggaaccaacgaccgagttcatttgctcggaaaatgatcgaggaagatgaactgtggagaattcgggttgcagattatcagattgcaccggctgacggcattaaagggcctcatgaaacgagaaaggccaaatacattcgtcaagaccaaaacttggaagcacttgtgcaggattttttcaatcgtgatccgatccaatttcttcgcgcttgcgcttatcatctgcacttttaaacatttataggattttagcattgtcgttttacacaattttgtcgttattttcgatatcaatttgaagttttcaaatgttagaattggcaaagttaaaattttgttcattgtcgaaatcggtcactgtcgtaatcagccactgtcggaaatgtcggaaaacagtaaaataaatgaaaatagttcactgtcgaaatcggtcactgtcgaaatcggtcactgtcgaaatcagccactgtcgaaatgttacagcaccagccggacaggactgggcttatttgttaggtatccgacatctcaaaaagcagattcaaattcttttgttttttaatttatgaattttattttacttttttttctaaattttacattatttttgatttataattaaattcctcaaaatttgatgataaaaattgaaactgtgcttgttatcaatgatggcacgtgcagttgattctgtaaaactcttgggcaggcgacagtttcaacaccaaaattcaatatttatttgacgagaatgaagaagcttttgtgctttaataggctgagcgtgagcgtttgctgcaggcggagcgcgaatacatcacacgacgggtgctgaaaattgtggaactgaaggagacggtctgtgccggtggagatcaaggatttgtggtgattaatcaaaaggtgtgtgcttgttttattcgggaatgactctcgaatttaaaaaaataactaatccccgcttcccccaagggcattgatccgccgtcgttggatttgttggcacagcacggcattttggccctgcgacgtgccaagcgtcggaacatggaacggctgcagttggcctgcggtggcgaggcggtcaattcggtggacgacctgacgcccgatgtgctcggctgggcaggcagtgtttatgagcatgtgctggtcagttaagggggagcagtgccgttatttcttgggcggggacagttttccattggtgtactgtatgtaacacatggttaccgtaccgcttcagggcgaggacaaatacacttttgtggaggagtgcaaaagtcccaagtcggtcactttgctgctcaaagggcccaacaagcacagcatcacgcagctgaaggacgccatttatgacggacagcgggcggttgccaatgcgttgaaagacggtgggttttgcgacgaggggatgggacaatttggatgaaaatgactaattacctaggcaattaatgccttggcactttgggttatttgattttgcacctcttttcccagttttgggctttacttatgactgtcatttggtcgtcacatatttaattttcatggtttctttaggtgccgttttgcccggcgccggtgcatttgaaattgcgggatattgtgcactgaaaaaggtagcaagtagagtcctcccactagacttcacaaccaatctctgttttagcttgccgacaatgtgaaagggcgtgccaaactcggtgttttggtgccgtaattctttctttctttcttaatccctttcaattattgtcatcattctcattcccaggcttttgctgaggctttgctggttattccgaaaactttggcggtcaatgccggattcgacgcccaggaggtgagggaaaaggcttttaaaaaaattatttatttactcctttcaattgccaggccattgtcaagctggtggagacgttcagtgctgctggtgagctggtcggattggacctggagagcggagagccgtgtgttcctcaggtgtgtcatcagaaatgggcggggacaaatgtgtcgtgccacaaaaaatgaacactttcattcattctcttcccccgtttagagcgtttgggacaatgtgtgcgtgaagcaggcgagtctgaacgcctgtcagaacatcgcctccaatctgctggaggtggacgaggtgatgcgtgccggcatgcgcgacttgaaggggggacagtgaaaatgaacggaacggaaatgaaggagcaacaccaataaatcacaaaatgttaatggctttttctttgttgaactctgcgctttattgtttgaatcagaccactgctgtttttgctttttcaatctcgcttttctgaacgaatgaaaattttgacaataaaaattgctggcattacgatggtcaaaataaaaccctgagaaatttgttgttcccgctgtgggattggctgtcttttttgcgggacggggttaaaatttgcgtgatcaagtcagaattgatggatttttgaaatctcgaaatttattaagctatggtgacataccacaaatgttaattgcttttttttgttagacctgctgcgctttattgtttggttaaaaaccactattgtttttgcttttctaactggcaattctgaacaaaaaaaaacaattacactgaaacgaggcattagatttattcttcatcagacaaaataacgttaaaacataagaggttaaaaggtcaaacgtcaactcatcattcgacttccacttgcaacgtcttactgcggtggcggcggaggagggggaccctgctgctcctgcatgtgctgctgctgaacacctaaacgaaagaaaatggagaaagtgcctgacttaaccaaggcactgaccaaaattttcgggctgaccaccgaaaaagtcggggccaaaaggtgccgcgtgtggattctggccgccgagcgcatgctggtcgccgagaaagtccgctggcgcatgatgatgctgctgttgttcaccaaaaaccccgggggcaaacgctggaacaagcggttgctgaccggcttgaaaaattaggcattacaatcaattgctcgagaaaagaaatttaaatctccaataaattttgcacaaacccaataagttttggagttgttggatgttttgctgctggtggttgattgtgttctgctgttgttggtttgttgtagtaagttgttggttggcggtggtgagctgttggttggcggtggtgagctgttggttggcggtggtgagctgttggttggcggtcgtcaggcgctggacatccttttgcgtccgttcgagtaacttcaaaagacggtcctaaaatcaaattcttttttatttcaaagtattacttaatttgaacccagggctaagggcacaaaatcagactaacaataaaatcaaatcattttaccctttccgaggactcaaaaaatatattaaaaagaaagtcaaaagaagaaaaaaccacatcaattggttgacgatttagcgacaaattggccaaacttggaacaatttctttggggaattctatttttggaatgtgcattttttataaaggattactttttctaaataatattcaaaaaataaaatgattggaaaaactatgcctaagaaaatttttgaattcctttcagtgttagacaaattggtcaaaacgccaaagagaatttattttttgcgctaaatctaaaaacaattgctgcttctttgtaagaagtcagcactgggagaagcttgtttcccccatgagaaattttaaaaaacttcggcaatactaccgatggtatcacaccattttttgtgatacctcggtagtattacaaaaattgctaacagaatgttttcaaaaaaaaaaattcttttccctacctccattttgtgctttgtggctgccaatgggatgagaaaaggcataaattttgacatgttcaattttattataaaggtacattcagatggcaacttcaaaaagtaacgtttaatagtaaatataatttatcaacagacaaataaaaacaaatgcgtaaattttggcgatttagggtgggggtggcactcatcccaactcaatttatggaaaatcggtcaaattttacccgctcaaatttctggcacattccttctgacggacggtgaattgtgacgacgattcgccggccgaacaaattcagggtacgcagaatgtgcgagaccacgctgtccaccactgacgaggcgaggtcctaatcaggaattttggaaaattcaaaaaaaaattggaaccttagtcggttggagggcaaaaatgatttgcgggttgtgccgcggttcgaaggcgaacggcaaacgacgcgcctcaccatccgaaatggcttcttccaactgaaaatgagaaattcattcttaaaaaactcgttcgccaattccaatagccgcacgacgaaactttagcaaccaaactaatccattagcaaattagtgatttccattttgtactgatccaaaatcccacctcattgacgcgtctacgcatcgtccgttgggtgtgtccgaccatccaaagctgtgccggcgccatcagatgctccttcaccgttggcgtgcccatgaacaagtcgtcctgttgcacgtactgaaattgagaacgggaaaacacactatagtttaataaccactaatcccgtttcaattaacggtctcaaccgacatatcgtcgatgtttggatttgccattccggcactttatattatgcggtcaagttttgaatttaaaactaacggcgcgaagaattgaaaaacttaattggtaaagtacgcttgaaaacccaagttttcaaaggaaaaattgtacattattgtaattctgtttaccatttatttgttttagaattcaaaatttgacatttaacagaagattagcagttttccgactcaccccgatgacgtaagtgatgaaccggcccaaggagtgcgcgttgatcagcacttgaccctccacgctcaaagtcttcaggttgtggtccagcaacgtgttcaaaagcgctgttttgtccactccgccgtcgcccgtcagtgccacgagttggcccgcgtcggccatgccggacgcgtcgtctaaaaaaatcgaaacagtctttgacgtaggtaacgcaactccgactggggtttaccaagaattttccgtcccgatttggcatggacagcggtgagaccgtgccaagacaatgccacgggtttcacctcctggacactctttgtcggcgacgtcgctccgtagttggagagtctgcggcgtttgcgttccacgccgtagtccatggtcaatgcgtcactggtgctgtgtttcaacgacaaaaattaccaagagatgcccctaaaagaaaatattgcaatttctaaacaaatatatatgaaaaatagtaaaaataggctatatagacagacgtccactggacttctaggtaggcgtctaatcatcagtttctttggctataaatttcttcttaattggtcaatgcctacattcttggtatcaaataaaagcatagtctatagaatcttttgtagtcccaaacactgggctaaaagtaatagacaaaaaaaaattcttgaatatactcaaaaaggatgcgtttcgtgttttctcgttgtcgtttttttcttaatgtcattatttgctattttcttgtcttaatgattctagggacttttagcttttgtttgatacaaaggttctgcattctttgtatcaatttaaagcttaaagcatcagtctcggtgaaatgaatgcccagttacatatcttacatatctccaacacaaaatcttatgtacaataatttttcctgattttttttcacaaagtaaattaaatttgaatttacgcattggttaattatttattggcattgtattttcttcaaatattttttgtagaga

SEQ ID NO: 348 - DNA, 4270 bp, Heterodera glycines
  genomic virtual cDNA Sequence=SeqID_660; coordinates=174..417 ,460..641,690..893,988..1136,1192..1336,1392..1512,1584..1690 ,1752..1844,2015..2122
  coding sequence=SeqID_915; coordinates=174..417,460..641,690..893 ,988..1136,1192..1336,1392..1512,1584..1690,1752..1844,2015..2122
  peptide sequence=SeqID_1142
aaaaaaaaaattcaattaaatattttttaattttcctaacttgatagcctggattttttcatggacttggatttttgtccaggaaacccaggtccaacatggagcccagactttttttaaatgtcaaattctaaagagaaatatttaattaaggtaaaattttattagaagagatgaaatttccattggctttcttttctctgtgtttatttgcatttgctgaagtggcagccgaccgggtcctccttcttatagacaatcccacaattcgggaatcgcactccgtcttcatcaaatccctcgaagagcgtggccactccgttattattgccatggctgatgacccaaacctttcgcttatcaaatttggcaaatttctctacgaccatttgatcattttcgcaccttcggtggatggtaactaattttttgcaatatttttttcagtttttcttttagactttggtgggaatataaatgttgacgagatcaccaaattcattgacggtggcgggaatgttctcgtcgctgcagacaaaaatttgggcgatgcgattcgcgaccttgcagcggaagtgggctttgagttcggggaggaccaatcgatggtcattgaccaccacaactacgacactgttttggttcgaattctgccccttttcactaaataatgcaacggtcaaattgaggacgatgggtcgcacacgaccattgccgtgcccaacgcacaactgatcaaagcgccccttatcactggcgaaagtgcgcttttggctcccgtcctttaccgcggcattgcgctggtcgcggatgaactgggccctttgcaaatgattttgatgaccgcttcatccaccgcgtactcacataaccccaacaaaacggttgaagaggtgtgttgggacaaatcagtttgatcccattatttatgccttaaattcattaaaaatttgttttctttatgacagagttttcttcacttttcagcgtccttcggctgttggcaagtcgacaattcttttgggagctttgcaggcccggaacaatgcccgtgtcattttgtccgggtctttggactttttttcgaacaaattttttactgcgacggtgaaccaagcggggggccacactgccaagtgcccaactttttttcttatattatttatttggacattttattttatttagtgccgtaaaaagtgggaatcagcaattggctgcgtccgtcctcaaatggttgctcaaagagtccggagttttgcgcataaaatcagtgaaacatcacactgttggccaaaagtccccgcccgccgagtacacaattatggactatgtggtgagaagagcgagcatttttaattattattttttatttatttatttccactcagcgatatgaaattggcattgaggaattgcagaacggaaaatgggtgcccttccaaggcaaagatgttcagttggaatttgttcgaattgacccatttgtgcgcgtcactctgaaaaacaacagtaagtcgaggaggcgggggattataatcattacatctcattggtaattaaaaaattacgtttttcatcagatggcaaattctcagctgaattcaaaatccccgacgtttacggcgtgtacaaatttttggtggattaccaccgaatcggatacactcatttgactgacgttcagcaggtcgttcacgccttccccattcgtcaattgtttctttgttcaattcattcattcatttcaggtctctgtccgaccattgaaacacacgcaatacgaacggttcagtcgctgcgcttacccttattatgtgtccgcattttcaatgatggttggggtgagcaaatttgttaaattatttttcaaaattcaaatgcgtaatttcgggttcatttttgggaatatttgggctacatatatgggttttattgtatttttttgcagttcatagtcagtcattttttggacgcatgccaaattagctaattacctttgccctttggtcaggtggtgctcttctccttcgtcttcctctacttcaaagagtcgcccccgcaaagttcgtcctccgccgccccttccgccaaaggcctccaaaaggcaaaggcttcgtaaaaggcgcatttccatcttgagaaaggcttaatgtgaatgttgttacatattattatactttcctttaacttttgctctgcttaatttatttcattgtttttgtttaagggtctttcgttaataaaattttattttttttcttcaattgtttaaataaattttttcaaattcaaaaattacctaagattttttgccttttatgtgaaaataaaatttgctaagaatgtcacggcataagaagacgcacaaacgcaacagcaggaagggctcgaagaagttcagttgtttaatttctgcactttattttaacttttttcaaaagcgtaaaaatttccatttttccgtttattttccccccaataaagcgctaatcttaaccaaattttgcatcaaggaaaaggggccgagggagcgcttcttccaatgggtcaaccgattcggacggtgccgttggcacttcgtccacccgccgggcaaagagttcgaatagggcaaatggacggcattctccgccgtcctcctacgactcgaccctttccgaatgttccacctcctcaacggcgcattgtcagcattttccggaccgggcaaagaatggaaacaattttggtcaaattcgcattcgaaaaacacgatggggaccaatgttagaggagaaaagcgaagcaaagaaaaggcgaagggaaaagccaacggcgagggaaagcggcggaaggcatcgccggagggggaaaagtgccgaatcaatcgacagaggaaaagacaaagcgacacaaaaaacacgcgaattgcgacaacttttggattttgtggacgaccgaaagcaattggcagacgaagttttggacagtttggacgtgaggactcggaacagaatattcccggaattaaaagtacaaaaaaacagacgcaaaagtgattggcaaatcattttttcaaatttagacaatgtcggagacggaaatgcgaaggattgtctacggatttatcaacggaatatcaaaaaagcgaattgtggcattgctccaacgtccgttgtgccaattttcaattaaatactcgtcatttgcaggaatagacttcgccgacagttcgtcaacctccgattcggaggaatgtccaaattccattccgtcgacttcgtccgattgtcgaaatcgctcaatttcgaacgaaccgaaaaaccctaccaaaacaaagagtaattcattgaaagaaaagcacaacagaaacaaaagggagaaggagttggaggagggcgaattgatttcggaggaggaaatggaaaaaggagaggagaagggaggggaagacggatcagaaccaccaccagcagcagaaagggcgacattcgaagacgacacggggagccaatcggacgacgacgaggaggacggccgattggcacgacgacaaaagaccgaaccgcaattcgtcatttcgcgtaataaacaattagtgttttaattgcactaattgacctttccctccgttcttttcactctcattgaattgtcagttggattttctccgcctcatcagcacaattccgaaagtgtcatcaatttttgtgagagtgacgaaagcggcgacgatgacaaatttggacaaccgcagcagagggtacaaaacattctccgccgggggtttatcaattggcttttcatccccccccccccccccctcatttatcagatcgtttgcattttgccctctccgtctccaacagcgacaattgtcgtcggaattccctctgctgatgagagtcagccaggcgacgaggaggaggaggaggacaaccgcagcaaactgagaactcctcctccgactgatcattacgaatttgaagagcaatcagtgaaagttcaaataacagtaactgacgatggggaggaggacgaaaatgaattggacgaggaagagagagggaggaggcagcggaaggggagtgccgaaccgacagacggagcggaagaagctcccgccgcaagggaaaatggtcggaacttccagaaaccaaaacggataatttcgctattttagttaaaggtgacaaaacgccaacagaggaacaatgaagatgatgatgatgacttgctgatcgaactggttgatgaatgaatcctccaattcattttgtccaaatta

SEQ ID NO: 349 - DNA, 3892 bp, Heterodera glycines
  genomic virtual cDNA Sequence=SeqID_662; coordinates=3369..3223 ,3179..3076,3033..2777,2686..2307,2261..1999,1957..1442,1392..1189 ,1137..930,882..568,348..181,128..47
  coding sequence=SeqID_898; coordinates=3369..3223,3179..3076 ,3033..2777,2686..2307,2261..1999,1957..1442,1392..1189,1137..930 ,882..568,348..181,128..99
  peptide sequence=SeqID_1126
ttttcctgcatattctcgccagtgctcactcacctcccaaaataagtgttttatatgcgccctttggtgcatccaatgactgaactttctttgccaatttatccggatggcatttcaccattatatgcctaaatcgaccatattaagttaaggaattgaattaattcagcttcactcaaccttaatctcctcagttgttcttgggagggtgcatccattctgaacttctcgggcaacttctccaccagaatcggatttgttcagaagaagcgtcagctgatgtctctgtttgttgatttcctttagggccttagggcgaagtcctagggcttcgattgcgtgagcgttctgtttgaaaatggtacctcatttttcataaataaccaaaatttatggtcaaaatggcaagaagaaagttttttgagtattctggttatgagtattttaagatgaatttttttgcgcaaattaatagtgacagtaacaaatgtttattctggaaatctggctaatattcctttacaaatctcctttaattaaatttgaagtgcttggtctgtggcccacctcttcctcatagtcagcagcaccaacagtgttcagaattactgtcaaatcaccaaagagtcgagcctcgccaacagcacaccaaagaaatctttgcttaatcacttcggacattctttttcgtctctcttccgttccgtcctcttttgtgcttgaaatgaacaataatggttcacgaacggagagagccgacaccaaagtgacggcaaaaggaagaagtccgccacgaattgaactgatgacgaccttcgcaaaagaaggagtgagaggcagctgcgcaagtgattgtccaagttgtgtgatggtataaagcccctgaaaggacaattataaaaaacaagaaaagtgactcatggatcaacttcttgaactctaagcgcccctatgtgagaaagtctcagctcagaagatttgatttggtccaatcttggaggagtcgggaaaggaaaattgtcgattttcgtgaaattcattgctttcaacataagaatcaattggtcgatcggtttattaaggatctcaggagtagaatgatcgcgcatatcttcgtaaacagccgaagaatacaatctaaaccaaaatgcacaaatcccttcaaaagtcctaattttactatgtcacctgaatgcgtatccggactgaactcgtccggcacgaccggatctttggtctgcagacgcctttgaacaccatccgaccacaaaccgagaaactcccgtaatcgggtcatattccctcttcttttcccgcccagaatcgatgacgtaacggacatttggaatcgtcaacgaagtttctgcaacatttgtagaaactacacacaccctgaaaataggatagaaactcaaaaagttccaaaaatgtcgaatccaacctagacccgtcatctggcggttcgttgaaaattttcttctgcaaattcactggtaggagagaatagagagggatggccagcagaggagggtactttttgaacgattgcgaagcattaagtgattcatcgtcagacccaaaaaaggtattttgccacgcctcatcttcaaggtccatatccgaagttccgaactcgtcgttgtcaagcagtagtccctcttcctcctcctcttttgtctctttcttccgacactttttcattttctcttttctcagtaattttgatgcagatatttttgtgtatttgttttctagcaatttgaccaaatgtgtgacttcacgttgacctgtgacgaacgcaaggatgccacccgctgggtattcctcgtggattttacacacttttttgaatgttgcttccaaataatttgttggagtgcgccgttcaaaataaattgtaactggaaactgacgagcttggacactgacaacttttggttgactgatggaaaaaagtctaaaagaaagaaattggcactgtaaaaaaagtgaattgacctttgtcgaagaaaatcctgaagtttcagtgttgccgacatgataatcagttttaaaggataaccgcgtttcattctgagcgcacaaatccttgacaaaagcccaattaaaacgtcactataaatggaacgttcgtgcgcctcatcaatgacaacgactgagtaacgcgaaagtgtaaagtccgtctgcaactctttcaagagtactccgtccgtcataaatagtatttttgtctcttcacttcgattcccttcatgtctgatctataaccaattagtattgtaattaattagtgattcgtaattcacctggtatgatgccaatttttcgttgtccaactcgtggccaactcgcgatgccatacttatcgcagcaatacgccttggttcggtcactccaattaagtgtccattggaggtgtagccagcctcatacaaaaattggggtatttgcgtagttttcccggaaccagtctcgccgcaaattatgaccacgggatattcgttgattgcctcaacaattggctgttcctcagcattaattggtaattgtcgtctcttcttttcaatgttttcgtcccgtggaacaataatttggcgtcctttgatgcgagaaagggcgttggagcattgcaattgtcctttggcatgctgtttattttgttttgacgcagcctcatatctttgttctgaaatttaaaacagggaagaattaatggtttgctcaaaatgcgctaattgaatgatcaattaatagaaaattaatcaaaataaaataccgtttttgtcaattgggagattctgtgcagtccgcgcgttatttcctgccagcaaacaagtttcaatttgatgcgtcaactttggcattcgttctatgcttttcccaggttgttgctgttcaccattcccactaaagtcctcttcacaagaactgctgtccgtttcaatgtgattgagttgtttcgatgttgctctgatatttttcaatttttcaccggaaacgcatctcagctttttcacaacttcaattttgtgtctgaaacacatatgagatatttgacaaaacacatggaactacttttgattgcctgcttctttttggctacttgcaatggaagttagtaaattcatgttcccttcgtcaagctgatattgttgcaacatttcgaacaatgattcacgcttaaaaaaatttttttttttttttggtaaatgagaaatataccgtttgctttattttctttcgttcagcaagttgggcaagtttttttgatttattttttgatattttcgtttcatttttacgccgaagtcgttcgatattctccaactttttcttgttgattcttttgtccggaactggatcagacattgtgctctcactttaatcgactcaatttgtgagaatgagcctgtctatgccttgctcttaaatttttcaattttttttttcaagacacaaagccaaaataaaataaatttaaaaaaattgatgattgtgaggtcactaaagtgaaggagggcacctcgtttcccccccgccgtttccgcacccgccaggcacgaccggatcgttcggctgcagacgcctttgaacaccgttccaccacaaactgagaaactcccgcaaccgggccatattccctcttcttttcccgcccaaaatcgatgaaataactgacatttggaatcagcaaccaagtgactacatcatttgtagaaactacacacaccctgaagattaagatagaaactccaaaagttcctaacatgtcaaatccaatctagacccgacatctgcctatgcgttgacaattttcttcttgagattcaccgaaaagagagaatagagagccatggctagtcaaagagggtacttttttgaacgaatgcga

SEQ ID NO: 350 - DNA, 9990 bp, Heterodera glycines
  misc_feature (5934)..(5934): n is a, c, g, or t
  genomic virtual cDNA Sequence=SeqID_667; coordinates=2624..2692 ,2809..2957,3038..3217,3266..3301,3574..3714,3790..3843,3897..3938 ,3998..4099,4230..4319,4375..4541,4589..4679,4887..5114,5358..5590
  coding sequence=SeqID_1000; coordinates=2653..2692,2809..2957 ,3038..3217,3266..3301,3574..3714,3790..3843,3897..3938,3998..4099 ,4230..4319,4375..4541,4589..4679,4887..5114,5358..5453
  peptide sequence=SeqID_1211
aaaaaatgataaacatgtatcaattaaaaaaataataaggaatcatattttgtcgataggaaaccaatgagtatacaaaaagaaaattttaaaaaatttaattcctgcagagggattgaaccaagggaaaaaagaaggaaaagtcaaggatagtagccactaggccatttgcaaaactgtgaatatattaattttttttttaattttttcctttaactccaagtttcgttcctaatttttcactcagccccccattcttaccagtgcttgtttttcccggttgccctaccgggaccgggacctgagcttttcaaaatccgggacctctgaggaccgggaatttccatcccggtcccggcgcactctacttaggggtgtattttttggttatattgcatttttgctaataaattctccgaaaaaatgtcgaatagtgaaaaaatagtaacaaaacgccaaaatagtgatttttagtgaccgatagtgacaacataatcgaaaaatttcaacggagaaatgtgttttttgagttcctttcttcaaaacaatttaaaacctaaaaattgcgaccctaattatgataccgccgggatttacgatttttcataaatatatgtacctaataataaaaaataggcaaaacgccctttcttttaggggtcttatcaacccgcgacttcagaaaaattctaatctttcattaaaaatatattttttccccaaaaattttaatatatgaaaaacttgggtttttaaaatttttactggtgatttctgacactttggcctactatctctttatatttaatagaattaaagttcaatgataccataattgttcagtttaattagggatgaaacgagttatggctgatcatcaaaataagcaatacacaaaacgcccataatttttgaattaacgctcaaaacattgccaatttttaatttttgaattaacgctcagaacatgccaattttggcactgggcttgtgacccattgccattgtgcctagtggaactggcataataattgttgaatttctttatcaccatttatttgtcatttatttagacttaacttttttattcaccgattggctgatcagcaatttattatggctttattatttactcgattgatcagaaatgtaattcttgttattgtgttttttaatgtcgtaagtttgcaaaaccattttatcttttgtttattaatatttttaggtttcctattatctccgctggaaatcttacaacatcgctgctcgggacttcaagaccgcttcggttaactctgcgagtaagttctgtctgttctcattttcatgttatttcgtttctttataaggtaacaatgcgctttcggcggtgtctaagtttcagtctgaactgaaacgcatcacaaagggacaatcggtttccagtgattcgacctgggtctgcatttattgcttattccgattggtctgtctttcatttgcttccttttcagattccactttctgttggaggattgcatttgcgtcttcagatcgcttatgccacactgttcgaagcgtaagtatttccattttcttgtttttgaatgtacttcgattttcctcacagtgtcactttattggtcgctccgtcgccgaccgtcggtcgttcgggcatccactgggccaattcgacttgtactgtgttagtgggggaagtcgtgcgccattccgatgcctacagcggactggtgaaagagacgttcacttcaggtttgtgtctttgttcatccatttttttacattgtggcaatagtcccttattatttttgttatatttttagcccaaaacttccgtcacggtcaatttgagagttacgtctacgagttcaaggagggcactcatgtcgtttgctactggcgtgggttcatccccgccagcggtttgtccgctttggtcggtgccgttgcttccggcgatttgctcggcgccgctcgtcttgtcttttcttattctaaggtccttcattattgcttttgtttaccaatattttttctttttttaggtgacctttgaaaacacctccgttttcttcgtggacactttcaatcacctcaaaaacaaagcgatgaagatggagttgtgagtgttcggatttcgacgttgtcacttctctttcatgtccgattcattttcgactcatcgcctcgctaacaaacgaaatcactttggcattaattcgatcattgggcttttgacttcccctttttatcaattgcacacctaactaaattgtaacagtacaactgacagtagtgcagaaatcaatttaaagaaatttaaaagggacatcttttggttgttttggattttcatttgttttttttattcttaaaagggttttgatcagcatttatttaattctgcccaactgcccgtttcctttggctcattgacattttttgtcattccaaatttgtattttagctcatcattaattatttattcgtacaatccatttttcaatctgttaaagaattcgtaataatgctcagttttaattggtaatattaactcctgaaaattatttcttagcaagtgattaaaatgccaaccgttattttattaataatttcccttttcgttacatttaattaattattttggttcggatggtttctgtggtcgctgggagagtgcatcttttgccgcgtgagttccataacatttgctaaattttaaagccaggaaaatgtagggctgctgcttcccccaccttttggtttcaacgaacacctaaattattaaataaaaaggtatcccattaggcaccgcctcttttggcaaatcgtttctttcatcggatgcgactaaaaagcctgataagacttcctttggcaatttgaacgactctgatcggattttcactaatctttacggtcgacatgactatcgcctcaaaggcgctttggcgagggtaattaattaatcagaaaattctatcgatcggcatttgccagatcattttaattaaaaaataaattttgtgatcttcagggcgattggttcaaaacaaaggaaattattctgaagggtcccaaatggattctcggcgaaattagcacttccgggctgcgcggccgaggcggggccggctttcccagcggaatgaagtggggcttcatgggtaaaccgttcgacggtcggcccaaatatttggtggtcaatgcagacgaggtacaccttcctttttacttttcatttgtcaatttccttttctttcagggcgagcccggcacatgcaaagatagagagataatggtacataaattagtttgatttcgatgtttattattcataagtaaaaagggagggaggagatcggagtaaagggcttaaattgattgtagaaatcgaaacacatttgcctggcaatgagtcttgtaaaggtcaaattttgaaactgtttccgatggcgatgccgatagaggctaacttcttaagtagtagttagtaaattgagttttcaaaaaacccatcttttccctttcatctttacttctctcccattttcattattgttatttctttagagacacgaccctcacaaattgatcgaaggttgtcttatcgcgggcgttgcaatgggcgcgagagccgcttacatttacatccgaggcgaattttacaacgaggcgtgcattctgcaagaatcaattcacgaagcttacaaagtgagtgcttttgacgaatttctgattttgacttattaaatgagaatgattgtggggaaagttgtttttcttcaggcgggttacattggaaaggactgtcttggcaccggctacaacttcgacattttcgtactaactcatatttcagttccatcaattttcttttttctttcctttggcaggtccatcgcggagcgggcgcttatatctgtggggaggaaacggtagaagaagaagaagaagaaatagcgaagaattaaactcggaattggtccgtttccaggcactcattgagtcgttggaagggaagcagggaaagccccggctgaagccgccatttcccgcggacatcggattgttcggctgtcctacgaccgtaacaaatgtaagcattgagaaagtgtgcgttttcatccttcggatcagaaaatctgtcttttggtaataaaaagcgctgtttttagtattttctccagttttttccttttcattctgtgccttttccttattgttaggttgaaactgtcgctgttgctcccgcaatttgtcgccgcggtggcgcatggtttgccagttttggcagggaaagaaaccgcgggacaaaggtaagaaaaaagtaaaataaatttcatatgaaatacttaaatttgccccgctcagttgtattgcatctccggccatgtcaatgatccgaccaccgttgaggaggaaatgtccatcccattgcgcgatttgatcgaaaggcacagtggtggagtgatcggtggttgggacaaccttttggccatcattcctggcggttcatctgtcccattgttaccgaagaggtgtttatttggcattccgacaatggccctaaagattcgtcttttagcatttgtgacgatgttctaatggatttcgatgcgcttgtccaagtgaattcggggcttggcacagcggcggtcattgttatgaacaaacaggttcaccgatacccttgaacacaatgccgcctcttcaagtctattgcactcgtcgaattaaattttaaaaaaacagggacaaaggaaaatcggaaaatttaagaacttttattttaaggcctttaaaaatcttcatagaatttttgtgagaaattcatgctaaacgaactgccctaaattgcgagtattgttccattcccatttcagtgtgacgttgtcaaatgcattgcgcgtcttgccgagttttacaaacacgaaagttgtggacagtgcacgccttgccgggaggggtgcaattggctgaacaaaataatgtggcgcttcgtccagggcaaaggagtgcccagcgaaattgacatgctgtgggaactgacaaagcaaatagaggggcacaccatttgcgctttgggagacgcagctgcttggccagtacaggtcaaaaaaaattttactgtaaatttcgccaaaaagttggtggtaattttatttttataattacctgaatgggaaaaacatcaacggattttggtggttttcaaaatttttataattttattttatttttagaattactgtattacaatatgatgtattttccgggtgtcagattttttcacgagagggggagaagggtctttttaatttatttttgtgttcttaatgaatttcttaatttagggactgatccgacattttcgtcctgaattggagaggcgcatggcgaaatatgcggagagtcatcccgaaataaaggaaactttagcgaccgcataaaaacctttgttcatttgcttggattaggtgaatttttgctatgtttgtacagagtaaaaaatgatggataggctcataaataattatttattcgcttaattagttgttccgttttaattaatgaactcattgcgcaattggtttcggcacattaagctcaaattggccgcttcgatttgagttccccgcgggcctataaaatgctatgaccacaacttttttgactgcttcttctgagtgtccatttgtaattttctcgtccttttccatctgttgtgggaatgaacgcattgtcgaccgaccgactccgacctttggcgaaagggactgactttagaattgcccaaatgcattttttaccattgcaaaaagaatacctctctggtcgatttccatacgatttgtgtgaagtaattagtccctttatttttgtaatcgtttttcaattattttccatcaaattaccttcttgccagcctgnggagtcgtattcgtactttctgttctccgcgtaccaatagtcgaccatttcgcgggcgcatttcccctcggggaaaacagttacattttcacccactccttgattgttgtctgacagtgccattccttcccaactgcccatttattaccgctcatttcggcaaatgacacatggccttgccatgcgattcggtccgcccattctttggccatttcgctgagttcctcgcagagcgtcaattcggggcatccgtgcttaaaaaatagtgtgggtgaatgtgcggggactctccctttatggtcaccaatttgcgcagttcattgtgccgttccacgaattcctttgtgaattccctcccaaattccctttcattttccattttggcattggttttgtccgaattatgggaaggcgaaaggggacgaaagaacggaacggaggaggaggaaaaggacataaaaacactaaaaaaacaaaggaaaattgggggaagaatggggtttttgaaggacgaaaatgaggaaaagacgaaagaacggacagagggaggaaaagcaagtgacgtgaagaaaggaaagaagaaaacaagacggcgggagtatcgaattgaaagcattgggcggagggggaaattggcacggcactcgccccccccccctccatctccaatttgtggacactctccgctttcgagagtccacgggccatacaaatatggagcagttgggcccatgaataaattagctgccagcaaaagaatggaagaaaaaagtgacgagaaaaggtttctttcccataatgttcgccccccgcacttgggtatttatttatcaaaaccgataaaattaatgtaaatgtttgattgttcatcctccgattatgtatatcctgctcaaaaattgtacatttaaaatacacacacaaaaagagatcagaacacaaagcgttttctcaatggactgatcgactgaatgagggcgactgttggtgcgttctccgccgctgctcctcaaagcgtttctccatctcatccagcagtttgggggtgaagcggacgaccaatttgaccctgcctttggcactcttcagcaaacggaccgcagtttcgtggttctccctttcaacattctgaaggagacagagaatgaatgccaatggaatggtgaaaatgccaatggaaagagagtccttttttaccactccgttgacggctatcaattggtcgcctcgtttcaatccgccgtgaaggtcggccacgccgcctggaattgaaaaaagcatatttcggtcaaaagtgccattttaatgacccgggataatccgagaaacgtaaatgggcgagttttgctccttgccgcccatgacgttgaagccgagtccctggtcagtcttcggcagatcgatcacccgcggatgggccgaaccctcggcggcggaaaaaacggcgacctaaaaaaagccaccgtcatcagtgtacgagacaaaaagcaaaacgaaaaattcaccgtagacttggcagcggcattcgacagaaaagccttgggaaaattggcacagtaaaatttccgaatgattaatcagcatttttcccccataaaatggtttaaaacactttgtcctttttcaccgtttcttccgaacgttcggcagcactttgttgttgtgcgtagacaaattcatacacatttttgaccgcattgaaaaagggcgattggatattttgctgaaggcgcaccaaattgggcatttccctgccgcttttctgcagaatccgtccaatcagttcagtcatccgatgcaaatctgacggcgaatttcattttgcctaagggcaaaaaggacgactcaccacgctcgatggacaattcggcacgatcattaatgaattcaccattggccatcggatggagagaatttatttattaaaattagggttgagcgggaccgggacctgaatacggacaactgagtaccgaagtcacggttttgaccgggactagtcccggttttttcccggttttcccagccaaaaattcccggtttttcaacccgaaaaggtcccggtcccgtatttgcccaaaattcccggtcccgctcaactctatttaaaattagagagagaaaagaaagacggcgcggtttggaaaaagccaaagaaataaaataaaaacaaataaaaaaaatttttcttttgtataacaatgcacgattttaatgactgactaagcggcggaatttacaataattttgtaaatttaaatacataattcactaaaattctgttggcggttaaaaaaggaatcacaaagagaattaaatgcaaaaagaaataaattaatcggactcatcgtacaaaaggagaggaaatgaggaggaggaaaaatgggacatttgcgaaacgaaaaagaaattcagcggacaattcacaattcgtcgtgtcggaactcttttctgaatccgtcgatctcccaaatgctggaggaatatctgccaaagctttggaacagagcgaccaaatcatttctaaacggaaaatggcaaatttacttcattaattgtgaatgaatttgccaaatctaataaatattaataatgttattttaatgttttttatgtcgccatttatgactcaaaatcagaatttgaagctcttttgggcataggcacaaaagccggaggcgtaaatttaatgcaaaccgaaagccgaagccatggtggaagtcgatttttgaacgaaaataaggaaaaatttgtggaagagggaaaaagatcaaatccatcggcccctgaatcagttgatcccttatcgtttttaattccttttcttcaccttgtcaatttgaaaagtccgccgttcgctgcactttctccgttttccgtttgctctttccttccgttcgctttccctccgtttccgttccgcggaaggtccgaaaagagcactttcagtgccgttcccattccgtgcgtttgcaatttgccccaaagtcggcacttgtcgcagccgacacagtccataatacgcgaaatgttccaaaagtgctggcgaaactcttccttcagcagacgggcgtgggactcttggaaattctgaaagaaagacgcatttgaagtcaaatccgattgggaaaagggcaaaaaaggaaataaaaaatgaatgaaaatgggccaatgcctaccgagaaaagttgagtctcgtcgaattggttggggaactctttgagcacggcgaggaagtgttccaaggattgctgcgtttctcggtcttcctgacaattacgagttttggtattattttgtttatgcgttcctttggcccagaaatggtcccgggattggcttgagtggacacgtgtccctaatgccccctttccctcttcgttttgcccttcccaattgtgcccacaattcattattcacctgctcgttgcccgtgtagaacagttgactttttcggatgtacggcgtcgctttgaccaatgccctcagttccttcgcatttccattcattttctcattttccaatgatttttgggccaccactcaccagcatgtaagtgaagtacaaattcctcaaccgttcgggcccttctttgccccatttcgtaccgaagcgattttcaaaaaactagaaaaatcaagcgatgtcagcattaattaaaatttgttttacttcaacatttcggtaccaagtgccggtgccgaaaccgccgggggctaaaaggaaaattaagataatgcaaaaataagtctctggaaagcggataatacccggtctgtaattgtgggccgcaatcgaaacggtaatggccgagtgaaggccggagatgagccgatagaacactctcttctccaaacacatccctaaaggacaaaggcaatgaattgcgatgtttaattggtggcaattgcaaaaataaacccgttggcgtcggttggaggagaaactttttgtcgaatttcgggtcgggtcttaagaaaaaacaaagtgtcataatgccaaagggggtggacgacttgaaacagttctcgttgtaaatgcactcccaaactttg

SEQ ID NO: 351 - DNA, 4860 bp, Heterodera glycines
  genomic virtual cDNA Sequence=SeqID_668; coordinates=2988..2930 ,2708..2567,2293..2122,2073..1963,1866..1783,1396..1326,1268..1140 ,938..729,610..405
  coding sequence=SeqID_832; coordinates=2988..2930,2708..2567 ,2293..2122,2073..1783,1396..1326,1268..1140,938..729,610..512
  peptide sequence=SeqID_1072
aattggataaggaggggagtccgaaactgctcattcattatctagcccattcaagacggcatataagacaatgaatttatttgagttttattttgtttaggccactttccgtgcaataactcgtggcgaacgacgacgccatcactgtcaactttttgatcagagtgaatgtgaagaagagtcatcctttttataaatgtcatttaaaatcacttgtgaaaacgatctttcaaaattaaatcatttttttgtttttgtgatcgtctctatttccagtagaaatcattattttgtttctttccaatgctatttttctcccatatatgttcgttcttgtggaaccgaataaattttgtcgtcaactttcctatttttcaaaaattattaattcgtttttgcgagaccaaatgtgaaatttttttaaatatcggcgtgcaaaacaagaaaaaaacaacaaataacaaaaagtgaggatccaccattaacgcattttgacgtcctccgcccccctttactcctcctccattttttccttcttgaccttctttttggcggctcggtactcggccaccaccaccgcgtggtcacgttcgtacggctcgagtgttacctaaaaaagtggagggggatttccattgccaagatgtgacgatttgcttttttgtgcgtcctaatggttggacaattttacaagaacgcaatccattccaatgcaacatccaatccacctgctcaatgggtttgaactgctcctcgcgcaatttgttcacttcgccggcaaacaccgcctccggctccgccgtgctgtccacacagttcgccttgatggagatgaccacatggccgttgttcttcagaaatttgtgcgcattgtgtgccacaatccgtgcctggtccggctgtgccacgtccgagaaaattgtgtccacaatgccaatctgtgcgcgcagtgattttaggaaaaaaacttgtattcaattttgggaagacgaaattgacacgtaaaccaaaaaagatggttttcaaatttggattaaaattcaatttagaaaactcgcaagagccgaaagtttaagcgaatgaccctatttgtgaggaaattaggtatgatgcaaatagctaattgtaagttgactgaccatcatggagtatttgtgcgggtgccgtgcgtcgtccacaattggcaccacgttgggccgcttcttggccatgccgagcaggtcacgtccactgcgatgtgaaaactcaactgcatagaccatgccttcctaaagaaagaaggtatctatttacaaatccaagacaaaaaaaattatttggcatacgggtccaacgatgtcggacacatgggaaacggaagtgccggaagcggcgccaagataaagcacacgggcacctaaagcatgcaaatattgcgcatgtgaaaataaatttgagtagaaaaatcggtcccgattcaatccgtaccggacggtttttcatgaaccccgtggatttataaatttggcatccttttctagccaacttagaaacataatcacaaacgaaagaattagaatggaagttcgaaactaatgctccaaagcatttacgcagatgaaaagcttttaggcaccaaattccggcaaactcttgattttcgacttttgttggagtcagggtccgagatttgaaaacggccaaactaatgcaaacacgaaatcccaagaatcatgcacccaatgtttttcatcgaaaacaaaagggttatcaaccaattgcgagtgcttgacggaaactgacccgggtaaatgtgcgtgtcctcaatgccggccatgacggcggcggccagtttggagcggaacgggttccacacccggtactcgactggcggtgccgggccggcagccgcggcggtgggtgctgagacaccgttgctgccattcgttgtctcttccgtcttcggcgttattgcagcaatcggcgcattttcggtctgctgggaggagatgcgcttctcgccgtacaccgactcgcccggcaccatgttcagcgtgcacagcgcgtcctccttgcccttgacgatgaaaatgcctgcgggaaattcgacggatgatctgatcaggcgtgaacacaatcaacctctgatccggtgcggctccacaatgaccttgcgtcccccgcgcatgcctccgccggcgccacccccgcggggtgaaccgccgcgtccacgtggcgagccaccgcgtccgcgcggcgaaccaccgcctccccgaccgccaccaccaccgcgtggactgcctcctcgaccaccaaagccacgcttaagaatttcaaaaaattttttgcttttatccacgcatttatcgcgaaaaaatcaatttgagattttgaggaattttgggtggaattttaaggaaattggtccgtcgttaccaccccagggaatgtgcccagttttgagagcaattcaactcgttcctgatggtttttggatttgtgtaaaccgctccaactatttgcgagtgcatgaagttgaagatgtacggcaaccatttggagtccttcttcaattagtttgtcccaccttaaaccctccgccaccgccgcctccctccccgttgctctgacgaaaaccgccaccaccaccgcccccacggaagcctcgaccaccaccgcctctgcccccacggtcaccaccaccgccacggcctcggaaacctttgcgaaagagaaagaaatgaagcaaatgtatggaatcgaatagccacttgaccaatgcgaattcgtaaccagaactcgaaagataaatcgaaaattttaatttttgactctgggttcgaaccccctagcaaacgtatttaagtccagaaataaactttagaagtgcttgtaaattaaaaaagccctttccgtttgtgggttttaatgttaaaaagctctttttaactttctcttctcacctcctcgtccgccgccaccgcgtggagaaaattcgggtcttcccattctttgattattatttttgaaggatgctgaaaaaatgcttttgcggaaaattatttgataagaaaaaacaaaaagtcataaaaacacaacggtcaaaacgtataaaatcatttgaacaaaacaaagtttggaaattcagtaattcattcaaatgcaaatgtacactgtgaataatagagaaaatggagaggaggaaaagaaatgagaaacgttttaaaagttccgaaaataccgttttttcgtaaatttctaaaaagaaatttccaaccttttttttacgtttaggtaaattaacccatcaagtcctcccgcaagaaaatggaaaaacattgcaaacaaataataaaaataaaatgatcaatcaaaaacaatgaccttcttgctcacccccccccccccctccgttgttgttcatgttggctttttggtgattgcagcggacgtctccaacctgggggcgggcggtttgaagttggcgccacggaagggctccaatttgcgctcctttttcttcacaaagtcgcgccacgagccgcgccgctcgtcccggctctcctcatagttcttcttgtactcctcctccaacttgcgcttctccgccgcctcctgcaccgactcggccaaccgccgcttctcctcgttggcccgctcctccagcgtccgtcgcttcttctcccggtcggcaaacacctgcaaaatgtggtgtatcccttttcaaataaaaaatgaaatctgattctggcattttgtatatcgcaatttcaaataattgacaaagcaatccgatacgacacccatttcgacaaatttcgaaccccgtgcccgaattcaaacattaagttaaaccttcaattttaaatcttcgatttcttgtttgaattcgggtaccgtggttcgaatttaccgaaatggatgtcatattcgtggtttcgataggatagaaatggtcattttttggcaattttttgctcatcccaaagccttttttgggtcaaacgatatactgggtttttgaacatttcaattgacccacaatatagttaaaaatgagaaaaaacctttgtcacggtgatccaaagtgcacgtgcgtagccctgtggtgtttcttcttcaatggcgtcagcttttccatcctaaaaatgaatacattttaaatggaatttcgatttttgagataaaaatgggaaacctttcgcattttgcgcttcttctcgctgatttgcactgccagccgcgctttggcctcctcgtacatgtctcggcagcgtgacaattcgtccgggtcttcgacggtggcgattgcctatagaacgaaaagaatttcaccgaaacttgtaaaatcatttccgaattttttacttttttgttgaaattatataggggattggagaaaaacaactcctttcatccttaaccaattaaactttgctaacaaataaggcaaaatgcaatgactgaataattgggaaagggaacagagattaagaaaaatgaatacgatttagagtttttggtttgttttatccattaattctccaatcacttataaattagtaataattgaatatcaataattgtcttagaaatgctgataaagtatgaaaggaactttgcccacatacaacttaattggtggtacttggagagtattgggagccaggaaacaacccaatccatctccatgagtcatttttctgattgcgagaaatgtcagatggaaggatttggtgcgtacctttttcagtgcgtcaaatgcgcgttccgccctctcccgacagttcggatttttgtccggatggatcagcagggacaacttcttgtacttcttgcgcgcatcctccacatttgtgtctggctccagctggagcacct

SEQ ID NO: 352 - DNA, 3739 bp, Heterodera glycines
  genomic virtual cDNA Sequence=SeqID_681; coordinates=1362..1193 ,1107..946,878..606,548..348
  coding sequence=SeqID_1020; coordinates=1362..1193,1107..946,878..606, 548..348
  peptide sequence=SeqID_1227
aatgttggaaaaaatgatgctcatgaaggtggagccgatgactactcctccacggctgagctacccggaattcaaggaggagcgaattggcctatcgactttgatgtcgcgttctccctggagcgcatgtgcttggaatgattggagagggacacgaaacaattccaaatgaatacgtaaattccatttttttttggtccgtcatttcagcaataattttcataaaaagcttttgaaaacaatgttttttttaatataattttttgagtttgtgaattatttaagctggttccaatctcccccataaaaaataatgcaaaatttttattataattgcaaaatgagaattaaaaaaaggtggaaatatttccgtcaagacttgacgaaatgaccattcttgcatcttccgaaaatgcaacccccgtaatttcctgggtatgggctttcatttccaaaatttgcttccattcttcgactccataaactttgacactctctcctccgattgccaaatatttgccggactggtcgaacgtgaggcagttaatctttgaagataaaaaataaaaattttgattttaaaagtcattcaccgattttttaacatcgtaaggcgcaaaacaggttacagttttttgattccgcaaatcccaaattttcacttcgccgtccgttgacccggtagccaaataatatccgttttcggaaaaagaaatggcccccaccgcctccttgtgaccctcgaactggaccaagctggtctgctctttgatgttccaaattttgacgatggcattttttcctccagttccaaagatgagtccgtcggggtgaatttgaccacagcaaatgcccagcaaatcatcattagatttgacctgagaaaatttttttaaattcgagtaatgtggttagcaaaggtgaagaacgattgttgactttgaccagtggacgtccagcgtggagatcaataaacgaccagtgtgagtcttctgaggaacagagcacgtaatcgccagtcggatgcagggatacgtctgtgacggcttttccatgaatagcaattgtatgaagtgcattgggttgttcagtgctccagattttgacctgaatgaaacaaaaaaaaattttttttggggggggggggacgtaattgaaaattagcagaaatattttaacaagatgaaccagcctttgaatcaaatgagccagagacaaatgtctctaagttttggtgtaggtggactttagaaattttagacgaatgccccaaaaaagttctccgttgggtatcagcatcaaatctaataaaagcaattgttttgtcgacaccaccgcttaaaatgtaatttttctgaaaataagcgacgaaaattaaaaacacaattatatttgttttaaaaatgcctgaaaatgcacagcagtaactgagccattgtgtaccccttgaaatgttatgccctccgtaaaattttgaatttgttccactgatgccaacccctcggacaccgggcgttgaaggcgtgcagtggagtactcataatgttttagggtaaacaactgcaaattcgtttgatttagtataaattttgtgatttagatttctgctaaataatcatattttataattctttaaaggagatttatacttttgaattttatactaaatattattttaattttaaaattcttttattattttatttaaaacccacaacccattctcacattgaccaactcctcactgatacccggtaatttcttttttcggtgttcacgcagctgggcaactcttcgtgcatactctatcgacatttttttgaacatcgaggtattaacggatgaggaagatgacaatgttgatgctgcttcagtggcagtgttacgcagtgcttgggctttctccctcaaagcccgatacttttttccacctcgttttgtactcttttttggcggcccggttgccttgaaaaaatagtaaaaattcaaaaaaaatttgattacatcctctcccgctattataagagcatcatcaacgtcgtcatcaccaccaccaccaccaccatcaactgcagctgctgcaagtgcacttcctaataaaaacggctcattgagtatttggtcaacggcatccaattcagcgtgggcctcttcattttttgcaatgtaaaatttttccaaggactccgcgtccttaattttgcacaatcgatataatttataaaaattgaaataccaaacaatcttcaccaatccaggaaattcctggaccccatccacagtcaagactctctgagcaactccataagactttataataagcaaagtcatttttacactcattacaatgtacaacagatgggccttaaaattttttttaaatattacgatggatggggggggggggggtaccttgcaaaactttttccaacactccatccccatcggtatataatttttgaaaatcggatgggtgagccttttttgcattaattataatgtcagggagatgctctccccgacatttgccggccttttctttttcttttttaatttcggccataaggcgcatctcacggcacctttcacattttttgcacgccctctttgggtttacaaaacattttggggggagggttttttttggctggggccattgagaatgaatgaatgatggagttggtatctgaataaatttatgtgcttcaaatataaaattttttttcatcccctttcaaaagctccctaactggtttactcataattagtcagcggggtgcaaattaatgcaccaattgcctcaaatcctgtgctagcacagaaccgggttgctagttaaagcaacacaacaacacagctgactaaaacaaataaaacagaagagaaattatgaaaggaggttaaatgccgaaaagcaattacataaatttttcaaatttggggaaaattttcgacagttttttacaccctcactcaaatttttctaacaatcttactcataattagtcagcggggtgcaaattaatgcacctattgcctcgaatcctgtgctggcacaggatcgggttgctagttaaagcaacacggcaacacaaccgactaacaacaaataaaattgaagaaaaaatttgtggagggggtgggggattgtaaaaatttgagagaaaacaaagttacaaagaattgaaaaaaaataaaaattggagaaaaaaaattgtgaggggggaggggattgtagaaatttgagaagaaaaaattattagaattgagaaataaatatataaaatggagtaaaaaattgtggggggggggggggggattgtatagaaaatgtaatatggattgagtgaccattgcagtggtgcgtccatctgtcgttggactggacatctctgacctattaaatacgttgagggcaaaaaaaaagtcaatatgccccgtctctctcagattaattctccctcccttcgccccgcatacatttatcaaagcgaattttttgaatttttgcttgggaaaaatatgaacatagttgtcggggcaaattacaccccccccccctccccacaactccgtacaatgaccaaagttcacctttcttgtcggggttgcccccgacaactcccgaaaaatgcgcgaatttagtgaaccccggcatctcggaaatttttcccacatttgcagagatgtcggggcccggaagttaatcaatcaaaaaattacccgcgattagcacacc

SEQ ID NO: 353 - DNA, 923 bp, Heterodera glycines
  misc_feature (96)..(96): n is a, c, g, or t
  genomic virtual cDNA Sequence=SeqID_682; coordinates=923..444
  coding sequence=SeqID_952; coordinates=923..444
  peptide sequence=SeqID_1174
ctttcgacagctctaataatcctaatttgcttgcaaaattaaaaaatttcgttaagtttcaaaaaagatattatgataaaatgaaaacccgtttanccgaacatttttggacccaactttggtggaaacatagttttttttgttatgttgaaattttaaggctatcggatgacattaaaatatgactttttgtatttttgctgagaattttagattttccttggtggtaccccccagacctagccctcatccaaattttccaaaaaatttcgctagattttcaaaaaaccgacaatttttgatgaaaatctgctaaaaaatggctcaaatgcgcaaaattgtcacttttttgggcaaaactcgttaataaaacgcattaaaaaatgcaaaaaattttcacggcggcgcctaacggcaccgccggacttccttcttcccaaagtttattgggaaaactgccgcaaaaaaggtcgtcgcccgggcggaggtactccccccccccaagccaaaatcctgggaccgtccctgcgccgcacctccgagaatatcagcatcagaatcatgccgacaaacaagcgcggctgctgcgacaggccgcgcacgcccgcgtcgcccaccacgccgatggcgtagccggcgcccagtccacacagaccgcacacgaggccggcagcgaactggctgaacccgcggtcgatggtgtagccgggcccggccgcctccagccggccggaaattatcaccgccaccaccagcccgtagatggccacaatgccggccatgaccactgaattttcggtttttttagggagggggtggaaaatggaaaaaattaattttaaaaaatgataaaaaagcgctaattctaaaacttgaaccaaaaagtcgaaattatattttgttgtttgagttaaggattcgaa

SEQ ID NO: 354 - DNA, 7360 bp, Heterodera glycines
  misc_feature (7133)..(7133): n is a, c, g, or t
  misc_feature (7236)..(7236): n is a, c, g, or t
  misc_feature (7281)..(7281): n is a, c, g, or t
  genomic virtual cDNA Sequence=SeqID_687; coordinates=6172..6035 ,5987..5757,5635..5498,5450..5280
  coding sequence=SeqID_1001; coordinates=6172..6035,5987..5757 ,5635..5498,5450..5280
  peptide sequence=SeqID_1212
cggggtcatggcagttcgtacaatgggactttcatacaatgttccaattgcggatttcgtacagaaaaaatatatattaaagtcgattttttctttaaaaactcttttaactacttgtttttattgcaatttttgtgaatgtttgattaacacaataaattatatttcctttcttaaaagcaagcatttaagttatgaaatcattgtctaaaactttcattggccaagttcagttgaagtgagcaaatcctccgaaaaagcccgaatgaattattattgtttacgtattaatattgttatttttggtacccattagctcattacttttttataatttgctttatttttgtcattttgattaaaagtaggtgtcgctgtcactatcacttattttttaaaatttaatattctacgaaacgtcaaattgaaacgttgtacgaaaccccattgtacgaactgctattgacccaatctgacgaggttttaccacaaaacagtaaaattttctattcctatacgggttttttaattacagactttctttttgccaacgaacgaagaaaaaagtcggcttcgcttagctgataataatttattggacgcataaagtttgatcggagcttaaaaattgatgggatgcacaaaagtcgattggacgcataaactggactagagccgttttttaagtcactaagatactaaacagaaagagggaaaataaattctatcatatctcataatctttaattcagatccatcccatttctgacaacgtttttatcggattgaccgggtttaacgcggacgccaccactgtgcttaacaagttgcgcacacatcaggccatttatgagatgcgcgagcagcgtccaatgtctcccaaggtattgtaaccggggcggagtcgttacttaaaaaaccatcattatgatttgatgaaaaattatttataacttagctgaaaagcaactgaatttttaattcttgatatcattctatagcccttagtgttctctaaaagtctacaaaatttcaaaaaaattcgttaagtttcaaaaaagttatggctagaggaactcaaaaaaccttgattttcgagcatctttggccctaactctttttaaacttggtgaaattttttgaattttgtagactgatagagaacacttagggctatcgaatcatatcaagaaataaaaatttggttgcttttcagctaaaacacaatatacttctagggacatgttttggcgcaaaccaatatttttgcgttaaaatatttggtgtttttgggcatttatcagacgtcaaaattgagagatcacgttaagtcatcgtttgttagtttgtcctcctcttcttgaaatgaaattcaagaattttaatgccacttatttgttagcgacagatttttttaattctgaaagaccccaaggcattttttagaatccccgaagatcaccaaattatcatatatgtgcaagggatgtctcgagacaccccgccccttctaagggggcgggggattgggtcgtgacgaagggtgaagtggaattttttttttatttgaaaaagctttaaaaattacaaattttccccagcgtcgcctatcggcaccgccggaccctcccctgttcccaaaaatgtttttggaaaaagcgcgccaccctcagaaaaatttgggccttcatatgaaaaattggtctcgagacacataagttcaagctattgctaaccgttcatttttcaggcgttgacttcctatctcgcttggatgctctataagcgcaggttcggcccgttcctgatcgaacccatcattgtggggctgaatcaacaaaatgagccgttcatttcccacatggacgtggtcggtagcgtaagtgagcccgaagactacacggtcggtggcactggtggcgacttggcgatgtctctgtgtgaaggtatttattgcatatttggttcataatacagcaaaacgaatatttctatttttgttagctctctggcgacccgatatgacctccgaagaaatgacggtggcggtcggtcaggcgatgcttgcggtggtcgaacgcgacgcatccactggatggggcgttgtcatccacacgatcactgcggaaggagtgaccacaaaaatgattaaatcgcgcatggattgatttgatcagctcctgtcgcttttgttgtattcgaaataagcgataaattcatatgcaaattttattcgttttaattgttttaacttgacataatatcttaacataaaagtgcaaaaaaaaatttttgactccataagagttaccattttattcgccttttgtgaagggcacaatgtacaaaattgtgcagcgaaaggaacgaaatgctgatggcacggcaaaaacagacgctgaaccttttgcaactccatcaacttcagcggttgtgcccttagtcagaattgcgaaggcaccccatcgtaaggccaacgacacaacagtagccaatgttcctgcggaagtgccgacctcaaataccagtgccgatggtctctcatctgccgctttaaacacagttcggacagaaatcgcaaaaagcgggggagtgccatctccagtggcgaaacaatcggcaaaagacgcaggggcaaccacgggtaattagggggttattctacaggatttgtaaccgtttttcaccaaaaaataaaatattatgtccctcactaatcatgataaatctaaagaccaagcccaaatggacgcatcgatccgactgattgacgatgaaatggaactgatcgacgctgtgaaggtgaacgacaatctctcgtagaagaaagtgactgttgctcatttgttcaggattttctcattgagtccaacacaaaatattcggtcattggtgcgattggggcacaaggtgaaggaattcagaaaaaacagcatttgatagagaatttaaggcactggcaagtcgaccatcctcagttcgtaaggttttctaatgatttgcacatcccttattttaaggtatgctcgccgggaacaatccggtggatatgtaccggtgggtggcagggatttttttggatttcgaagcattgtacaatgcgtgaattgagccaatgtatcactacagtacaagaaacgaaagtcaaattttaccgaatttttagtcttaaaatactttttgcctttggttttcggctaaatttgtgattatttcttcaaaggcttttccattaccagtattaagccagtacatttttcgtcctgctgcgagggaagctgttgaggcgtgtcgttaccaaaccacaaaagtctcagtgtatgttgtgcccaaactgcgcactttctttttggactgtcaggtaaagtttcgaaaataggaaaataatttataaaatttaatacaaaatgtttatgaaattttttagcccttaaattgtgctccacttctcgaggacttttgccgtgcgcgacgtgtcaaaggggcggaggcattggacgcaattgaagtggaagtaaaattttatgtgaatggaaaggtcatttctcttttatcaaatgctttttagagcctccacttgcttttgcttctgtactccatttgccattccgtcgtcctttgcgtcgattggttcatcgacttgagcattgtgcggcgattgatgcgcattgagctgttctacccaatacttttcccacaaagtgaagcacgacgagtgaatttgggtgattattggcattttaaattcatcctcattcaaaaaattttctattgttttcctattcagttgtccttcaccaacgtgccaaatccatcgatctcgagcctcttttggtgtcccaacggatgcgcacgttgaatgccatgtttgagacaagttctttcaacgttaacggcggactgacaatggccaagcttggattcggcatttatgagcatatttgtgccgatttaaacgtcaattacattttgttgggcgagctaaaaccccggacgagaatggatgaatttggtgagtgacaaagtccatttaattctctgaatatcttatgccttaattgatttatattttcttttattgaatgtcgcagaaaaacatgtgatgcaccaagatgattatgggacagtaattgcaaaacttcgccgtcagatataccaattgcctaatagtcgctcaattttcgctaaaaaaacagaggcccaatggtctgattttatataggtagttgaatattttaaaaaaatcattaacattttaaggtttaccgagctggcagaagcatggaagcgaatccgagaggaattgccgacaatgacagaggatggatgcacatttaagcgacagcgtggcattggtgcccattcacatttgtttggaattttaaatcctcggtactcatccttcagtgactccattttcacgcaatgcatccaacgatgtgtttatgttgaagcaacgaacggcgccgcagggaagtgaaattgggcgcgggagacaaaggcgaaggagccgtaagggaggcaccaattgggaggacaacaccggaagcatcctccggagagaagcagtgaattttaccgaaacagctacggatgaaaccgaggaagtggagtcgaaggccaacgaacatcgaaagacgacagcgacagccgagacagagggacaacagcaccaaaaacggagagtgtggcgaacgcgaaatcgaacagcacttgactgtaagaatatgacaaggaagcaatggaacatcgagcagaagacgaaggaagggtcatcattaaagcacaaatctgttgtagaatgggtggacagagagcagcagttagacgaaagtggaaggtcgggcacaccagaccatggagacaatgaagaatttgaccaacgggaatgaagtttctatatttgaacaacgataaaatcaaatgcttacgattagaaatagtgtttatttccttaatttgaaacagaatatacaatctgatcaaaagcaaatgtgtgtcaaagtcattttgccgatttgagtccaaaaaaacttataagccgtatcaagaaatgactaggcaggtcccttgtagaattggttttaatgccgtagatttttttatgcggcttggcgctattatcaaaatttgttaaactctaaataaccagaaaaaattgcaaattgaacttttcggggttgtgtctatgttacaatccagatacgactaaatcatcgtggttaggtcagtggtgaatggtaagagcatttctgatcggattgaaaatatgactctcctcacgcatttgcccacgcttccaattcggcaaggtcctcatcctcctgttgcttcttggccaccgtcttttttggcaactctttcggtgcgcttggcaatttgtctgcaacacttggcacactatgtgccggcacaatacccgcgtcgagcaatttgccactcagatcctccttaaacacattttagttgggttgcaattatatttgttgcttatcacctcttccatctcctcaagttctttgagcagttcttcatcgtcaatatcgttctgaagtcccactgggttgctgatggcagttgcgatttcgtttcctacttcctgttgctccgcaatttcttccatcatatcgtggacctgaaataacattttacaataaaagggtgaaagtcagttgtgattgaatttggttgcttcaattcgtaattaaatttgtacaaaatgtattggcactttcagcaaatgcctttggcgttactttgtccgcgtccatttcattgtgcgcctttttcaacgcttttgctgattcgcctatcactccaagcacatcagagttcatggacgcgttctccagcgcggtcttttggtggtggatggtgttcagcactcctgcaatgtgttccaattgcttttcatagcccttttttcgcctcagtgcctgcaacgcgacccttttatttgccgcttgcgcacgtgccgtggcaatttcctaaaaggaggaatttaacccaggggaattcaatctcgaacaattactgtttcgattttcttttccagaaattcctgcttcttttgaaacatgtcttccctctcttgcagcttctgcaatacttcttgtgtcgatggagctgcctcttgtttttttccaccaaaaattttgccgaatagactcattttttgtctttttgtcggaagaaattaaaatgctgcaatttaaatgatgaaatatcttttaaaaacaattaggtaggtaataaaaaatcaaaaacaaagctttaggcatttcaaaattatatgcagtgaatactgacaccaaagcggaatgattcacgttatcattacattggttagcagttagcctaaatgggttcagcaatttttattctttttttactttatggcgttttatattcctataaaaagaatgagaatttggagtgatcgctttttatgtttgccgcgtccgcggcgtttgaaccaataacagttgtatttttgtgatgacagctccaacttcggcagttgtgcgtgagcaacatttggcccttcggggtctgtcaatgtatattacaaaatgttaccgaaatatttttgttttaagtgatgcgactgtccaatcccaaatttcatgagaccatttgcttgggccgcgatccggccgatcctttctcaatggctatttgtgattcgattggcaaattgagtggtcaaagttctgtcgatttgccgcttgattcctacttaattgcaccacatgcgatgagatgagtttattaattaaatttatttttaaatgctttcaagttttagtgatgtttatctcggggaaatgttcactctttacatttcaatcatcaacattagctctgtcatttgcaaagaaatagccattaaggtcagcgaaactccaaagtaggaaaactcgttttgttattttacaaccaaattcagcttaggtcgacattcaaactcagaatcagcgcgtctctctcggagaactggccttcgccggaattgcccttgagccgaaccaacaaattggccaaatttttaaacatgacatccgggaactaggccaacacatgtgagttttgttttgttttttactagatcgttcataacctaaatatcttgnttttgtttttttaatttcaaaaaaaaaatcaatgaaccgttcgaaagctctgatgattcgctataaaattaaaaaagtgatattccgttcttaaccagtctanaaaataatgaattttaatcgaatgataccatacgtaagcaactanaaattattgttttgaatttgtaacgtatatatataaatgagtcattttatgataatatttatatctaaacataaatcta

SEQ ID NO: 355 - DNA, 6512 bp, Heterodera glycines
  misc_feature (45)..(45): n is a, c, g, or t
  genomic virtual cDNA Sequence=SeqID_688; coordinates=1459..1515 ,1594..1676,2023..2185,2387..2485,2559..2636,2823..2926,3042..3218 ,3455..3576,3665..3886,4607..4695,5024..5212
  coding sequence=SeqID_835; coordinates=1459..1515,1594..1676 ,2023..2185,2387..2485,2559..2636,2823..2926,3042..3218,3455..3576 ,3665..3886,4607..4695,5024..5212
  peptide sequence=SeqID_1075
ctcttttacaccggcctccctttgctgcgaagaggtccccatccncaagtttcgaccttttgcgggcgaagggggggggggggggagtctaacaataagtcgccgggccccgtcaatctttataagcctaattgtcctttctgattgtcagatgctttggcagacattgggccgtaacatttccacggttccattcggtgagcctccgtccgccttcgttttgctctgtcaaactttgctcggcgctcgttttgtccaaacggcacacttttgcagaacgtgcgcagtgccatcggccaaaaagcgttgcaaagattgtaaagtaaaaattccatggtttttcttaacttttatgcattttttcattttcagacattttactgttccgtcgaatgccaacgatttgattggggcgttcacaaaaagtgttgtgaggcaataaaacaaagaaattttgaccaaaattgtacagcaacaaattttgaggaattaaatatttcatgagtttgtgcagatacactctttattattaaacacttccgtctgaattgtaagcattcgttttcatgggtcaacgacactttctggcgaagtcggtaaagccgcttaatacgctggaattccatcggtcacctacccctccccccaaaatctcttggctaaaatggtgactaaatcaaatccctccgcttttgttttgcccctctctttcgcacatatttttgcagctccgccgctttggctaaattcctttcacgccgccgtcgaattgtttttgctgtggacaaaacaacaaagaatcaccccgcccatccgaccacatattttgggatggatcatccgggggatataaacccctggggcggggggggggtaattgtgtgtgtatgtttggcggatcggccaacagttgtttggctgggtgtgtgggtggaccgatcagcaacaaatgcgttgcgattcatccaaagcgtacgggcccgagggtatattcaataaaacaaaatcgattgaatgaaacggcttttacactttgtgagactcaattgttgttagctttatatgtgtgggaaagttatattgtgcagtaagctgacattttttacaaaattataaaggactaattctcgagcaaatgcgacaaatgtaagcctaacatactctgctgaccacggtcacacataaaacaaataccccaattttggtggattttcgtccatcggccgaagcagaaggcctcagatttgtgccaaaatgtgtttatttgaagaatatcgatcagccactgcttttgcatattttggccttgcggtgtttgtttcgtttcctttggaaaggacccaattttatgagttttttttcagttttccctttttcaaccattttcattgtttagggctttcctgtttcttttgttaacatttcatttcgtctttttttgttgtaaattttgttgccatgtcaatagcgcccacttacaaagtgcacaagccaaatgtgcccattctcatggaggttggacattcattcataacatttgcaaatcaaataaattgagccctttccaaattaaaaagtggtggacattttcaggacatttttggctgggttcgcgagggaaattcgttccaagtgcgcgtttggttggacgactctgagcacgatttgaatgttgggtaatgtgaaggggcggtggacggaattttcgatccaaaaacacatttaaccttttttgacacgttaaagaatttagtaaatctaaaaaatttaccatttttttaaacttgaataacaaatttggctgagtttttgttatttgtggagtttgtttccgttttggttttattttttaaatcttaaacgcgatttaaacgaaaatgtccagtcctttaaagttcttccgcacaaaaacggaaaaatgtattataaagtattacgcatgccaaatcacgcttttattctagcttaaacttgccgcatcgattcgattgaattaggtaataaaatcaaaaatatttccagggatgaccatgccttttcgctgctccactgggcctccaaggagggccacgtgtccatcgtggaaatgctgctgtcccgcggcgcacgtgtcaatgccaccaacatgggcgacgacacggcactgcacttggccgcagcgcatggccatcgccaaattgtggtggtacggaatttgggggggggggggtaagggtaattcatttcttaagcttccgtgccttgacacgagttaacgaattccattttttaggtcggtaacagaaaatttttgaattttaaacttacaattagctgtcagaaaataaatccaaaaattcgtccggcgatgacacctaatgaacccaccattaaaaatttacttcagaagctgctattgcgaaaagcggaggtgaacgtgcagaatgagcatgggatgaccccgctgcactacgcctgcttttggggctacgaacaaatttgtgaggtgtgtttttaagccgtgcctttgcttttgctatgccttgtgctgttttcattgcttttcccccacttgttaggatttgatccgttccggtgcgcttaccacaatgtgcaacaagcgcgggctcaccccgttggatgtgtgccaaccacaagtccgacagtccgtctatggcacgttttttctttttttttgggggggctgattttctgaaaatttctttttgaattaaaaaaaggtgagagctttttaggaaaaaccttcccagcaaaaaaaaaaattaaatgaattttctttctttatttctcatgtggccaattagaaatcactgctttcagagattgcgttgagcaatggacagaatccgcagcagaagatccaatacagcggcgacgcgtggcaaaacacaaaaacatttcgttcacgcgacgcgacgtggtcacggtatgttcaaggggaaaaaacagggagcaaattccggcgttttttgaatggcacctttctgtgtcccttcttccgctttcccaattgatgatccattgtcatcattttcccacagatacaccggcgttgacctccaatcgttggcgctgaccaaacaaattgcgcagtcgcattccggcattttgtaccgcggcaaatggcagaacaacgacattgtggcacgggtgctcaatgtgccgaatgtgacggagcgaatatcgcgcgattttgccaccgaatttttgcaactaaggcgagttcggaaatgaaaattcttgaagcttggcacgatgagagaggccctttcattcattttaaagaaatttatgccacattccgaatgtgtctttcaaaatcctaattttaaaaaaatgcccaatttttgccttttaaattttttttattggattggaaatatacttacaattatcaacttttttgaatttcccattttctcctttttaaatgggggtattgttttttgttaagaatattcgccagtgccttcgtcaaccccgtgttggccgtggtcaaccaaccgccccaactgattgtcatcagccaattcatgcctttcggctcgctttacaatgtgctacatgagcagtcatgtgagcaaaaacttaagcaaatatatgtaaattgatagatcttttgcaatttgaactaattaataagacaaatttttgcaaaattcagctgtggtcatcgaccaccaccaggccattcgttttgcgctggacctcgcccgtggcatgtccttcctgcactccttggaccagcccgtcctgcgatattatctgagctcaaagcacgtgctcatcgacgaggatttgtccgccaaaatttccatggccgacacaaagttctccttccaggaggtcggccgattgtattcgcccgcttggatggcgcccgagggtaagcaaaaatgggcaaacggaagaaagggattcccacggtctttgatgggaattcttctgttacagagaatcgggagtctcgaaaaaaaaatttttttctcccgcgtgataagaccgaacccgggcttttaggaatggaacccaatcggaaacaaaaattttgtatttgtaaaattttgggtctaaaaataccttccggaataaaagataatcgtaaacacaattgtatttaattataaacttggccaaaaatctcatccggaatgaaaactcggaaacacaatttattgtagctctagcgcttatccggaaaagtattttccggaattgaatacaattgtgtttagtgtaaattaccatcaggaaatcggaaatacaatttttattgtaaatttgggcaaaaacaccatccggaattgtacacaatcggaaacacaatttttgcatttgtaacgcttgttgttaacccggaaaaatatttccggaatcgaatacaattgtatttagttgtattgtaaacttggaccaaaatacaatctagcaaatcggaaatacagttgtattttattgtaaatttggacaaaaacaccttccggaattgtacacaatcggaaacacaatgcaattagtggtaaacttagaccaaaaatacatccagaatcaaacccatgggaaatacaattgaccatttgctttttctattccattgtttttttagcattgcaaaggtcgcctgaatcgctgaacactcgtgcctcggatatgtggagctttggcattttgctctgggagctgaacacacgcgaagtgagtgccatccatccttttttaagctgggtttctggtcaaatttcgtctccagttttgaacccattggttgacacatttggggctccatttaatctgcgttgggattctgtagtatacagtaaactcaaataattggtatcgtcagcaacacgttttagcatttaatttggagattcgtttggtttattgggtcattacccaatctgtcaaattgtcatgttcagtttttcaataattcccatccaaaatccccgccgtttttcatttaaacccttttccttttttgattttctgcacatttctctcccttctttctgtttgccaggttcccttctcggatctgtcgcccatggaaattgggatgaaaattgcgctggagggactgcgagtgaccattccgccgggcatttcgcgaaatatgttccgactgatcaacatttgcctgaacgaagacccgggcaggcggccgaactttgaccaaatcataccaattcttgagaaaatgggccactgatttgcctattttagatcactactaatcagctttattacaaaatttttggcgtccgttacaaaatgatcatttttgaaagtgcaaaatgcggatgccttttggtttcaaaaattttctctttgtgcataatttgcttatcactttgctttgtaattagcgccaattttttattcgacaagctgattgtcttccgtttaattggttcttttcttttttttttgttactatatcttccaaaaagattcgaaccatttttaatttctaaagcccattcacagcaatgggacaatcagcttgtcgtttttgtgtaccattatattgtcccagaacagtaatcacaaattgccttttttatttttgtattcttttttgtacttgaaaatcatttaaccctttcttttattctctacattaaactaaatttaatttaaagaaatttttttatcttttttatttttgtgaaattaacatatttttatgcgcttttccctaaccaaatttagcccatagttagaataaagcgaaaacgcttttttaattcgaaaatgtttgctacaccggaatttatggatgccgaagacagtttgatggagatgaaatcgaatcagttcaaaatggacaaaaatgagttcattgccgcggagaaattgatcgacaaggtaagcaaaataacattttaatgatataatgaaaaatgaaattgcttacatttttaggactactacagggactttggcgatatctttgacccggatgtgaagtaaatgcggctactttttgtgcggaaataagcaaaatgtaatgttgttgtttttgatttttgagacataaaattgtgtatgaggtatatgaaatggaaacaatgaaagcgtagaaattccagataattggagatcacaaatgagaaaataatttccatcgggccgttaaaacatggtgatttaatcttttctgtcgcagtttggcgttcaatcagtcacccaatcgaaaagtgtaaagccatctcttccgtctagttgaactattttgtttggtattaattgagggtaattaagcgacttattaacggttaggcaatgaaacaaattaattttttggggtgtttaatcacgcccaattccgattgaacgtcaaaaaactgcaataggttcaatgtgatcaaaatggtgtctcatatagtgaaataggcattgatagtctctgatagggcactttgtgtgtttgttgtgtctttcctttgtgctccccgcgccgtgccatccctcacatttgccggcatcgaatgacgtgagggccttct

SEQ ID NO: 356 - DNA, 2443 bp, Heterodera glycines
  genomic virtual cDNA Sequence=SeqID_689; coordinates=1609..1427 ,1190..992,891..673,534..306
  coding sequence=SeqID_884; coordinates=1554..1427,1190..992,891..673 ,534..430
  peptide sequence=SeqID_1114
ataaaaacatgaatccaaaacatgaaattcgaaaaatttgaattttcgactttttgttcgaattcgggtccgggattaggaattggcccaaatggatgtgcattcgtgatcaacgaccccgaaaaccccctaaaacctatcttttaaacacttaatatataggcgctttaagctttcgtttgatatcaatgtaggtattgatcaagtaagaaaaatggatctggcttttggacccagcaacatccagacccggcaatacccgtaccagtataatactattcttttccatcaatatatataaaatattgatattcaaaatttattgctaaaacaatatatgtaagttgaaagaatagcgacggatcgcacataacaaaataaaatggtgaacaaaggcacgtagacacaaaatgacgctgacattggccatcattccatcttcacaacgcccactttggctggtcgaatcggacggtcgtgcaaactgtacccaatgttcaacacatgcgcaatgtgaccggcaggcctatctgactgcaaattgaacatattcattgacttcataccattaaaatgacagaatgccaaatactcctaggcacatataataggaccttttgggaattttgctgattataaattgcaaatatgcccttttgttgcaattcttgcctggtccttcggtatttcatacaccgcttcgtgcaaattcgggtcgaacttctgtccttcgggttgaaccggtacaagcccatgctttttgaacgtcttcagcaacacttccttcgtcattttgatccctttgttcactccactgtccaaggaggcggcaccgtcctccgttttcattttttccaacgaattcaacgccaagtcaagcacatcagccacctggaattttaaaaatcaaagaggactcaatcgtcgtttcgggctttataaaacaaatgtgttgaatatattttcttaactgagtatgaatttcactaacctccagcaaatccttgcaaaatggctgaattgcaaaaagttttgcctcctcaatttgccgctgcgttctcttccgcaagttttccatgtccgcaagtgttcttttgtatttgtcggtcagcatttcgttgtcgctcttcagcttttccatctgctcgatttgctcccgacattcctgactcattccctcgtgttgcgttctgtcggatgagaaggaataggaacggagaaagatgagccctgccccttctagaaacagaaatattccactattttttatcgtccactttgcgcttacctgtaaaaccaaaattatttgtattgttcgacccggtaggcttatcaaatcacgcatttttgtccatgtgattggtcgtccgtccctttctttccctttttttttcaccctccccactcctatctattctaaacccactgattgtttgtaggggaaggcggcgattgtttgtcggacgaagcgctcttcgttgtgccgaactcgatgtgttggttcatcttggagaagtaccttcgcaaattgcagctcaaaattcgactggtcattgccgcttttaaggaaatgaaaaacagaggagagagaagcaaagagaaaattttctggaatttggatatttatagcataagcttccctagggaaagacaatttgagtcaaatcaactctcgtttaattttgctgatctaccaaatttattatctctaatctaacgaaacctcaaattggcataacgcataataattagagagagcagagaaaaatacactctcattttggcatactcctattctttatctggaaaaagcagaattcgcacagtaaatttttttttaacgcatacctatttgagtggaaagttttttatacttaaattaggtaggaagaggcaagaactagggatcttttgtatctaaattcgtcatgatgagtccggggatgaatgaaaaattacaatgttttcctattgtggccattaattattgaaatattttttttgttctaaatcctcaaaataattctttatccgctaaaaatattaatcatttattcattttagcaaatatggatttgaaagggtcaagcgaaaggacaaaaagaagggagaggaaacggcagcgaagctcttcttcctcatcttcatccagttccgagtcaagtgcatctaccgacacatacgacgaaggttcaccgggcagcgaagaaaagtcagccaaagcgcaacactgaatgggccagaaacagagacaaattattagttttagggccaaaaagtcatcgaaaagtgctggacggaggtattcgtcgtccagcaaaggtcggcaccaccacgcgcaacagcagcagacgacgacgcattcccatcgccaccattaccaacatcatcagcatcattcgtcgtcaagaagatatgaaagaaaaatttcttcccatgaaag

SEQ ID NO: 357 - DNA, 2378 bp, Heterodera glycines
  misc_feature (2338)..(2338): n is a, c, g, or t
  genomic virtual cDNA Sequence=SeqID_690; coordinates=23..166,223..303, 349..558,631..775,1088..1275,1318..1394,1440..1547,1626..1732 ,1779..1943
  coding sequence=SeqID_1022; coordinates=143..166,223..303,349..558 ,631..775,1088..1275,1318..1394,1440..1547,1626..1732,1779..1876
  peptide sequence=SeqID_1229
gcgcatttttctatcctagaaaaaatgcttcttaaatttttaaattaattttacgcagaaaccacaaaactgcaccattgcccggaaatccaatatttattcaaaaaaataatcgttttcaatttgattttaccaattttcaatgggtagagcacgtagaaaaaaggtaaattaaatcatttgttaaaaatataatttcgtttttcccaacctaatttacaggggaaaactgccagaagagctcggcaaggattgcttggatttacacgaattgcaagagaaggaaagaagccaaaacaatttgtgagcaattttatgctggttttaattctcagaaaatgtttttaggagaagagagtcaatcaaagactggacagaaaagacgatgttcgaacggaggaaattttgcgtgaaaatattgccggacaaaagacccaagaggagccgagaacgccgcatgcatttgtaattcactcggcaggagtgggacgatatgtgcgacagttggagatggacttacggcgggtgatgagtccgaacacttcgaaggcattgcgggtgagaatttaacaggaaaaattaatttaagataagaaaatattttggtaaatcaacaaatttcttgtttaggtgctgaaacgcaacaaactgaaagactttgtcgtgcattcgcaatttttgggcgtctctcatctgatcatcctctcgagaacagaactttccacgcatttgcgcattattcgaaacccgcaaggcccaactttgcacttcagaggtaacagtgaagaagagcccatcagagggggagggggagagaaagaagtgcacactgaaatggggaattataaatttcagggaccgttggtcataaatccgtatctgtttcaagatttggttttaagcgcaggtgaaaaattacacctatcgaattcccatttcgagcacgtgaattcatttttacaacaaatgtaattttaaaattgatgcctaattcgtgagttgaattcctggaaacctaccaattgatattttatacatactgagaatttgtttttatgacaagagataatttctgaattttaaatagttgaaaaatattcgttggcacgcgacgtgctctccgtgcagaagagaccggtcatctacgaagaactgttccaacacgcgcctttggtggtgatgaatgggttttccagtgaagacggcagcaaaaaacatttacaattggtgcagacggtggtgcagaatatgttcccttccatcgacgtggacagagttaaagaaaagtgtgaaaattggcttactttttgagtttaggtgaaactcgcgtccattcgtcgcactttgctattaaactacgacacagaggacggactgatggagttcagacaatagtaagtcttctctaagttgtgaccttttgcaatgtttctctttagctccataaagtcagtgcccgcgggcgtttctcgttcggccaaaaaactgatgcagagcaaagtgccagacctgtccaagtacaaagacatcagtgacttcatgctcaagtgcgtcatcctcgagattatttgaatcaaatgcaaaaagaaattactaatccaatacatcactttctatctattcagaccggagcagttgagtgacagcgaatttgaaggcgaacagacggaattggagctcacgcaggatattggcggacggggcaaaaaacgaggacagcaaaccaaattgagtaagtgatttctcgcaattacaaaaataaggaattcatcccatagggttgatggaaattggaccacggatgacattacgtttgatgaaaattgaggaaggcgtcaacgcgggcactgctctttggacacactcttcaacataacatcagattcatattccaaacacgtttattttgtttttatgcatgtgcgagaaccgtttgatcaaacattcgagaaaaactttttattattctaaaacagcgatgaaaagtatgcagtatttcaatcacaaatcgcccttccgtccacgaaaacgggctcgaggatcaatgttgtttcgtttgcactcggccagtgaatacatcaaatgaatgcaatgctgaggcaggtccaattcttcgtgacactccctggccttcttccgcttgatctgttcgaaaaactcagttagtgtatatctcaattaaaaagtagaaatagacctagtaacaagcaaacctataagcgcacaagggtacattccggactgtcactgctcagatcgctttaaaaccgcccttatcgtgtagagcatagtcgatttgctactgtcaattttcggcttttttggcacacagcgtcanggggatcagaaaaaagtgatcaaagtttcgaaaaatcgat

SEQ ID NO: 358 - DNA, 7455 bp, Heterodera glycines
  misc_feature (7413)..(7413): n is a, c, g, or t
  genomic virtual cDNA Sequence=SeqID_691; coordinates=6341..6598 ,6644..6775,6866..7059
  coding sequence=SeqID_851; coordinates=6341..6598,6644..6775 ,6866..7059
  peptide sequence=SeqID_1089
attttgcttgaatattaatttttcactaaataatttaaattttaggcaaataaaaatatctttttccgcttcctttttttgtgccctgcggcggtgccgcaatattttctcacgcaaatgtacaaaacattgtttttgtcttcatcaattaataataatacatgtgtctaacaaataagcattgttggctgaaataattgcggtaaaacgaaactttgataaattaattaattattaatttaaaattgcaataatttccataagggataaaaaaataattcaattttaaatgttcttcaattaatttacatgcatttaaaatagttaattcatgtgaatatttgatttttaattactttccaaaagcatttcaattattaaatttaatgggattaaataatatattttttatatttttaaacaaatttttttaaattatttttgaaaaagcattttaaattaattttaagcaatttttaatttaaaaactcctcaattttttaaatttcgcgtttttgtttcaattcgggttaagcaattcggaatttgtcaaaatgaatgtgaatttcataatcagccaatttaattttttaatatttaatttttaaaaaatttttatttatatttcacagtttatcctctcatccgatgggcacatttcgtccaaagcattgccaccaaaggcatcaccgaatgccatccccgccctctcgttgttgtgccatcattttgttgattttgtgccacaatttgccattgattttgcccattctgttcctggaagacggtgagtgaccaaaacagaagcgaaattttcaaaaatttaaattaaaaaaaaaaaacggaacccgtcagttgggcgcgcacggttgggcgccagcacgtttttccaatatagcttttttatatgttatccaaatccaacaatcttggtatcattcgaaagctcttaacatgctctattagtctacaaaaagcgaaaagattttcaagcctagaaaaatttttattaagaaaaaactttaaaatttcgagtttttcttaattttcatgtataacttttttgatacttgtctaatcgcgaagcaatagcttagaaaaagtttctaaatacattaagctttcgaatcataccaacaatgttggatttggatgacaaagaaaaaagttgtagaaagttatagtggaaaaacatgctggcgcccaaccgtgcgcgcccaaaagtgagcgcccaaccgtgggcgccaaaccgtgagcgcccaactgacgtagaccgtgttgatcaaaaaacaaaataaaaagtaatcattttatttttaaattagcgcaaatatttttctttggcgttgtatttaagattcaaaagaaaaatttcgaaaaatttcgtaacgaaattttcgttttcgtaaaattcggaaaaagattttaggaaaaataacggagaaaaatacatttttaaataaattttattcagattttatttgacgatattttcattttactgcacaatgtcgttgattggaattgattttaaagctcctcttcgagaagtaaaaaatgtccaatttggcattctaagtccagatgaaatagtaagttttaaaaaagaaatatagaaatgacttgcaatttaagaaacgcatgtcagtttgtgacattgaatattccgaaacgaaagaaaatggaaagccgaaattgggtggacttaatgacccaagacaaggtgtggtcgacaagaagggagtgtgcatgacttgtgccggaactgtgaatgattgtccgggtcatttgctcgtttggagttggctaagcctgtgtttcacattggttttttctccaaaatcctcaaggttgcttttaaaattctctttgcaatttgatttattttaattgcattttcttcagattcttcgctgtgtctgtttctcctgcagccgtttgcttgttgacaaagatgacccacacattaaggaaattttaaagaaaacctcgcacaattttcgttctcgacttggtcttgtgtatgaacaatgtaaaaagaaaggaatttgcgaaggtgcggaagaattgccaccgaacccggacgaatttgaggaaggggagaaagagcaaaaggcggggggctgtgggcgttatcagccttcatatcgaaggaaagagatcgaaattcatgccgaatggaaaaaacacgtcaatgatgacacgcaggagaggaaaatcattttgacggcggagcgcatccttgagatatttaaagcgatttccgacgaggattgtctcgttctgggcaagttttcaagttatctgagcaaaattctaatcagcaaagtttttagggcttaatcccaaattttcgcgaccggattggatgatttgccaggttctgcctgtccctcctctgacagttcgtccatcagttacgactttcggttcaataaccagtcaagatgacctgacttataaattatccgacattgtgaaggtgaacaaccaactcaaaaggtaacacttccgtaaattgatgcgtttcttcaattcgaacattggtttagaaatgaggctaatggagcagctgcccatgtaattgcagaggacattaaacttctccaatatcatgtcgccacactcgtcgacaataatgtcccgggtgttacacaagtaatttactcgacttctcctcacattcttctaagaacaaatttaggcactgcaaaaaagtggccgtcctttaaaatcaattaaaagcagacttaaagggaaggaggggcgaattcgtggaaatttgatggggaaacgagttgatttttctgcgcgaacagtcataacgccagacccgaaccttccaattgacactatcggagtgccaaggacaatcgcacaaaatctaacttttcctgaaattgtcaccggactcaatatcgaaaggcataattcttattgttagcacttaaactaactgtgacttcagattgcaaactctcgtggcaaggggcgaccgagaatatccgggagcgaaatatatcatccgcgataatggagaccggattgatttgcgttttcatccgcgatccgctgatttgcatttgcagcctggctacaaggttgaacgacatatgaccgatggggacataatcgtgttcaacagacagccaactctacacaaaatgtcaatgatgggacatcgtgttaaggcatgactgttttatttgcaattgttattttggattattacgatagatcttaccttggtcgacttttcgtatgaatttgtccgtcacaaccccttacaatgctgattttgacggagatgaaatgaatttgcaccttccgcaatcactggagacacgggcagaaataaacgaaattgcgatggtttttattaatttaaagcaccaaatataacccttaccttttctctaaaaaggcatctcgacagttaattacgccacaggccaacaagccagtgatgggaattgtgcaggacacattgaccgcagttcgaatgatgactaaacgcgacgtttttattgattacgctcgtctcatggatttgttgatgcatttgccaaattgggatggaaaaattccgcagccagcgataatcaaacccaagccactttggaccggaaaacaagtgtttacaaagataattccaggttttgtcaaatgaaacttttcctccattctttgttttgttctaactaaggcagtgtcaatgttatccgaacacattcgacccatccggacgacgaagacagcggaccatacaaatggatttcccctggcgacaccaaagtgctcattgagaacagcgaacttctctctgggataatttgttccaaaactgttggcagaggttccggaaaccttcttcacattgtcgcattagaattgggtcatcaaattgctgccgagttatatgccaacatacaaactgttataaacgcatggcttctcgccgagggacacaccattggaattggtttccaattttactttacaataattttgttcaactctcaggtgacacaattgctgatacttccacctacagagatatccaggagaccataagaaaggccaaacaggatgtcattgatgttatcgagaaagctcacaacgatgatctcgagccgactcccgggaacacacttcgacagactttcgaaaaccatgtcaaccgaattctcaatgatgctcgagatagaaccggagcttcggcacaaaaatctttgtcggatgcgaataattttaaggcgatggtcgttgcgggatcaaaaggatccaaaatcaacatttcccaggtcgctcaatacaaaagtgttttttattgttaatttaatcattcaaggtgattgcctgtgtcggtcagcaaaatgttgaaggaaaacgaattccatttggatttcggcacagaacccttcctcattttattaaagatgattacggacctggtaactctaaacagtactttcgttaggttttgccatttatttacagaatcgaaagggttcgtcgaaaactcttacctcgccggactaacaccggctgagttctttttccatgcaatgggaggtcgtgaaggactgatcgacacagctgtcaaaactgcggaaacgggctacatccaaagacgtttaatcaaggcaatggaaagcgtgatggtcaattacgatggcactgttcggaattcgtctgggtatacagttttcctttattttttaataaaggaaatgctacaaatagggctgttattcaattacgttacggcgaagatggactggatggcatgtgggtggaagaccaaaccgttccaacgcacaagccgaacaacaatttattcgaaaacgagttcaaattggacctcaccgacgaacgacaactgcggaaattatacacagaaaacattgtcaaagaaattactgtaagtaactacaaaaaatcatttcacttatatgactaaatccaagaattctgccgatgctcttcactcggttgagtcggaatggcgaaagttggaggaggacaggaacattttacgttcaatatttcctagaccaagcacgaaagtctatttgccttgcaatttgaacagattaatcaaaaatgcgcaaaaaatctttcatgtttccatgaataaaccagttgatttggtgagttccccaatatttttggcatgtccttttctttatcttccacagagtcctgtccgagtaatcgaaggggtcaccgaattaaccaaaaaactggtcatcgtgtctggagaggattctattagcattcaagcccaacataatgccacactgttgatgaacattttattgcgttcaacactttgtgcaaaacaaatggccaaataccataaattgaatcttgaggcatttgaatggcttcttggcgagatcgaaactcgctttgaccaggcgatttggtgctggtattccatatttatgttttatcgtttaaggctattgcacaaccaggcgaaatggttggcgcattagcggcacaaagtttgggggaaccggccactcagatgacactgaacacttttcactatgccggtgtttctgcaaagaatgttaccctcggtgttccccggctcaaagaaataataaacgtgtcgaaaaagccgaaaacgccttcgttgactgtttttctgaaggtttttgcaaatcggttttacactcatttaattgattggaattttatagggaatagctgccaaagacgcggaaaaggcgaaagatgtgttgtgcaaattggaacacacgacgatgaggaaagtgacttctaacacagcaatttactacgacccggacccacgcaacacatgcattgaagaggaccaggaatgggtcaacattttctacgaaatgccagactttgacccaaccaacgccagtccttggcttcttcgccttgagctagacagaaaaagaatgacggacaagaagctgagcatggaggcaattgcggagaaaataaaccattcgttcaaagacgatttgcaagttatttacaccgatgacaatgcggacaaactcgtgttccatctccggctgagcactcaatcttccgataaagaaggagaggtttgaaatatagtcaattatagtgtgatatattaaaaaaggagtattaggaacaacttgacaagatggaagacgacggcattttgagggcactcgaacagaatattttgagcgatttgacacttcagggcattgagtccattgctaaagtgtatatggtatatgcgaaaacattagaaatcgacttaatcgttaactgattaagcacaaaccaaccaccgatgacaagaaacgaatacatattacagcggacggaactttcagcactcaggcggaatggctactcgaaacggacggaaccgcacttctgagagtgctaagcgagccggacgtcgatttcattcgtacacacagcaatgacatttgtgaaatcttcgaggtgttgggcattgaagctgtccgcaaggcgattgagcgtgagatgaaccaagtgatttcctttgatggatcatacgtcaattaccgtcacttggctttgctttgtgaagtgatgacggcgagaggtttctttggttgtttattatttcttgaaagttaatctttaaaagggtatctgatggcaattaccagacatgggatcaacagacaggaggttggagctttaatgcgatgctcatttgaagaaacggttgacattttaatggaagcggcagttcacgctgaaactgacccggttaaaggtgggtaaacatgccgttttctactcggacataattttgcaattttactgcaccggttaaatgcttgcttctatcaacttcttatttcaggagtttctgaaaacattatgcttggacagatggctaaggcaggtactgggtgttttgacctcgtgctagactccgacaaatgcaaattggcaatggatattcccgattttattatggcgaagtcagctggcggtctttttggtggtggaatgtcgccaccagggtttgctaataaacggattgatttgttttaacgtatgttattatttagcgccggaatgagtcccaccggaactccgtggcatgctggtgttactccttcctatgcgggtgattggagtccaatcggtgcaggcggtgggatgacccctgctggttctttctcgccggcagccaattacgggacaacatcgccgagctactctcaaacatcaccaaattattcgttgacatcgcctcagtactcaccaagctctccacgctattcggcaacaagtccaacctacagtccgacgtcgcccagctattcaccaacatctccgagctattcaccaacatcgccgcaatattcgccgagttctcccgcgtattcgccaacaagccccagntacagccccacatcaccaaagtattctccgacatctccaagc

SEQ ID NO: 359 - DNA, 2716 bp, Heterodera glycines
  genomic virtual cDNA Sequence=SeqID_709; coordinates=1288..1250 ,1201..1022,976..596
  coding sequence=SeqID_996; coordinates=1288..1250,1201..1022,976..851
  peptide sequence=SeqID_1208
tcaaaccgcccctctctctctcctaaaataaatttgccattaattttgcacccgaatttcccccccccccctcctaacctcaatttcctccgcctcttccttttgcgctccgttttggtttctgtccgcgttttctcctccgttccgtcgttcttcgccaccgtcgttcatcgcattgttcccaatgccctccaactttttgcccaatttctccaataattttcggttttccaccacttcgcttttaagcgtttcgatgcgtctccgaatggcattttggcgttcctttgtttcgacattagtaaatgagtttactgagtcccttttccacctcaaatttgcccccctcgtcgtccccgtaaagtgccgtcctccgccgcgcgttcgattccaccgacagataaagcatcatactaatcaacatgaacgtaccgagcgccaacgccacggcccaaatattgccccgggaaaacagtggcatgcctcctcaaaaccaagtcaatgtgttaaaattactacaaaaatttcgaaaattgacgcattaatataatcggtttttgtcttttataacaaatcgaagcaataatcacacaccatgagatggtatttatggtacaatgagaaaaatgccttcaagcgaattacaaatgccggaaaaataagaagcaaccaaatcagaacagtgaataacatcaatttaacaccaattttaggaatcatttcctgctaattgtaaaatgtttaataataaactaataataaatggaatttaacacgtcaccacaattttcaacggtaaaatgggtttgttcatgacagtccgaaaagaaagcgcttcaaaacaaatcggtcacttcaacagaatgttcacgacagcgttcgcgttcagagtgcgcaagtcgtggtaagtttgaccggtgccaacaaaaacgatgggctgtcccgtgatgtaagtcatcgaaatggcggcgccaacctttggtttttacatttgattcctcaattgaatattcttgcccactttgtcgtcaatggtgtcgaatttggtcagcacaatgccgtcgatcagccgtgcctgctccccgacggcggaattgtcggccaacgcctggttgaacttgaccagctggtcaaccgcctcgtttccgaccaaagcttcgccaacaaacaacaccaagtcgggcttgttcatgtggatcaactacacaaataacacatggcattgtgcactgacgttcaaagaactcaccttactcaacgctcgcatcaatggctcattgtcctgcattcgtccggccgtgtccaccaaaactacgtcgattttgcgctctgtggccaattgaacggctgccgttgcgatggatgccgggtccttcccgtagccttgctcaaacaattgtgctcccttcaaaattgacaacaattgaaataccaaaagtaaaaatgattaaataatgaattaaatgtgcctgcgggtggagagcattcaaatggtgggtgtgcgtgcgcaactgttcgacggcacccgccctgaacgtatcgccggcggcaatgagcacgcgatggccattctcattgagccaaaaagtgatctgttggcagagaaaacagataaagggaacacttcctcctctgtgttcaccttggccaaattggtcgatttgccaacgccattgacgccacagaacacaatcacatagggacgtttttgcgctttggcgtccaaaatgtcgcggagaatgtccacgcggcgctttggagtgagtaactgaaaaaaacgatatcaaatgatcttaacgaaagataatgtccaaggacataacaaccaaacaacaattttttaaattttgctctctccgtatttccctcctttacacctacccttcccttttttcgctataattaattgcctggacaagtgcttcgcgcatggcctcgcgcacagtcgacgcaactcggttgaacgttccgatcactttgccctccaatttggcagcaaccgactcacaaatgcgttcagcaggttccgacgcgacattttttgcttaaattggaattttactttttgattatattaaacaattttttaaagaaagaaataatgcttactgatcagcatttccttcattttctccatcgccggctcaatgtcgcctcgggcaagctgtttggtgcccaccagcgatttgaatgccgaaaaccaaccgccggaagccgaaatgcccttcggtttcgctccgctgaattttaaggctgacatacaaattttagttttaaagcacctttccccgtggtcattttcgctgtcgctctccgactcttcgctgtccccaatttgctgctctccttcatccaatccgggcaaatcgcccttcagcgtaccgacaaattttttctaaatttagtgtaaaatgcacaaacgcattcccgtctttcatattgcaccaatttctcaccgctgcatttactcgttgacgtgccaagccgcgtactgctccgccttcaggacgtcctcaacatgctgcttcagcatttccgtgttcgccaactctctcccacgtgacaatgcgagtcgaccatcaaattttagtgaactctaaacgaaaccgtaatagtaaaaagcgctaaaacctgaaactttggtagccgatcttcgccaaaaatgattttgcgctacaattgctccctttggttcactaaaattgggtttgttatt

SEQ ID NO: 360 - DNA, 6257 bp, Heterodera glycines
  misc_feature (6137)..(6137): n is a, c, g, or t
  misc_feature (6146)..(6146): n is a, c, g, or t
  misc_feature (6149)..(6149): n is a, c, g, or t
  misc_feature (6200)..(6200): n is a, c, g, or t
  misc_feature (6207)..(6207): n is a, c, g, or t
  genomic virtual cDNA Sequence=SeqID_712; coordinates=1386..1465 ,1520..1607,1721..1819,2193..2375,2899..3035,3342..3405
  coding sequence=SeqID_999; coordinates=1386..1465,1520..1607 ,1721..1819,2193..2375,2899..3035,3342..3405
  peptide sequence=SeqID_1210
aaaaaaaaaatttttttgtaaaaataattaaaaagaaggcagagggaaataccggccaattaaccagcttaagcctttttttaatgaaaaggagggattaggaatgatcgccccctgatcgggggttcggccgggtccaggtttttgcaaactgttcgccgtagtcggtggcctgtgagcggacgctaaacaataaacattcaaatcttcaaacaacaccgccccctgtttataaaagcctgttcagaaatggttatggcaagttatggcaaacgagaattaaaatggtttttctgtgggcgccttagcaaaaaaaaagaatcaagactgataaacgaaaaaaataaatgttttcccctttttctgaatcgttttttcatattaaattagaaaaacccgagggtatataaattttttaagcaaaaatcattaagctcataagtacaaattctgtgctgaaatattctgatttttttaattattcctgctcacaatgtgtcgtaatgggtgagtatttcttccggtgacaatttgccatctttgttttcgtcagcaatatgaattaaatgtttggcttccgcgtcggcatggtcaaagttcaacggcattacccagtcgcgcatttcgtccttaaagcaaaacgccaaatttgaacggttaaatgaaaattataaaataattttgaaatttttttggcaatgtttccatttttggataaaattttacgatttaacaccactaatttgaaatttttggcacctattttgccatttttagcacctattttggggatggcagtttttagcaactataaattgcatccctagacataagtatgtatgccgtaaaatgtatttctctttttatgccaaagaaagtatttaaaattcctttttttgctttaatggacaaaaaaaaaagttgaaaaagacataattatttgcaaccaaaaaattaaaattaatcaaaaaattcctaaagataattaattaattcctttttcaatttttaagttaattattcttgaaaatacaataaattttggcgatttttgcattaaagccgaaaagttttaaaattcaaaattctgttaattaattgtcattaagctcataagtacaaattaatttcggtgaaattttttaatttgaaatttttgattttcactttttttttatatttctcataatgccttcatttggtttttgagaattttttaaagcttttttttgcagttttgaccgccttcgttggtttacttatcttttgatcgattttctatgcttcggttcacttataaatttcgttttttatttttaaattttttcaattaattttcttatatctgactaatccttaaaaataaaataaagttttttttacagaacaatgatgttgagcggacatggaaaaattacaaggaggagcagctgaagaatggcttgctcgattggcaagactacaggtgaagaaaatctaacagagggcgagaagggtggaaaattctaaaaaaattaagaaatttgatttacggaaaaccgcaggagggccaggagatttcaccggaatacgtcaaaatgattgagcgagacgaacgtcggtggaaggtcagaagcaggccaaaaagacctgctaatttatattaaatcgagaggctaacggccaaattttaatatttttaaatgctttccatacagtaaactcaaaaattgatttacaggtggctgactacaattcggacggtaaaatggaccgcacggaatacggctgtttcatgcacccggaggactgtgaccatatgagagacattgtggtgcaggtggattagcaaatttatttattaaaaaaaaatcaaattagattattgcttattaaagtccctttttcaatgattttcattttatatatttttcacttgtcttaacttggaacgggaaaaattcacctcaccctaattctcatatttacccagtattgttgcctaattatttaaaatgatttattattaataaatctttaattgctattggagcaaaccctcaccataattctcatatttatctcaaaccctcgccataattctcatattatctatgtattttcctaattaatcccgaagtattgctaattaataaatcttttaattgttattgatgtcctttccttaaaaatccttaaaaatttctgtacaggaaaccgtcgaagacattgacaaggacaaggacggtttcgtggacatggccgagtacatcggtgacatgtacagaccagacgattatccggaactgaagggcaaagagccggaatgggtggagtcggaacgggaaatgttcagggagcaccgggacaaggacaaggacggcaaattaaacaaggcacgttgaaggggaagaaaaaagtgccacgaaaatgccaatattggctacaaaattggcaattctgccacaattaattaacagaattttgaattttaaaacttttcggctttaatgcaaaaatcgccaaaatttattgtattttcaagaataattaacttcttataaaattgaaaaaggaattaaattatctttaggaattttttcattaattttaattttttggttgcaaataattatgtctttttcaactttttttttttgtccattaaagcaaaaaaaggaattttaaatactttctttggcataaaaagagaaatacattttacgatatacatacttatgtctagggatgcaatttatagttgctaaaaactgccatccccaaaataggtgccaaaaatttcaaattagtggtgttaaatcgtaaaattttatccaaaaatggaaacattgccaaaaaaatttcaaaattattttataattttcattcaaccgttcaaatttggcgttttgctttaaggacgaaatgcgcgactgggtaatgccgttgaactttgaccatgccgacgcggaagccaaacatttaattcatattgctgacgaaaacaaagatggcaaattgtcaccggaagaaatactcacccattacgacacattgtgagcaggaataattaaaaaaatcagaatatttcagcacagaatttgtacttatgagcttaatgatttttgcttaaaaaatttatataccctcgggtttttctaatttaatatgaaaaaacgattcagaaaaaggggaaaacatttatttttttcgtttatcagtcttgattctttttttttgctaaggcgcccacagaaaaaccattttaattctcgtttgccataacttgccataaccatttctgaacaggctttattagagggggtcggtgttgtttgatgatttgaatgtttattgtttagcgtcggctcacaggccaccgactacggcgaacagttgcaaaagcatgacccggccgacctctgatcagtggccgatcattctaatcactcttttcattaaaaaatgccttatgctgttaattgtcgttattccctctgcttcattttaattattattacgaaaaacttttatttttacaaaacataagccatgcccattgtaaggacatcttttttgaaacatttaaaataaaaagccaccaggcttccatagtacatttacatatgtgcaaaaatatttcaaaaattctcttgaaaaaatatttcacaaaatttatttgctgatagaaattgttctgataccaaaataaaaccgaacccatccttttcagattggtcaaattcttatcaagtagaatgatacaaacacatgcaattcacaaaaatattttggagggattagtcctccgaaaactaagaaaaagctttttaaaacttaggaaatttagctgttcctgaatgaaattattgattgattatttttttgctttttgtcagtttatcttttatattttctcatgataaattaatattttactttgaaaatttgcggttttcaaatggtttgacaatcaagtgatttaaaatggcaataaaaaagaataaattctaatactagtgaaatatactaatcttgaaatcgtcattccagttattgttttccaaaattcgtttaaaattagttctttgtagaactctcatcgcaaaattgaggccaattttgggcccaattcaatttggcaatgcactgaagaaatattcaattcactaagtgattaattttttcgttttataagaaaatattaattagcagttttttaaattttaaaccctaaatataaatgcaaattttgcttccaatgaaaattgtataagcaaatgtagccaaaaattgggatcgatatcgaatgattttccgttatatggaattgttggatcaacaaatgaatgccttttgctagtgatattttttactaaaacaaaattttcgtcaatcagattatttgctctccacgatttttagggttttatttaatggttaaaatttaataatccagaattttgacaaagaaaatttaatcaaggggaaaagtttttgaataaatttcaaaaaacacctccaattgtggcaagctttccaaatttctgtcatttatgctttagtcccataaattttgttgcttaaaatcacaaattttgcccagcgttgtctgttcgtatcggtgtaccaaaaaaaaaaaaatgtaaaagcggttcaccaatgttcgcttaaaaacaattttcttttttttcttactgatttagcccttttaaccctaattcacgaattccgattttttttctcgtcccgaatctcggaacttaaccataagctatttttgaccatcactttaaaaaacaaaaatatttgtaagaaaccacggcttttttaagtaccatttacttttttccagctaataattcgcatctttggctaatatttccatggttaatgaaccctaccgctatagaacacttcgactggagaagccatgacctctcctcctttcgctaatcaccttttactctttttttttttatcattttccggctaaatctttcccatcatttttatcttccgtctcccccccccccctcaacattcttcttccccccccccccgaaatgtccatcgggccgagttggaaatgaatggaaaatggggaaattaggcgaggggatgcgctgcaaagacggcggagatagcgtcacaataaacacaacagatattagcaagcaaaaacatcacagagcacaatccccgcgggggatgaattgattggcgggggcgggggatgaaagacagaaaaaaaatattacttttgaacataatttcgtttttcttttattgattttgttttaaaaataaacaaattaattcttttttttgctaaggcacccacagaaaaaccattttaattctcgtttgccataacttgccataaccatttctgaacaggctttaatagagggggtcggtgttgtttgatgatttgaatgtttattgtttagcgtcggctcacaggccaccgactacggcgaacagttgcaaaagcatgacccggccgacctctgatcagtggccgatcattctaatcactcttttcattaaaaaatgccttatgctgttaattgtcgttattccctctgcttcattttaattattattacgaaaaacttttatttttacaaaacataagccatgcccattgtaaggacatcttttttgaaacatttaaaataaaaagccaccaggcttccatagtacatttacatatgtgcaaaaatatttcaaaaattctcttgaaaaaatatttcacaaaatttatttgctgatagaaattgttctgataccaaaataaaaccgaacccatccttttcagattggtcaaattcttatcaagtagaatgatacaaacacatgcaattcacaaaaatattttggagggattagtcctccgaaaactaagaaaaagctttttaaaacttaggaaatttagctgttcctgaatgaaattattgattgattatttttttgctttttgtcagtttatcttttatattttctcatgatagattaatattttactttgaaaatttgcggttttcaaatggtttgacaatcaagtgatttaaaatggcaataaaaaagaataaattctaatactagtgaaatatactaatcttgaaatcgtcattccagttattgttttccanaattcgttntanattagttctttgtagaactctcatcgcaaattgaggcgaatttgggcccanttcattnggcatgcactgaagaatattcattcactaagtgattaattttttcgtttt

SEQ ID NO: 361 - DNA, 9333 bp, Heterodera glycines
  genomic virtual cDNA Sequence=SeqID_726; coordinates=9217..9111 ,8806..8608,8561..8334,8288..8172,8127..7747,7698..7410,7362..7259 ,7216..7138,7091..6856,6810..6592,6323..6219,6085..5903,5822..5697 ,5651..5408,5353..5210,...
  genomic virtual cDNA coordinates=5093..4934,4889..4793,4743..4609
  coding sequence=SeqID_975; coordinates=9217..9111,8806..8608 ,8561..8334,8288..8172,8127..7747,7698..7410,7362..7259,7216..7138 ,7091..6856,6810..6592,6323..6219,6085..5903,5822..5697,5651..5408 ,5353..5210,5093..4934,4889..4793,4743..4609
  peptide sequence=SeqID_1192
tcgcccccgggcattttgccctgctgacctttgcccctcaaaaggtcgcgctgtgacatgctgcaccggcggaagccaaattgcttccggtgcccgaagaacggcggcgatttaagcgaaaactcatgagaaatggaaaagggagttgaggaagaattggacgaaggaatgacccggcaggcgatgagagagaaaagatttatcggggggaggggaaaggaagggaccatcatcgaagggagagaggggaggggccactgctgggaatgatccaaagtgatccaaccccgtcagttggccacggacaaacaaacacatctgtgctggtgatggacagaatacggacgatggccaaggaaaatgggggagagagttgcaaaagcaagagaaaaaggcaaagcgatgggccaaagtaaagtgaaggaagcttcattaagcaaatgccattttatttattcatttgtctcttcgtcatcgtttataaaatgttcaatttcggtcatttgtccttccattttgcgatggtatctccgtccttaattcgtttgtccttaattttggattgcctttccgtccttagttcgtttgtccttaattttgcgattgcctttccgtccttaattcgtttgtccttaattttggattgcctttccgtccttaattcgtttgtccttaattttggattgcctttccgtccttagttcgtttgtccttaattttgcgattgcctttccgtccttaattcgtttgtccttaattttggattgcctttccgtccttagttcgtttgtccttaattttgcgattgcctttccgtccttaattcgtttgtccttaattttggattgcctttccgtccttaattcgtttgtccttaattttggattgcctttccgtccttaattcgtttgtccttaattttggattgcctttccgtccttaattcgtttgtccttaattttggattgcctttccgtccttaattcgtttgtccttaattttggattgcctttccgtccttaattcgtttgtccttaattttggattgcctttccgtccttaattcgtttgtccttaattttggattgcctttccgtccttaattcgtttgtccttaattttgcgattgcctttccgtccttaattcgtttgtccttaatttgtccttgtctccatttctgactcttccttatcatccattcatccgttcgtcccctctttctttgtctcttccgccatcattttgctgatcatttccatttgtttgttggccaatcgtcgtattaatactgtcgcaattaccagctgaaatcgctctttttttcgttctttattagcgaatttttataaaaacttcgactgaagaaaaggcgcaatcgatggaatagaaaaattgttccaaagggagcggacgaatgtcggagttaaggccgagaaagagaagagagggcagatggagggctgacagaatccaaaagccggacagagaagggatctgccgaagaaaagcagcgagtgaaatgctccgattgtcgctttaggacaacaaacccggccttttaagttgccatgaaagccgagaaaaggacgcacaatttggacgagcaccgaaacgaaatgcaacgcgagaagagtggcacgataagtcgggtagagaagacggaactgaccaacgaaggaggggggtaatgaaagaaaaatgagaaatatggtggggggggggggggtaatgtggagagactaagtgggaatggtgggcaaccttgagcagaaaacagccaatttggccaattatggcgaacggagtcaggtgagcatgaagatggagcagaacttggaaaggcaaatgcagcgacggcgcagcaatttgaggaacgacggaagccatcagagaagggaaatgatgccaaaattggaatttggggcggggaattgcgattggttgccatagtgattagcaccaaaaatgttttggattattatggtattttagctaccatttgcttttgtctccttttttggtcgcccatttgtccgtccatccgacagataattccctttgtcagcgttccgcgtcaaattccctcccattcggcttcccgccggtgcttttaaagtgcgcttcgcccctccgcccattcattccgccgtgccaaatgctctttctgctcgtcctcctccccctgctgcccctctcttctcaaagtgatccctattcgtcgtctcccgctgcttcgcccgctttctctccgccttatccgccgcccattgccaatgcttttcccatttcccctcaattcccttcgtttttgtgcgttccgtgctccgccaaagaaaattctctacaaatccctccaccttttgtcggacaacaatatcccgttcaaaacgacgccaatttttcgccttttggttacggcacagtcgccggatacagtaatcaacagttatacggcaacgcacacggcactccaccgatagttagtgaaatagcatatgataatcagcaactgtacaacaatggggcgtatagtaatcctcgaccttatgccaacggaatatacggtaacgtgcatcaaattatttatatattgtaaagagaatttgaaaagatctttttgaaggatacagcaatgagcctgtgtatggaagaatgttcccggggtacggtagaacccccggatacggtgacgagaatgtgccgaatgcggcgggggcgtacattcaaacggaaatgccattgggaaaactgggaaaaggagtctttgggagggcaaaaggtaatgtgaaggggaaaagcaatggaagcagggctggacgtactggactttacttttaattacggaaaaccgtaattacgtggggttaaaaaacgccgtaattagcgaaacccgcaatcaataatctaaaaatgaaaaaaaaaacatcatcacattagcgtagttgagtcatatgacattttttctgcttctcttcctaaaattgagtccattcctgaaaaattagtgaaagtgatggaacaatttgcagaaggacgacggagaaacgaacgcaaagcggcgaaggaaacggatcgaacggaggaaaacacgaagaaattgggaagagatgaagggaatgcgaaatggaaagaaaggaatgcccgggggaatgaatcaacgcactcattaattaattagtcaattcattagttaatccttttgtattttatcacttttacaacgggccattggaacataaacactcgcaatgacatgaggaggatttgtcggattggtcaacaataatcgtcattcgttggcaattaattgcctttccttcatccgcccattagcaaagcgccgtatcccaacggcacacagcgacagtcgcgcaacagcgcaccgccgagcgaaaagtcggcacagccgcccttacaaatgcccagcaaatcgacgcaagtcgcttggctcggctcccatccgcagccacgtgcctttttaggaaaataaaagccaaaaatgggggggggggtaattaattaatgtaattcacttggaaattgtcgcgatcgaagagagaatcgcgcagaaaattattggcgacgaaatgtgaagggaaaggggcggcgacggaaggggggaaaaagggacgacgaaaagcaaaggaagcgaagttgggacgaacggaggcaaagccaaagggcactaaaaggcaaagggaagggaaaaggacaaggaaaaacggacccgaaaaagaggggacggacggaggggaaaaacgggggccaaaagggaaggaggacagactgaagaacggaacggaatgaaacaaacggagcaagcgcagcacagaccgacccattctcaacgccaagagcaaaaggcgagcgatggtcgggactgaagtggcggaagggaaattgggcgaacagaacgccaacggaagcgaagaggcaaaggcacagcagcagaaggggacgaagagcgaggaaagccattgggggacggattgtgaccgaagggcgagaagacactggacattctcgccctcccaagccccgcaaattggaggagatgacccgcttattttggggcggcactccccgcgagtaattagcaagaatctaaggggagatgacctcactccaccggggacacttcttgcactttccttccaacaacaatcactcaaatttatacggtaaaaagcagtcatttaacaaacgataaataaaatagaccacaaatgtcactttgaaattggacagtaccataattcagacaaaaaatatttaaaaaagagatgacagactgtgaataatggagggtcgacaatggtcgaattcataaagcaaaacggatggaggaacacactcagaaacaatcaaatctctcaccaaaacagacgagtagagacaatcagaagcaaagaaacaaactccattagaagaagcaggggaaagctcagcagaacggacacaaaacatgaaaaggagagcaaaaacagacgaaaggaattcaaatgggcgcagagaaaaaatacgaacgatcgtttaatgtcaggatggacaaatggaaaaaacaaaaacggggaaggcagggccgagcccacccgacggacgcattgtcagaccatgtcctcctccaacaattcgttcggatttctaaccccgggaatcgcttgttttaacgattgaatgcgctggatctcagcctctttctcttccaagaaaaggtccgcagtgtcgtcgccggcttcttcctaaggacaaaatggaaaatcattttttcaatttcgaagagagagaaaccctgatctggacgaggaagtctcggatgtgttcacgcatctttgtaactgtgcggttaaagctgaagaaccctttgactgtgactcgaatttgcggcctaaactcagaatatatttgatttgtttggttcatcatcctcactctgtcaaatttttgaaatgagtggtgaataaagtggcaatagcctcgtaaacaaattccatgtttggttggctgggatttgtcggattcagtggcacttcaataattgtttctgctgcttggaataacagacaaacgctttcagccagattcgtcagcccttaatggttgagaatggataaaaatgacgacgtttcggtctttccaaaacttcagtgactaacagttatacgattttctcaaaattgcaaaacattacaaatgtgcaacactcaccaacaaagttcacttggttgtaatcggtgacaacgccaaggacatgttccatgatcaccataaagtgctttttgtaaaaggcttgtgcctgcgctttgtccgtcattgttgagactttggtcaaaagctcgcggagaatgtcaactcctgcagaaaatcatcgtaaattaaaacactcattcattaatgcaaatttcttgccattttccgcaacatttctcattgtgtgtttcactgcccaaacgatggcttggatgagcaggccaaaaacttcgtcgggaagagtgatcagcacgtcgaagcagtgttggttgatggccttcagcagttggaagaaattcgtgcggtgttccgggaaggcttccatatctttgttgatcatttcgagagtgcacgtgaacaccgcgtcgagaatagcggggacctgtgccgacgcgtcctccttcaagaaaccaacaattgcaaattcaaaatgacggtgtgaaaccttcagagacacaatggtaatcgaaaggagggaaagcactttcggttctcgcgcttgcggaatattcatttcataatcgacgagaacggtgctgaacagaggcttaatcacattctcgatgaccagctgaactggcacgaacaaaggatcctcaaagaagacaaaaagattaaaacaattcgcttggattttacgggaatagcgacacggggctcaaaagcacgcgaaatccaagtggacagaagggtcagaatctccttcttcacaattcgcatttgcttcaccaacggccatttcagcgcctgttcgccctgctcgttcacagctttgttcaggtttccggaaatcacttggtacacgctcaacatgtcattcaaaattcgttttagctaaaaatacataaaaatttattatacatttgttttattccacaaatgaaaatccaactgctttgatttttaaaaaataaataaatactgctaagggcatgccataaaaactgaaatactcaaaaataaagacctggctgaagaatggagctccaattgatttgcaggcggccacattagttttcaaaatgtgtgctaaatttcgtagcacgtcttggtcagaaaggatgttcacatcctaaaaaatgtccaaaacactgacaaatgtgaacaggtccgcatgcagaaaaagcagtcagtaaaaaccgacgacttttttttcgagcacatatacttaaatgccaggaggtataaaaggacgatgaccaattcggattcggcataaaaccaattttagtgcataacccattttataattgtccgaaaggatgaatgaaagagaaaaatcccgattatgagccctattgtttgatacggatctgaaaacgagtgattaacgaacatacccgactggcatggtcaattgcttcgctccagatggaattgggcaaagtcatcaagcggtcgatgaggtcctcttgaacctcgcgactcgtacaagcgtaaattatgtgcccaaccgcttcatagaacacgtgaacttgtgggtgagacaaatcgcagataatgctgttcaaattctgcagaatttcgtcaataaatggcattgtttcaccgccttgaatctaaagatccaattttgccgtaaaattgtaaacaaattaaaataccgagataaaatgcgatttgcacttgatgacaatcttgatgaatgtgtcacaggccatgtcctggacaccttcgtgcgactcgtgcatgaattcaaacagtttgttgatcacagttttcaggaacttccaatgacagcgaaggaaacgcgggtattggcccacgacgtacattatgttggaggcaatcaccgctttgttgtctttgccacgcttttgttcacacaaaccaagcaaatctacaaaaaaatatatatttatttggtgcccgaccctttcactcaccgcgaatgactgtgaccaaaaatcgcttctcgtcgtcttcatgcatcgcaccgctaattgagccgattgcccagcacagcttaaatcacttttgaaagacagggaagaaactccaacaaaccgtgttcaaattcttccaggaccactcactgccattaacttgattttgaagtttttccgtcattttcaactcagtgtctcggtagtccaaatgggtcagcaacactaaaatcacaaactgtgaaatttgcctaaataaatcgccaagaaaccaagtgtttcccgcatcgttttgtagagcacaacggagtccgtgtccttcacaagttccctgactgcctcattgttctcgttgacaacgacaatgacttcttcgggtttggccattctgctaatcatcagcaggcgaagttctgagagcacttcgatgtacagcttccgcttgggcgattcttgccggttatagcgcttcagagcgtcgatgatcgaatgttcagattgttcaaatggagattctcgaaacagttccatgcaaagccaattccaataatccaaacaaatctgagtaattggagagagtgtaataagggttccgtaaagaaaagagactttgaacacttcgatgtcttcgacttcgctgctgatcttcaacaaatacttcaacgccatcaaatgtgcttgcttgacagctttttgttcttcgtccggatgaggaaaggttatttcgaccaatgcagaatgttctttgaagaaagtgctaagcaattgggcgaaatttgacacaaatttttggtcttcgttagttccatttgcgtaggaagtggcaatgtcaaaggaaagtggaagttgttccgatataatttcgatgaccttcctgagcaaaaagaccaatttgccgccgtattgcggattgtcatcgatgctgatggacgacacctcaaccaaacattgaacagcgatcgaacgaaaggcaggaaatggtaaaaactgaaaggcaatcagcgcaattattgcggactaatcagtgtggtcactttaatgatgagatcaattaggttgttttcaaacacatatccaacagggatccaatccaaaaaaccatgcaatgtgtacagagtagcatatacgagctgagcattgtcagaattctcctaaacaaaaattaagacaaaattaagggtgtgaaaaaggcgcaccaaaatctcataacaaagtcggtacacttcttcaaactgcccacaaaattgctgcttcaactgtatagccctcgacgaggtaaggccggtcccaaagtcaaagacttcttcgctgagcagacgaagaatggccatgttgttcatgcacagagactgtccatttcgactggacccaacaatgtcactgatgaaagttggccaaagacgtggccactcatgtttcacgatctgaaggaaattagtgccgaactgcgaaaaagcgcaaaataacgacctgcaccaagacgaggttaagtttctgaagcaacagtttcattcgttcacttttttcggggtccgcactgatgtccaaaatcatgttgacaatgtaacctttgatcccttcgcattgatcccttggcaaagccttccatcgtgtttggatcagatgctccaaaatttgcaaaccaaagtatttcgtctcgagcaagtcactgaaaaaaaaacaaaataaaagttagggcttaatggcacaaaaattaaaaatgacagtacggacaaaagagtaaatttctaaacgagttcgaactcttttctttactttaaatgcaaaaatccgctttaaatatactaaaaggtttagattttcctttgtttaacgaagtatttacagcttgcttttatcaaaatgaacgatttgaagctttttgtaataattttgttggtgggaactaaaagtattaatggagaccaaaccattataataatgaatggtataataaaaataagaaaattaacctgaattccaaaattgtgtcaacttttgtccaagaatctgcgctttctttgaagcgggccaaaatgtcagaagctgctttctgtgcttcgccagtcgaacggttcataagggtgacgaccttagaaaatgtcattagttgcctcgtcaatgcctaaccaataaaggacttttattatttgcacattaaaacaatcgaaatacgaaggcaacaataaaaaaatg

SEQ ID NO: 362 - DNA, 4764 bp, Heterodera glycines
  genomic virtual cDNA Sequence=SeqID_728; coordinates=2555..2472 ,2419..2201,2145..1909,1664..1565,1514..1444,1371..1255,1199..972 ,811..402
  coding sequence=SeqID_896; coordinates=2555..2472,2419..2201 ,2145..1909,1664..1565,1514..1444,1371..1255,1199..972,811..608
  peptide sequence=SeqID_1124
agaacagttgcgaacaaacatttaagcaactttggacggacgaagggcaaacgatcgccgggggcaaattgggaaaagcggcaatgatcaaagggggtaattattaacgaattaattaattgactatccatgcaattttttgattgagaatagcttaaaggcatttgtaaagccgggattctgctgggtttgccttcccctcgtcctctgtggtcattcttcgtcccttttggtattcatctgctgacaaatggacatggaggaaaaacactggtccatccacaaatatttgtttacttgagaattgaagggatttttcggatcgatcgccctttttccccttcgttcaacttccccccccccaactgctgaagtgaattccattgatgacaataaacacaaatcatgcatttatttatttgactaaacccaatcaaaatgaaactgatgccattttcgaaacaaacgaatgaatgaataaaccaacaaaaaacaaacagcgaaagttgtaaagccattgccatcaattaacaaattcacttataaataaaaatgggtcaacaaatgccaaagcaaagaatgcctccgaatatcagcgtctgcgagactatttcttctttttctgcactttttcctgctcaattggcgccggctttacaaagggaattcgttgcgaatattgcgatggcataaacggccgcaggggttccggcacgacaatgccatcctccgtctgattgttctccagaatggcacagatcactcgcgtggtggcacacattgttgcgttcagcatgtgcacataattgacctggaattgacattaataaagacctaaaagagaagaaatgcaaataagaaaccgcagaaaagctgaacccaagaacaggacaaatggtcaaggatgaagggcattatccgttttattaattgattgccggctgatcctttcgtttcaaatcactttttacctctccgtccattttcttcgtctgtccgtaccgtattcgtaaccgtctcgactggtaatctgtacagttggagcatgaaaccagctcccgaaatgcaccgctgcccgggaaccacgcctcgaggtccaatttctttgccgccgcgttgttcagttcggccgaaacaatggccacaattcggtagggaaggccgagcactttgcaaaactcttcagcattgccaatcatctgaattttaaaaagaattaaatttaatggactatattttcaaaagtccactaacttcgtccatgtgcttccacgattcgttgtcaaatggtgaacagatgacaaattgttcgatcttctcgaattggtgcacacggaaaatcccgcgggtgtctctcccatggcttccgaccttaaaaaagtgaaaataaaaggtgacgatgccacgggattaaagaaacaaatattggcagaatatacaaacctcctgccgaaaacaggtggacattccggcatatttgattggcaaatccgatgggttaagccattcgtcaccttacaaatggcaaagttgaggggagcagaataaacggataaaaatgtacgatgaaaggcggcgattggctgctcagaagttgcgattagatatttctcgtcgggagagccgtcttcattggctgcgtccgtcttttttgcggtggtcacctaaaagaaacttatacttacccataaaagttacaagcaaagtgaaagaaggtgattttgaaaagccaaaattttcttaaaatagacttaactcataatttctctagtaatggctcgggcttaaaatgggtaagaaacacagccaaaatctaaaattttgtttcaaaaatttcgttatgccctccctggttggtcaatctcaatagtaaagaaggaatccgaacattttgaaccttttgtacaccttgtaaagctcttcgtcgaattggctgagttgtgccacctcctgcattacgtctttgcgcataaaaaagggcgtgtaaagcggcgtgaagccctttttgttgagcatttgcaatgccaatgcgatgagcgcttgttcaaggaacaccaacggtcctttcagaaaatagcctcgtcctcccgccacattggtgcctctctctccgtcaaatccgtcgcacatcaccacgaggtcaacctgtttttcaattggaaaagaggaaaatgactgaaccatgagtcaaatcactgacatgagaataactttttctgcttgcgcagtcgccaaatgtccgttcgactcgattttcgtcttcattgtcactgatgggcaccgaattatgcagcaaattcccaattttggccaaatgctcatttctgtccccctcaagcgtttccattctgagtttggtccgtctgacttcttcgtccaccattcccttgactgttttaatttgcgaaattttcatttcctaaaataccaaataaaatcagtcggtacaaagaaaggttcagtcattttactttgatgtcatccattttcagttctgcaagtgatttgatttgtccttccggaatggcatcggagtcaccagccgactctttcttctaaatccgaattcccattgcaaggaattccacccaaattccaaatgcgacttttggtaatcatcggttttactggtcccataaaaaagaggtaaaaaagagattttgaggtgttcttgggggttttcggggcgctgaacacgaatatgccatccatttcaacctatttcgaaacccggacccgaattcgaacaatttttttttttttttttttgcatttttcactaggaatttgcgtcaaccttctttattatatgtaaaaacaaactttgtctatgcgttaatataatccaaatgtaaacaaaagatgaagaaataaatacgaatgaagatttgttgattgactttcatgtagcggaataaacaaaaacatcgactgtagctgggggggggggttgtcggtcatttgaatgcagcgtcgacgactcaatcacctcacctacactttgaccacccacccgtcctcattttttaactaagtttagctaatttttaagaaggttgacgcaaattccgagtgaaaaatgcaaaaaaaattgttcgaattcgggtccgggtttcgaaataggtcgaaatggatgtcatattcgtgttcagagcccccgaaaacccccaagagcgcctcaaaatcgctcaaaatctcttttttacctctttttatgggaccagtaaaaccgatgattacccaattattaacacaatgtgcgactctgtcttcctccccccacattcgattctattgcactataattccaatcacattttatgaatctaaccaatccacccctgagttttttttaaagcacaatttataacaaactaaaacaaagtcggggtaatactatagatggtgttttttgaagaaaaagtgcaatagattctggggttttcgattcaaaattacttatttggtctagtttttgtaacataaaatatatttaaattatgtacacgttaaggcttcttcaaccaatgaggagtgtactgttgcttggggcgtctgcaaccacgctttccatttccattgcatttcgcgttggcttcgtactcgtcaggttgcttttatctgccttgaatgtaaatggataatactgacgtcccctcggaattgcacaaaaaatactttcaagaatacaatcccgtgacggatgtgagttggttaggtacctttaggactaataactggggttatctatttttctgtgggtagcacttatcgagaggagcgcaaaaaaaacttatttccgcttaattttcaaagcgagttaaatgactgcttcgagaaaaaaattttgaatttttttttcgaacgaggaggggggggggtggcaccatcggcactgtaaccttttagatttttcacgtaaaacatacacgttatggctaaaaataaaggtcagattcttgatcagcatcaaaaattagcctagaaaaaattattagagaaaaaatttcaagggggtgacaaaacccggaagtacccaattttattcactttcccgaatgtatacattgaaatattttgaaatataatttcttcaggtttgtccgttggacaatcgcgactggtaagttcgtattctttgttcctaaaatttttgtaaattattagggagttccaaagatatggacattgagttgccttgcggttattgcacacggctgaatatttgggatcacgatcattatttaaatatgtgttttgttaggtacttgacaaaatcatgactttgttttttctatgaaagtattaaaaaggattcaccatatgaattcgcatttattacacattttttgaaaacaacttcgtttgttttgacaaaatactgaatatcattgataatatattttcaatgtaattaaccgataattttagtgaatagctttgctttatctaattttgcgtaaagatggacaagccaatcaaactcgcgaaagtcacgcgtatccttggttcgttttataacatttagctgatgtactctctttttaggacgtactggtagccaaggccagtgcacgccagttcgtgttgagtttttggatgacacaaatcgttcgatcattagaaatgtgaagggccctgttcgggagggcgacattcttaccttgcttgtgagcaattaaatttgttttcgtctaatgtttaacactgaaatttttaggaagctgagcgtgaagcacgtcgcccccgataaatcaacactac

SEQ ID NO: 363 - DNA, 3580 bp, Heterodera glycines
  genomic virtual cDNA Sequence=SeqID_740; coordinates=750..912 ,1114..1286,1328..1717,1798..1950,2000..2143,2217..2495
  coding sequence=SeqID_941; coordinates=750..912,1114..1286,1328..1717, 1798..1950,2000..2143,2217..2495
  peptide sequence=SeqID_1164
ataataaatcaatagggtcttacataaataaaggaagacacaataattagagagtggggaaaatggagaggaaaagaaatagacacatgcaaagggaaaatgaatgcatttgtgtacttttatctcggggttgaccacccgaacaatcagccataacttgcttcattccccactaaactgaacaaatttggtatctaaaaaagtttttgaaaaccagaattttatcaaaatggatgcctcccgattcgagatcaaccttaaatattaccaataaaaagatcgatttggaatgtcatttttcttttgaaaccttatcgtaatggtccaatcgattaatttctccctttttgctcagataataaatcctattgttgcatttttgcttataaaaaggaagaaactgacccgaataaatttaccaagtgtatgacattgtgctcaaactcaaagaaaagcgacacgaagtcaactcgctgttttatggttgattgtcttagaggttttaatgtttagttttccttaatacactaactcaaaaatgaattcaggaagactgtcgagaaaaaggaagaaactgaagttcaacagtccgattgagcccaatctggaagtgattgtatgcacattagttgagcggactactagtggaagcgaaaatccaagcgagaaatttatcaagtcgagcagcagcgtaagaaaaagtgaaaactcatttgtgtaattcttttactgtttagaactgaatcaatatggcgaaaaacaatatcaacattaaccgtggcgttcaagaccctttttatcgttacaaaatgcctcgcattttggcaaaagttgaaggcaagggcaacggaataaagactgttattgcgaacatgcccgaaattgcaaaggcactgtcccgtccaccgacctgtatgttaaagaaactggttcccctgtatagtatgagtcgtgttgctttcccttgaccacaatttttctgaccaatttaagcctctcgatctaaaccaataatataggcattacaaacaaacaaaaaaagttcgggtcaaaagcgttagttgaataaactcccaaggagtgaagttaagactatgcatttaatgcgtttagatccgacaaaatattttggctgtgagctgggagcgcagactaactttgacctgaagaatgagcgttatattgtcaatggggaacacgatgccaacaaactccaggatattttagacggatttatcagaaaatttgtgctttgtccgagctgtgacaacccggagactgtgctggtatgtatatttactaggcaaaacatataatttttgtttagaccgtaaagcgtcaagtgatcaatggaaagtgtaaggcttgtggacacgcttttattgtggatccaaaacagaagctgtcgacattcattctgaaaaatccaccgcctcctgacaacatagagagcgaaaaggaagtgaaaagcgacggcggattgccagctgaggagagtaacgatgtaccagtagtcgacaactcgggtggctgtgatgccgggtcgaacggcgaagatgacgaggattgggcgcctgaacccgttgaagacgaggaaaaactttcgggacaaatcggcaaattggtcattgacaaggacttggacaaatctgtggatgagcgccttgacttgttgcatcagttcttcctcaaggcggtcaagaacaacacgattcaggtatagtctaccataattatacaaataaataaaattgtataactttcttaattaactatttaataataaaattcgtttaggacagcaagatgatgttaaacgaagctgaacgtctggaacttaaatcgaaggcaccgctgttgctggccgatgttttgttcgacaccaatgtcatcactcagatcaaacaacatcgcaatctgctgctccgcttttgcttgaaggacgagaaggctagttcttgttcaaaggagcttaattaaaccatttctccaattttaggcgcagcgcatccttttgggaggcattgaacaacttgtgcaaaacaacaaggacattctcatgtcgaagactgcccacatcataaaagcgctttatgacaacgacatttgcgaggaggacgtcattttagcttgggggagcaaggcgagtcttttctttgttgggctatattttttagtaattgttaattgagtgtaaaaatgatcttcgtatttagccgagcaagaaatttgcggataaggaagtggtgaaagagatgatcaaagttgcccagcccgtgcttaaatggctcaaggaggcggaagaagggtcggacgagtcggaggacgacgatttggacgttgcatttgacgatcgaagccgcaacattgggatgacagtggaggtggaaaagggagcaaaggatggggtcacccgtgtacagaacggccaaattgcaaccaatggcaaaatggacgatgggaatgcagacgacattgacattgacaatatctgattgtgagtggcatggcgcggtggacggtaattcagtgatgttgcaagaatttgtgatcgtatgccgaagactttcacccaccccttttgttcattgcgataccaccacatttttgttcgcttttatcgtaaatgtttttttttaatttactcgcatcggattttttcgaaattagatggggttttttcttgatttgatgataatttcatgacaaatatttttgctagtgatttaatttatttactttaatttgctttcataaatttgtttgtgctataagcatccattaaagtgatgcctttgtcgacattcgttcaaatgcttcgcaaatactgctgctgcaaggggacttcttcgatggattacgcaagattagttaccgacggcggacaaacggacgaatacacagcggcgaataggtgatttggtggcaatggtaaaggcgtgatagattgaattggtttatattttcatgaagcaatggcgcaactgcctttagtggaagtttacggcccgggatttcagagagcggctcagttggccattcccggagcagggaggaggaagaggaggagttgatgaacaaaatcctggacagaacccagcaagtgggtgtttttttaaatttgtctattaaaatttgggtcaaacttcggctcaagtacagtttatgcgtccaatcgacttttatgcgtccaatcaatttttatgcgtccaatcaatttttttgtctaatttcagtgcatttacaattttccgtcattgactaatctatttttacaaaatttctcaatagttcaaactatacggggtaatttaatctcatttcttccaaaatatgctgaaatatttttgcgtttccgtggtatcttctgaacatgtactgaaacaaatatgtcggcagcatttcctcatttgaaccacgtaagtgtcggtcagcagtaatatagctagtcgaaacatagcaaccggagtttgaagaatggagaaaaaatgccggctggctgctttttgccaacgaacggagagaaaaagcggctagtattggtttttgccgacaaatgggagagagaaaggccggctgt

SEQ ID NO: 364 - DNA, 4236 bp, Heterodera glycines
  genomic virtual cDNA Sequence=SeqID_742; coordinates=661..744 ,1097..1177,1235..1289,1343..1461,1529..1669,2050..2213,2269..2338 ,2428..2551,2602..2787,2852..3087,3147..3243,3296..3435,3505..3629
  coding sequence=SeqID_861; coordinates=661..744,1097..1177,1235..1289, 1343..1461,1529..1669,2050..2213,2269..2338,2428..2551,2602..2787 ,2852..3087,3147..3243,3296..3435,3505..3629
  peptide sequence=SeqID_1241
tgtttttcatgtgtagagacagaaaatagtctccaaaagagagaaaagaaatgcaaattttttcatcccattttgtatgttctaggccaaaattttactcaaaacactgaaagtttgctcattttccttttctctatcgatatgcaaaatttggggtggatttaacgtgcaggaaaaaagttaaacgtcacgaagtaaatgttgttttttacataattaaaatgaagagatagtacgccaaagtgagagaaattacaaagaaaaagagaaacgacgagatagtactaggcttttctctgcacagtggggcgtacccatagtgttctagtgaaaaatgagttcgaattttgttacaattcggggctggtccgaaattgatcgaaatagatgtccattttgtgatcagcgaccccgaaaccactcacaagaacatgttttacacgtttttaccaaaaaagtggggaacaacctgactattacccttttttccaacagtgtagtactgtcaggatctatattatgaaaatttcaccatttggtataactcatattcagaacctttcttccatttgaatcttttttcaaatatgtcgtctattaagctcaacgagtgagttttgttaaccgttattataatataatacatttgacattttcagaatattaccttcgcctatccaaaacgaaggaaaggatgaatgggcaaatgttgtcacgcgtgacccctggttcaaaggccacgaggttttggatttgcattaacaacagggattagatctgttattatttctaaggaatgttctgatttgggggtagtgccctatttttatttgtaagaggaagtttctaaaaaatgacaaatttctaacaaaattcgtgaaaattttcccccggcggcgcctattggcaatgccggcgtccaaaaacttatttttctttaaaaaattagtctagaatctgcaaattttgtcattttttgttttttagccttgatgttcttttaaaaaatattcgatcaagtccctgtttaataattacactgaaaatccgtttaaaataccacacccccacgctaatttaggtggccatcaatcacaatgccgcatcaaaaacagttgccatcaaagaaccaccgccctatgggcaccgcaaaggatttgtgccacgtacgcctgaagtatatttttgtcccctttactaaaataattttttgctaattttaatactttttcaggactttggcgatggcggtgcctttccggagattcacatcgcgcaatttccacttggtcctttaaaaatgttaatttgtcgtaattttccgcgtttctttctcctttaggcatgggaatggaacgcgcagtcggaagaaacaaagacaaaacggtggcactgcaatttgacgaggagggaaagttgcgatttgacgaaattgcacgcattgggcacggaaaagacaaagtgagacggacgaaaaagggacaaaaaatggacggaaattaattattaattgcccttccattgtcagattgtccattctcgcctttcggacatgaagtcaaaaataattgacgaggaggacgaatcctttcacaagccgaccgaagacgaagtcgaacagaccactgaagcgacgcggatggcactggagaaaatcacaacggcaaaggtaaaacgccagggggagggagtaatgtgaaatattaaaaacaattttgagccttaaaagtctaatgttttagcttttgaacctccatagcgaaaagtgaaactgtaataaaagtagtcctggctctatccaattatttaaaattcatttcttacaatttaacaataatggtcatatcaaaacagattatttttcaataaactgcataactcatgatagaattattgtgaatgaaaatttggccatttattaaattagatgaaaagaaaaaagtgcgaaaaatatgttaaaaagcaataaataaacgtaaaattcggcgtcgacccctttttccacctctttaatgtacattttgaaagttgttactttcatacttttagattgccgccgctttgcccgttcaacacgccaaaaagacggcgcctgcccaatacattcgctacacgcccagccaacagtcgggcctaaacgcgggcggcgcccaacagagaatcattcggctggtggaggagcaaaaggacccgatggaaccgccacgttttcagtaaccataacatgaagagcaatgttgttactggtgcattaaatttgtgttttaggatcaatcagaaaatccctcgggcgccgccctctccgccggcgccggtgatgcattcgccgacgagaaaagtgcgttttcagggacccattcattttgcgagatatgacttggaaatgcactcaaactggcaaactcatcctatttatttctttttgaggtaagcgcaaaggaacaggccgactggaaaattccgccttgcatttccaactggaaaaaccccaaagggtacaccgtggcattggacaagcgattggcggcggatgggcgcggattgcaacaaggtgggcaaaatgggtggagcaaagcattagccaaagcatgctaatttaagtgcacatcaatgaaaactttgccaaaatggcggaggcgttgagcatcgcggaaagaaaggcgcgggaggcggtggagacgcgcgctcagatggagcgacgcattgcgcagaacaaaaagacggagcaggaaaagcgaatgcgcgagttggcacagaatgccaggtgaaagaaaccaattaaaaaaagtactggcattttgcccattcattttcaggttggcccgtgcacaagcgttgaagaagacggaagatgatgacaccaacgcattggaggaggcgaaggagcgcgaaatgatccgacgggatcgcattgaggaccatcgacgggaccggaacatcgcccgctcgagaccggacaaattggagaaactgaagcgagacaaggagcgcgacgtcagcgagaaaattgcacttggactgcccgactcacgcgcacgcgaaagtggcgaaacacaattcgactcacgccttttcaaccaaaccggggtgggtggactcgagaaatgatttggtgcaccgtttgcctttaaaattgcttttcacagggtctcgacagcggcggcatcgatgacgaaacgtacgccgcctacgataagccatggcgtccccaggatggcattcagcagcacatctaccgaccccgtaaatccatttttgttcacgatgggaatcatccgttctctctcgaattcaggaaaggacattgacagcagcatttatggcgccgatttggatcgaattatcagcaccaatcggtttgtgcctgacaaaggcttttccggagcggatggagccggcaaggagggtggacaacgaagcggaccggttcaggtggattttacggatgattaacagtaatccacttttaattgaatcctgttgttctccctttagtttgaacagcgtgaggaggaggacattttcggcctgggcgaactgctccaaaccacgtcatcctcagccaagcgaaaagcgacggaatcggaggaattgccaagcggcatcaaaaagagtcggagatgaactgagaacggagagcattgtttcggcttcatttctccaaataacgaacacttttttatgtatttgttcaaattggtgatgtcgataaatttggcaccatcaccatttgctcgcacattttgttctgctgacaaattgtttgtacgtcttccgctgcgtgtcgtcgctgcaggcgaactttccattgtccttcctttccaaacgcaaatggcctttggcttcccctccctttggtgagctttcgtccacccttcccccccacctcgccatgtccctcacctcaatttacgcacccctcccctcccgccgccgtgggagtgaaagttgctctgactgtatgccctcgggggagagggccccgccgcgacctttccctttctccccgcctcgccattccctcactcactcgtacagaaagcgcaaaaatagagtggattcggtggcttgggcgagggagggccttggtccctccccctaaccttttcactgcacacaccctcaggtgacggtccgtacttgcctacctttcagtcgccggaggggttttcctccgccccattgctctggaggggatggaatggtcggcaaacacagcccccgggggatgggggg

SEQ ID NO: 365 - DNA, 9461 bp, Heterodera glycines
  misc_feature (9407)..(9407): n is a, c, g, or t
  genomic virtual cDNA Sequence=SeqID_749; coordinates=4471..4621 ,4668..4809,4876..4897,4965..5348,5399..5580,5625..5817,5861..5941 ,6028..6113,6157..6251,6293..6322,6372..6502,6547..6646,6819..6943 ,7007..7137,7340..7535,7580..7775
  coding sequence=SeqID_968; coordinates=4471..4621,4668..4809 ,4876..4897,4965..5348,5399..5580,5625..5817,5861..5941,6028..6113 ,6157..6251,6293..6322,6372..6502,6547..6646,6819..6943,7007..7137 ,7340..7535,7580..7690
  peptide sequence=SeqID_1185
agggaataacgaatgcacagaacacaataccaccgaatgcccagcgcgggtctttcctttccaaactcacgaaactaacgaaaaggtacacaattcgcttattgtcagttctgtttactggcaattgccaaggtttcttcatcccattttcagaactggcatggacccggcgagtccggccgcacaatcactgagcggttccaacagtcagcagccccctctaaagacacacggagtaatgcgagcaggtaccatcggttcagctgcaggaacggcttttacacaaccgcagcaacaacaacaacagcatgttcaacaactttttcaacaacaacaaccaccaagcgctttctcagcgccgaacaccccaaaccaacaacagcagaacatttcccagcaacagctgacgccggcagctgcgcagttgggcacagcgaacagtccatgcccattgggcatcgaagaggtgaagccgcgttctctgcgctttacttggtcaatgaagacgacttcgtcacttgcaccggacgaaataatgaagtccgaagaacaaaggagtaaatgttacagagaatgcatttttagagaaatacgaaaagtactcgacagcaatggatgcgaatatgagcaaagggagaggtcgtcttttctgtgttttgaatgcattttttcctttaggtatttgttactttgtgcacacggcgacccaagcaaagactcattgatacaatgggagatggaggtattgtttcaggctgaatattttcggagtatttttttaatttaaaggtttgcaaattgccaagactttccctcaatggagtgaggtttaaacgtaagtttctcatttctttactgtcaaattttatcgcatacgttcttcttttaaagccctccaatcataacgttatttttatgcaaagttatataatgcgtatttattttattaagggatttctggctcttcgatcgggttcaagaacattgcttctaaaatcgctcaggagcttaacctctgacggttttgtgaaatcggatgctgcctccaaaccatttattgaactttgtcttcgatgttgtggattctgtttctcaaataactaattattgctaacattttcttctgcatgcttttgctctgttcgtgcttctctctctattcgtttgttttatcttttgccactatcgcttttttggtcggtcggtaaccaattttcttcagtttctcagcgacaatattcttattgttcgtgagtatttaaagataatttaactttcatttaaatgaaataattctacataaattgctataaatgtttggttaagttttatattagcattaataatattttgtgagagcacaaaaaattttgtttatcagggcgacggtgtaaaaaggtcgggggggaggagccggcggaggagtaaagggcaaaccttgaataaattttcttaacattcagaaaaaattcaccagagaaggggaaaaagaaaaatgatttctccatgttttggttttacgaggctaaattccctgtttttgcttgcccatgtccgccttaattcccaccagcaattatttgtaaagttgcgcactttgccaccagcgcacagtccgcccgattctcccgtccaacttctaccttattgattctaagactaattgggtttatactattttaacaaaaaatcatttgcatttgaaaattatatgcttttcaaatgaaaaaaccacaaatgtcattgaactaaaacccaaatttttctcaaaaaatcttaaattctttgacttatcattaacgttggaaggagacaatcttttattataagcaatttttacaagatattagtattcaataagtagagagtgttacggaaggacttcacttggcatttttttcatctgttgggacattccctgcagttggggagaaaagggtggactttccaaattgccacaagcgagaaagggtgggtgagagggtgttggacgctgattgtgagttgggctgtctagaggtggcgggtgccgaggaggaggacgcattcgcaggggacgacgattgatcgcagctggggttgcgccgttggaacagccgccaaccgacggtgtaagacgaaggccttgcggtggaatcagtcgaaacttaaaatgggaacacactcacaaaacaaaacaatacaaaaaattaattaattaattaacgggttttttggcaatcaacattttaaaaatgcctaaaggccgagaatttatttagattctaaggataaaatacttttgaatttaaccaaatttacagtcctttcgaacaaaacaaagttttaattttcaaaatttgatcaaaatcgcaattaaaatcgataaaaaatgcggtcctaaccattcaaaaaccttttgtcgaattcgggttagaagtttttcagagagaataaaaatctagggaaatatgtcttcacgaatagcaatccttgaagtttcatttggccaactcaccgtccgctttcgtttcctccgggacactcagtgccgccgtgctgatgccattttgtaagggaatactgcgcgaccgcgaatccaacgactgttgaagggcgattggagtaagccattccttgaaagaataacaaatttaaatgtagaaatcggaggtggcacctgagggatccatcgctcgacaaatggcaaagaaccggaaatgttggccaaacggttaatccacgggggcaactcctggcccgttagaacctgaatggaccaagaccagagtaattgcttaagaatcgctcaagtttaagaagccctttagagttcaatcattaccagctaacgagtaatccacgcaaaaattcttaagtggaccgtcttttagagaatcgtgaatttagttttgatgcccttggtgggatttccgaaccatacacaagagacaaaaacctggaccactccgctcataaattgctacgaattttaattctcaccttgctaaggatggcagagaaatggttacagtttttagtgatcaaatggtagctgtccccccggtactcttggcccaaattctgaatcattttgttcacatcttcagcagaaaaatcagtttcgcccaaaggaatgctttcccttgaataaaagagcatcagataaaaactctcaaacacaacaacctgaagttgaaattctcccccaattcttcagcatcgcgtggcgtattttcgaaaattccggaaaaggggaagggatgtccaccgtaggcatattctgaaagtgttttgcaaaatataagacaataaaccgccttcacatttaaagtgggaatacgttaaaatgcaagaaaatagaaatagtcagaccggtatcgtacacttcgatcccgctgtgaaacactccaatgcccaaactcgaaaagacgatgtcgttgagcttatacatgtcataaacattgaggaaaacaggcgcacgagccatcgtttgaaagctgtggctaaaatgaatcaatttttttaattaacaaggcggatcaatgtgaacattaaagtcaaaagcagaattgccgataaatattggacagggcaaacacaattaagagtacttctgacgataaatggaaagtggtcaagtttaaaaacgaatggtgggggtcaactgggcaatgtcaaatgggcgacgccaactgggtaacagcaaacgtaccgggcaagtactgcaagaacttgaaagataactgaggacttgaaaaaaaaattctgtcggcatttcagttatctgattggcctccagttagtatcgcacggtgtctctttccgaaaacgattatcaaggagttggtttttattttaaatgaattccctgaatacaaagaaaaggacaaaaggggaaggactccgggttcctccctttgttttgattgatttttattcgaactttacctttcaatactaattagcgcagcatttatgggaaggacccaattttttttttggcttaaatcattttttatacacttttttggtttgaacctgttggaaattgagatgaattcaatgaagttttaatgttattttaagtttgccagattaaaattatttgtttctatcgactttcatttccacaccgtcctttaataatatattttgcattttatttgtggcgttgtcgctttcttttgaattatgaaaatggtgtgcaacaacatttgttacggaattttgatgaggagaaacggccagaaaatccgccttttgctttgctttggtttttgccgcatttcttcgcttaacacacagccgcccattctgagatggggcgtgttgtttagccatcaaataattctccctctccccaccattttattcccagtgatccgctttgcacttaaatatctgatcgatctttttcaccactgattttgctatttctcagttttgtttcatttttactcacttttatttttactaatttttcagcaaatggcccacctcatccaggacggttttgtcgtcaatgacgcaacatggaaactaggcattttcatcaccgatatgaacatatcgcgagagttattcgttcgcggtgacatgaccatcggtagtctgatgatgcagttggtggggcaaattggtatcagaggcaaaagcagctccgctaatcagttcactgttcttaggcgagactcaggactggagtgaccattacatgtggtggcctgaccgccgtaagtggctgaaacacacgcgaagcacgttggaccaaattggaatcactgcagcgacttacttggaatttacaccgatgcataaacatgccaagtaaagggattaattattgcgtaattgtcttgttgattatttcatattttctgtaacatctttcagggtccaactccccgatttgcaggtgttcacatttaatttactttgttcaggcttttgattatttctctatatcttcttgacttttgtagattatcgatgcccgactcgatttttccgtgcccattttgaaggtcacccaaaaaatctgccaagaacttgccatccgtcacccggaagaactgtcgctgaagcgtgatattccgccagatattttgcgaaaaggcgcatctgtcgaatcggaggctcagattcagccatacatgaagccgggcgaggagtccattggacccggcactctccgaacggccaaacccatccgcgcttcaactgtcaacctcactagcgggcgaggctcacctgcactttcgcaggcatctgcaatgggccccggtcacttgtttaacgcttctgaaattggcacactgccgaagatgggaacgattccgcgcggaatgagccccggtccagccgcagtattcctttcagtttccaacatttttaaaatttaaatttgctccattagtatcgcgaagtgcttggacgaacaccggagcccggttactctgaaggaggcggtctcgaatgtgaccagttcgacgaaaatttgataaactcaccgaaaataactccgggtcgtgaaacattcagaccccaaaattatttggagaaagccgcgttgaaccggggatggttggactcatcgaggtgggccttcgctttaatcaaattatgtgccaattattaaacaggtcgctgatggaacaaggcatttgcgaaggcgatgttgtgcttcttcgttttaaattcatgcagtttttcgacatgaatctgagatatgaccccgtccgtatcaatcaattgtatgaacaggccaaatggtccgtccttttggaggaggtcgaacacacggaggaggagtcatcattatttgcagcgctgcaggcaggcacttgactaatacatttgaattatattattgcttcagttgcaagccgcgcttcagcgaaactctccggaccgcgaatctccggaacgtgacgaggtcgatgtactgcttgatgagttggtagggaccagaattttttctcaatgattaaatttttcttgaatttgaatcaaataatagtttttataaaattttcctgattataggaacagactttggacaccactgcctcactaagtcgccgtgatttaacatacgtgcctgagttgacagaatatctcaaatatttgaagtttttttccaataatgtttttgtatatttgtttttactttagacctaaaaaattgggttttaacaacttcaagagagcttactttacatttcgagacctttacttgagttattacaacacagctcaagatgcaaatggttataaatgtatttttaaaaaattaaattcattgtttaagggcctccacttggtcactattatctcaaaggtttatcattcggtgtccgcatatttcttgacttcaaacaattctaaaggttgcgaggtcagccaggatttgagcgtctcgcaaggaaagttcaacataaaattgcaagtgccgagcagtgaagggatgtcggaactgatattgaagtgtgacacggagcaacagtttgccaaatggatggttagttaccaaaatgagtattgacaaatttcccgctttctaaggccgcttgtcgtttggcatctcgtggaaagacaatggccgattcttcgtacaattcggaggttgaatccattaagaaagtgctgcagatgcaagcaggaagtgagcatttggttgcgaaaattttttggtggtaaaaatttgtggcgtctaaaaccattaggcggatttacaatttctattttacagtgctcaaaaatgtaatcttcttatttttgcctgattacctgataaactaattaaataagccctaacaaataagacacgcttaaaggggcagcggcagcgcaaaacggtgcacaaaacaagaagaaatcgcaaccggtgcagctgcccacggatttcaattcggaagagttcgtttgtcagcgatattggaagagatcggggaacaaaagcgtaagtcaaacagaggaccggggtaggggaggaaagaaagtgttaaaaagttttattcaaaagatgcaacagcgcatttcggatgcccattcaaacgtgaaaacattgagttgcaccgaagcgaagcttcagtacattcgcaattgggaggctctgcccgagcacggccttcactatttcatcgtcaaattcaggcattttcttttccattatacaatttgcgttttttttcaaatttaagtggtactatttatacttcaaaaatgccaattaaatgtactcatattacaaaacttattacccaaaactttatttacaaatggtttttgcaaaagtatgtaaaaaatatcccctaaactctaaaagtatcctgcttatgcctttttgattttacagaaatgggaagaaagctgaactcattgcggtggctcacaataggatgatgaaagtgaacagcgacaacggagaatcatcaaagacatggagattctctgggatgaaaaaatggcacgtgaactgggagataaggcacttaaagatacaattcgacaacgaggatgtcgaattcaaacctttgtcagcggactgcaaggttataccgaattgtaaaaaagaaagctaataaagatcaaacaggttgttcatgagttcataggcggctacatttttctctcaatgcggagtaaagaccaaaaccaaacactggacgaggaagggttccatcgcctgactggaggatggggatagaaaattttatttgtaaaccacaactgccatttcaatttgtcatagtttctcacatttaaacaaaataaaagcgacaatatgcaaagtacgagaaggtattcataaatgttacaatacataagttgcacaatatcgtaccagccccatctgaaatcataaaacgctttcgaaatcgcggtctaggagatatccataagattaatccagcgtcggaaactcggcataaaattagacaatacattacttcaaaatgtagtagatgtatttagaaaaacctttttcatcatcacatctatcattctgccaaaagtggtcgaattactaagaaaaaataaaataagaaaataactgtattttagaacacaccctaagtattgctgcatgaatttcttcgcgtgttcatgtttttcgaagatcagatgaacatttgattcactctcctgccagattttcttaattaagtcactttaatagaaatcctattatggtgccacgaacttttatgggtccgattttgctggcaatgacttccactcttctacaggggtcgtccaaacctgacacatttgtcacaacaactgctaggtacggtctcaatcggtttgctgtcatcttttgccgctgtgttccctccgtttcttctgctttctttcccttcccttcgttcgtttcgtccttttgtccaccttctcttgcataaatttcttttcggtgttggttttttttgcgcgcaatttcttctctcagtttcttttgttcttcgattttccttaggtagtcactgtcaagtccaattgccttcgcacattccatcgtttgctttgataaatgcgcctaattcacaaattaaaaggaattgttgccttaagtgtgatacaacctctttcgtctgtctttgcgttcttttgccttgtgaaatattgtgcttcaaacgccttttgcgtgtcggtggcgatgtctttcgggaatttcgactgttcgatcgcgtcgaagggtgagaaacgggaaaggaagaatcggaggatggggaacgattcttcgggtaattgcgtggaggaactaaaacagagttcgaatgagacaacaaaagatgtgataaaataatacccgaaatagtttttttaacgaaatcatcgaccatcaaatgccaattttggctgctttttgaggaaaggtgttgtaactgattgctgtgaacaaaggactggtcgtgagaagtattgaaaacagatgggtttatgtaaatgttgcttgcaattgttggattaaaagaagggtgataatgtgcgacgtttgaaaattgagacgttgagcaaggaaattgcggagcttttaaaggcaatgcattggatgagttaatttatccgagaatacctaatagatttctcgaagcattctgcgaaaattgcatcaatgggaaatcgttcagtccggctcgctggcttatattttgtgaagtttgataattaaaaagctaaatcaataatcagtcgaacagttttcgtggtaaataaacatacattggtgggaagtacgactgaaaaagcattgagacttggagctaaattttcctataaattattttgtaaatggattacatcattattaataagccaaagatcaaaaagtagcaacaatgaaattaaatttttagtaattacgaattaacatttaacaaatttgaagttaagaggaactcaatgttttatttaatatnccatttttgattaagtgatgttttgcaaatttagggtttaggtaacattggacg

SEQ ID NO: 366 - DNA, 9104 bp, Heterodera glycines
  genomic virtual cDNA Sequence=SeqID_759; coordinates=6794..6651 ,6478..6257,5958..5847,5549..5372,5022..4893
  coding sequence=SeqID_971; coordinates=6760..6651,6478..6257 ,5958..5847,5549..5372,5022..4904
  peptide sequence=SeqID_1188
caccccaaaatctcgccgccgaaatttcaaaaaaaatcaaacagaaatttttcaagggaaaaattcttagaaaaattttttttataagaaaatttaaagaaaaaattgttgaaaatttttcagtatttttttttgaaattttatgaaaatttactgtttttccgaaaattttcaaaaaaaacttagcaaatagttttttttctttaaattattacccttaaatgttccgtctgcagaccagtgcctgtggcgtcttaatcgcctgaggccgttatccgtcacaaatataaaaaaacaggcaattctggttcttgctgtcttgaatcataaagcagaaatctctgcccatcatttccaacaataaattcgccctttaacaagaaattaaaatatctatatattttaattacttcaaggacaatggcgttgacgtcattttgatcaatgttttctcgtcctggaatatgtctttgcctggaaattaaacggttagcagttgaagttgacggcatatttaaaagcgattcatcatccaaattagcccgtgccgccccaataatatttctgggagcatctgcatgatttgcggctctgcttgatttgttccttgcgatcacgcacctaatgattccaaataattcaccgttatcattttaattacggtatgttgcgttgaatcgattaaatggttatgtgctgtaacaacgcgaagctcgatcgatccaacggcagaatgagcgcggcctggacaagtttttcttggacaaacccagacctataccaagattggacaagtcttactacatcaaacgacctgaacttctcatgccgctatcacatttttttccgccactcatacccattaaacaggattaaatccttgccctttgttgttcggtcggctggggcttcaacaaagctttttgaaattaggcagaaaaaaagacagttgcatgaattccaattcgcatcattttatcatggcttgttgacaaaaaataagattttttaacggctgtcggcaatgagaattggcctagccctcgcccagagagttgccatcagctgtcacaagcatcttcaacgtcagaaataaaaggaatgaacagctgtcagcagtgagaattggactttgcttctcccctaggcgggaccttgacataggctgtcgaaaacacttcctacgtcagctgtctgagcttttctggttgcttataagtagcaatttgtctcctaccaactagtcaaaatgcattgttcccttatccttttgattctcttttccgctcttatttctacccatggagagacgcatattttacggtcaatcctcacgctttttcgtcatctcctacgaaacggtggccgccattattctgtggttcatgcagaaagaactgcattaagggctgcactaaactcagggaaaagcggaatagctcataccctcaagaagggcacttcgaaattaacaacaaattttgccggtggcgttgttgggggagcggcggctgagaccgcagccaatttaattaggacaaaatgtaaaccccctatttatcaaaaccaactcgtaacttaagcacgatcaccatatttcttcccagtcactgttcggggaccaaaaaagacggaatttttcttgaatgaagagtattttaccaacgacgaagacttgcacaatttttttgatgatggaaaaagctgcaggggtaataactccagcctgctgttaccttggtcaaaattaatttttaaattgttaaaaagagtatttccacagatgaagatgatgttctgcgcatgttgatcagaacttcaaacatggaagttgtcagaagcagagccaccacaattaacagacaaacttattttaactgtgacgctatgtgtttgttgccttaggtgtccatatgaccgtagtttaagcattttttaaaatgacgctcgttgggccttgagcaagccattggaaataaaaaatttatttttgtgtatttaattgatgtattgaaaaagttaaatattatgatgaagagaataaaatatcttattcttaaattgataaaatctaatagtaatatttattcaaaattacataaaataaatttaaatgaaatgtagggcaaagccgcaaatgtccgattttggcttgggccgcaaaattcagcaaaaaattgggccgcaaatgtccgaaaatggcccttaagaaatgggccgcaaatgtccgatttggctggggccgcaaatgtccgagccgcaaatgtccgggccgcaaatgtccgggacgcaaatgtctggacaccaaattgacggggggaaatcaggctataacagcggtgaactgcttgaattcgaggttcccaaaagtggatgaacattttaccaagtatatttattgaaattatgtaaattgacggtatttattcacaaaaaattaaaccttgtcggggcacagtgccaacagttggccaaacttggcacgggcatccgccaatttcccatcacgttcaagcctgaaatgcaaaattaggcgcaaaaaaatactatttttgcaataaatttggcccaacatgattacatttttcattgagaaaagcagaataggacaaaatatgcaatacaatgaaggagaaaacatactccttggcataggtgtgcaacacttccagcctgtacttgttggcattccggtggttcggctgcagttggacggcacgctccaagtcagtcagtgcggcggggaaattgcgacagccggcacatgccgcgccacggccaacatacgcgtcggcacagtgctcgtacactacacattgagcgccttgttgaagcactgggccaagcaaaattgaggggggaacaaaatgccaatgttataaaaatgggaacctgaaaattttagagccacgccgcccagaaaaattatccgatgcccgtgccatggacaacctggatagcctcgaagcatttgttgtcccgcgtcagttcggcaccccgtcgcacgtgtgccatcgccaatttggccgactgttcggcacgcagctgttgcgcggttggcatggccgatgatgagggtgacatgccgccggcgtcatggcgtacggcagcggcgaatttggcactgagtgaagggaggccggaggaacgggcacagcccaacggaacgccgagttgggcggacaaattggggttgtcgcgcaacgattggatgtgctcgctgtgttcaaatgtggtccgatcgaagtccctgaacggcgaggggtgaaataattgcgttgaaatttaaatttttgcctattttttaaaataatttttcgattcgaatttggaagaaagttattttatattataaaaaaatcagttagttagttattataaatgagatccaaaaatggcttcaaaaagtcattaaatacgtagaaaaccaagtatttcttgaaagtgtcactaaaattgggaaaatctctcctccatgaaaaatatataaaaatgccttgctgtgtaaggattgcctcaatttgtaaaaaggggaaatgaatcgtctcgtcacatgaatgtcacaaaaatgcaccaagaaacaccgtggtattgtcagtagaagaaaattgctcgctgtgttcaaatgtggtccgatcgaagtccctgaaatggcgttgaaattttggttttttttgactatttttattatatttttcgactcgaatagagtgttatattataataaaattaaagttggagatttaaaggactacgaatgaaaaatcatattttaatcttaaaacccgcgtcatttgttcgaaattaccgctctcccccgtcgaaaaatgatactaattgtaagtcggccaccttaacgcctttatatgccttttttcgttgtagctaccgttttaaattgcatgaaacggataaaattgggcccaaatgtccgttcccgtccacctacgtacctcgttctcgtcaatttccaactccaactcttctcgccattactcgtttttgtgcgcctctgaatgaacgtctcccaatgccggaatcatttttaggttcccaaaatgcggctttaaacatcaatttttagagttattggacttttcaatttacataaatcacaattaacaaattaatacctttgcagccttaaatttatttccatgccaacaagatcttacataaccatttacatgaaacgagctcgcttaggtttgtttcctccgttttgttcatcgtcttgttccttctcattttcctcctcttcctccacttctccgcctttcttttcctcctcttccttttgcttctctttctcctccttttcgtccgtttttccttccttttccttcttcaaagattaaattttttcaattaaaacttttgattaccaaaaaatcgacgtcctcctcgagcgtatcgaccacattttgagcggccaggaagtctcgctccatgcgagacattggttcgtccgtgtgtgttgtgcgctggccttccgcctgacaaagtgcgtttcaccaatgaaaagggaatcagttctgttatacctttgatttgctccgctctgcattgagcgcatttttcaattgttcgatttcatttttcaattgttcgttttcattctccaactcggcaacacgggcttttgcctcctccttttgcttcttttcttcctccttctccttcttttcctgttccaactcagccgacattcgctcgcatgacgctctaagatcatctacgttctctgactccttaaattttttgtttgagaaaaaaacaaaacaaataaattaacttttttttcaaaaaagggggactaccatcggtactattaccaaatttcggaaaaaatgtcagcgtttttgtgtctgtcctccaccgccttcgttttgaaatttgtcattcaaagcatcgattctatcaaagtgtcgcgcaaatcggtggaaattgcgctcggtgccgcgtctcccaatttgaagatggactccaacacggacagttcggcggaagtcgtgtcgaggcctgcaaatgggaaaacggaatttacaattatataaaaattgttgattaaagtgacagccccgcccacatccgtcgccaattcctggaaaactaaacaattcggccgaattcgcttgatgagtttcagtttttgggatttatgtcttttctgaatatagtttgcttcaatccgattaataaagttccgtatgagagcgttgaaaaataaagtccccaactccgagatttttgtttcatcgaagaaattatttaaaaatacccaaccagtttgaaaaatgctggggaagtatttaatttggaatgaaaaagccgaattggtatgtcacggcacggcaccaccaccactcgcctgtgaatgcgatccaatcgttgacgcaacagccggcaccgatcagttccgagccgcggttgaccgtcccggcgaccaccggcacttgggcgagcgaggcgaactcgcgctgcacctccggcggtgtctttgccgccaccaacgcaccgtttgaggtcatcgccgcgtaagagcccacctaaattgacgtggggaaatcaggctaaaacagcgatgaactgcttgaattcgaggttcccaaaagcggaaaacatattttgttttttttggaattaaacatctatattccgttatgagaccgaaactgatgattgtgagacattccattttaaattcaaaatttgacgctattttctccaaaaattaaaccctttcagttcatttgttaagctaataacggaaacaagagcattttggacagaaaaatcatgaaaaacccaacagccacaaaatgttgattaaatgcccaaattaccaatgcattttcgccgagactgagccggaacacttccactttgagcacttcggccagcgccgcctccgtttccttgcttatgtccgcgtggacaacagcgatgtggtcattgctgaacggaatttgagtaaatttgcaattttttgcgccaaaataagatgcgagaagctctggactttttgatttgctcatgcactccaaaatttaaaagaaaacaaaggatcgcaaaaatgcgtgccattattttggaggcataaatgccacaatttgaaccaaaataggtatatcagatggttcacattgtgaccgccatttgtcgacttaaaattatttttgcagctataacatggaaagccctggacaacaattagtcaataattaaatccaaatttaggagcaaccaaacagaccatgcaattacattgcccagcgctgacaaccgttcgtcaaccctccgaatttggaccgagtcaggcaaactgttgcggatgtgctgcaattcctggtccgtggtcgcgttcggcaccaacagtccgtgccgattaccggccgtcacacggccaacaatccgacagcccgcaactgtgcaatggatgaccgggatgacgtcggccaactcagcctccacaatactaaaaaaacaaggaaattttcattttcaatccaccggaataaaatgggtaaccaaatcccatcaccgattttgttgcaataattctggatttacacgcccatttcggtttaaaaacagcaattttcaaagaatatatcgccaaaaacggctgctctattcttagcaaacacctgtaaaaattttcggaagaagcaatgcccaccagacaataagcattggtgagtttacagaaaactccgacatcattgctcgcctcaaattgggcacggagtgcgaccatttttaaatttactttttccaaatttggaaatcgattctgcgaggcaaaccaacaaaatctttcttatataaaattgcaattttaatttttaaattatgaaactttgaaaacaaatgccactttctgtgtcaaaatcaaaacatgcgctaatttgaaattcgcttattaaaattttgtaggaagggagatattttttcattttgagtaattccaagaatttgtattgatttctcgagacttagaaaatgtattttcacattaataaaaacgatgggaagggagggaaatgatgagaatgagtcaccgccctgcaatttctttaatggccaaaaaatttattgtgaaatgtaaaatttattacgtaactgtcacataaatgcagggctcggatcgaaaatttttcaaaataagaacatcaaggccaaaaaataagattttagggtcaaaaataagaacatttcgcaaaaattgcttcaaatcagttatttttaaaatttattcgatcaaaaatgtatcaaatagtatatttttggtctcccattaatgattttaacaattttggggaggaaattagcaaatcataaaattttagtgcattcgggataaaaaaatcagatttttaacaattttttgcggcgtatttttccaaaaaacttttgggaagtgcgaggggagagggtccggcgccgcctgaaaaattttttgtaatttaattctgatttgttaacagattttcaccaaaaaaggccaatttttttattaaaagccaagcggcgattttttgtctttaaaaatacttttttttgcggtgcgttttttcaaaaacttttggggaacaagtggggagatggtccggcggtgccgataggcgccaccgggaaaaattttgtaatttttaatgcgatttgctaacagttttttgtcaaaaaataaccaaattttgcgcaaaccttatattttcttgataaaatagtgacattctgccataaaatttcaaaattttgaatatatttaagaaataagaacaatagcccgaaataaggacaaatcttacaaataaggacatttttattttgtaagatttggaccctccaaataaggacaaatcttataaataaggacagatccgagccctgcataaatgatgattcgcatggcattaaaaagcttgattttaaaaatttgcatgaattgaaacattttcttcacttaaaaatagagatcggaattttgagaagatacggatcaggatcgggattacggactaggcacacatacggattacggactaaaaatccggaaaatccgtagtccgtaaaaatccgtatccaggaaaaatacggatccgtatacggatacgcattttttttaaatttttttcatattcgataaaaactgatttataaaaatcgctgacccacaaaatgtccagcccacgaaatgtccaagtctcgaatttgagttttttattattcagatgggcctaaggttaggcaaggggtaatataaagggtatattcgtattcagcgaccccgaaaaccctaaaaatcctaaattaaactcattttgtttttataaattttgaaaaattttggacatttcgtgggtttttactcttttggacatttcgtggcttggacactttgtggggccgccataaaaatacaaattttgaatatttaaagctaaaagatttataatcagggttcccagatctgaggctttagcctcattttgtggttttttgataggtcaatgaggataaattttcaaaatgaggctttttgtggttttttgataaatttcgaagatttttggggaaaattcgtcagattttttaaattttgattaattttgataaattggcataagtttttggccatatttgtcgacaaatctgttaacaaatcgtattaaaaatcacaaaatttctcccggcggcgcctatcggcaccgccggcccaccttgcgccccaaaagttttttgaaaaaagcgccgcaaaaaaatctacttcggtttttcatgcttagaatcccaaaaaatgcttatttctaacaaaaaattgctcaaattgatcatggacaatcaaaaataaatcatttgaaaattttaagcgtgttttaataaactttaaaaaatgaggctttttcgtctgccaaatgaggcttttgaaatttttgatctgggaaccctgtttataataaatttattataaattctaggcaataaaattcaaaaaatactcaaaaattttttcttacacgaccatttattgcttttcacaccacttttttgcggcgcgctttttcaaaaaactttttaggaaccggcggtgcctatag

SEQ ID NO: 367 - DNA, 5633 bp, Heterodera glycines
  genomic virtual cDNA Sequence=SeqID_763; coordinates=2368..2194 ,2153..2115,2071..1973,1926..1848,1793..1717
  coding sequence=SeqID_1012; coordinates=2368..2194,2153..2115 ,2071..1973,1926..1848,1793..1717
  peptide sequence=SeqID_1263
aagcactcactttgatctcattttgctgtctcattactgacactgagttttgaatgtcaggaattatttacagaaaataattggttacctgatccgatggattgttttcccatttcggtgctttctatcggacaaaagtctttcttcaatttgctaagcgacaagagaggggaattgccctcatttccaaccaaaacatcgtggataatttggttactttcgccaacaaataaccgaatttcgcccaccacagttcggctagcattattattgtacacatgagcagcgtttttctgtaaccgtcatttaagaaaaagtaaagaaaatgctgtaaaattaccttttgagtgccattttgtaaccatttacatttgagcagttcgaacaaagatgtaattttgtcatttacattaatttggaccatcaaaaggggattttgctcactggcaacaacaaattctctgtcctggttcctcaatggcttaagtctgacaaccaaatgttgtgggatttcacagtttcttctgtcatctgaaccaaaagtaaaaaatccgtaatggcataggcaaatgccattgaattacgaaaactcacatggaaagtatttgagcaaagctggacagtaaggcgtcttcaaattgacaataaactttttccttttcggtcgaaaagatgcgtactgaaatgaaaaattggtgaaggaaagtcaattaataatcaaacagaaaacgtaccccttccattacgagttgcttgaactttttctcgtcaaatgacaaccctttgagccgtttacgccactcgaaaccattgagaagcacaaacaattcccgggcatcgcgtggaatgttctcccaatcgacgtcctcaatttgcgctttgcacttccacactttgaaggtgttcaaatagtagttgcgcacttggtctttgtccttgttgaacttctttttgagcatgaactttgaaattgcgtcaaaatctttcccatgctgaaatttttggtttaggcttatcaattggaccgaaaatcttaccaatttcaaagcctcgtagaacaccgcttgttcgtcaaaggtccaatacattcgccgagttttgtcaaccgtttcaacggaatttgcatttgttgtacactttgaggacgaagcagtaaaatcagaagccgtagtttttatgctcaaagaaaggcccgcagaagtggagagaggaacattatgctcatttttgtcagccgaaacgcaagttgaagaaacaggagttattgcttttttattgctggacagatttggaggcctaaagggaggaaaaaataaatttaagtataaatttatctgaatttgagttagcacaaaatatttgaatttttagctaaatcccgtgttcaagcatttttttatcttttacttaaatgccagcctccttctcgacactataagtgctgttgaggagtcatcgggcatcataccatggacatgtgacggcgaattcatcggcaccaagtgcaacaacaattgtaaaaggttcatgggaatctaacaataaaccataaaggatgttcgagcaaacaaaattcattgaaagcaactcgattaaaattgtttatgaaaacaacaaaaacataaaacaattgacagatttgatttgatcaatctttgaacacctttctgttcccagttggaactttggatttgttagaggcgcgggaaatgttcttcagccgttgcaactcctgcttgttattcttttcccgcttttcctccgccttctcagcaaaataatctttgtatgggtctgaagggagagaatgagcaaaaaaaaacggaagaaataaaaaaaagactcgcctttttggtcgggaatttcaatgagccattccttcgattggttctcggctcgtctgtatccgtatttcggcttccattccttaacatattaacgattgaacaattcgccaatgtctcagattaacctgagtcgttttgtcccagactttcctgtctttcttctttgttatccctttagccctcgcgaacttctcccatttcgttggttctttcggttttggaatcttagaatttggaattatttaattaaaaatttaaaaaatttacgggtttttcacgaggaaggccataagtgtattcgggaagctgaattttataatttaaacggacaaattattttgtacacctgagaacaagtcgcatcttgcacaatttttctgggtaatttccatatttcattgaacaaaagctgggcatttttgcttgtaagttcgttaatccgttctgagttgctactggccaaaccttcggcgtccgtctcaacatcaatgagtaaaagattgccaacatcaatgcaaggagcagtcattggtaaccaacaaatcaaatatgtgaatttcccaaagcaaatacctaattgtttatctcttgaattggcattatatttcttaaaaagcacaacatcctaaaaataatatcgaaattaaataagcgtataaattttggcttagaaattagagaaacacaaagaatctttaataagtttatttaacacaatattattctttaaaaatatgaaaagctttgaaaattggaagtaatttggaggtaatttgggatgtcagtgggtttaagtcaaaaaagattttcaataaatcgaattcgtcatttttcgttcattttctcagagaagttcgatgccacgctgggtccgcacggcgcagtataattcgtccattttggagaccttagggcataaactgctgggcctgcaaactttgtccagcgggtaacaacgtcgcgcttccttacacatgtacattggatgcgaagaaaaacgcgtgcattctatgaaaaaatattatttttttaaataattaattttatcagttttttaataaaaaactttttcaaaagattcaggtgaaaataattaaagggaaatggaggaaaggttcgcatttattaaagtttaataacgcatatatagtaacaaaagagcttatgactatcgtatgcaggagacccaagggataagtcattgatttatccccctccgttccgcaccttcgcatgtgcattccttctcatctgatgcgtcctcacaatctttgtgtccgtcacatcgtcccatactcgaaacgcaacgacgctcactttgacaaagaaatgcttcatttttgcacgtctcgcagtcgcgctcgtcttccccaccaatgcaatccgtgtatcctgaaaaagaaaaattcaatttttagtaccactattaatcagctaattagcactcaccgtcacatttctgagactctgaataacagcgtccagtcggcagtcctttcccgtggtcttggcactgaaacgcgtcgtcgcagtcacaattcgactcgtcagaaccatcgaggcaatccattttgtcatcacaaaccttaatacgtttttacacggcatctagtaggatgtgcgagaaattatttttaccgagaatcgagaccggaaaatgaccccgggaaacgatacgagaaccgagaccccaaaaaacacgagaaatttctcgactcgggaatcgaaaatctaaaattttttagccatttttcaccaaaattactattttttgccattttggtctcaatttttcaaaaatatgataaaatggggggtccgatggtgccgttaggagccccagggaaaaattttgaaaattttaatgccatttgttacgaaaattgcataaaatttcaaaaaaatttgctgaaaatttttactttttgggtttcgaggggggggggggggctttagccgcctcacccaggatttcggcttgggagtggtacatcccccgggcgacgcgacgaattctgtccaaaaaatgaccaattttgcgattttgagtcatttttagcagattttcttcaagtaatagttcacccttaccgcaataggcgccgcgttagaaaaaaatggaatttttgaatatgtatctttcttcagatttcactgaaaaatgggtaattttagattccaattttttccgagactaaaaacccgagaccgggaagcgaaaaacccgggaaatttcacgagtcgggaaccgagactctcacacatccctagcatctagtacaattgagatggatgtcattcactcataggtttttaaaatggattacaaccccaattgtttatgaataattcaaattaccagcgaacgatgaatgcattcattgccgttgctgtcattggaagtctttgtgctgcccacacattggaatgcgctttgcgggttgcaccgatcacagaatttgttgcattcggggaaaagccctccgcaggcgacagcccataagcgagtgactccatcggagcatttgaccattccatccgtattcttgtcctccgttctgctcgctcctttgggcaatgatggacaaatgccatggcaatcgttttcgtcctcccctcccggacagtccgctcgtccgtcacacaatcgtcgcctgtccacgcaaaacttctgctcgccgtcacacaacgcgctgttcattccggaacaagaaggacaatcgcagtccttgaaaagacaattaaatgtattttattttttccaaaagcataatgtaaccaaattaatgtttaattattatgtaatgtaaaaaaccttttcgtcactccctccgtccacttgacagtccacttctccgtcgcataacttccgttttggcagacaatggtcaccgcatcgctttgcttcgcctatatttttaattttttcctataattcataaataaacagttgtgttattccacctcgacattccgtgcagttcagttcgtcgtctccaaaaggacaatgttttattccgtcacagaccacttccttcggaagacaaatttccgacacgcgacacgagaattcttttttgtcgtcacatttcgcacctttaaatacatttcaatccaacattatttgcaaaattgtagatgaaatgacttacggcaataggtcttagaatcttcgtcttctccgtttgcacaatgcgtgacgccatcgcaaagatgctccggagtgagacagaaaagatgttcaggacgagactttgatgggcatgacagcgaagtttgacagcctataaaagattgtagaaacttgctcgagaaatgtgtgttgtactttcacagcccatttcatcactcgagtccaaacaatcggtgtaaccgtcacagcgataattctttggtatgacgatgtgctttaattcaatttttaataccctattgtttaaattaagcttggacatttactaccggttggtccagagcaggcaaagccgaattcgctacaaatgctgacgtttggaggaacaaacagttcagcctggacgatgagatcatcagcatcctcccagtcggtgaacttatgaattggaacctttgaggcatcaggccaagcgtgatgagtccggtggacggagagaatattcttaaaataaatgcaattgttttcagaaaatgtaaatgttatttgtgaaaggttttttaaaccaaataaggatttcattgtgtatttaaacgagatccaaatcattagataaaatagcgattttaaagcttgcttttccttcttgaaga

SEQ ID NO: 368 - DNA, 2950 bp, Heterodera glycines
  genomic virtual cDNA Sequence=SeqID_768; coordinates=109..275 ,403..516,689..972,1225..1396,1521..1728,1796..1867,2044..2427
  coding sequence=SeqID_890; coordinates=109..275,403..516,689..972 ,1225..1396,1521..1728,1796..1867,2044..2283
  peptide sequence=SeqID_1120
cagaaaaattaggtaatttcattcaattttcaaaacttactcatcaaaaccaatgaccagtttggagaaattctgaatattatctttttataaaaaaagaaaataaagggccgaatgctgcacatattcgccggcgaagagaagagagtgcggacgaacggtgcagacgacgacagcacaaacgacggatgccaaagtgcgttccaacgcgaacggaacgaaaaacgcaaggcgaacgacgcggaaggggcgacagaggcggcgacaaacaatcggtgagcaaaaaaggcaacaacaacaaagcctcggaacaattatccgaccggtggcaatgtgctgcctcggaattgtctcccattaattaatgcatttgcaactaataatgttttcctctctgttcagttgcacttggaacgcgctgtttcttggcactgacgcggtggcggagacattagcggaaaattatgaagtggagaagcgcgatttgctgctggttgacggcaaacagcagaacaggtgagctggggacggagttggaggagtacggattcgacgtatccctccgtacgcccccgtctctgttttaagtcggcatcaaaattttaagatgttttattgtttaaaaattagcctcatttggttgccaattctgctctctttccccctttaattgatatttctcccatagtgccgcggtgcgcgtggcaatggccgaggcgcgtttggtgcgcgagacgcgcaaattcctgcttgacaacggcgttcggttggacgcgttcgcccagcggtggcaccttttgagcaatggtggcgacaacgtcgacggcactgaggacggaaccgcaaaaatgagacgttcaaagacgacaattttggtcaaaaatttagacgccacgagggaagggaaaaaggaatggctgcactctctgtttggacgctttggggtcgttaagacggtgctggtgccaccaggtcggaaattgactgaatatatttcataattagacggtaatggttacttttattcaatctgcgagttttttaaccccgatgtaattagctgcaagtattttggcattgcttttttcaatacatacatgaaaaacctctcaaaaaataaccagaaatgaataaaaatgaacacgtaactcgtaaagttttgtttttagtttttgtgccatttaaatgtaatgtttttccattatttcccccttcacatttcaatgcacggaatcactgcgatcgttgagatggcaaatgcccgtgacgcgaagtgcgcctttgaggcgttggcctactcgaagaaacacactccgagcgggggacgaccgctgtttttggaatgggcgccgtccaacgtttttgacgaggcgcaccccctcagagcaattggacagtcagtttttccaaggaatgggaggatttaatggccaaatcctattacattattgctaattacctaattatacataatttttcatattccaatgatatgcaatcttttttcccgcctttctcagttacggctatcagcaaaagggtcaaactgccgtcctttctgatgacccatcatcagttgggcatcagtccccggcggagacgaaaatggaaaaaacagacagagagagagggggagaagaggaaggcaaattggaggagaaaccgaagaaagaggagaaggaggacgagaagcacaccaaaatactcgtcagaaacgtgcctttccaggttaagtcatgccacccattaattcctgtggtagaaaatgcaaaaaaacattttttaaaaacttcaggcgaatctcaaggagcttacgcagctgttttccgcatttggtgaactcaacttcatccgattaccaaaaaaggtaaattcagcaaaataaaagggaaggcaaaagtgagaatttttggtttcggagaattattatgtgcctttttggactgtggcacaattggctagaaaccaaatattttggaatatccaaggcatacacttggatatttttaaatctaaatattttacaatattatttttattcagcctggctccgaaggccaccgcggcttttgtttcgccgaatttctctccgtgagcgacgcgcaccgcgccatggacgcgctggtgcattccacgcatttgtacggtcgacggttggtgttggagtgggccaaaccgagcgaagaaagcgcggaggagaagcgacagcgaacgcaggacagaatggcaatggccgcgggcgttgccggggcgaagaaaaggccgaagatgcgatcattttagagccagtttcaagaattggcactttttaaccgttaattacattaaaatggtccgtccaccttgcgaaaaaatgttgttactgttatcttttggtcatttgtttttataacaatttacacacaaaaagagatcatcaccaatttattacaatcaaaaactggcttattcaatggtacacacatgattttcacacaaaaatgcattatttcaattgccaaattggacaaagataagttatcatgtaaaacaactaccttttacagtgttgtgcaagacgaaaacatggcttttaaaaatgtatactccagaaaattctccgatttctaaagtctcgacttcgagggtccccccccccccccggaaaaagtgggccgggtgtttacgtcttgcacagtaccacactccgtttcattggaatctccgcataatatccctctactcatttattggtggttcgtccccgcttcttcgcctccagctttggccgcttcttcacctccacccatccgtcgtcctctttttctgtcgatggcattgccccgtttgtcttttgctgttgcgtttcccttttcggcaccaccaagtcgctgaaatcggtcggtcctcgcactgttatgctaaaaaggggaagccagtgcccgtccactgaatggtactgctgtcccat

SEQ ID NO: 369 - DNA, 6061 bp, Heterodera glycines
  genomic virtual cDNA Sequence=SeqID_769; coordinates=383..494 ,1377..1498,1871..2056,2770..3108
  coding sequence=SeqID_984; coordinates=383..494,1377..1498,1871..2056, 2770..3108
  peptide sequence=SeqID_1257
gtggtccttctaattaagcctcggcaaaacttttaaaaaattttagtttagctttcaaaaaagttacggccagaagaaattcaaaaaaccaaatttttccaacttttttcggccatcaaattggttcaaaattaacaaaattttttggaattttgcaggctagtagatcatctgaagagctttcgaatgataccaacaatgttggatttggacgagaaagaaaaaagtatagtggaaaaacatgtgctggcgcccaaccgtgcgcgcccaactgaggtagaccgggcgtttgttgtgcattagttaaattgtttttgattttccatgatcaaatcgttatgtagtttaaccctccgaatacaaacaaacaaatttaatttgcaggaggacaacctgttcgagcagttcatcctgtccactcaaattagctactgttactatgccgactcgcatcgcattctgggcaacacctttggcatggctcgtgctgcaaggtgaataaaatttcggagggtggaacccaaaaatattctcttttttttttcttttttcttttttgctctgttaaattttattctccgtatgaaaaaaggcaggaatttgtagtcttctttttcacgaaaaatgaataatttttgtctttttggtgtcagaattttcaaaaaaaaggggtagtaagagcggggttcgggcgttgccgcgcctggaaaatttttttttggaaaccaagcaatttgttaacaagggaaaattccgagctgtgagtgggaaaatgcatataagctatataccattggatagagcggggtcgacttgtattgtgaatttttaattttagcggtgcattccgcctgcttcaaaagttacagggcctcgaaactcgaaaattcgtgcttctgtgctcattttcaacttttttcactttatatcgatttttctccactttacaatgacagtacacatttattttaaacaaagaaataattttaatgcatttttcatatttaaaaatgtattttttaaatctttaatttgttaaaaatttaattaaatttatttatttttatgttggattcgaacccggacccccaaaattaggaatttaaccaactgagccaccaacttcatgtgaaaacacagccaaattttcgattttcgaggccctgtaacttttgaagcaggtggaatgcaccgctaaaattaaaaattcacaatcgaccccgctctatccaatggtatatagcttatgtgcattttcccactcacagctcggaatgttcccttgtaagaaattttcttagagaccattttctactgacttttgtctttctatattcactactgtctcactcacttacaatttcggcacttttcagactttgaggcacttacgcccaaccttttggcccgaactgtcgaaacggtggagggcggtggcctcgtcgtgctgctcatccaatcggtcacctcactgaaacagttgttcaccatgagcatggtacattaaaaagccaaaaaatcatacgaattttagttaaaaaaaaattgtcttggaatgtttcttttttctgagaattttaaaatttctatgattgaggggcatagaaagtgcccgactagaaattttttagaaaatccgggcacccataactctactaaaatcagaaaaattggagctaaatttttggactaaaaaatcatgttgctctgtttttcatgtcccttaaagtaaaatttggtgcacacttctgaacattatatgacgatttgtgggtgccaaaaaaatttttttttaatgccaacaaaatagcgccacaagggatttgtctgtccattatttatttattttgattgccatgcctttgcgcaggacgtgcacaaacgctaccggacggaggcgcacgcggacgttgtcgggcggttcaacgaacgcttcatcctttcgttggccagctgtgccaactgtgtggtgatggacgactgtctgaacgtgttgcccatttcctcctccgtcctcaacatggccaatttgccgcccgtcgtcgcccagcaaaaagtctgtcttattttatcttaccttgaaaatatgccgggttttgagaggagtcagtgccggttttttttttgccaggttttgagagtccgtgacaggttttttgccggctttttcaacacatgtgtcggatttttgggctttgagtcttacgtttcaaatatacccatttgcacttatagaattcaatggcggatttctgtccatcgattcctctagaattatccatagtaaaaaatattaaatcgcttcttttcatacataaaaaaggggggtgggtcggaaaattttttgcgaaggggggtcgggccgcccgatgacctttttttgtttttcaaaaaccgtttttttcggcgcaagtttttccaaaaaattttcgggaacaggggggccggcggtgccgttaggcgccgccggagaaaatttttaagttttgggtgtgctttgttaacagattttcaccaaaaattgccaattttttaagaaaaatttggattttggggtccggcggtgccgctaggtgccgccggagaaattttttttccgatttttaatgaatttgttaagaaaattttcaaaatttgcgagctgcgaaccctctcctcccacctcttttacacggaccccccccccctaaaaaatgtgcttctttttgcatcccttactaaattaggtaagtaagttcataacggcaatcaaacccaaaaaattcacagagtgccgcgggcggcgatgtgtcgtcggagttggcacggctccaacagtcgctggccgacacaaaacccatcggcccgttgctgcaccggtgccgcacactgtgccaggccaaggcgctgctccgcctactcgacctggtcaccgacaaaatgtccaactcaatgtgcgcaatcaccgcggcgcgtgggcgcggcaaatcagcggccatgggcctggcggttgcgggcgcggtcggctgcaatttgacgaatatttttgtgacgagtccaacaccggagaatgtgcgcacactgttcgaatttgtgttgcgcggctttgacgccatcggataccaagtgagttctttatttgttttttggcccagttttgggcgggggatggatgagataggcatccaaattgtttgaaaaaccttttaatttttatttgtaattagtgacaatttggtaggggtttcagtcttgcggcacgagggacatagaccacaggattttggagggattgtccggatttttttgtggccgatacgaatttttggatggtttttacgtacaagtcccaacccccattaaaacctgtacgggacaccctcgtttcagcgccgctcgtttcggcgccagcccagtttttggactataacttttttctttgtcaaccaaatctaacattattggtatcattcgaaagctctaagtgttctctattagcctgctaagtttcaaaaaatttcgttaatgctcaaaaaaattatgactagaagaattcaaaaaaccaggccacatgtgtacttttggccataactttgttcaaaattgatcaaattttttggaattatgcaaaataatagagcatcggaagggctctcgaatgataccaacaatgttagatttggtggaaaaagaaaaaagttatagtccaaaaactgggctggcgccgaaacgagcggcgccgaaacgatgtggacccgattttcatagcctcaaaaatttttttgagtttatgactttaattttgcaaattatttacataacgccaaaatgtcatggctaacaatgcgcgttaattcaaaaaaaaacatgaaaatgtctttcagcttcgggtctattatttttgcttcatctcaaaaattagtaatatttaaaagcttttgaaagaagagcaaatttttctcggagttttcagtgtcatatcatgtcgaaaaggttatggcgaatctttgaaaaatttccattgcttcaaagacatttggattgttttctctcaacgtacaatggacaaaataaaaacaaacatacatatttataaatgtattatttatctgcataaaacaaaaatgattcctaagagccgattcgatcgctttttctttgcccttccctctttttctcccatttctctcttttctaatggtgcgccggctcggcccaatgtccgccccaactcgtgtgcccgtacttcatcttggaatacacctcctccagcccgatgattaccaccgcaatgcaaaggccctctttgatgcccggcttgagcagctaaattggggagagaatggagaagcaaattttaagtggcgcaccggcatcaacggacgggaaaaaagaaaaaactatggcaaaaactctaaaaatgcttgaaattgaaaatttaatgggattctggatggtactaacagaatatgtgtgctttgtggttgtcaaattcccttcccctccccaaaaaaaattttttttcgaaattttgcacgagggcgccaggcccaattaggcacattgaattaaagcatgaaacaaagaattaagaaattcatacaccgtaattgcaaaaatatcttattaattagcctttaaatgatgttaattggcccttaaatgaccacttttccctcctctcccgtcgtgttataccttccacgcatagccaactttggtgtattgttttgtcacattcgagcacgggttgtccgggttgtacatccagtagatgttactgaacaaaaactacatttttttgttatttcaatttttgtcccataattccgaccaaagaatgctcaataatgtccatttaccgaatccacgggtccttgagacccatgcgctccaatcgtttggcatatgccaccaaatgaggactccgctgccaatcgttgtatatcgaccagtgcctaaaacaacaacaatttcgtggaatgccattgataaagcgaaaacaataccgatgaaacacaccattttcgattttttgaacccgttgcgcaaaattcgtttgctttttgaccaaatttgtgcccatcaaaaagaattggctcaatgccccgtgcccctccccgtagaaggggtaaaatttctaaacagacaagaaacccgaatctgaaaattgtttttcttttgaatacccgccaagccacggaaatcctaaatcattgggaatcaccaaaaatgaacaatttttcggaacactaccaatacgaaggccaatgtcttagaatcagttaaatgggtgacttacggcactttgaacggctccccgtgaccatgtctgggcaagtcctcctcatacattgtggacaattaatttgttgttgtttccgttgggtgttgctttctgtgattatcctttttttgcacaatgacaaattgtctaaaaatgttttaatggcgcaaaacatggaagtcgaaagaaagcattttttcgatagaaaataaaatgaaaataacaaaaagtgttaagcaaatcatgtttgtggaggtctttttattcagtttatcacaccaatcatcctttggagacaattttaataggaaaattcaattaaattatttgttttttccgaaaataatttatagttttgacatttggcagaatcgacacagtttgacacggcagttcggtgttttgtccccgcgcactttttcatcaatggcatccgccgacaccgcctgaattaaaaaaggcaattaaaaggccaattttccaaggaatgcaatttaaaaaactcaaattttttagtgttgggctgtgaaaattggaagccacgaaatatgttttttttagtcggatgacgctcaaaaacccaaatgtttctttcaatttttgtttttggcgttgggattcgtaagtaaaataatttttgtttatttatttttccatttttattatatgattggaaaaacagtcaccagctcgcgctatttgttcaacggaatgtatcaatttgtcggacaatttgcactgtttttggagttggcgcaatgcgtcaagtcggtgtaatcgccgcaatgaaagcgt

SEQ ID NO: 370 - DNA, 10543 bp, Heterodera glycines
  genomic virtual cDNA Sequence=SeqID_772; coordinates=10543..10400 ,9891..9800,9758..9589,9537..9455,9378..9310,9197..9091,9003..8783 ,8731..8517,8336..8154,8112..7958,7891..7709,7601..7439,7385..7071 ,6784..6554,6503..6229,...
  genomic virtual cDNA coordinates=5926..5569,5526..5366,5304..4838 ,4789..4593,4531..4340,4295..4148,4080..3951,3888..3843,3619..3488 ,3442..3335,3289..3175,2776..2672,2628..2437,2370..2241,2162..2031 ,1980..1836,1782..1678,...
  genomic virtual cDNA coordinates=1631..1557,1511..1449,1172..1062 ,960..759,684..502,314..283
  coding sequence=SeqID_1026; coordinates=10543..10400,9891..9800 ,9758..9589,9537..9455,9378..9310,9197..9091,9003..8783,8731..8517 ,8336..8154,8112..7958,7891..7709,7601..7439,7385..7071,6784..6554 ,6503..6229,5926..5569,...
  coding coordinates=5526..5366,5304..4838,4789..4593,4531..4340 ,4295..4148,4080..3951,3888..3843,3619..3488,3442..3335,3289..3175 ,2776..2672,2628..2437,2370..2241,2162..2031,1980..1836,1782..1678 ,1631..1557,1511..1449,...
  coding coordinates=1172..1062,960..759,684..502,314..283
  peptide sequence=SeqID_1027
cacaaatcgggaacgtactattggcctgtcctcataattaaaacaatacaattttaaattaaagaatcaattttaaaataagaatcaacaattagaaggaatagacaagtcaaaatatgaacacagaagctttttaggcacttgggattgaacataatatacgtttttacaagggacccctcagagggtcgatgctgttgttattcctttctgtcgatgccttttccgccggttgtggcggcggggcaatgcgtgcgggcggaggctcaaacattctctcggtcaaatacccggcaacagaagaggagccaccgctaggaccacctgccgaatgaatgaatggtttacacactagcgaattcatcagaaactataaattttctaaaatttgtccagatagcctattatggcacaccaagccatctaaatttttttttgcgaaaaacagcgacttccgagtgtttgccgacgatctgtccgactcactacgatctctctcacccgttatggcttgtgtttgagtgatggtaggcaaaaacaagtcgtgccgttggtctcggtactgtgcccagatttgcgatttttgtagcaattgcgtgatacgttcaccaaagtgtgcgtctcttgagcaagctttgagtgcgtcggcaatttcagcttttgcagcggacggattatttactcctgaaaagagattaataacgttttaaattgatttgaatttaaaggaatggaaaatgtcccaaaaagagactcacctggtaacgaactgcccaacattttcaacaagtgatcgaccattccgctcaacaacatttgttccgccatttcaggagtacatctttgagagagcattttgagtgcatgggccgactcccgggccaactcgggctgcattcgcatgcaaaccaaaagcccttttggaagagaggggacagcagcgaacgcagaagcacaattcttaaacagcggaaatgaatttaaagcccaaattgaaaatttatgactagtttcaaagtgtaatgaatttgtgtgacaattttccaatcgttaatatttaccaaattttctgagagttggttaagcactctgagagcagatcgcgccacatcatcactgagggtcgattgcatcgcttgacaaaattgtggcagatatccttgtgcagggatctaaagcatacgttatcagaccaaaatcattttttaattttgttataaaaataaaataagaatatacaaataaaaaaaagcaacagtggttcagttgtagaatgctcgcctggccatgcgggcggcccgggtccgattcccggccgttgcaattcttgtttccattattcacatagacagataacttttttataattgaattttaagtcagctatcaataaacattaagatcgcaaacatttttattgtttgtttttgcactgcattctgcattaccatgtcagtggtcgtcggatggtgtgctgccagcagaatcagtgccttgctgacctggtccaacacatttcgccatttttgcacttcttcctcactttgcccctttttcttttgatggggcaattgccaaagttccaacaagcgctctatcaattccgtagcaaattgacgcgggtggcgaacctttgttggtttaaaaatgggaaatgcatcacccacggaaactgaccgcccacgaagggttagcgatgaataagcgcaagaaaatgccaccgactatcaattctccgctaatcacttcctcaaaagcgcaccgattctcaccaatgatggaattctacggaaacaaaaaaataaaaatcagaaaattataatttaaagtattacggaattccacttggcatttgggtctttctgctgggcattgatgagttcgtccaaacttcggcgaagaatttgccgaaccccatctcgcatagtgtcgttccaaattagctcgggattttcagtatttgtatcaaacatttgaatcctataaagggatgaatctaacgatttgaaattggcatcaatggaacaaacgcttgtccaggattgtctctcaacgcatcggcaaaggtacttggcaaaaagcgggccatacatcgtgcccattttggcccagtcaatttatctgcttggagtttggcaagcagttcagcggataatattcggctagcacttgatgacccaggagaaatttctaaatgaaaatagaattaaacaaacatttaggtttaaaaaaaatccataccattttgtgttaaattagattcggtaaatgtacaaaggacataaatgagtccaccatactccaacagatctttcaccaccgtcccattgataaccaacgcaatcagagttcgtagaattacttcggttgctaaaaaatcacattttaaaattagaagatttcttggagactttaattctgtaaaattttctcgacctttgtgaagcttagaaagaagagtgagcagaagtggcagctgaatggagcaggcgatgtcgctgacgcactctttgttgttggccgcgatcgaaatgatttgcaatgccttcagttggatggctgatagcgaatgaacacgaagaaaagcaaaaatggcggaaaagtggccaattaacagcaattcaatgccttaaacgaaaaataaagaaagaaaggaaggacaaaacaaaacctggattcatcatcagcacattacgcaacgcctcgagcaccatccgaacccgttcctggagaggaaagcgacccccggaagcaccgtttagattaacggtgccaaaagtggaagaatgcgtcgttatttccgggttggaagcattggcgttggcaaaccgtccccagtcgacagccgggtgctcctcttccaccacaaattcggttgtcaaatctattaaatcggcctcttcggttttcgccggcttaaataaacaggttagtatagtagtcaataccaaattctcattgatttttttttctctttcgctaatgccctgccgcccgtacaaaaaatactagatgctttttgatcatttcctcatttaattttttaaattgatggtcctatcctttccccaattcttactactaaacgtaccttgggcctggacagtgttgcaatgttggttccgtttaatgaggaccctgctggtcttgcgggtaaattcaagggtttcggggtggtaatcggtttctgcttcactgccgcaggtcgaacgacgccttcaccgataaggagttcctccacatgtttagatagatagtccaaaaagtccatgcacgtccgttttggttcctttaccgtaattaaggcaataaataaatacttttaataaaataccagcagtctgaattccggttgagcgttgtaaatacgcacgaatatttcgccaaccaccaattctgttgcgtaaatactcagtttgaattcggcaccaaacatttcgctctagataaaaaaagatgaattactaaatttgaattaaattaaattaaatacgttctcgtgtgagtttctttgtttgtccacaaaatcgagcagttcagcacgagtggagttgtcccaaatcagataggggtcttcggtgtttgcgttgagtaatttcaacacaaaatcattacggcactgttcaacattgggcttggcattggccattccctcttcgtcctcatccccattttgcccttaatatgataaattttaaaaatataatgtatatttttgcactttcaccaccgccgttgggagctttggctgatgagttcggctgttgtttctgctttacattctgtgctatttcatcgtcatcaccaaattgtaaaacattaacgggcaaagcaatccgagccaattgcatttgacggcaaatgaatggcgttagcatggcacgcaaactttaaacggtatcataatggagataaattcagcaatcgtttgcctaattgtaagtaaccaccttttttgtactccatcattgtccggcgtgtccggacgaaagccggccaaacaggcaagcgcttcacaacagttgcgggccagtcggttaagtaccgcttggtggttcgtcttctcggaatgggcaaccccttggaattggtatgcgtttattttcaatttggctatatttatttgttatattgccttccaaccaacctccttcgtccaacgtgtaatcgaagcgaaaaagatgaggtaagagttgccaaatgacacccgcttgaaacagttgcgtctgtaacaatgtgcacactgaaaaggcacaaacgcactccgccgcagcgcaagccaaccgatggagagacttaaaagcatactctgagtaattttgagcaaaaagcaaatcacttcgaatctaagcagttggcaaatgctttggaacaacgttttcatttctgcaattttttcacggcacgcatcaaaacgggcagcggtggcaaaacaattgcacacgtgagtacaaacttgcactggcatttcgctttcgagtgaaccagcagtaatcatcggaacacaccgctcaaatgttttgtacagagcctgaacacagcattaggacttatttatcgcacagttaatacattcgcccattagtacatacatctaaccctccgtcccgtcgcaactgctccgcattcaatgacgaactccttagcgtccaatggcataactcaacggcagcaaccagcaattgaccaccgtcctccttggttcgagcaaacaatgtgtcgtcggacgactcgagatcgatggttttgataagttgggtatacccggcatatttgtatggcgaaagcactaaagaaaattataaatgattgattttgcaccgaattgctggcgaaccttgtaagttcctcttgtatacaatgctttgtgcacgaatgatgatcactatgcgattcatgtctggcgttgacgaggaattggctctgaccagcgtcgatgtgaggaattcgtaggcgtagttgatctgctcaaactgttcccgaccatccgggtttttgtccgggtgatacttttgtgctaatttgaagtaggctcggcgcactgccgatgcgtctttccacccgccagtggaatccgtcgtggacagccccaggcgttcacaagcctgctcaacagacattttcgccggtttgcgcgtgatttcatcatgccaggcggagagacaggcccgcaaaaaatcgacaggctcgcgaataggccaattcggaaagcggtgattatcagtcaaatggcgaaggtaatagaaatggcagaacagctcttcttttagttgtggataatcaatgggaggaataggacaatatctgacaaaaataataataataatgggtttgaaacaaataaaaagtttttggttttcaatacctgtaaagtgccttaacatttgaagaaagtctggacgaaaaatcggacacatgaagagcaatcttttcgatcatattccgtcgcatttcactattccaaatacattcgggattctcaaactctcccagaaaaacttcggcatatttttccgctccatattcctagaccaatttttgaaaaagcaatacgaattaaaaattcacctcgaggtagaaaatatttgcttctggcaacattgggcaaagcaccgaacgggaggcgagctccgacttggaaagagttgaacggaatgcttgtctcaaatgagtgtctttgaggaagcgagcaaccggcaaaatgttggacccattgtacatcaagataaagaaaaatatgcccgacaaatacagtctcgaaatgtaagggttgtcctgcatgacatcgttgaccaaagttgcaactcgttgcacaatggacgggtcgtaagtaagcaacaactgcaccaattggtacagcaacacgggttcagaaagcacttttttgattcgaggcattggacgaatgacagcgtctgtctcatctctaaagcacttttaagcaaaaataaaaaattgaacaattgacacttaaatgtaatttaatcaaaaagttaggggtagtctgggaattgaacccaggacctctcgcaccctaagcgagaatcataccactagaccaactacccacatagtgaagcttaagaaatgtatttactaatgataatcgtttggtcaattattgctgtttaaaaaaaacgaaggtttactgatacatcgcggaaagcattaaattcgtttatttccctataagtttttcttaaaattatttatttgttttgggttcacctggatgggaagaaagtgcacatttggatgagagtgtcgaggatcaatgagcataggtcagtgaggttgtaaaggcccatcggcagtgtcgttggttcatcgtcccttccttctgttacggcttcgtccccaattgatgaaagttttgcattgccgacacaacaaactgtccaccgaaattgggaaactgacgacaaatggcaccatttgtccaatccttctgcccaaatttcactcttctcaaaaagcacaccgtcacggtataaacgcttcatctaaactgacgacaacatttacattatttaccgagcgaaaatgattcaactcttttgaacgaaatcggtccctggcgttggccctgccggtcgttgtaataccattcttttggctcagtctcctcacaatgtgccgcatctttggttgcctcaatcacatttgtttggccgtgaagttttgctcggttggtatgaagatgggccaagactgcaatgtcgatgaaaagtgagatcgaattggcggagatcaattcgcgtacattttgtttgtcaagtgaaagcttaaacattatgggaaattaattaaagaaaggatctgtttaaataaatgatttcatggttattgggtcgtctcataattattaactaaacaaattcaaataaaatggttattttaaataaatctttagagtaaatcaaaatggacctgcccacactctacacccatctgctaacatatttccccaaatttccttatgtttcaagctaaaaatgaacaaatgctttgattatgataatactataattattatgaccaaataacatttcctcaaaagtaaaataaaccttgttaataaggaacaagaagtggtccctttcagcaacatttgtgcatttggccaacatttccacaatgtgtcgagtgtcagcgaacggtccaatgctaatgcaatgcctttcgtagacaagtgccatcgctcgaaggcaaatgcatcgcatttcggtacgttgagaaagtaaaaaacgatggtagattttattgaaaaagtcctcggggcgatggatgggcgttgcactgttcgaactgttctcttcggtcaataaaaagcgaagataataatcaccaattcgaatttcgtccaatagtgagtcataagttacctaaaataaaataactttattaaaatgacaattttaatcaaaacggtaaccaccgtaaattccgagtggttccatgatacggtagttccgggttgaataaattctaattcctgctgcaattggcgccactcattctcaattgattgtcggaattcatcccgagtcttttcgttccaaattaaatcggcacgggcgtgattttggccaaattgatagctaaaataagttaatgggacggaaataacaaatgcaaatcgtaatcaaagaatgtaacaaatttacaataattaggcaattaattatgaagcagaagccacgcataccaaaacaacttccaatttgcagtcgctttgaccagtcgccttcgcttgcgaagcacgactggcctttgctggattttctgctgctggtgttcctcacgaattcgattgctctgtaaaaagttgagcttctgttccaaattccaatgttgcagcaacgagtcgagccttgcctccagcgtcacttgcacatttctgaaacgagttgtttttcatttaaaatggccataatccggaagttgctcgaaagacctgaattgatcctgaagctgtgcaaacggacgctctctctccgaattgttggccatttccaaattattgcgaatagtcagcaagtcacgttcctcggccaccgcagaggcaggcacatgctcattcgaatccaaataatcaatgagccctcggggctaaagcactttttaaaatttatattttggcttttttataccaagcatcgttgcagcaaatccttcgctgcttggttttccgcaatccaaagtgccaccaaatagccgctgagttgtttgttggtaagaacgcgaaggtctttgccagtggaaagaagggccaactccaaatgtttgagaaaggctccttcggtgagggccaaaagttgcatttgacgactgatctaaagacaaagttggtaaaaccggattgtttttatgttccgcagtggtccaatagcaaatttttaatttaattttaaatgatttaatttattatgtttaaaatgtagctaaaatgtacaaattaatcattttatgtttgatattgccactccctcctctttttcagttatgtctcttacatctctgcccgactcttcgatgatcgctcgcatgaccatccccgcccccttcacaatggtcatagacggatgctggaaaagtttgtaaaaggttcgtccccgctgtgcgaccatcgccaaaatcgaatcgaacgtatcgcccggggttgtctcactgtacggggcgcatacggtgaatgtgagaaagtccaacatcgaggcgatgaccaacgcacctgggcaatcattttgaaaaacgataactttggttgatttgatttgtttaccagtcccccttgccacgtgttccaccacaagttgaagcaaatgttcaacgaaggcacggctggagagaagtgattgtttgttcagctgctcgatgcgcaagtcgaagttggcatgcattggctgcatcagtgcacataacagctcaaccgtggcatggtcaatcgcttcgcagcgccgcttcagcaccgaaatgaccagcgaaccgagcttctcgcggatcctaaataaaccaaaaattacacccaaaaaagcaaaagctgccatggatattttacttgagaagtcaaacgaattgcaattaactgacccgtcaaccgtagtgaatgcttgaaagcctgtttttgaggcgaagagtctgtgaaggcaagccaattgggcctcaatgcgaatgatcggttcggtagtgtctacgacctttcaaagtcttaagttggtgaattggaattatctcagcagatggcaccggggcgtgcacattgttgaccactcgctgcgtctgcaccaccgtgtcctgctgctgctgcacaatttgttcagataagacagcgtccaaacaggcaacaattgtctttgatttgttgtcggtgaaaaaccccttaagtattgaaaaacgaattaatacccatttccatgtcaaattctgggatagtttcgacccgaagttaaatcacctcagattgggtcgagtgatacagaccattataaggaatattggcattgaaacgtcgaaccatgtcaatacgttttagaccagctgaaaattggtatgtccataatggcaggttaatcaaattaaaaaactcacccggcacattgatgatatgtttgagcagaagaacctccgaatcttcgtccaaactttgtccgaattgaagcattcgcattgcacggaaatgcctttggcttgagatgagatggacttggtaattgccggaaccacgaattccatccaaaagggcagccagcatagaatccctgaaaaataaaaaggaaaatgaatataaaaaagagaaaaccgttcattggaactgaatgtccgctcaacgccacattcgtaaacaatggtgaatttttgcgggtcattaatatcacggacaaggcaaacaatctgaaaaattaaaaaagtcgagaactttagagattcatagatttaaaacatggatttattaagtcacttgagactgaatgttatttggaaaacaacatagaattaacttatataacttaatcaaaaaaattttatgtgatttttttctacaagtctatttaataatttcgatttggtcagtttccataagtaatattattgtcgttgaacaattagtgagggttttgtggaattatttgagttctaattaacaattattggaatgggaagaagtttttctatctaatgaaatcatttgcatacattagaaaacaaaaaaaaaatcgaaagaacccctctaattatgcaacaacctaataatataatggaaatgaaaaccgtgatatgaaaacaggcagctttgatttaaaataaaaaaaagatttaaatataacaatttaatgaacatcattacaggacaacttatgaaaaatgatgccacaaattccctttatttttgttgtcccaccgttcggagtgatctggcacaaatgacagcgtaactgatcgggtctctctctatgatgcacgactcgctaaggcataacaatcgccgcgtggacaacgcattttgtctggcctccgacgacgccccgctgccgcattttgcagt

SEQ ID NO: 371 - DNA, 5041 bp, Heterodera glycines
  genomic virtual cDNA Sequence=SeqID_773; coordinates=3538..3671 ,3715..3841,3881..4087,4144..4264,4326..4367,4412..4503,4746..4872 ,4929..5041
  coding sequence=SeqID_913; coordinates=3563..3671,3715..3841 ,3881..4087,4144..4264,4326..4367,4412..4503,4746..4872,4929..5041
  peptide sequence=SeqID_1140
atgaaaaggagccgaaacaaacaaagcctaaggcgtccttctagggagtggggaatacataagcccggaggtgaaaccctcactgaagaggatagcaatgacagagaaagtaaagagggacaaagaaacgaaaacaatttcatttaatattttaggaagacaaaattacagcggatgaagcgaagagaaagccgacataaaccaaatggtcattcgaagtcattcatcgcagtccaattccatcgtcctttcctctatgatggcagtgttcacatgtttttctgaatctagattttaaaaagttagtttctatcgtaaaacaacctttttcctttgtctcttgtcttggcccaataatacaaaatgcacctgtaaaattcggcctcataaaaccctttccccagcggtacactcacagtctgaccgttcgccaacccttacattggaaaacaatattgaatttttaaccgatgcactaaagtgagaacgaagtggtgattcgccaattaggactaaccctttgccgacaatcactccgtccattagcacgcaattatccactttagagccatcgccaaaaacacaaccgtcaccaaatactgtccttttaagttgacattttgaaccaattttgggcgcattcataggtgaaaagagcggagcgggcaataatttgagaagctaacaataataaaagtgaattctttcctctttttttgtattaccgttttattcgcttcgaagtatgagccgacattgttgcactgagcaattattgtgaagtccgactctgtgggaacccaagcgaagcaattggcacgctgcacaatccgtggcaccaaatcggctttgacagaggaaaaggaagcagcggttgaccttgaaaatcgaggaatacctaattgagaaagctagacaaatgcaatcacttttttgataacaaaatgtccaatgccttccgttggacgaggtacaaatgcacgtccttatattttgcggttgcttttgccttggggcatctgaaagaagaatttgtcacgtgagagtcaataacaataacaattttatgacagtgcctgtcaaacaatgaaattgggattccttcctcctccgcaaaatcgtcctcgtccaccaaaaagagcaattgtccgttcggacccaaaatgacaaaatctctgtctaaaaatacaaaattcaaccaatcttcttttcccatcatttacactttttaacgcgatctttaggcccggggataggcccacccaaagccgaatcggtgagcagacaggacaggacagcgttgttctccatgtactgcttgaacatgtcacgcagccggacatcactgaccaagtcaccgctaatcaacaaaatgtgatcactctaaaaggatggtaattaattggattgattgactcattaccccctccttttacatgcataaattagttttgacccccctattaggaaatgcctttattcgtcccatttgcttttgccttcaatttcccgagcagtcttttgagtacgtccgctgttccccagtcatccacgtcctcctccaaactgtcaatggccaccacttcgatgtccattcccttaagtgttggccatcgtccaccgccgtccgttttcagcgcattttcaatttgcaatttttgccccaggggaacaatcaaaaggcaatctgatgaagaaaatgagtacatcaaaatgaacggaaaaccattaaggaaagcctaaaggcattgtttgacctctgacgcgattcagtcgaagtaaattaagcgaaaaccaataaagtggcatattggccatgggcaacaacgccttcggcatttgattggtcaaagacggcattcgacttccacgacctccggcaaaaacgacagcttggcaatcgctgagagaaaccatcaacaaaggccaaaagtaaaattaagaaagcaaatgacattttattaattagaattatagggacatttttattaaccataatgaaacaagccgaatttttatgaaaagatttatccaaaaaataattaaatagacacagaaaatattgttcttttttggtttcaccccttccccacctcaagatattctgaaattgtatcaattatctgaaggcgcacataccaattttttttaaattgtagaagcaggatatttattattgtatttttcgaaaattaaggaccaaggggtgcggagggtaaaagaacgaatagtacacaaaaagatttacaatccgagatcaggtgatgaacgcggaagtcccttcttgctggcgttctgtcgttctcctcccgctttggctatgccgaaccggcaagtacagcttgaattccaccggcaactcatcctcagtataaaggcgatcagcaaaataaacacgacgcaaacgacaatttgcatggatctgtaggaaataatgctggttgttagacaaatgatatattttgaaaaatatacttgtattcggagtgtttccacataagtgctgccgtaagctcgtttgacgaaatcggcgagattgaactgaacttgattccatccctcgtccagtcttagtggcatcgtacaaatgaaaggcttcacgcgggtcgtcgattggaagttagaagcgcgaaagcgtcgcttcatgcctttgtcgtccaaaatcttaaatcatttttataaacgatttttagttaacaaaggtatttcagcttttacgacctgaacttcaaaagtgaaatatttgttcaggttcttgacagtcatcacaaaataaggcaatttaattccaagatttttcttagggtcgagagggcaagtgatgaaagttgtgcttaaaatattaatgataataatgtatgtgagcattgttcaatgtcccacctgacattgtttccaagcagttcgataacggaggattgaatgtctaataataaatgggaaattaataaattcaataataagtttttaattcaccttcatcggtgattcttttgatatgaccattccgtacattctaaaaatcaaatacctaatcataaattaattatgaaaaaagcaaaaagaccttattccaaatttgcaaaggtttacttccaatgctatacaaaactgacaataatccactttgaaatgtgttgtgaaacatactatctttgttctaaaaaacaaaaaccaaatttagtttggtaaataaagaaaggaatagcttaatcctagggaatcattttcattgccatggaaacagaatcccactaaaacaacactaaataagtgcattcaattgcaaaaattaataaattttttttaatacataaaattttattttattttccatctcgactgaccttaactgattaaaccgttttagcgttctctcctcagttttcatctgttctttctaacacatacaatacaaaacttggtatttttgcagtttaggtggcccgatgaaaaaccaaaggcggggggggggggggggatttacagggtcactacaatcaaggaagacccaaaactgtaatttaattttaaagattaattccttgaagctattaattcgatgtctcaagcggatgccggacgtatcattcacattgggaagcggcgagagcgtgccaaagaggacattgagagccaacgacaaaggcttgaggaagagcggcgaaattgtgatgcctttcaatttatgtgttggtaattcgttttttacagtggcggcgagcatcaaagcgaaattcactacaaatattgacgaacaagaagagaaattcaaagaacgaacggttggattggtaacacttgacgaagtgaaggagagacagaacgaaatattttacaggtgaaaaccattctttttatttaattttaggaaatttagtgggccatctttaaaattttcaaacgaagaccgacccaaatttgagaaagccattcaaaaaagagtgctttcgtttggcgcttttgacgacgacgacgacgaggaggacgaggcactgattccaatcaccaaaaagagacacggaatggacccaacggtggacacttcttttctgcctgaccgcgaaagggacgaacaattgcaacggtaatgaataggaaggctcattattaattgtatgaaattaaaattcccatttttagtgagcgcgaacggatcgctaaagaatggcaagaaatgcaggagagggaaaagaatgaggagataaccgtggcattttgctattgggacgggtccagccatcggaaggactcaaaaacaaaggtcaactgtcaaaaaacaacaacaattattcttggcatggatttatttgttaatcattcagaaagggacgacaattgctcaatttctgcagaaggcattggacgtgggcgaaagtttactaccacaagatttattttttgtttttagacatttcgcaaagaattcctcgaattgaaattggcaacagtggataatctgatgttcgtgaaggaggacttaatcatcccgcacttttacacgtaaatttattatattctcattcatttgatgacaaaaccctgatttcttatgaaaattttgctttttttttttaaaaagagaaataacaaacagtgaaaaatagaagaattattagggtggaataaagggattccaaattgacattttagtcacaaataccgaaacagccaaaaattggcatataaagccaagctatttgctactgcgaatttctcactttccataataattgctttttcagttttcaagacttcatcaaaacgcgtcaaatgggcaaaacgggtccgctgtggcagttcgaagctgttggcgaaattcgcgtgcggcaagatgccgcgttggacattggcgaatcgcacccggtgaaggtgacaaacaaagcgtaggaacgcaactcacaaatcaacattttaacaccatcaaggtcattttgcgcagttggtatgagaaaaacaagcacatttacccggcttcgcgttgggagccatttgtgccggggaaagtgtacaaacggacaattgacgacttatccacgat

SEQ ID NO: 372 - DNA, 6192 bp, Heterodera glycines
  genomic virtual cDNA Sequence=SeqID_781; coordinates=5941..5713 ,5672..5571,5528..5395,5333..5124,5071..4958,4916..4782,4739..4623
  coding sequence=SeqID_935; coordinates=5941..5713,5672..5571 ,5528..5395,5333..5124,5071..4958,4916..4782,4739..4623
  peptide sequence=SeqID_1158
tcagacacactgaaatagcctttgtcgttggtgcaacggaacaaccgcgtgtattccatgaagtccgcgtcccggtcgtacttctttttgccccccaatgccttccaaaatagcaatggttcatttccttcctcaattctttgaacagcaaagtcagaatctcgaccaatcaattcactcgcaacctgataaaaggagggcataaacataaatataatcaaaaaccacctcttccgccaatttgtggaagtaagggtcactcttggaaccaatccacacaaaaacgtttccaatgccctcttcatccgtttgaaggtcagaaggaggaactcgaagaataaaacagaaggcggaattcagtcttgtcgcattacagtccacttggatggtccgtgtgcaaattgaagtgccattggctcgcatatggaataactctggcaccgcttggctcaaattgtgcgacggatttcttttgccataacggatgaccaatttgcatttgaaatgtgacaggaatttgtgattctcttgctgctgattcattcgcaccacctccagcttgtctttgaacaagctttcaaactttttctgaaacggaattatcattccgttggcatgacagtccaacttggagtgaaaatgtgaagtgtaaccatcccatgttgctggcatctcggccctgccagaagtaaacgacgcatttgaagtcgcttggttttcccgaggcagaattctttggctaaaggtggcagtaaaaatgataacaaagtgaatattcacacctctttaattggaccaccctcgtcattctcatccgacacatcgtttgcctctttttcatcttcggctccctcctcctcttcatcgtcgtcatcgataaaataacgacacaaaaacacataacagtccattgaatgaaaaatgccaaattcattctgaggaaggcggacaaattttttcccttccttaaacgcggcatttatttgatgttttatagtaagtgaaatctcaccagcacaaatgattcgatcacttccaaatccatgttgaaatcctcaatgattttctccgtgtcgctgtgtggcattgcaggcagacggtcgaggaacaaagcgaccaaatccgtcttcaatttgtctctctccataataacctgaaatattgataggagttattggtaatatgccagaaaaatctcacttttatgtccgctccgcgtctttgcacagtgtccgctgtcattgtgaaatcgaatggcacaatgtcatcccacgccgcgaatttggaacgaaatatcgttgattcttcatcttcgttttctcggcaaatcacacagaagtcaggccgttcgatcattcgatggatttcagatgcgattttctagcaaaaaaaaaacaattcacttccaaagctgtgttcacaattcaaaacctgtcccgccattttcgtaagacgattagcatttttgccgacccacaagaataattctgaagtgcaatccaacagaaacactcctttcggcttcagcagttctttatgcaacacgccatttctcagctccacctgaggcaactccaaaaatcccatgccaagttggacttcgtagagacgtttcctttctggtttacgatcttccaaaatgtgttcaaagatgggctcatccggccttttagatgatcctaattttactttattttcattttcattcattttttaccagtgagcgcaagccaaaattcttccggcgtttttagctggttacaagactcaatctcggcttttcccttcttatcccttttgttcattttcaccgcgaaaagtcgcactttattggcaatcgttacctaaaaaattaaattgaaatgaaaagtgttgttatgaataccctcgaccgagctccactccaaatccaaataactttgtcacaatcaagcaaaaagacgaagcgtgggtccaacgactcggcattcaacggaaccgcctccatttcgacggacggtccgttgacaaatgctcgatagagtttgtttgagaaagcgactttttccacagcataaaagcccgattgagtgcgggccccgtcatagtaaacgatttcctcactgaacatctccagaaactcgtccgtttcctcattcatttcttcacgaattgtccgacaagatgctcccaaatgatttcgcaaattgactgcgtgtaccgccgcgcacatggccttgtccaggctggtcttttcaccaatccaataataaatggcatgtgtcagtgctccgtttgtctcccgagttgttttaaggaccaaataacagtcagcttcatagaattgaccatgaaaacccgagtcgacaagcacaggataaaagttctcaatctcccaaacccaaagaccagcatccgctccagcgacagcgtcgaatacgtccgaatagtccaatcgcggtttgtgctgctccattttctctttccagccaataactgggcgtaaattggcgtcgttttctttctccacggattgattcatttcatgtgcatcttgtgccattttggacattccttggatgactttagaggccctgtcttgatctgcttgacaccttcggcgccgtataaagtcctttttgcgttgcatgtagtctttttgttgacttttgttaggactaagcgagtccactgaagaaccgggactttgtccagccaaacgaagctgaaatcgggcattgattgaacaatggaaagtggaaaaacccaacctgattggacagggaaaagtcaatgttgtagaaagccatagctagtaaaggaatcacaatcagaatgaatgaaagtccctcgggttttacctttttctttgtcggagggtttaggcggcatcacgaggtcgggattacaaaaacagaataatcattgaaagggaataagaatttgcaaattacttgtgcaggtcgagttccttcaagtcgggcagtaaatatatcccatcgggaagggttattaagcgattgttgtccaatttgattttacgaagtttcacacaacggccaatgccttcgggaattaattccaagtcattgtccgacaagaacaaaacttgtaattgcagaagttgtccaaaactggcaggcaagcctaaattgtttaaaataaaaatcccaagtaataaaattataaattccgaccttcaaatttcagtttgttgtaactcgcatataaccgctgcaatttttgacaattcacaattttggcaggaagagaagtcaaattgttgcccgacacattcaatgtttctaactgagtaaaaacggaggaaggaaattcaattttcgatattttgttgaaactgaggtccaatttgcgcaattgtttgagtgcataaagtgaatcgggcaacgattggagctcattcatcgaaagatccaattccttaaacaaagtgcaaattcaaattagcaatatttatgttgttttaatttacctgcaaattcaaaacatcctcaaatgagtaaggaatatttgacaaagtcctatgtgtgtttctcagaattaaaacacgaagctttttagaactaaatggataataagtacacgtgaattaaaggtaggaaataagcgacactcacccggggagttgtttaagttgtaagtgagtgagcggattattggacagcttcaacacttgcaagttggtcagccgcttcagttgtgggggcaccacttccaaccgattattgctcaggtcaagatatatcaagtcgattaaattggaaaaaatctgaaacagtgaattgacaactaaaaaattaagtgaatatgacctggtttggtacattttcaatattattcccgctcaggttcaacacgatggcacattttgcatattccaagttagaaggcacatccctcaacaaattgttactgaaatcaatgatggtcaaatccttcattcgaaaaatgtctgttggtattgctgatgtttttatcttaaaccgaaagattaaaataaataaatctaattcgtctgataaatacctggttgtatcggacgatgattgagcgaaggagcggaaggtcggacaattcgccatgcacattctgtataacaaggaaatagagaaaaagcaggacaagatagggaattcgatggattgcgtacaaatagacgaatcctcccaagttttatttaatcatttcggtctttacttgtacagtacctgcaatttattacgcgccatttgcaggtgttctaagtgtttaagattagaaagaacatcgggcagtcgctccatctgagcacggtttagcttcaaccaagtggcttgagtcatctcaataacttcgtccgggaagcgatcagcggaaaaatcgtttcgagaaaaatcaacacccttcagaaagcaaagcacacccgtggacccatttgataaggccattttcaatacacttccttcattatttgtaaaaaacgcttaaaaataaacaagaataaagtagagatcagaaaccaaaattaacaaattaaaaataaaaacacatgaagaactgcacaggtttaattgagataaaagaaactgatataaaaaagatcaataaagggctgtccaattcaaatctaaaacgacaaaacactatttcttcgcctttttgttttgttcagcaggagttgcacgaggaggcgtaaccggacgattctgtccagccccagtgtatgaaaatttgcctttcttgtcggacggcttcagaatctaaaaccgaaatacaatcacattcacaaggaattcatttacctgaaaagaacacatcaatgtctcatcaacggtcatcattgacccggcattgtcaaactctccacagtaatttggagcggaaaacagtgtaaccaattgacgctttgcaaagaattcatagccatcttcgaccaccttttaaaccaataaatttcaaatgattattattgactaacttgatgagcacgacaaatcaaatctaggtcatgtttgtgcaagaatttagagacgacttcaggtccaaaagtaaaagacacaccacgatcattttcaccccaaccggtcacatcctttaaaaaattatatgttgattatgtctaaaattgttgatcaagtaaataccttgtctgggtcagaccaaagcagatcgcaaagaagcccctgatccggaacgtcagttggtcgcatgagccgacgaatttgttccatggattggaggtcgggagaaagaccaccatgacagcaaaaaatcttctcatcaataattgcggcaacaggcaaacaattaaagcagtcggtaaaagtcttccacagttttatgttgtagcgccgcttgcctgaaatacagatgcttataaacaatcataaactgaaattaatagtgaagaaagatcaaacattcgtcataaaacccgtaaattcggttgatggaagcacactcgtgattcccacgcaacaaaaagaagttctcggggtacttaatcttgtatgcaagaagcaaacaaattgtttcaagtgattgttttccttaatttgtaaaattgcatccatttacaaaataaattatacctctatccacataatcacccaaaaacaagtaattcgactcaggcggaaaccctccatactcaaacaaccgcaacaaatcataatactgcccatgcacatcaccttaaataatttgtaattaaaaaattttttgtttttttaccgcagattttcagaggagcctccagttcaagaagtacaggttgactcagaaagatctctctggacttcatacaaagaccctttatctcattttccgtaagctggacattctttcccggtttagaaccacgcactaaatttaaaaagtacttcgttactaaatttgaaaaacaaccttcaagaagccttgaaattatattgtccaggtttattttatcagcatctgtcattgttggcttgaataatggaaaatttactagataacaaaaaaatatttggtaaccagagaagagatcagcttaaattaaataaaaaaattaaaaaacagcaaatttgtaaaataaaaaaaggtcaatcggatcattaatggtctgctgaaacatacaatttaaagggaaggaaggaacttttaattcactttattgtcaagcaatattaaaatagagagggaaattttaatcttagatttcattcaaacgaa

SEQ ID NO: 373 - DNA, 11104 bp, Heterodera glycines
  misc_feature (8391)..(8391): n is a, c, g, or t
  genomic virtual cDNA Sequence=SeqID_782; coordinates=7461..7352 ,6789..6615,6171..6007,5584..5435,4825..4742,4355..4210,3776..3659
  coding sequence=SeqID_1018; coordinates=7452..7352,6789..6615 ,6171..6007,5584..5435,4825..4742,4355..4210,3776..3722
  peptide sequence=SeqID_1225
cggggacctctagagtcattttatttttattttctaattatacccataaagagttgttccatgagcagagaaaatgttgtacagcacaatgttgaggggagcctgtaaatgggaatttttttttaattgatgaatgaagaaaaatcttagaaatttttttttgcataaatttttgaaaaattgtaaaatttcaaaaaaaaaattgaaaaatgctggaaatttacaatgacaaatttgccgaacaaatgcgtgtccacggcacagagcaggcccaacagaatggtgccagaaatggcggaaaatccagcaaatttggtccaaagattggcccgacggagcggcaacagcaccatttggacagcaattgggaggccaagcagtgcggcaaagggccagccgagcagcgcactgaacgcggtcaaaaagatggagagaaacctggcaaaaaaaagaaggaaaaaatgcatgctcatttctgtttaaataatgtctaaattttaaaaatttcgatttcaatgtcgttatgaatgagaaaaaaaatgggacaactgtgaataaaaataaaagaaaaatatcctgggcgcaaatgtccgattttcgctaggggcgcaaatgcccgaggcacaaatttgcatgacaattggcctacaatggcaataaggtcattggtttgtctacttttgaacatatattttggcatttttgggcatgctttgcggaatatttctcaaaaaaaaattgttttttttttcaaaaactaaagagaaattgccaaatgaaaattgaattaaaaatagcaaaagaaaaaaaattggcgcgcggagtaaagggttcgaaacccttcaccaatgcactgaaactggcgcttaaccgactgcgctatttgcacgcacagtggcaacacctttcattgtcatttttagcatgattttttttaaattttccaaaaaaagctaaacaaaaaacattagttggcaccatttttcgcgcagccaaagtgccattgcgagtgcgttgaatgccatgctgaacgaggagggcaaaaaggcgcacgaggcgctgaacattgcgggcgacagcacagtgaacagcagaaaggcacggccaacggaattgcccgccctgcggcacacactttcgtacagacacagctcagagaagaggcacacggagctgcacaaagccaaatgttacatacaatacagttcaaacaggacttttttattgaaaaatttttaaaaatttatacaaaaaatcggaatttagtccaaaattaattttgaaaatgaaaaaaaaaatattggaaaaattttagggtacagttcgtttcttcgccgcccccccccaacaaaaaatttaaaaaaatcaaacagaaatatttctaataaatctttgaaaaattctctagcaattttgaaaactttatgatacttaaattattttttcaaaaaattttcccaaaaaagcgtgaaaaaattttcatttttttttgcaattttccttgaaaaatgtttggaaattctttttaaaaacattttcgggtggggggaaaagggggaaggggggtggaaccgaattgctcccaaaaattgtaggtttaaaatgttgagaaaataaacacaattcaaagcagctaaataattatacaaaaaaccaaaaaaaaaaaaatgcaaaactcacccaatcagaaaacggatggcaaaaaacagtgccaactttgaagaggtgccaatcaaaaacaaaagtggttgggcaggcagcgcatacagcagcacataaagccacgaacttgaaaagtatttttaaattttttacattttttttgaaaattatgttaaaaatacggaaagcgaattttttcgttaattctaccctcatcctcagggacaggcccaggatttcgacttggagggggtatagtctcagaatgaagattttttacgtcgttttttttaatttttgaggaacaggaggggtccagcgcggtggaaatttttttttttgaattttttacaatttttaacatattttcattaagaattgtttattttatgaattttcggaaatgggccaccctggacgtccctgctcaacttgcgttcgagccccgtaccgaattgcgtagtcgggcgcatattcccatgtttggaagccgcggccgaacagcaccaggtgcagcggctcccagtagttgaacacctcgtcacagtccgaaatgatggaccacagcgaagcggacagccgaacggacagcaaaatctgtggcaaaacaatttttaaacaatccaaaaactcaaaaaaaaaaaatttttttttttctgggagagggaacggcggagagattgtcccattttaaatagattttggccatgaaatcggagcctgaggtcagaggcgataaggatttcaaaaatcctggccctattttcgctgttatcgaaaaaagggtaccttccgggttttgccaccccctccccttaaattttttttttctaataattttttctaggctaatttttgatgctgatcacgaatttgacacgcacgaatatggtggtgtttgttttgcaattctgatgacatctggtcatcgatttgacaaagttatctatataattttttcgaagggggggggggggtgacaaaacccggaaataccgaaaacaattttccagacttttaatgcagctgatcttgacattgtccagtccatgtcaattattcgtttgtccacgcgtttccattcactgtttgacgacggcacatccatttcagtctgattattatgcgactgtcctgtgtaaaaaaaaaacaataattttacataggaaattatgacatccatccaattttgacaccagttcgaaccccgaaaactaggctcgaatagaagttgaaaattcaaatgttcaacaaaatgcacaaaaaatgccaaaattttcagcttaggggcccccatcgattgtattgccggaaaaaggttcatttgtgtgccatggaaactgagaaaaattttaaaaaaaacatttctttgcaagaaggtcagattatggatcaattttgttttggtttataatcatgaaatcttcagagagattcccacaaaacttttctcatcattccttctcaagcttttaattttattaaaattaaatgcagcaccacacatcggcggcaccgaacccaacccaatttagagccaatttcaaagaaaccaccactgagccaaccacatttcgtattactaatttaactacagaacaagaaatgaaaaacaattagccaaatgagtttcaattaggttgccctgggcgacactgaagtgccaactttttaggccactttttctccgttaattaacccactctcccattaatcgttccctaattgtacaaccacctgccgcatttgttgaactgctcgccgccgttgtggccgccacatctgtgccggcggctgctgctgatccgtcgcgcagtcgacgcattggcacacgcgaattgcccttgcgcaataaaagcgaaaaatttttcgtattttttcccatcgcaaaaaatttttttagtgtggaaaaaatagatatttttttcattaaaaatattatgtaacatgcatgttgttcaccaggttaatgttgttccaaacacaaaaataaaccgaaaatgaacaaaatttattcaaaaaattgtcgacacatttagaaagaaatccaattaaaacttcaataacaagaaagtatctgccaaagttgtcgcgtttgatctacgccgtcatttctgcaaaagaggaggaaaacggattattttttaaaattttttacataagaaaatgtaaaattaagtcgtctttatggagacacagaatttgaaattttttaaattttatgatgaatttctgattttttaaaatttgttttccaaaaatagttgaaaattttcaattatttttctttaaattttcttataaaaaaagttagacaagttgtgtttaaggtgggttaatttaattaatccattagcgggttatatggaaagcgtacgagttttatcatagaatttttatgcttattctgaaaattgctcatgatttgagacataaattttttccaaaaaaccagattttccacctttttggccataaatgtgatcaaaaggatttgtgggaaatggtaacttttctttttgatgatatgaaaacgctggtgaccacctgttcttctgctcatagaattccaatagtttgtccattttgccgttgatcaccaaatagaaggccaatgtgccgaaatgtctggtggagtacagcacgtccaacttgtcattttccaatgtgtggtcaaaaatgtacttacaaagctaaacaaagtcgtttaattttgaaaagaaaagaagggagtgaaataaatttttcgaattacgaaaaaaattccgaaaaagggtacatcccaaaatctcgccgccgaaatctcgccgcagaaatttcaaaaaaaattttttcaaacagaaatttttcaaggaaaaaattcttagaaaattttttataagaaaatttcaaaaaaaaaaaatatttgttaagttttttttgaaaatttttccttattaaaaattttctaggaattttttccttgaaaaatttgtttgaaatttctgcggcgagattttgtcccggcgagattccggcggcgagattttgtccagtccccccgaaaaatgccaccgatttctgacaaaaaatgatggacctcaacaaatttgggagcgtccggctcgtaaaaatgacaggcccagtccagcacaaactcatgctcatcacggtccagcgtcttctggaaaaaaggggaaaaggttttcaacccgaaaaggtcccggtcccgggtttgccaaaaattcccgggttttcaacccgaaaaggtcccgggtttgcccaaaattcccggtcccgtggcactctagttaaaggatgtgaaaaaattttaaaattcaaaaaaattgcgaaatctgaaatatttggctatacagcagcttaccgtccaaccactgaccatcctcaatttcttaggccttaactttcttactttgttaatgcctaaaaagtcttggtatcaaaataaacttaaagtctatagtttttgatagacctaaattccgggctaaaagcaacggcaaaaattattcttggctatactcgaaaaaaaagagttgattgtcgtgttctctgattgtcatttttttttctaatgtcaatatttgcaaattatttataaattcccgagactttaagctttcgtttgataccaaaaattaggcattgacaaagtaagaaaaaaaagttagggcctaaaaattgtgaatggtcagtaattggatgccaatttgccagagcaataaaaaaaatttttttgtttttttatataaaaaaagggtttcttgggcacctgtaaccattcgtcggtcattgcaaacagcggcggttcgttgacaggccgattgggttgcacaaaaaacagccgattcatccgatcgtgttcttccggcaacgccgttcgtagcgttccgtcctgctcccggacaacgacagtgcgatccttgggggagataaacatgaccaaaagactctcagcatttgaaatcatttttcaaaaattgtgaaaatcctcatcagaaagtcggcatttaaaaaaaaaatatgagaatttttgtgtaaaaaaatcataaaaatcaaagaattgatcggtttgggtggggtcttttgcgtgttatagatgcaataagctaattttgtaagctattggatgttcaagaattttttctcggcatttttgaacgatggcaaaacattcttattttctcaagccaaactttttgagaattttttcttttttcagagtcaaacccatttaaaaaataataataataacgaagaaaattaatacctaaacaaaagtaacaaaaaaaaaaaatttccacgccgaaatttaaaaaaaaattttttttttttgaatctaaccatatctgtggcgtcgaatgaaatgtcggtgaaaacgaatttggcggtgtcaaatccgtcaatttccgcgtcccgtgccaacacttcggttcggtttgagcgcggctctttgaacggcacaattcgcagaaatttgcccgcccgttggtccagtcgtgacatgaacttgacaaaaaaaatggccaattttacatcggttgacccaaaaaattgatttgaaatttttttttttcaggttttcagagagcggaggtgtgggggagagaataaaaattgaagaaaaaatggactaattttttttttaaatttatcaattccctcgataaattgcattaaaatttccaagaatttctcctggtggcggctaacggcaccccctaaccccaattttaccacaattttttgaaaatttggcccaaaaatggcaaaaattagtcatttttagggcgaaaaaaaggcaataaattcgtgttctttctcactggccctgacaatttttaaataactctggagaaaagctttttaaatttttgacgcccgaaaagcaaaaaaaaaatcttcgagttccaccccttccgaaattttttttttttggctacgggctttacctccttcaccatgccgtccgtcatcaacgcgtaatgcttgcgctccgtttggttgatgcgacgatggcgcaaaattttgtcggtgtcatggccggtcagcgaaagcagcaagcgttggacgcgttcatcaacaaaaaggctttccaattgttcgccattgagatgggaaaggggactaaaaaaaaattattttaatttgaaatttgtaatttttgcgacgacaaaattgaagttccccccccccaccccgttttggaaaaaaaattacaaattttttgttgccataaaaacaagtttttttttggggttttcgaattcacactgatcacgacgaatacggcatccatttcagccaattccgaatcccggacccgaattcgaacaaaaagtcgaaaattcaaatcttcgaatttcgtatgtttggtcttaaatcggtttatatacttggaaatttctaaaaattactaattttgcaataaaagtcaggtatggatggtacccccgtttttcgaaaaagaaagttgatttttttacaaaataaagttgttttgtgggttttcagcggtcagagattccgattcaacacccatttcgaccatattcgaattccgaagccggattcgaaccaaaattctaaaatttagttgtcaatattatttttttatggtcgtgtgaactgcaatagagccacatcttttttgaaggggttaattcctttaaaaaattatgttattcacctctcagctttacaccatgacgacaaagaagaatttgatgcagtaaatgggaattttgtaagtgcaaatttgcgaaggattccggtgataagcaaagtcataatgtttccttaaacccaaaggttacaaaaaattaaattaattaatcattaattatggcggaattttatttacattgtattgcttaaaagcattatgaaagaagctcaaaaaacgcatttcatttgaacgtcaaaagctgcgtcaataaaaaaagaaaaaaaaacaattttttcggagtttttgaaaaaagaattttggcaattggcattattaatattcagaatgccaaatattttttgtgttttttcaaaaaatctgtggcaaaaaatatttagaaaacaagttttttgaagttttctggccataacttttttgaaacacaacgaaaaatttttgaaattttgtcttctaatagaggactattttggctataaaatgataccaagaatgtttaatctggatgattttataaaaagttatggtcgattaaaattgttaaattattttatggtcctgtgaactgcagtaaagccaaacgattcccattaagatttgcttgtttgaaaagataattcaagaaacaattatttattctggcatcaatcaattgtataatggcaaaagtgtgctaattgcagcaaaaatgaacaggcggtaaagaaatttaaaattaaccttaaaaatttttattttccaatttttacccatatttcagttggatttgtagcgacgtgtggatggacattcttccatcttttgaccgtccccaactcgggctcaaaatggcactgctttcttatcgtttcgatgcgctggtggacacgcattttgatggcaaaaggacggaattaacgctttggagaccaatcgcaatttgcaaagagaagaatattggactagaagcgagactgtgtgtatgtatcgatggcattttgtggaatttccgatgccggaccgtccgctgcgcaacaaaatcccgattaacgaccttcggatgnagtaatttctagggagtccaattatatggaaatccatatttttttcctggactgtgggaggcctgaaacgcatgaaaaacatgtttttagcttggtttgaagcttctaggaaggatttctatatccatattttccatatttcgcgatttatgtccatatttccatatttttccatattttggcattttggtccatattttatgtccatattttggcatttttcaaaaaaacctctattagaacggcccccagcagctaaattagcctttttgagcccaaaacccgaaaaatttttcaaaaaatcattttttcgccaaaatttctcgagaatattgaataaatttaaattttcttaaaaattaataaattatgtcaaaaataagcaaaaaagcgaaaatttcgcttttgttgttgattttgcgctaaaaaattaataaattttagcttttatgttttttttcttttaaaatgattgcacgtaattgccgaaaaaattcgagaccaatttccgagtgttgaccgactaattgcaaaacgaaagccttcaaaaaatttggaaatgtatctcatatgcaatttcaaccaataaatttgaagaaattttgcactcaattttgaaaaatttatttccatattttgacatttttgccatttatttccatattttgagatttttgccattttatgtccatattttgcgatttttggtccatatttttggactccctagtaatttcaattacatatttatttgtttatattaaagcatttttatttattttttcagctacattgaccattccgtcattaaatttctccgtgccaacaagcaaatttgggacagcaaaggcaccaaattggaacttgttgtgtacgtagacgaatttgaaaatgatgaacagccagtttggcattgtttttcctatgaaatttggcccatttttgcgacaaacattcgccatttgagcatttataatgccgatgctttggacaatttgcgtcgtcgcatttcactgacaattctcactgatcttgatcaattggattcaatcaattctggtgatctgttccccgatgcaattgctgacgatgggccgaatgcaaattcttctggccaagcattgcacaaatggttgcacacgccgagaaaagatggacagccaaagcgattgagttcctggagttgctcgtgttttagtctcacaagaataaacacatggttctacaatcataaacaggtcgatgattgatcatggaattttttctttcaatttctttttttactgtgctaaaaatgactaaaccctcaagaaactgcgcggctaagcatttaaaccgctttttgggaaggtttaaaactcgaaaaatggacaaaacaccaaaattaattggaaatcctaaaaaaaaaaaaaataaattttctggcggcaaaaaaacattttattgttttctttcacttgaaataaatttttcaaaaatgctgattttttgtcggccaaatgttgattttgacaattttcagttgggcgtcctgcattttatccttttttttttttgtttgaaaatggtcgtcaatatgttattgttttggtactttttgttaaggcatttctctgtgccaccacttcagtcagttacaaaattcaaatgttaacaacgcaagttgagccatttgaattggtgaatgaatggaccaacgagaagctgacactgatgaagaaaggaccatatcattcgctgttgaagcgatgcccaattattggggagacggcggcggttaaatgggaagacgacgaaaattcggaccatttgaatgcatttttcatccgtcttggtgaaaattgcattgggtgagcagaaaggaggccttacttttgtatagagcacagacaggatttgagacagtattctctgtacagtactttctccaaatcttggcagggccataggagtccctgttaaaacgggtgcccccaaaatcacgccgccgaaatgacgccgctagaaaattaaaaaaatatttttaaatttagaaaaaatttttataagaaaatttcaagaaaaattaaattttttggaaaatttttcgaaaactgtaatttatataaaattttaaaaaaaacactgaaaatttttcaaatttttttttctttaaatttttcttattcgcttcgctctttggtttgtctgtcctattataatggtccatcttgggaaaactctggtcctaaaccagggcttcgatatctgaggatttttcctcattttgtggtcttttagagggtcaaagaggattttttttgaaactgacgatttgcggatttttgtggtattttgagaaatttgaggatttttgtggtcttatgattttttgaaaaattaggtatatttggcaaaatgttcgaattttttcgtcaaatcttatttctttacgaaaaatcttcattttgcaataaattttaattaatttcctttagatgattttacaaaaaaaaataaacaggcattcgatagagggggtcaaaatcattttttttgaaaaaatctgttaacaaatcgcactcaaaatcccaaattttttccggcagcgcctatcggcactgccggaccggactcactccccccgatattcccaaaaagttttttggaaaaaccgcgccacgaataaagcaatttaaaggcaaaaaaattaacagattgtcaatttatttaa

SEQ ID NO: 374 - DNA, 4800 bp, Heterodera glycines
  misc_feature (150)..(150): n is a, c, g, or t
  misc_feature (4728)..(4728): n is a, c, g, or t
  misc_feature (4759)..(4759): n is a, c, g, or t
  genomic virtual cDNA Sequence=SeqID_783; coordinates=3366..3171 ,2427..2190,2126..1988,1938..1738,1658..1554,999..835,688..570 ,437..175
  coding sequence=SeqID_966; coordinates=3360..3171,2427..2190 ,2126..1988,1938..1738,1658..1554,999..835,688..570,437..305
  peptide sequence=SeqID_1184
caaatttgttaattaagggccagcgaataatcatttgctggattggtgccatccatttttcccaccgatatttaccctccccatccccggcagagacatttgaaacggcaaggccaactgaccgctaacaaataagtgctgaatgaagtntagaatcgacaatttcatttattcaatccttttttacacagcgataacaccaccaatcatcgcaacagcttaattgtttgtgttcattcctaatggatcaatggatgaataaagcgatcgttatccatctttttcccatccgtccgttctccgctcaaagtccgaacgccctttgctcagtgactatattttgcttcttaaaagtgatcggcttccgtttgtaaagaggcggcgaacgaagggggagcggacactgcggatagtcagccattcttggctggtatggtctggaagaaattgttagaattagtcgaataagcctgagcctcgctggtttgatgtataaattatttttccgttaaaaaatttgttaccccattaaaatgtatttttttttaaactaaacgcatttggttcacctctgaaaagaaatttgcatggcgtaatagccgcccatatcctcaaaatcggtcaacgaaacgcccaaatccttcagaagataagtgtccccagccgacagcacatcactcgtcgcttcctgacaatgagttttttagttgaatattttttcaaaaaatgcaaaagactgatcaaaacttaagctttcgttttatttaaatgcctatcttttgctttccaacaaataaatcccttaaaatttgaaattggaaatctgtagcgcaccatgaaatcgaaccactcccaattaataacgccaggacgacgatatattttcgtatacgaatgacagagaaaagacgtgaaaaggaaccaaatcggaataccaacacgacggtatctgctagttatgtcagcgacgaggccgcctttgatgaagatgaagtcgaactaaacggggaagggggcattagaaaatggaaagaaattggcgatgaaagtcgaaaaagcactggtaaaaatgataaaatttttacgaaaattggaaaaaagaattttgcaaactcaaaattttttaacgaaattggatttcattttcaatttcgtatatttttttttatggaatttggattatttagtgaaaataaatctgttaataaattgcagcatttttccggcggcgtctattcgcaccgccggaccccccccccgccccccttccgcaaattttttggaaaaagcgcgccacgcaaaaaaaaaggttaaaaaaaatgttgagcctttttttcaattttggcctctgatgggggatatttcttatttggtaaaggcaatttctgacccccccgtccatttatgacatacaattcagctccatttacctaataaacgacaaatgtctttcttgttcgttaaccacataatgaaaattccttttcattaaatttcaatcccgtcatttgttcgactcccatggacatgaaaatacgtttcgattcacttaccaactcgcacatttcgtagcagtgcggcccgacaaattcgtaggttttgcccgctgttgaggagtccatcgccactctgttcactccgtcggcaaagtcattgacctcaaaaaaggaggttttaaaccttttacttttaaaaagaaaatattgtatatgcattatttaaaaacggaatgctcacaaaaagtggcattttgtaaatgccttcgcccgcattgaaagtgtacacattgccgaacgggtcaacgcgccaacgggtgatcagattataaatgagacggtcaatgtcgccgtacatcacagagggccgaatgatggtggcacttgggaattcggcacggaccgcctgctcggccatgcctttgcttttcagaaaggcgcccttttcaaaaatgggggaaagagtgagcgattatccaaatttcacatacatttttgatgaattgtgttttgtacgatgggtccgcgttcaatgcgctcacatggatcagccgttccacgcccatttcccgacaaatgcgcgcaattctccacgcaccctccacattggcgtcataaatggaataattccttaaaaataaattgtgtcttttgtctcattttcccggccattaattttatttaaaaccgtacggtgtgtcgacatatgtgccgatcatattgatcacaacgttgctgtatttgactgccttccgaatgctttcatcgtcgtccaattggaaaggaaaaaacagaacttgaccaaggtcacaaggcactttcaattctctgagaaaatacgaatcgcagcggtacggcaaaattagctgatttgcgtgtctggccaaccgattgaccacccttcggccggtaaatccggtattgccaaaaactaagaaaaaaagagtattttcttttagtttgtaaaattttttgtgtgaaaaccagtttcggggggttttgggtttctgaccacaaaccgcacatctaatttaacaaatttctaattcttaaccagaacttgaacagaaatcgaaaattctaaatttctcatttcggtttttcagattccaaaaaatcaaatttacagagaaacgagacatttaaaggaaacataacgagtggcaatggtaaagttttgtggtttcttcaaaaataaatttaaaaatttaagaagcagattttctaggctgaaaaaatgcgctgattacgaatctgagtcttggattttgcaaaatcattgcttttatctatgatttttttatcaagtacttgttttttccaaaattttaagtaattagtcgggcgtaaacgacacacatcaaaatgagcatttgaatgagctattgaatgtctggaaaagtcatatttttagttatttacgattttttgaaatttaattactagctcttaagggtcatatgagatgggggtggggttcgagcccgcttggctgcagtttatttttttattattgaaaaatcatagacaaaaatttgcaaaatctgagctcagattcctgatcagcgtattttttagtctagaaaatgtgtttctttaatttttaaatttatttttcgaagaaaccacaaaacttccattgcctaacgagtaatataataagaatgaggggacctgtaatgacattgcccgagaagctggaacgaccgcccgctcccttgcggaactgtgccatgttggaggaggaaatgaccggctcaggcacattcaccggcacattctccgtagtcgaatattgtagttttctggtgatcctatttctgtagcaagtcaaaagttggacggctttgctgctgataatcattttgagagatctctttaaaaaatgaaaacacttggtatcatttgaaagctcttgaggaggagaacctttttctaagcaaatgctaagcattttgatagaattagaaaaaaagataagggcattcaaaaatttgtttttttgaataactttttagctaacccactttttgctctaaaaattctccagttttgttcgtaattttttctctatcgataagcaaaatttaataatgaaattccggaatgcatcaaaagttatgcgcatcggaatgcgaatgttattttataatactgaaaatattagataatccaccaaaagaagagaaaagttagagaaaaaaagatattagttttttctctatactctctttctcactatgggtcaacagtagagaccgtcgcgggacgggatcccgcgcgggattttgcgggatcccagtccgcaatcccgcattttttggaaaatgcgggatgtgcgggattaatcccgcgggatcccgtcccgcaaaaaattttgagttccagtcccgcagcgggatccgcaaatttgaaatttccggtctctagtcaacagacaaaattgctcataacgccaaatagcgtaattggcgtaaattattgcgcgctaattcaaatttacaatgatcactgacatttttgattgtttattttgatcagccgtaactttcttcatttccaactaaactaaacaaaattggtatctaaaaaaagttttgaaaaggtgaatctttttctaagcgaatgctaagcaatttaactcgtttcaaaccatcaaatttttcgaaaatgttaaaaagatgaaagtgaggtgaaaatgtggtcaaaaatctgggtatttgtcattttctttgttgttctcaacgcctcgattgattagagatataaaaatagtacgataaaaggagagaaaaatttctttcatccattgactcgattttcttttttgaatcattaatttatgctatgcagtgatttgccacctgttagcaaagacacgtgccgaccgatggaaaataaaaatgcagcagcgcaaagaaataatgcacttaatccttctcggattaaacacataggttttgcgtatttgtccccttctccgccttcacccaattcgaatcggacatttcggaattccaaaacacctttccttttccaccttctcccaacaataattctttttgagaggttgagtcccaattccctcaatatattttctcaacatttatctctgacgtttttggttgtaaaggaaagagaagcgaaaggaacgaccaaccactgggctttatctatcccatttttgtggcatagctcaactttaaaaaaaaatattttttcagtcaattanatggaaaatgacaagacaaataacagaaggngcggcatgacgcggaccagttcatgcagcagcaatagcagt

SEQ ID NO: 375 - DNA, 3554 bp, Heterodera glycines
  misc_feature (50)..(50): n is a, c, g, or t
  misc_feature (67)..(67): n is a, c, g, or t
  genomic virtual cDNA Sequence=SeqID_622; coordinates=860..1055 ,1152..1346,1679..1880
  coding sequence=SeqID_939; coordinates=943..1055,1152..1346,1679..1880
  peptide sequence=SeqID_1162
acgatgtctatgacaccttgccacttatttttagtgtctttgggaatcgntagtcaacaatcggggnaaatgtggcggattgaatagaatcaccaattcaaccctccggggacggtggttttcttcgatatggccgtcaagcagggcttcagcagcaggaaaagtgcgctctcgactcggccattaaaaggcttatttctgcccattgtctgtcattcgttctttcactccaatttctctccgtcagccattggaaaatccacgggtgtccgtctattctcgaatttaatatttagaacaacttcgcgagagcctacgaatccaaaagcctctccaagtgtattggcccagaaattattatatggatacagtaggtatatattatgttgaattttttttgctctctgcctttttggcgttttgtttgcgtcccgccccctttttctctgatctctcacagggaaattaatcaatcaaatgctgacgtgttacgaaatacaaaaaagaggaggatgtgctgtgttacactttgcacctgtatcagcgatcaatgatgtgcgaagcaccacccagctcgacaagcgttgtttaaagtgaaaaaatcatacgaaaattccaaaaaatatatttttacggtaggaattctaaattttttatattgatttttatggtgccctcctcgaatttccaaattcaacaaaaatattaaaatgattgatagtgagtggactgttctttagcaattacctaattcgataattgttggtgtcctggtactccccctcccccgttgcaaactaactacctaatttgcataattaaattggggcctcttttcatgaatgccgccgattggcatgtcctaccaaaaatagacattaattaacacaaaaattaacgacagcaccaaatctctgttataataagcattttgagtgcaaaatggccggtatcgcagcaggaagactgacggaggagcggaaagcctggcgcaaagaccatccattcggtttcatcgcacgacagtgcaaaaaggaggacggcacattggacctgtaatttttttgttttgaattaatgttcgaactagccctaatctcatatatttggatattatacagtttgtaatccacttttcatctaaatttcaggtacaattggatctgtgccattcccgggcccaagtcgaccatttgggaaggtggtctgtacaaattgcgcatgatcttcaaggacgacttcccatccacgccgccaaaatgccgttttgagccgcctctcttccacccgaatgtttatccgtccgggacggtctgcttgagtctgttagacgagaacaaagactggtgcgcaacacatcgcggtttttaatccttggcttttgtttgcagaaatcgaaacgatttttcgggcattaaaatgaccgctcgtataatttttattaaatatatattttgtacataggttaggcaatatccaagcggtgcttatactcgttggaaaactagagatttgcttgctttagtttggactcgagaccaaagatttttcaacaaaatttggattattaattccaaaaatctccaaaaaattttatctcctggcattaacgcatgggattttaacttagtttcgccattcccgattttttagatttgtataatttggttcccctcaggaaaccgtccatcactgtgaagcagttgctgctcggcatccaggaactgctggtgtcgcccaacccggaggacccggcacaggcggaggcgtaccaaatttatgtgcaaaatcggcccgagtatgagcgtcgagtgcgcaaacaggcccaacagttctcggaggaccaggtgctgaagcagttgttgacggacgacagctgaacggacgacggacagaacggagcgaccaatttttttatctcattacactcactcgtcaaagagagagtgtttttcttccccaatttttgttcaatgttttgctattatgacaaaacccaaagaaaaaagtgtgtttttggtgtactttgtttcgtaactatggttcggatgaattactttctttcctccgtttttctccaagccctcacaaaatacatttactcaaacattcattcgctgtgtcaagatttgttcgtttttagcccgaaaatgttcaaaacgtacgggccaaggcccgagtcgttcacgcttgacgatggggagcgttattatgtcggtaagtgtgtgtttgaagcggttttatgcgttcggtactctgtttcaattggtttacgagtgttaaattggtctgtgttcaggtgccgacgttggccaatacttgaaataccatcgtggtacgctgtacaaacgctatcctcaactgtggaagcgaatggcatcggtggaggagaagaagaagatccaggagttgggctgtgccacctcctacatcaactcgaacattatgctggtcaaagcgaacgaggtgatgatgatgcgaatttggtttcattttttgaagtgggaaatgaaaattgtatttttaaggaagccttttttaaaacaaatgcctttccaggtggaggacatttttgacgggcaagaggagaaatatcgcgcgtcggtcagcggcggcagtgcgtacggacgcgcggagggtgcgcaaacgctgcgaagtcggggcagtgctccgtggctgaaccagcaggtggcccaaaaaacaaatgtttgtcagggagaatgccaacgcttttttgcactgattttggaaaatctacgcattccaaaaaaaatacagactccttcaattaagcgtattcatatttgaaatcccagttttttttattattcatcccagggacggtcccagggtttttccttggaggtggtaccgccgcactaggcgacgaccttctttttttacttttaaatttgcatgaggaaggtcttggagggcgtaccaataaggaaaatcggaaagttttggtcagaagccgttttgttctttcttaggtgaccagcggttcccaccacctcgagtccgtgccctgctccaccccttcggcgcacgggcgaggccatttcaaaaatcgcgactaccccaaagtgtgatgagtacggcgaaataaagactggatgtgcattcgatctgtagtactgacgcaggtctggttcgtagatgtctgaaaagacggtttctgtggttcaactgcggtgtcgctgtataagctgaaagttgcttaacaatcttaattgttgactagaaggtcatatttcactacatattcaatggtgtcggcgaccaaccgagcaaagtacgaattggagtaacagatcgtgaccttctgtacggcggaagagtaggatactcggacgcctcttctggtgcaattgacttggtttcctatgcaatggaatgtaggtggtggatcgtgatgttctgaggtgattggacaaattccttgtgttgtggaggtttgaacgcccaggaaagtgacgaggatggccatgatcgtggtagtggtgcgaggaatcgcgataagccgagattttcgccgcgcaagaatgccgctg

SEQ ID NO: 376 - DNA, 10725 bp, Heterodera glycines
  misc_feature (31)..(31): n is a, c, g, or t
  genomic virtual cDNA Sequence=SeqID_624; coordinates=956..1098 ,1252..1446,2187..2404
  coding sequence=SeqID_991; coordinates=994..1098,1252..1446,2187..2279
  peptide sequence=SeqID_1258
gcgctgaggatagaaaatggcggcactgccngggttcagatctctttggactcgagcggggaaaagaattgtgcctttttgtcgctccccaggaaatgaatgccatttttggtcagaatgagcagtgtgtccggtaaagagcagttgaatagccaggtctaaacaaggtttcaaaaccgtatgaatttagtcgattttagaattcaataacctgaagcgactgcgatttggagtatgggttttcatccgtatttgtgccgacgcaaaagactagcgaatccaccgcacgaaggtcgtcgtcactttccttaatagacaaaagaataacaccttttttccacttttttaaactttaaaacaaacccaagcattgtagattcgagttgcgcgttctataaaaaagtttttgttcaccgataagccagccatagttgaaagaatcgctgctaaatgatttattaattataagaaacagtacaaaagttcatataacttatgaacgaatattcagagacttagacaacagtaaaagagtacaaaaaaactgaattgcaatggaaaaagctcgctaacaagtaaaaaaacaggttcaggatcaagcaaacagaaagaaatttgaattgttgttttcttttaaaaatatgtggcgttttgttaatattcaatccatttttcaaaaaaaaaatctttaaaattctgtcatggcatggtcattgcatgccatggaatataaggctcgtgaatggcgtatatttgttttgttggtcttacgagcgcgagctaattctttttttactaatgatacttagtttgactagattctgcaaatttgcttttctctttttaagctctgagtcagctttagttagcaacactaataattgagcacttcttagaaatattacatttacaactcacaatttccatatatatatgatttttaattttagaaattcagcagtccaaaaacaaatttcaccagcaacaccagcaatgatttaccaccgatttgttgagattggccgtgtcgtttacattgccaaggggaaggaccaaggcaaattggcagtcattgtgaatgtcatcgacggtaacaaggttttagtttttttttgctttctgaccaaatttattgttaggaataacaaagccgtttgtataaaaccaaaatttgttaataggacatgcggatttatttgattagaaacaatcgctattcaatctttttttacaaaatatataatctttcaggttttattggacggcccctcctcgggtgtgcctcgcggtgtttggaatttcaaagacttgcagttgacaaaattcaccctcccactgcgtatcggccaacgtacgaaaggagtgcgcgaggcttatgaaactgccaaaatcaacgagttatggcaaggcactgagtgggcaaagcgcattgatcggaaacagaaggtccgtttggaattctacagatagtttattgggtggatatggtagaatttctaattaactactcgacaaatttgtggcaaaggttttcctttattttgtgcccagtcaattttatcatcctcccgcagatttttttgcttctaacacttggctattttagtttacacgtccaatcagtgaccatccttagtttcttaggccatgacttttttttagcttggtcaaatcttaaatctggtatcaaacgaaagcttaaaatctatgcaacttatagatacaagaaaagagcaaatgttgaattaggaaaaaaaagttgcaatgaaaaacccgaaattcagcatttttcaaatatattcaagcatatttttgtctttagcccaatatttaaaataattaaaaattattttgctttttttaaatctttgctataaacttggtactatatttaaattccatttaatgataaatattgcatttatttacaatgcctgcatggctcagtggcaaatcctttgttctttccttgggttcaatttcctttacgtgccgtttttcccaatgctttcacaaaagcaccgtatgcgcccttaataatttggcgtttttcggtcgtcgcgaaagcgaaattggcgcgaattcaattgggtgagacagaagtcgcctaaattgggcttcacgtctcaatatgaattcgtacaatcttttttaaaattacatttaaattattctctcgttttaagcgtgccgggctcaacgacttcgagcgcttcaaagtgttcaaagccaaacagcacccgaaacccgtttggtccgcgttgagatggctaaactgaaaaagatttcgaagccgacagcgaagtaaatgactgaatttggcctgatcatattttgaacacacaaatgccgtcttttttgttgatgaaattatttgttggagttaaattgttttttaattcaatcgtgagttgataatgcgaaaaagagggtgttgtaatttcaagacttgtatgcaaaacaggtcttaaattaactgacaatatggttcggattgaatgtcggacagacagaaatgagtttaagcttcgacgcttcattgaaatgattacattgggggtagtcagtcagcggccaattttgcaaaagggtaacggctatgtgaatcggcgacctttttgcttttaaggacctccgaaactattttttactaaaaaaaaatagcccaaaaaattaaaaaatttggtcaatttttggacaaactcttaacaaatccgacggtaaaaagttgatcggaaatcaaattattaacggttcataaatttgactatttttttcttttcaaaaccacttttgcggtggaatttttcaaaaaaactaggaacagggggtccggcggtccttatcagggatggcattccgaggcccaaaaaatgtcggaaaccggaagtctttccgtgccatacccatacctggtgcctatcgacatctgcgagaaattttatgaaatttaatgcgatttgttaacagattttgtctaaaattgatcaaatgacgcatttttgactcaatttctacaggattattaagtagggttgcacccccgaacgtcggggttagaaaagtcggggttcggggttgtcggggccagcaagttcggggtcggggtcgaccaaattgttcgggtcggggttcggggtttttaaatttttaccttgtgccatatagtcaaattataatttccataataaagttttatttgtttatatttatttatttttttttatcataaatatttttgtatgctttaatatcttgaaaattttaaaattttttattttgtcggcaacattatgtctttttggcggcgacatttctggtgcatcgaatttctatattaataaatgaaattttgccggtttttacaaatataaacatgtgaaaatttaaatttttcccaatccggaaaacggtttcggatccggcaatttgaaaaaagtgaatcttattcaaaaaatgatcaaaaatttaataagtaacttttcgcatttgcaaatcaatgtttcatattgttaaattttcttctttcatacggcctgccaaatgtgactttcttctccaactttgagctgatcacggctcagaatttccaggaataacttttgatcaattggtaaaaaatcatccgatttgatcaatttttccatgttattgtcaatgtaagccaagcaacgaccagcaaagtcccaaaataaaagtgattgaaattattatttataattcaaaaattaatttttgtacattttcttgcagaagacgagcttcggctaaggcaaggaaaacatttggcaatttcgaaatgggaaagtcggcgaatgcttcgatcagaccgatgatggcatattttttggctaaataataaataaataataattaatccattggtgaaataaattttaatttttgacccgcataaaacacagccattgcattttgtccgtccaaaacactcaaattgtttgtgtaaataaagcgtaacatcgccttaaatggcacggcacaaatgtcagtgaccaccacagggttagaaggagcttaaaatgaaaaacgaaagtttaatttaattaaatttgatttaattgtccaattttcgtacaattccccgccattgtcccattttgagagtcataagcgaacatcgcttcgcacacatccgaggcggccatcagaagggttttatgtgccgcaatttgcttaaaaataaaaaaccattttttatttggccattgcaccctttgtataaaacatgaatatgtatgtatacagtaccaaatacaaatcattttcaattgtacagtagacactgaaaaactttgtaccgtactaaagacaattcctgtcccgattaattattattttaattgatatattttttaaatcgccctcactcgcctccttttcttcgtcttctgcaaccaaaaagtaaacatccgcgccattgcccgtgttcaacaaaagttccaactgatcaaccaacaattttggttttggcattgtgtaaaaacaatttcggccaaatttggaattaaaagctgaaaaactttaaaaaggtaagaaacaaaattattagagatcggtattttgaaaaaagcctggacctggattccatgttggacctggacaaaaatccaggaaaaatccaggcctggacctggattttttgaaactcattttaaaaatcaaaaaatgtttgaaaaaattaattatttgcttagaaaacatttaaaaatatctgatttataataataatgtgtttttaaatttatttaatctttttttgaaaacttgaaaaaacttcggtcacttgaaataataaattctaaaattttgtccaggaaaatccagttttttcctgtttgcctggacctggatttttttcacatttgacctggatttcctggacgaaaatccaggtccaggaaaaatccaggttgccgaaaaatggcctggacctggatccaggtccaggccgatctctaaaaattatcaagtggcgaaaagttgatgagaatctgaattaattgaaggattgggagacaaagtttggcgggaagagagtcccgcgcagaaatttcgcaaattttctaccagaacccgtctgttctggatgaattgttaatacctggacacagcaaattcaatttgtaaatttaaaataattataaatggaaaatgttttttttaatttgcccaatgatttgaggaaaggttttttgagactaaaagtttggtgttttttttaactttcgtatcgacgaaaaaactgcagaaaataaatgtttgagaaaaagtaaaagaaaaactcagtcaatgcaaaggatgagagaaaagaaacggaagagacaaaagggaaaagaaaaaaaggaatatttgtctgactaaggcattttatgggcagaaaagcgggtcaaccaaacaaaccgcgaccgaacgtgggtcagccgcggcggcgttgcgagccaaaatcggccagcaaaaaaccaacgccatttgagtcattaggacgctattaatgagtaaataaaaatacgctaaataaaataggataatatcaaaaactttaataacgaaaagatgggtgaaaagtccgtagaagtgaaaacaataaaaaaaacacttataactttgtcaaagatcttaagaaataatattggaaattctcaatgtcaatgttttcccgtttccgctcttcgtcgcttttcccttaagccttgtatgcttctgaaataccgatttcggcacgaattttcagtgcctttccaatcgcccagccgatcccgaccaaatccttaaattttgatacatttcaaaagcatttcatttcttggcacctccacgggtttttcgataggcgagaagggataaagcatccgatctccaatggactggccaaaaaaggtcctcttttgctcatttcaaccatttaatatacccaattaaattatggaaaaatatgaaccaaatcttgcaattgacaaaaaaggcggtaagccatttactggtaaagctaaaataaaatttgtcagtaagttcattagcaaaatgctcacttaaaaataaacaaaaattaagcattcattgacaaagtaaactcatctcaaatttgccgaaatcagaagagcataaggaaaaagatttataaaaaaagacaaaaaggctgtcaataattaaccacaattaaataatgtcagaattttgtttactctccaaataatcatttgataactttgaccatcgatcagggattgatcaatcagatgaagctgccacattcttccggcttcgtgtcacaacattttcgcgcattgcaatggcatttagtcgtcgctttgtggcagtagcaaatgtcgtccaaatgcattttcttcccgcactttttgcagacgaatttcgactccaacgcctaaaatggaaatattttattgtacaaatttcaatttgaaaattcaaaaaacaaaacatcttattcatcagtgtcagcccaaatatcctttaacaaaaataggcccattaaaaaaagtagcgggtcataaaaagagaaaaatggacaaaaaagaagccaatttgggtttttgaacataatttaaaaaaattagtggaagcttaagtctcttggtaaattttttgctagaaaatgttgaatatttggtgcctttttccattttttcgtgccttttttgccatttttgtatttttttatgccttttttcatatttttggtgccttttttaggtgcctatttgagaaattttcgtgcctaaaagtccggtctctaattatcacccaagtttttgaatgttgttaaaagtagttttttaattttagtgataaatgtttgggtgataatattatacaataatggtggaaaaattactgtcccttggggcccagttggcggggcccagttggttggggcccagttggcggggcccagtcgacccccaccgctgattcccaatccctggtcccggatttttcaaaattccgggctgaatttttaaaacttttttcccactttagttccacaaggtgcccccaccttcacacgcaagccacagattttgcaaaaaacatcagactctggcgacccggccattgtgttcgacatcggatttcaggttaaccatttgtaagagaatacaaaaaataactttgatcctaaaaactcggccaaccaaacgaacaattgtcaatttttatgatgaaatttcatgttgcgctacgttatttttaagaaaattctagaagatatttttggaaaaatcgctagtttcattttttttttaaatttttaaacaaaaaattttaaatttttttttcgagtttaaaagatatgtgggcgagtgaaaacgaacgctttccaaatttcttgattcattcttaaattaatcatctcattttttatgcaggctgaccaaaacccggaagtgatttggctgaacccgaagggcaagaaaatgaaggagtccagcagaatcaagtttgggttgacgccggacggcggcgctaacacttacaccgctcaattggagttgaaggtgaccgaaaataaattttaaaaaaacttgggatataatccgaataatatgcaaatttttattctaaaatttcaatttcttttttttttgcagaattataaggcaaaagacagcgggacgtacacgtgcaacatcaaaaatgacgcgggagaggcgaatgtggagctgacactgaacatcgagggtcagtttaaccacaatttttttaaatgactaatgacacaacatttaattatcggtgtgtttgggagtgaagtgagtgaaaatgctttatctaataccaaaacaacaccccgaagggttaaccccccccagactcaaaaaatttcaacaaaaaaaagttaccacgtttttcttaaaattttcgtttctgacaactcactaatccgtgcgcggtttgaagcttaaaacccgattaaaccgttcttccaacaatctcgcaaagtgttgatcaatcccctactggaaaatcaaaccctgctaattaattgatcatttctcgcaatcgcttccagccccttttttgttttattaaatttttgccaattgcccatttaaaaacagcatttttttttgttcgttatttttactaaaaccggaatatgtatcaaattgactttattttcgataatttttcaaatttaattttggtgaaatttcactgcaattctcttctagcagtactttacttttttgtaattttgggcaaaaaaaaagtcttgcatcctaaaaccaattttttttttaaatttcttcccctgaaataaaaaaacggttttcccgcaattttagacgacgaggtcaagcaataagccagagaacagaagagcgcgcaaactctatgcagtgtttaaaatggtgctgtgtgaatgctgttgttttacaatattattcatcacattattattattttatgtgtatgccgtgtgagtgtgtgttggttgctctctcattcttttatcatcatatctcttctattagatttgaatttcaaaatgataattaatttattttattgtgcaaatttgctgatcgaataattattgcataatacatacatacaataactcaacatattgttttattttaaattataatgaacccgattcaattaaaataatacgattaatgcaattggcacatttctagaatttttagtgggcccaatgaaaaaccataggtgaattcttattagttggtagttttacaatcgaaaattacatttagtataaataacaatctatgatcagcagtgaccctgaaacattaaaaatcaaatggtcgcttttatggtttttcttcgggtccattaaaccagggtgccttaattatgactaatttgatgcaccgaaattctaaccgtttgtgtttaacaatttgacaaaaaaacattatttattttttccttgttaggaccattggacgatgctggcgacgacgaaagtcaagcctaaggagtaaattgggaaaatggagaatttgttgaacgatgccgagaaaaaatttcttgaaaaaaatctgtttttatcatgaatccaacctaaggcatttacacatacatttaatattttgtgcccaagataaatttttctttctcatccatcggtgtaatctcatcaatcaatcaattcacttttttttttgctgtcgctgatcactgatcaccactcggcccgggcaatccgtcgaaaacactgaaaaaaataaaaatgagaaaattagcaaatttttaaaattgttcacccattgttgactccgtcgtctccgatgcaaatccaaattttactgttcttttgccctcgaatcacttcatcaatttccatcatccatttttcatcgtctgctgctgcaattgaacaacggatcagcttaaaaacattcacaaatttttttgacagtctcaatttctcttgagtgaattcgtttgtgtgttcaaatggcaaaacaacaggaaacggaaaggaatacggaaatacaacgcaaatgctgaaagcaacaggagaagaagcgatggaaaatgcctaaaaaaaaaaaaagggaaaaaacgggcaatcgtaaagaatgggggtccctaatttaacttttttttattttcgctcaaaatgagtattgagggttttcgagggcgctgatcacggatctgaactcggaattgcccaattccgaaccccggacccgaattcgaacaaaaaagtcgaaatttttttccaaacgtacatttttcctgggtaaaagctttggattcgtttaacaactatttatacccggaaattcccggttttcccagccaaaaagtcccggtttttcaacccgaaaagtcccggtcccgacttaccctaattaaaataatggataattaccgctttgatttgttccactgttgtcaaccattggtcaaccgacgcactcacaatggtgacaagcagcagtttcggcaaattgtcgtggcgtggcgagaacagccatttggccaccgcttggccatccgacgacgcattggcagcaatgtcgtcgtcgtcggcgggcggaaattcgggcaaaatgtcgccaatgaaaccgacaaaacgaagggatggaaagttgaagagaatggacgcgtccaattggcgcatttgacgaaaagtgtttgtgttgaaatacatcacacgaatggtgtcattgagcagtgtccaaatgttgagcacaacgcattccggaatgtgaatgcttgcagtggaaaggtcaaattttgtttcacatttgctgaaaaaacgggcaaaacggcgaaggaaagtgagcacattgtggtcgaagaagctgaaaaacagaggagggcacgtgtttgatggcacaaatcaatttacaaattcggcaatcctaaagaatgtgggggtttctaatttaacttatttattttgtgctcatacataattagtttctgcaggttatcgagggtgctgattatgaatctgaacttggatttccccaatttcgaactccggacccgaattcgaacaaaaaaaaaaattttttttttcaaaaatacacgttaaaatcgaccaaatttacaagaaaattgcgtattttctattcaattaaataattggagcattgttttgcatcaaaataaatagtggtcaaattaactcgaagcttttccccagaaaactgcattttgaaaaaatttcaattttttgttcgaattcgg

SEQ ID NO: 377 - DNA, 1031 bp, Heterodera glycines
  genomic virtual cDNA Sequence=SeqID_625; coordinates=894..715 ,658..419,371..264,203..74
  coding sequence=SeqID_873; coordinates=840..715,658..419,371..264 ,203..74
  peptide sequence=SeqID_1104
ccttaaattgcactttttgttaccattgccctcccccgtcctattgcatttgtcgtttacgccaattttccactgactttgtcggcaatgaggtcgagacgcgcttccaaagtggacgagacgcggattttgccgtctttggccaacaattcgacgccgcccgcactttccggggacaaaaagtactcattgtcaattttcacctgaaaaggttgtattcggcggaccctttccacaataattacttcgcttcgattgccccacgtccgctgaaattcctccaaacattcgggcaaaatcctcgccaccatttcctcgtctttcttgcggcatcgcaacacaactttgctttcgagcaattggaaaaggccctgccaatggacaaaaagtgccttttttgccgcatggggccgaaaacctgaagcaaaagtcctttgagaatggccggatagcgctctctgtccgccgaaattttgctgagattggcgcgtgcctcctccaacacatttttcaaatggtcgtccctcgccttcaaacatttcaaccgactctgattttgcatattcgacctctgaatcttgcgctgcagctccacttgcttctctttcttctcgtaatattccatgattttctgcctttgctgttgcaccaatttcccctaattaattgccttttattaactaattaatttaaataatttgcaatttaatgaaccttctcaatgttaaactcctcctccgcttttgcgtcgatttcttctgctttttcgttagcttcctgctcaataaatgccatcatatggcgaagctgcttttggacatcgttgtcggaaatgcccattttgtcaacgaatgcttttttgattttttggcttttggaacagacaaaaccttctttggtggaagtaattttgtgattaaaattgcaaaattaaaaaataaagatcattatatgataataaaatcgtgttgaaaaaaattcatatttaaattttattttattttattcacattgtatgaattgaattcaca

SEQ ID NO: 378 - DNA, 6534 bp, Heterodera glycines
  misc_feature (6398)..(6398): n is a, c, g, or t
  misc_feature (6439)..(6439): n is a, c, g, or t
  genomic virtual cDNA Sequence=SeqID_627; coordinates=5524..5444 ,4694..4462,3821..3728,3422..3321,2826..2687,2446..2225,1941..1775 ,1716..1601,1142..955,749..608,58..1
  coding sequence=SeqID_930; coordinates=5524..5444,4694..4462 ,3821..3728,3422..3321,2826..2687,2446..2225,1941..1775,1716..1601 ,1142..955,749..608,58..1
  peptide sequence=SeqID_1154
cagctgcgccacactccgcgccgaatttggccagcgcagtgacagcggcggcacggaccttttttatggggttaataaaataaagacgtttgaaaatttgaggaaaatttcaaaattgggactgttttcctagtgttggttggtctcagaattttttttgttgcttctcaatataatttatcgtcaaagaatcgaacaattttaaaaaaaatgctgtctttcagcggccttttaatttcatcattgaccaagaaaaaacgcgattgaacctcaaacgattaaatcccaaaaatgactatatcctgacggtacttaatttttgaattgcataaatttgaaagcattcgacaatcatttaatgttgctattagcctatagaatttcaaaggttgagtttcaaaaaatgccaaaactttacggaacctaagttttatttattttttttggatacctttttaaagatgaattttaaaaaaattgcaggcaaactcttatgatataacatcaaattccgtctctgaattaggactttttttatttgctaacaataaaacgaattgtcacgccgtatcgaatagccagatttttctaggtgttagagcctcacctgagtgctctccaaaatgacgcggttgtagatgaaccgaatgtagcgggacgggttcgccgtggtcggtccttcacggccgagcaaatgcagcacacgggtggccaatgcggcgtgttcacagtcctcaataaactcgcaactgaaagggcagaaaaagcaattacttagtaaatcaaaccggaaaataccaaaaaaaaaaaaaaaaaatcagaaattttttggctttgtcgacaaaaatataacattccaatgccaaataaaatataatttgggaaacaggtggatgaaactactcaaaaatatcagtaatattaggggaatcaatgcccatgaaaagtgctcacagatgggacaggcccaagtccttggcactggggttgtcctccacgatggtgatgatggtgtccacaatggcctttttgtagtcgaaaccgccctcgtcgcgcagcattgaggccaaaaagttcatcagtgtggcgtgtttgcgcgggtagcgatggcacagcgaacggatagcctcgatgacgacaatctgacaaagatttgggatattaaaaaaaatatataagattttaagaacagatttggcatgggttaattaatatttgaggataggtcctttcccccgcatcgttttccctcgaaaaattagaagaaaaaattggtttttcgcgatttttcaatgtttttatagggataaattatgcgaagcagggcgctccacccacgaagttttcttcgattttttagaaaattttaaaaaatgatagaaaaaatttagaaaaactctagaaaaaaattcctaatttttttcttaaaaataggaatttatagctgtttatcaccaaaaatgaataattatgctattttgagatcaagtttcaaaaatatggttaatcgggttttagaaattttaatgcttatttagaaaagtgcatattgttagaattaaaaagaattatgccctttttcttttgaaaaattttacaccttgaattcgtcgctgatctcgctgacaaaagtgccaatctgcttcatcagccgttccacgctcgcctcggcacccgtcttcaacagcgtggtgatggccaaagtggcaatggaacctgtcaaaatattttatgcaaaaatcgacaaaaaaaaagttgattgagtgcgccatacgattgctatccgtgatcaactgctccaggtccacgttgcacgaaatcaccgcctgagggtagtccatggaaattcggttcaacgttcggacggccgcaaaacgcagcgtcggctttggcgaggagaggaaaagctgaagcacactgacagccgaagccaattcaccactggaaattggaataaaattaaggggaaaagcaataatttttaaaaaatatcataaaacttcaaaaaatttccgtcggtgtattagaaaacaaaaccaaattaaaaatttagacgaaatttgtttaaaaaattctggggagggtatcactaaaatgacagagagcaaaaaacagggatttacagccgttttaaacgacctgctaggttccccgctacccaaatttcatacatacaattagttagaccgaacacataaaaagtgccatccccttcctcccccacctgctaatgcgcggcaaccgcacaatggcagaggcggcctcgtagacgaccatctcgtgtttgttgcgcaggcaactctcgatgaaggtgaaggcggagcgcgactcggcgctgccgccgccgtccacgcccagcgcgtgctcctccgcctcggccgcgatgaggcgggccgccacacggacaagttggcacaacgccagcggggagcgcagtccggacttgctggcaaaggacacaaaatatatatatatatataatttaaattcgaatagatcaaagatttcggggggggggctgaagccaaaattcgatttttagggatgtatttttggttttttgaatcccgaattagggggttgtgttttgcaaaatttttagccgttttcgccaaaaattactattttccccacatttgcgcctatgtccaaaatcggacccaaactacccggacacgacttttacctgaacttttggaccatcttcagaatggccagtcggtcgttggcacggatttgaacgagcaaagaaagggcgtggaattggaccatgtgattttcggcggacaccgcctcctgcacttcgttggcccaacggcggacgaccgaaaaaagggggaaaagccatgaaaaaataaagatgaaaaataaagacaaataaaatctcaaaaaaaaaaaaaaaatcaattttcacggcacttttcatggtgtaaaaaataggagcagctcgtttccccagagaattttttttttaaatttactaacttagaaacttctcaagaaaaaatcttagaaagtttttttataagaaaattctaagaatttttttttaaatatattttatggtgaattcgtaagatctttcaaaaaatttttccaaaaaatcgctgaaaatttctcgaaaagatttattaaaaaattttttattatgaaaaaaattctatgatttctttcttgaaaaatttctaagttagtaattttttttaatttcttgggggggagataatgcaaaataaaaaaatttcaataaaaaagtaagaaaatataggtagatgaaatttgcaaacataataagaaatgtttaatgaatgtgcgcaaacctcggggcttttgcgcatcaaatggagcgatgagaccaaagcggcggaggacaccgaagccgttttgtccacaatcgcctgcttcatgtagcgctcgatagcctggcacaaaatttttttgtaattgccgttttttgccatgaaaaattaaaatgacgcacgatcaaccaaaagttagttatgcatgaaaaggaaaacgatgacagtaagaaattttcaaaaattcaaagaaaatttttttgaagaattttctgcccttcccgttggtttcctgaaacaagtttttgatgaacacccattaaatatgttaaccatggcatgcatgcacaaatccaataccaccacgagttgaacacccaaccaaaaatggatgggtggaatttcaaacgaggtcccccccccacaacctggagcatgccggtgtcgttcagaatacggcaaagcgcacggattgcgggcgctcggtacacgtcctcacggccggtcatgtcctttgtcagactaaaggggaaagggggtcatcatcggttatcccacatttacgtcccggacatttgcgcctattttttaaatcccaaataacctaacggcattaaaaacagtcttttggtttatagtagcattaattttgtttgtttgaataattgacgattttttcaaaaattttattattatcaaattattggatacaatcaatttctatcatttatataatgctgtttaggcgatcaggaatagaaaaaactcagatttgaacctgatttttgacaaaagcgcaaataggtatctggacacggtcatcatcaaattcaattgtaaactttacggaaaaatgttccgttttggcataactttcacatccaataatttatgcaccaaaccgaaaaaggaggtcctttatcgctacgctaattaatgcaatagggatggtataaaaattgtcacttcagccgccctttgttaagaatttttgaaattttgaggtataggcccaaaacggaaaagtaccaagctgttgaaattttgtaaatcaaaagcccgcccggagttttgaaaaatttgtaaaaaaaatgtcaatttttcagaaagatttgttgtgtaaatgaaaagaaataaaatattgaaacaatgaacaggaaacctgctggtcacaatgatcacatcgctggacatttggcacaactctttgatggacaagtagaccaacatgcgcagcgtcatgtccttggcctgccacagtttggtgatggcaaaaaatgtgtcggtggcctccgtcttgccaatggtctccccgtgctgcagcaagtacagcaatttgcacagaatgggccgacatttgcgtgcattcaccggcgtctcgttgaaggcacgcgtctgaaaatgggggcattttctgtattgtcgtcgtcaaatgagggaatttgcatatttttttgccacacattttgcatgataattaacaagttaggaattttccgtgaaccagggactaacaaataagcaggattcggcttaaggatggagtggcgaaccataaccataaaatccagtaaaagttttaacattcagactcgttaactgataaatttggcaaaagtttgagaaattttagtccattttcaacgcccccaacaaattgtgttcaaacattcgaactccgtgcatttgcgcttgcatatgcctaaaaaaaattcgttgcaaattcacgcttttaaatcacaataggcatggcttaatcagcaaaaagagccggacttttcgtgatcggctatgccgaaaacctattaaaaaacgtgtttttgacttaaaatctaaaaaaaattcaaaaaatggggggacaaattgaactattaccaaaatatgttttccttgtaatttatgatttgagtttttgttcgaattctggtttggagctcggaattttacaaaacaaatgtcatattcgtgaccagcgccagaaataatcttagaaatgacgttttatttgaaaatttcaaggggcgtctcaaaacagaaaattaccaaagacccttggacccatttgccgatggtctccaaaaagtatgtcgtcatttacacggtcttgaccaattataagcgcaaatatttgggtaaaacaaaacctcttggacaacagtggccttgtccaagtggtcgtaagggttcccggcggccgattcatcgtcttttttgtcacgacgcatttgaagcacaaaacagcgagtttattatgtatggtatttgaggtgctaaaaatatcgaagattatacagcatatagaaaacgaattgcaatccatctttaatgacctctaattagtgaacgacaaaacgacgtttaaaaaatacaaacgatgtaacaacatcgttttgttaattttaacgatgtacataacgccaacgatgttttttttaaatatacgaattatagaatcggaaaagatgtaaatgaaatgcagttgttttttatgtagattgatgcaaagtgtgtgttgaacgaggcagggcggtgggatgggtgggtggaacgaccttttcttcacccgagcgaccagccaacgccaacgaaccaccactgattcatctcatagtagtatttgttgtccaccaatagaaccaaaaacattttgtccttttcctcggaattaaatggcttcttcatcacatttatcttcgcaactacaaaattgtggattttctggccaagactttaaatgtttaagaatattaagatatgtgatgtaattgtcaatgctgctaaagagcgccgtaaagaagaaatttaaattaacacacaacataaggaggactcgaacctgagaccccccttttggtgactaacgcacagaccactaagacgaaaaaaccaactcaattgtacaagaagtccaaaattgaatcgccgtgtagaagatcaaaatacctataactagggcttcgatttttaggtttttacatatttttttcctgagctccccgtggcctgaaacgcacgaaaaacatgtttttttgggctgttgttaagctacttttcgagttattagcacctattttctaggtttttatttttagcacctanaaaacctaaaaaaattttaaaaaacttattttcacctattntggcattttgcccaaaatttgttaacaaaaatgcaataaaaaggaaaaacagacccctaagaatcgaccgaaatttttttcaaaaatatacccct

SEQ ID NO: 379 - DNA, 8728 bp, Heterodera glycines
  genomic virtual cDNA Sequence=SeqID_628; coordinates=6806..6662 ,6574..6391,6349..6112,6020..5892,5844..5761,5709..5584,5531..5467 ,5415..5313,5271..5196,5131..4980,4934..4779,4729..4436,4383..4071 ,4022..3838,3789..3612,...
  genomic virtual cDNA coordinates=3539..3447,3397..3266,3219..3151 ,3000..2885,2841..2746,2688..2492
  coding sequence=SeqID_926; coordinates=6806..6662,6574..6391 ,6349..6112,6020..5892,5844..5761,5709..5584,5531..5467,5415..5313 ,5271..5196,5131..4980,4934..4779,4729..4436,4383..4071,4022..3838 ,3789..3612,3539..3447,...
  coding coordinates=3397..3266,3219..3151,3000..2885,2841..2746 ,2688..2557
  peptide sequence=SeqID_1150
attgaaaaaaattatgtatttctcggatcataagatgactttaatattttaaatattcatttttagatatcttttgaacacggacagttttcgtgataaaaatgcgcccattttcttttacaccggcaacgaaggcagcattgagggctttgccgagaatacggtaagaattattggcgaggatacggtattgtttggccaaaaacaattatcctgctctgatctgtagtgatctattgtaataatgaagtctctccttgatttggagattttattattttggctttaatttttggcatttttgaggggttttttgccgaaaaatgttgtcttgattgaacaatctgatcagtgatcacattcattaagggcttcatgtgggacattgcgccagagtttggcgccgccattgtttttgcggagcatcgcttttacggcaaaacgcaaccgttcggcaatgagagctacacaaaattggaaaatttgggctacctgagctctgaacaagcattggccgactttgctcaactgatcgactacttgaaaaatgaggtgggcgacaatcctttgggactttgatcactgcgattgatcagctcccgttggattttggatccgggatcactgcgctttgatcagttccctttgggtttttgagttagggccttgaccattgcacttgatctgcttggcatttgaatgtctgactctgatcaccccgcttgatcagcccgctgtgcagctgggattataattaatgcgcttgatcggcttccgtttagttttcgatttgtatccgatcacaaaaagtaatattggaatataagggcgggaaaatagaagaatgatctcataattggactgtttccctgattcttcaatcaaacaaatcaaatcatttgcattttgaccattatcctgtctataaatattgcagaaattaccgaatgccaaacattcgccggtcattggatttggcgggtcttacggtggaatgttgacggcatggatgcgcatcaaatacccgcacctcatggacgggtatgattttttgaattcaagaaataaaaaaaatgccaaactttaagaccgtcagtagtagttatggtaccggtccataactactgttagttgagcccaaggtttttgtcctagactttttgaaaaaaaaattttgtttcagttaataactggtgcaaaaattattttaatattaaaagcttttcaattgttgagtcgagagtctataaaatatcactcaattaattgccttttgggatcgggatttggtcgtgattcctactcattgatctcttatcatatctctctaattataattcttctaatgataccaattttttttttcaaattttgatcattttcagtggcattgcggccagcgcgccggtgttttggttcctcaatgtgccaactccgccggaggatgcgtatgacaaaattgtgacccgaacatttgtgaacagcgggtgcaatgtggagagcatcaaacagagcatggacgcgatccgagaccttgccaagacaggtgggcacattattgtaataaacattgtagtaaaggtgctgctaggtagagaatggcaaatcattttttaaaatttatatgagcggtttataattttagtgcgagagataacgcaaaaatgagagagtgctggatctcagtcccagtcatacaaaacatttttgatgaaggaggtagagaaaacaatttcaatagagagcgcaatgggaagggagttcatgtctcttcttcgctgattcttttggtaagagacgcagattcctcgctatgttctctattctctctctgtcttaaatctcttcccataacactctctttttaattaatttttctttattcttctttaccaaaaatgcttttgtatgactggggctgaatataacaccctctcacttttgcgttatctctctccccatcttattttccgccaaaagtcatttttgaaaaattgctttaaattttaaaaaattatcccaattttaaaaatagcgttgatattacgttgatggcataatgttatgttgatattaaataaatatcaacgtcaatgttgatatttattaaaacaattttcgctaagagaaaaatgttgatttgcctttatctacttaggaaccctggttaaaagtataccgtaaactgcacagataccaaaaaacagacaaaaggcaaaatatttacacccttaatgactttttgtaaaaaaagttctcatttacttaattttaaattttttgtcctgctcccactaggaaatgagaaaatttaaacacctatcagaaagtgcattttatgttttttgattaaatttcaccacctttttagtaaacaatataaataaaaacgtttaaattgtccaaaagttatgtcaaaggaataggaattttcaagttgttttttatgacatcagatcggattctgatagtaatataaagagtgtagtaatcgctggcacaataatttaatttccaaatatatttgaacaataaaatcggattatcaaattcaaatcaaacaagtttacaaagaacggacatcgaataaagctttgccccgttcggcccctgcagcacaccatcctccccttccgtggtgattaaagagccagacaccccacgatcatgcccataaatgaccttagcctgaattgaaagacatgagattttttatttttgtatttggttttgtcaacaactgacctggtctccacttgccggtcgaatgggcaccacatgttcgtgctcaatagtgaagtcatcgtcaagctcctcgaaatacaaacaacattcgccctcctacgaagaatcaaccgaatcattactaattaaatacacttactctaattgaccgtattgagccttctaaaccgagaagttggtcctttccacacgtcggaagaacattgacgcacaggtcgaccatacaccatgaaccagtgggaatttcggaatcggctgaagcattgcatgcaataatattcgcggatagttttagtggtcttacgcattatttcctgaagtgccggtgactgaccaatgggcgttttcgacggatgcagtgaagcttaaaggatatctgttataaataccaaaaaatgatattgccatttgtgcttgggttggggtaagggcttgaagaataatcgccgaacatatctcgcggtgtcatttggcctgataaaaacaaacaatattcagaagaccttaaatcctcacgcacccattggagtattcgctcccccaagtcggcttctcacagaacctgccggcgttgatgctcctccgccaaatcccattgtgtcaaattcattgtcaaaatgagcagttgaatgagccggcgtattggccaaagctaaagtgaacgaaaattgagttttaagatcaaacaaaataagtatgaccagggtcccaagacgaagatggttggtgcgaaggcgttcgactgccgtcgtaagccggggtcatagagccgtaatgaggagtacgagcaccgactaaattaaaagatcagaatctttgaaacaactctgcgaattccgaattagaatagtaaagatattgattacatgagtcgtgcataggcgttgctgctccaccgtacattggcgtctgcgctcctccgtacatcggagttcgcccgccaatggtggccgttcccggagtcattgcgccagcagtgtccatcaattccctcgggacggcaccaccaacctccatcactttgttgatgtcaaaattgaccgtctaaagttaaagatttatcgatccaaactgaaacaattagggcttcacttttggcatggtgtgcagttccaccttgacagtcgattccgttgcatctttcacaattccaatgtaacccttcattggaccagccagaacgcgcacagttttgcccattatttccatgttccgacgtacatgttgccgaccaactccggttgctgatgttgcgatgctcccgaccacacttggtgctaaaaaaatctgaattaacaagaacagatgaccatctagaaaaagacctttaaaaccatgatcgccacggacagattgtgcaccaacaacacttgacccggaatggggagtcattccgccgtgaatggtgcgaggactttcgagcggattaggacgaggactcataagttgactgttatccaaaatagtagtgttgatttgtgactccgacgctttgcttccaccaatcaatgccaaattccgcgctttgcaaacaaacattcccccgttttgtggatatttacgtgaaaaaacgaaggcccaatttctgaaaagatgcttgatctcgccctgacgttcttcttcagtttccttctttcgctaaaaaatgactattatttaaagtttttaggttcaaaaagacagcactaaccgccaggaagccctcaacaactttgaccgtatctcccgcttggattgtattcttttgagaatcaagtgccttgacgaaccgcgaattctttttgcattcaatcgtttgagggttaacacgaagtattttgccatgcatactcaaaacttccacattttcgcgttccaaacgaacgattactccaactgtttctttatccagcatcaccaggtcttggtactgatattggcccatccgttcaacaccagtcgcaacctcagcacaaagttgtacatctttgggcaaaattttcatctgcgaatagcatataaagacaaatggtaatcgcaactgagctaattacctctcccatggtaagatcagacaacatgatgactacgttgtcctcaactcgtacaatcagacccgtgtcaccctcgtaacgaccggcaatcactcgaacatggtcaccaggtttaaaatacttccgcaattcactcgcattcaaagtcaagggttccttaaaggaaaagtaattccaattctgaaaattagaatcgcttacatttaaatcctcatgctcgggaaggatgacaactttctgcccatcaatgctttgaattttgccacggagattcaccagttcaccgtccataacttcgacgttatcaccaggagcaaaactatggcgcttctcccttaggtgagtgttctccactaaaatgggaaaatgaattattttctcttccccaaatatattgaaattccaaaactggctgacgttctttttttaagtcgtcggtggaatcttggaaccgctccaactccgtaagggttggatgagtaatgtcgacttcctaaacatagatcgttttaccaatcaaaatcactaacttacaatagcattcattggaaaagatttgtaaagaaagcctctgcgataatggccaccttcgaaaatgtaaaagtcgccatcgtttgtcacttcaccaccgattgatctaaaacccaaggaatacattgaacaaagaactaattccgaatatgctaactttatacggtccaaatcgaatggagcaggcaatggacggcgttttttcttcataattctgtcgtcctaaatttaaattataatgtcgattttaacgtgtttctcgtcaaaaactaacttgtgaccgaagagccccccttaagcgcgtgtaatcaatgcgggggatgagtttgaggttgactcgattttgtgatatatccacccaatcaacttgcgcgaggtcgtctttgtaaagagtcttgctctgcaaatcattgatgagaatattaattaaatacaattaagagtgtcataccaaacggacatatgcaccgggctttaaagttggaatattcttgacaacgcggagagtatcggacatttcttttattgggaccatctttgaaatgaagggaatgaaaaaaggtaataataagccgatattaccgtgattttgaattggttcagcgccgaaatcccttcaattgctttggccacgtgggccattttaaacgcttcaatgtagatcatccccttgaggccctctttgacaatgacagatttaatttggagaggcttaaatacaatttataaatcagtcgtattttccaaaatatccaataaacaaatgaacaggaaacctgtgcttttttttacaataacttacctcgtcggtgttgacaaaagtcaagtatttgcgcattaaacgaagacaggtcgtcttttcctcgcccagtcgacactttacaatccacaaattcgggtctttcgtgcttggcaacagtccgttctgagtgatgtcgtcatatgcgtcctcgtccatgtcgccctggtgtgtcgccacttgtgctgcatgtctttcctggaagtaccgctccatttcctcctcggtcatgtctctgaacaatcaatcctttagaacggattaactgtcaactacaaatacgcgtatttgttgcggcgtttctctttcatcttttcctgttctcgtagaaaacgttcagcttctgcgcgttcattcgggtccactccaaacaaatcatcgccgtccgccccagcatcgtagtcatcctcgtcttcatcgtcgtcgtcgacttcgacatcatcttggataaaatcgcgcgcagtcgctcgacgctgaacgtaaaaataagataaaaaggatgagcattattgattattgtccctgcttatcactgccctccccctccctatacccaccctaactctgcgcttcttctttgttttaggtttgttcagtgccaattcgttctcgtcgaagtcgtcctcttcctcaacctgctcttcttcgttttcctcttcactgacagaaatcttgaacacatatgtcgtaatcaacatttgcttttaaaaacattgccttcctcttccgtgaaacgtcttttccgatgttgtcttcgtcctcctcctcttctccgtccacagctgcatcaccttcatcccccgattcgttgtcaaccgctccttccagttcctcttcaacctcggaatgaacactcgcgtcatcagagtccgatgacatttggcaacaattaaattaaacttaaagataaaacattcacgtgataaatgggtacattcaaatccattattaaatatttcaatgtatttagttacatttgttatttggaaacacaatgcaaaaagaatttattaacaaaggaaaaaaaacaaataacaataactcctctatttgtgtttgccattttgttgagcattggaatgagttatttggggaatataaccttgattgaaaggattgttaaaatttggaaaagtaggttgtgcttgcgaaaagtattgggatgtagaagcggcactgagtggataaactggcggaggaggaggtggacgaacccatggatgaggaggcaattgaacaccaaatggttgatggtaaggcgaaaactgtggatacatgtgcatatagtgatgctgagcgaatgttgtgtatggtctggcaaataattgacgttggaaatttgtgtgactgaaattgcatatcttctcaggccgattctttccattcctcgaccgcttcgaaggtatgacattagctaaacataaaataccaaaatgagatacctaagaaaaattatacaaaaacttgtaggtgattctgttgcttttcggtctcctcgagttttttgtcctttgcatgccaaatgacgcttctcctcttcgtcgtcactgaaaaactcttcggaactggatgagccgccacccgatggccgaactcggtcccaattctttagcctgtaaataaatatgcaagtcaacagcttgcaatcactaacaaatactttgccaattcctttgggaagacgggctttgtcatggcattgtccgaatttgcataataaattacttcaccaacagggagtttcgctacagcgtcactttcgtcattgaatcgcaatgcatataaagtatcagtaactgtcccgaatatttcaaaaatctctccaattggctttttgtcgtgattgaatagaattgtctcatatccaagatgtggcgtatccttgtcaggctttatcttcgcttaaattctttatatgaaaaagtacttttgaaatgaaaactcacctaaaaaatttatgtgcgaatcaacaacaccaaatcttttgaattcagtctcctctttgacttgtatattaagttggtcgatcgcaggtaaagaataatactcggaatcaaagaccttatcacgcttatttaaagaacgcggcttattttgactgtcttctcccattttagcagcagaaaattcacgatgctttcgacacatttccaagattctaaatgtaaattttattgaaaataacatcagtgactgggataattacttgataaattcggactcagaatcatcatcgttattttcctgtgcttgatttgaagaaacgcggtgaaaaaataaatcatcttcttcatctgttgaagcacaagaatctcggtaatcgacaatatttatcataatttgtttgtgctaaaatgaaataattatttgctgattataggttataccaaagtatgagttggctcttttgccctttaggtccaataaagaccgtcctcagtttcctaggcaataacttttttttctgtcaatgcggggtaaaccaaactcatctaaaccagggctgccagatctgaggatttatcctcattttgtggctttttgataggtcaatgaggattttttttggaaaatgaggatttgaggatttttgtggctttttgacaaattttgaggcttt

SEQ ID NO: 380 - DNA, 10404 bp, Heterodera glycines
  genomic virtual cDNA Sequence=SeqID_629; coordinates=2130..2489 ,2544..2666,2715..2893,2938..3040,3091..3477,3527..3679,3720..4014 ,4056..4267,4314..4464,4518..4633,4933..5118,5162..5296,5340..5471 ,5519..5540,5678..6008,...
  genomic virtual cDNA coordinates=6066..6129,6417..6572,6804..6945 ,7168..7346
  coding sequence=SeqID_871; coordinates=2130..2489,2544..2666 ,2715..2893,2938..3040,3091..3477,3527..3679,3720..4014,4056..4267 ,4314..4464,4518..4633,4933..5118,5162..5296,5340..5471,5519..5540 ,5678..6008,6066..6129,...
  coding coordinates=6417..6572,6804..6945,7168..7346
  peptide sequence=SeqID_1102
tgcgtaagtcgtccataactttcggggattatggacactcggaaacaaatggccatgccgtcaatgtcactgaaaaggcaaacgtaaagatggggagaacagctaattactactattagttgaagtaaatagttaattgaaaaaccaacccggccaaagtgtatcctttggggggcctccgcgaccgcgccaaaacaatcaaattggtcaccgcgtcaattgcatcagtccgaggagtgaagcgggcgcacaaatatttcttcttcagggcgcgttcttctaaagggcaaaaaaagtgaaggaagaactatggaaggcgaccgacgcactggtgtcaacggtgaagtccaagcagacgaagctggacggaactgcttctttgtccgaaatgacggccacgtcagtcaacacttccaaaccgctgggctaaaaagcacacaatttaagcagcagacagacggacaaaccggcgtttcggcgatgtgtcggcttacagcgatataacgaacggaacggttgaacaacccgaaaccgaacccatccttccataaatcggcgtcacttccgtcgtcgtaagttttcgttagctgttggaaaaacggggaaatgaaaaattaaagaaataatcggaaaacaccgtaatgaaattggccggcgcacgacttttgtccgcgacaattaccatcgaaacaatgggcaaacgttcttcttccatttcaggactccgactcaacatcaataaggcaaatacaaagaattaaaggacacgtttttttagatattttatgagggttaactcaatttgacacggaaccaaaaaatccatttttgggctgaacaacgggtatttcaggcaaataataagagatgtaaatgaaaccgatagaataacataatttgaactgaacaattcaatgcatttattttttacgcccatggcggcacaattggcgttggattctgcagataggacatcacctgaattggaattgaatgtgtaggtctaacaataagaatcatgcatcaaagctggaaaattaccacggccgaaatgctgagcatgaacgagctgaccacctgtttagtgtcatcggacgcgcgcatattggcaaaactaacgcaagagcaaataagagccacccaagaacaccatttgagctaaataaataaacaatgagttaattaaagaatttggaattctttgtagaaaagtaattaaatgcttattccgtactctcatcataagacccatcatcgaaaagaccatccccaacacgttcatatactccggaatgctgtcttccgctgtcactggctgtaccatcggatcaattggcttatacctgtcaaaataattaaaatccaaataaaaagaattttaaaaaatgaacataggcacctgacaattttatttggtctacgaacttcgccattcatttttattaaattaaaccagggatgcgatctgttctgatttatcagaaatgttctgatttgaagggtccaaatctgataaaataaaaaagttctgatttgtcagaaatgttctgattttggggtagcgaccaaaatttgttctgatttcttaaacaaactcataattttaaaattttatggcctaatgtcactattttacaaaaaaatataaaatttatggcaaaatttggtcattttttggacaaaaatctgttaacaaatcgtactaaaatcacaaatttttcccggcgaaaaaaagcgtttttaaaagcgaaaaaagcgggaccgggaattttaggcttaaccgggaccgggaccttttctggttgaaaaaccgggactttttggctgggaaaaccgggaaaaaaccgggaccttggtactcagttgtccgtgtccaggtcccggtcccgctgcactctagtttttagacgaaaaaaagcgaaatttgaagtttcgactttttgttcgaattcgggttcgaggttcgaaattgagcgaaatggatgccagaatcgtgatcagcgactcggaaacccctagaaacttgttttgaatgactttttaaagggcaaccatcttaactattaccgcagtgaacctatcaaattatttacataaattttaattattttctaacagaatatacaaaaatgtacatcaaagaagtgaatatcactggttttcgcagttacaaagagttgacaacagttcgcaatttttcacccaaacacaatgttgttgtgggccgaaatgggagcggcaaaagcaacttttttactgcaattcaatttgtgctgagcaacgatttttcctcattgactctgcaggacaaaaatgcctttttgcatgagggggtcggaagcagagctccaattgcaaaggtcgaaattgtctttgacaacacggacagacgaataccaactgacagtgacgaagttcggataatgcgacaggtcggccagaagaaggaccaatttttcatcgacaacaaaccagtgacacggactgaggtgagccgaatttgatccatgaaaatttgaattttataaactcgaattataaagattgtcaatctgatggaatctgccggattttcgcgctcaaatccctattacattgtcaagcaggggaaaatcactgaattagcaaccgcgtctgatccgtacagacttaagctcattaaggaggtgcgtgctttacacgatgacattggattaattgcatttttattaaaggtggccgggacacgcgtttttgatgagaaaaaggatgaaagcaccaaaatattgcatgaaactcagacgaaaattgagaagagtgttcaattgctcggttatattaatgaacggttgaaaaaattggaggaggagaaagaggacttgaaggagtaccaaaagtgggacaaaatgcgaaggtgcgattgcggtgtatggtgaggatttactactgaatattaagggcaattgagtacacaatttacgatttggaaatcaaagaggcgaggagcaaaaacgagaaactgacttcgcatagagagcgaataaacgcacagcaaaacgaagtcggcaatttgcaactgtccagcaatacaaataaaacgaagcacttaaggtggagacgaagctgatccaagccaaaatgtcaatccaagaggcggagatgcaaatccgtcgattggagacgcattacaaaggcgtgaaggaagagcgtgccaccctgctcaaggagcagacggaccttatggagcgcaagacgcagttggagttggccattagggacttggccgaagacgtagaccgtgagagaagcgggcgcgaaattgcggaacattcgctgcaacaactgaaacgcgacatcgcggagaaggagggccaattggaacagttgcagccccaatttgaacagttgctagaggaggagagtcagctgggctcggacattcgcattggcgagcaaaagtgtcgcgaattgtatgccaagcagggccatcgtgaacaggtgagggaccgggaaagtgcgagcagtgcatttaatcattgttgtgcagttcaaaacggtggaggaaagggacagacatttgcgcaaagaaatccattggatagaacggcgtattgacgagacggagcaccaaattacagagatagacgaatccatcgtggaggatgggaaggagcacaagcgactgcgagccgaaattcatgtcagcattttgattaaattttaaagaaagtttaaattaggatttggaacaaattttgcgcgaaaaatcgacacgaatggacacattaaacgcagaagagaaacagaggaaggcggaattggacagagcaatgaacgcacggatggaaaacgcacgacaggaaaaggacgtgcgggaaagactcacattggtacaatacgaaatgcagcagagcgagcaagaactacgaagattgacctcaaaagcagtgctaaacggcattaacagtgtgaatcaagtgctggaggaaatgagacagaacggaaacggacaaaacattgttgacggatattttggttgagaagtgccaatggattggattgatttcctttttaaggccgtgtgattgacttgttcgaatgcgaaagtcagcacaacaaagcggttgaagtgactgccgagtcgcgcctcttttaccacgtggtcagcgacgaccgcgtggcgatgaaattattggagcgtatcaaccaacgagggctccccggggaagtgaacttttatccgcttaatcgtgtgcttgtgaaagatcgccgcccggtttctgacgcggtaaaaaatgtattaattccactgaaaaatgaattgtctctcttaggatgcaagtcccatcctggaccatcttcaatacgacccgaactttgagcccgtttttcgctcaatctttggtaattgtgtgttcgtccgtgatcttgcggcaggttctcgggttgcgaaacaagaacgatttgactgtgttactcttgacggtgatattcatgacttttttgaatcatatttaatttggtaaattgaaacataggtgatcaagtgagtcgtcgtggaccaatgacgggcggatacattgacagaaaacgttcaaagattgacttggcaaagaaattgcgcaattttgaacgggaaaggataaatttggaggtaaatgcaaaatatgtttaatattgcatggaacatatttcgtaataagacactttacgatatatgggggaaaacatttcccatcaccaataagaggttaaaaaatcttaagaaaatttttactaataataagtaagtttcaaggagaaataaaagtcaaaaaatcgttggaaatttttaaaaaatttatcatgaaattttatttaaaaaattcatgattgtcttttaatttcttaatttgaaaaaaaacattcggtttggggggaactgttttcataaaataccatttcgtttaataggaacaagcggatttgttgtcgttgagtgtgtcagatagtcttaaagaagtggaacggattaggctggagatttccaaattggccatggacattcaaatgttgagcaaagagcacaaagcccttctggagaaaaagagatcagtttctgagttgctcagccaacattcgctaaatttggagccgaaggttatgccaaaagttcatttacatttacaaagattttttacagaaaagtcaaaaaacagttttgcgaaatcgaattagggaattggaggcgcatcggaaattggtacaagaccaattgggtactgagcttcagtcccaactgagtagcgaagaaagggacgaattggacggagtggaggtgggaggagaaggaagggagacgaatcactgggaatgttaaggatgaaatcaaagcgaagaaggagaacatggacaaactgatgcggcagcgaatggaagtggaaaatcgcatccaaacgctcaaaaatcagttgcagtcaaaccttttgcggaagcgcgaaaatctgaacgccgtactttcattctatgggggtaccaaacgaattcgtccatttttcagaaaattgaatcgatcactgtcggtgaaaagggccacaaactcgcaactgaacagacagaagtcaaactcgtgaacgagcggcttaatcgggtgattggacggctccaaggcatgcctttttatttattttgggtttgattcatccgttttgatgttcagaattggatttggacttgggtaaatacgacacggagaaggaggaattgggcaatgcattggatgctcaccaggaggagagtcgggaactgaacgaacaattggaagaatttgcgaagaatgccgaaatatattgcacaaaaattgccaacattcagtcaaaaagggaggaatgtttgaggaaaattacggacattggttctttgccgacggacacagcgatgggcaaatacgacacgatgggactgaaacagctggacaagaagctgacggaatgcatgaacgagttgaagaagtacgaaaacgtcaacaaaaaggcgctggaccaattcatgtgggttttgttttttatattttctttgcgagttaattcgcaaaatgtccaatttaggcgtgcttccactcaaaaagaggagctcaccaaacgagtggaggagctgcaaaacaatgaaaaggtgtgaaggcattcgtttaaggggggcgggactcattttgtatgaagcactgaaattctactaccattttttgaaacattattaatcaaatttttcggttgttcaccgtttccttcccgttagtcccccacccggaatttttttttattaaaaatctaaaataaatattttttaaactaggatttataaacttttgcaagtaaattattaagtatttagaaaactaaaaaaacatttttgatataggacttattttgatgtgagcattatttgaacatgacttttagacgatccaagacttactttccgtactggaaaaccgacgttttgaaacccttcaattgacttttaaacaagtggcaaagaatttcgaggacgtcttcaaaaaattgattccgcaagggacggccaatttggtgatgcaaaaggtggacccgtccatggtttgtcgagcaactctttcattccctctgattttgattgagttcaggacacttcttcccaatccgacgcttcgagtcaaccaagaaaatcacagcccaaacacgtattggagacatttgtcgggactagcattaaggttaataggaaaaattattgaatttgaatctatcgttactatttttattgtctgtccgtaggtttctttcacgggaacgcaagaagtgcgtgagatttccgcgttgtcgggtggtcagaagacactcgttgccttggcgcttattttcgccattcaaaaatgtgacccggcccctttctatttgttcgatgagatcgatgcggcattagaccaagagcaccgacgtgccgtcgccggtaaatttatgggataaaattcaattgttcttcattttaaaagtagttcaattgaatttttgactgattgtgagataaatattgtgtatccaattagtcaacaataccagtttgttttggctataatcttttaatgggtctagtagtaagtcgcactgtttcaatgtaaatttattagtcgaaaggactcatgaaatgaaatctgctaaaataatgttttagaaatgatccacgaactgtccgaaattgctcaattcatcacaactaccttccgtgccgaactgttggaacatgccgagaaattttacggtgtccgttttagggacaaaatgtcgtacattgatgacataagtcaacaacaagcgcaagactttgtgcaggatgatcagacacactcctgagaattatgacaccttttacattatgtcttaacaagttgatcgatctcactttttacattttatctcgcgcatataaaataataaaaagggctttggatttaaaactgctgattatgttttcatgctttgtttgagcagaggttttaattagagtgcagcgggaccgggacctgaacacggacaattgggtacaactgagtaccaaggtcccggttttgaccgggacttggaaatttcaggttttcccagccaaaaagtcccgggttttcaacccaaaaagtcccggtcttgcccaaatttctcggtcccgctgcactctacttttaatccataaaattttttaaaatagtggcgacgtgttttacggaaaatgaattgacgttttgttttttcttgtccttgctgatttggctgtttgctttttcttttgaattgcttcagcaattactcaattcatatttccaatttattaattcttcccttgagaaactatgaaatataaaaattctaaaaatataaaaaagtgcatatttttattatgtaggtatggattagctttctttgttttaagtaactttgttgctttcttttgtccttttcctttttggtcctttggtttttcttttgttgtattttttccttttatttacataatttccattccttcaattactttctttggtcagtcttcattaaccagttaattcctcctcaacttgcatatttcttcgtccaattacacttgcattttctacaaagtttctgaagatgaaccaattccgtgtgggtggtcagcgtgaattgttgggcgttgctgaggattatgcggacgatgtgagtgggggaggggacaatcgctgacaagggctggtggaatatgaattgttttttatttttgtgctacaattttgctgctgttttttgtcgaaccattaattctcctgtttttcagattttgcgtcatacaaaaaagattctgccgcatttggcccgacttttcctcgtttccacattcattgaggatggttgtcgcatgtgggtgcagtgggacgaccaacgcgagttcatgcaggtgacagaaaatagatgggacggatgggcgaacctttcagcgtccatttttgacttttaccacatttaaaatgttataaaacctttacaattttaggagtcttggtcatgcggttggtttcttgccatgctttttgtggttttcaatttcttcggccaaatccttcccgttgtgatggtgatgatccgaaaatatattgggattgcttgtgccattcttgcgggaggtttgtttggctttttgttactttattttattggacttttcagttgttgtgcttcaaacgtttgcttatcatattatttgggacctcaagtttcttgccaggtttggcaatatgctcgaattctttctttattattattttcctagaaatgtggccattttcggtgctctcgtcctcctctatgctgaaactgtagaggaacgaaagtcactcttcgctggtgtgcctcaaatggacgaccaaaacaaacccaaatcgtacatgattcttctcgggcgtattctcctcgtctttatgtttttgttggttttttgttttttatattcaaaaactgatacgcttaattgtaggtctctcattcattttgatcatttgtccttcttcaaagtggtaattaatgacataatgctgaataccttttcttaatttttataacccaacaattttaccataagtgatttggcttctgttttagcttgaactctcagttggcattgtgctaatgattcttgtaacaattggtttcaaaacaaaggtaaggctgaactaaactgttcatattttgtttaattttagtgttaatttggcttttttattgatgcctgacattttaattgtgctttagaaaatgaaattttattcatttttcttcagttgtccgccatgtttctctctttttggctgttcgctttaaatctgtggctgaattgctggtggaccatcccatccgaccgtttttaccgcgacttcatgaaatacgatttcttccaaacgatgtctgtcattggtggtctcttactggtcatttcttatggtcctggtggagcgtctttggacgcatggaaaaagcgcgactaacacaggattaggtacaaatgaaatgaaagggaagaggatgaagaaacgaggagagatgtagggggggggggaagaggagggaagagaaagggagttggacgttgaacagaaagggacaagcagatgaagaggcagagagacaaaccaagagaaggggggggggaagaacgaatggaaagggaaggaagaaaaagagaaagaagggaatgggtgggtgagcgagaaaaatttgaaaatgattatagttacctaattggcatttaattttgaattcatcatccttttccatgaccgtctaccgaaaatcccgtctaaaaattgttttcctattctttgatattcgagaccctttcacatttttttcttattttcgtttttgtcctttaccatattggaacataaacacgtatttattctctccatctttcgcagattcctttattattttatgtaaatctctcctctttcacgcgtttattcttttgctgtttttcaaaagcattcttttaattgtggatttttctatttctgcagcatttcttgctgatttctctaattgtttccattaacaaatggcaaaagtacatggaatttttttttgtttacccccccccccccccctaattgttgtgattaattcttcctgtttaattttgccagggatgtcatgtccacacattttatccgatcgttttgtttattcgcaaacaattgggtataccgttattttgatagtaaaacagtaatgaaaagtgataaccaattgttttagcatgaatggattgtcaatgtgttttattatgacaaaaaaagattgttggcttttaaatcttctttggctgaatttaaattttctcaaacaaagacttatgagagctaattacagattagtgaaattataa

SEQ ID NO: 381 - DNA, 3407 bp, Heterodera glycines
  genomic virtual cDNA Sequence=SeqID_631; coordinates=2811..2692 ,2644..2519,2391..2278,21..1
  coding sequence=SeqID_1021; coordinates=2811..2692,2644..2519 ,2391..2278,21..1
  peptide sequence=SeqID_1228
ctctccctctctgctgttgctctttttccaccgccgccgccttttcccgtcccaatttctttttctgtcctcgtccaactcagaaaaagaaatttcccgcaaaaagtgagcgaatgagagaaagcgcagagaagcggcgaatgctgtcaatagaatcccccggggggtagagccaaaacagacacgagaatgagagagacaatgcggagagaggagagcgagaaagacagacagagtgaggagagaagggcaaatgcaagagaaagagaaagagggcaaagagaaagggaaaaggccggcgaaaggaaaacggcaagaaaatgattatgcgatttcgtaggaaataaaagggaatggacgaaggtcgaacggagactattcaaaaaacagaccaatagaaaacaattaaccaaagggcgttaaacggtgccggaaaatcatggcacacccaaagtgggttgattttccaattaaagagggataaaaaacaaaagctaaactaactcttgcaaataagggatccagaaattagtagaaccaatttttgtcaaaattaatcggtaaaaagagcaatggcctcctgactttttttgttaacaacacgactttattctcataaataaactccaattcacaaaagaaaatggagagagagagagagaatacatatgtgcaaaggaaaggaaatgtttttgaatttggaattgacagaagagaaaagaaacgtttagcgaaagcaaagaaaacggagaaaacaaacgagaaaagtacaaataaataataaaacaacagacggaggatgatttaggtatatgttaaatcaacacacaaaagagaaggaattatgcaaaatattaaaaaaggaagcaattaactgtgttaattaattagtaaatgaatgagtcaatttacaatgtaatcgccataaacacttaaataaaaaatgccaataaatatcacaaattaatcggaataaataggaaatggaagagaaattgggaaaatttgggaccatattgtgaaaatgaaaattgaatcgtgtaaaggaaactatggggggagaccatcaaattgcagggtaacaattgccattttaaggtccgtcccccagaaaatgccaatttcgaattcatccgtctccccccttttcctttctttgtccactcttttcctcaaatttggtggtattccatgtgcgcaccaatctgatcggacgttgcattaataaagcgtggatcgaatgcattttctctcccaaaaaggtttggtcgattatttatttcgtcaaattccatgccaaagtccgtctcattttgctgtgtgggaacagttaggaaattgtgatcatcgtcgccttttttgtccatcgtgtcgaatattccgaatccaaggccaaaatgatttttgttggcaccgccatttgtcggcgctaaagcacgaaaaaaaatcgattaaattaagttatgaaactaaaccgttttctccaccgaaatgcgcaattgttgtcacttgggattcatctttgtccatttcaaaatcaaacaaagtttcatcgctaatgcttccgcaaaaattgcgctgttcctccgagttataaaaagaatcagagaagaaattgtttaatttatgcgactggcaaactgaaaaatgggaatttgttggtagattttatttgttgaaaccccaatcaaaaacaacggcactttgggagagcgtttcctcctccgtcccatggcctccccccgtgtccatggtttgtccgtgctgcaattgctccgtcggttgttccttccattgtttcagtgccattgccgcagctgcctcaaaagtcataaacaatgaatgacattttgtgagacaaaagtacgcactttgaacgaagctgccgagtccgctggggtaaagcccagcgattgttgtcgctcattctgcgcatttccctcaacgcattgcgcccccgggggcgccacgaaatcaatcaaagtacgagaagcacctggaacaaatgagcagggttacggtcatttgtaaaacaattcgaccattttggtggtgaatggaagaggcgaattcggggttgtccatgcgagcgatgggctcattggcagaaaggaaacgcgaatccatctaattgtaaatccaaaaacaatcccttgctgataggccgggtggtcaaaatttaagcccccaatcccggacaaattggcccacctttttttgctgctgttgttctgcgatcagcgcctgttgctgctgaaagggtccattcgcttgtcctctcatgccaaggtgtcgactatttggcgtcacaattaaacagacggaaagcaaaaggacagccaggcaagtgcctgtctgggcattgcgctttgacgattgtccaatggaagcctttgaaaagaaaggacaaacgaatgttttgctaattagtgttaatgagttaggtaatttacactgaatcgcccccgcccactaaaccatgggtaagtgtggctaattgcaagtccttgtccagcacctgcatgttgcgcagttgtgccgcaagctgtctgttttccgccgccatcacttcgatttgctttttcaattctctgttttcgctgtcgctcatgaaaatgcgttcctgcagggcctcaatgtaatcctaaaaacatcaaaacaattcaactgattcccttcttcagatttcgcctgtttttttcttctgctcgtctgtgccgacattttatttcggattttgcgccgaattcgcttcaattcgcgctcttcggattttgtcaatgggtaaaaatccggcaaagttacgccctcctaaaatgggtgcattattagaagttaaacgaattggtcagattcttttcataaaaaactcacaagcgaacattccgagctgtaactcggaaaatgcatatgtattatataccattcgatagagccgggtcgacttctattgtgaatttttaattttagcggtgtttggcgcctagttcaattcaaaagttacagggcctcaaaaatcgaattttagactaagagcccttttccagctttgttaactttctattaatttccaaccttagcatttattattatttttgctcattctcactaaagaaaaattatcatacattttttaagtctaaaaaatgatttttaaattattttaattatattatatcttaattaaaatttatttattttcatgttggatttgaacccgagctccaaaaatgtgaatttaaccaactgagccaccaattttaagtgaaaacacagccaaaatttcaatttttgaggccccataacttttttatttttccccaagcaccgctaaaattaaaaattcacacagaagtcgaccctgctcaatacaatggtatataatacatatgcattttccgagttac

SEQ ID NO: 382 - DNA, 8398 bp, Heterodera glycines
  genomic virtual cDNA Sequence=SeqID_632; coordinates=5173..5066 ,4970..4788,4745..4548,4324..4097,4026..3898,3719..3590,3472..3341 ,3271..3102,3041..2947,2893..2788,2739..2626,2401..2343,2198..1936 ,1868..1747
  coding sequence=SeqID_911; coordinates=5173..5066,4970..4788 ,4745..4548,4324..4097,4026..3898,3719..3590,3472..3341,3271..3102 ,3041..2947,2893..2788,2739..2626,2401..2343,2198..1936,1868..1747
  peptide sequence=SeqID_1138
tttttctactcgtcaacggtctgaatttcacacagactttatctcatagatatcgtttcattaattcagcaatctgtacaaagtgttgggcgtttctccttccgcctcacaaagcgacatcaaaaaagcgtattatacactgtccaaaaaggcattcttttgggtttccatttgtttgcatatttctgacattcttttcagtatcatccggatgtcacaggttccaacgaatcgtgcgcaaagaaatatttggaaatcaaagaggcttatgacgtattgcgtgatgaaaaggtggggtgatgggattaggggtggtctccatccaatggaatgtttttctgtggtttttaccgtgctgaaattcagcaacgagaagaacacgaccgatggttagcggccgaagaagttcagcggcaacgtccaattaacggacgacagccgtatgtacgcagacagaaagtgtacgacgatttgtggccaaacaatggaaccttttcggatgaggaaatacgaagggttggtagaattcaaaagaagggggcgggtaaaaggaggttgatggtgtcggtaaggtgcacttcattcacctctgtcattaaatttctaaaaaatttccaacgcttcaaagtgttatggtgaattattattgttttttttaattttaccaactttaaatttttcaagaaattttggtattccttgttttgctacccccccccccctccgcccccttgaaaaattttaaaattcaaaaaatcatagatattttgttaatctatgaccagatatcatcagcagatgtcaaacaaaacaccattttcgtgatcagtgaccttgaaaaccccaaaatatgaattttttaaattttcgagggggggggggggtagcaaaacacggaagtaccgaaattttctcataaaaaaattgtcttaaaatttattaagagaaattggacgacttatcatttcatttgtggggtaaggcttcataccctttgccctattcggctgcatattttccgttaattttaaataataacaattgtcatttatgacagatttggcgcagtatgagtggcaacagcgaatttggacggtcgaattgggaatttgaaacggaggtgaagcgtaaacgacagatggcatatgaggaacagacgaggagaagaaatgagtgggcgaagaacgggttcggccaaaacaatggtcgaaggtgaaaatcgggaaaaatggaggggggggggagtttaccattgaccaattaataccaagaactttagtgattggactgaccaggaccaatacaaaatcattggcaaaattctcctctgttatgtgctcatcactttattcatcgaaattttcaggttacaatgaatttttgtctttatttacatcagatatattttaagcgcttcccttggacttttccgagacccatttctgccgccatataacagagaagaagacatcagaaaaaggattgaagaaagaatgcgaagaatgccgtaggattgacatgataatttaataattactgaatttatgtattgatcgttattttatttataggaaagtagcaaaacgaatttttccataaataataatgtctaaagaattgagactgaagcacagttcataatttattaaacaacaaaaaaacaacgactgacccattatgaactgcttcagcagcatgaatgacttgtggaaaaacaattgtgtatctctatcagaatatccgaattcacatgcgctcgagtgcgcgaattccaaggacattaaagcaccgttgcataatgtcagccgttacctcacaaagcaccaatctgttgaaattgactttggtggtcaccgcctgtccactttctgttttaatgaaaatttgaattattcgactgttttgatttgtcccgtctaattgctctttaattacccccttcggtcggcaatttgcttacgacgtaacattcgccgtaaaagtcgtgaaacaccgtcgccaactcgtaaacgtagtcacatattttgttgagttgcaaactttccagaacggacaaaagaacgtcggagaacttcaggatttgctttgctaatttgacttctcgtggatggtccaaaaacactccgtcgtcagaaggcaatccgttaatgaaggaattaatggcatcccgagtgacttgggcatttcgagcaattgaactaaaaagtcgcaataaaagggaaaggggaatgtgaggaaatagggcggaacaagtcatcgtaccaccgaaaatttacaaaaaaaaattaaatccgaaaaaaccaaatattttaaagacaatcttgcattttttatggactcaccgaatgcgtgcataagcgtatagcaaatacacagcagtgttgcctcggtcgtcaagcatcttaaatttgccaaattaaattgttgaattttgtggttaatgccattagatgatattcccgaaagccttttaaagtgatcataattttaaggaatgttctatcattaaaatccatatattcatttgttttatctcacaccgccaaaatttaataaatccatcgatataatggattggtccaatttgtatccttatgacccccactggtccccctcgaaacggaccctgtcaaatgagaacacatagtcaccggtccgggactgggccatgtccgcgtaacgaatgcatccgtaagcgaccgactcggcaacttctctaaactcttgcggtgtgaactcctgaaaaatattaccaaagaaatccctttgaaaatccctttgccttactccttctttgccttttgtgcgcaatttttcctccgctcggcgtacgccttcgtccagcaattccgtcagtttgacattttcgccggaacgcgttttgaactttttcctgcaacaaattattggcaattgttgctcaatgccactgtcgctttctgtcacctgtcctcgcccagcaccaatccgaattggacatgttccacgcgtttttgtgccgcatcaaaccacttcagctgctttccggtagcgaaaacgttcttcagaacgaataaataccattgtttataattgaaaatgtgcattttaaggattaacacctccaaatgttcggattggccacggtcgacaacgtaaagaatccaatcggcccgttcctcagacagtcgctgcttcagtgtggccaagtcgctggtgtcgtaggtgaaaccgccgtcacttttgaccaccgtcagcggaatgttgcactcgtgagggaagaaaagcttccctagaatgcgataaaagtgaataattagatgagggaaagtagtgagaaatgaaagagaaaaagacgcacttccgtcgtcttcgacgaggagttgagtctgtttcaactcctggatcaacgactgcatgcgcgactggtagaaggactcgccacgctcgacaaggtcagtgatgcccaaacgctcgtaaattgttgcaaagtctttaaaggagaggaaaaaacaaaaattaagcacaaaattattccatggccactgagggaagctttggtaaattaattggccatattagggtaaattttgtttgtccattgactgaccctttcggctaacgtcacagatcattttccacgccttcactgtgtccggctcaaagttttgcagtgcgaccacacattggtaggcttcggatttgaactgcgggtcgttgtcaaatttcactttcgattgctaaaaagtctgtgtatcataaaatttatttgtttttgggtttttttcatggtatttatgtaatgccaatgttcttgtgttgccctgtcctacccaattcgtcactgttaccctttcttatcatatttttaactcaccaactttgtccgtgcccaaaaaagtgatgacttccgtttaccttgtaaaactcttgcaagtcttggataggcggcgtttcattcagataattgggaaagcatttcttcagatgggcaattagcattccgaactgagtgccccagtctccgatgtgattcaaacggaggacctgagaaataacacaaatttaattaattataaatgaaatgattaatttatcgcctatttctctttctcaccgtaaatccaaagcattccaaaagacgtgcaattgcctcgccaataatcgtcgaacgcaaatggcccacatgcatttgcttggcaatgttaggcgacgaatagtcaacaatcacatgtttcttggcaattttaggaagcgaaaaaccctttctagagatttcggcaattcgttttcccaaatgtttacggctgatgtatacattaatataggcattgacgagttggtactgaaaatgggagattatcaaaaggaaaagccaagaaaaaatggaatgaaaaaggtagaagaaatgaaggcttgatttcaagaaaaggtggatttggtcggatcactaagattttcaattacaaagcaaaatgtccgttttcgctgtgttcaatggattttgcaattctctcaaccgccccttccgttcccatttcaaaaacttccattccttttttccccaccttttcgaccaattcgatttgctccagcgcagccacaattttcttggccaccaccgggggcggctccttgacgctttgttcgctgagaaggcgccgtgaaatttgcatgaccatttcgaattggtagtcgccaaacttcgggttgttcgcttctttgactcgtataatcgaaggatccatgccaagagttgggtaagcctcaaaaatgggaatgaatgcgattttattcgacttcctcacattttggacggcctttgcgaaaacatcgctcagtcgttcgatgattgaatcgccaaagtcttcgatttgcaaatgcgcactgccactcggcccatttggaactgtccgattattggcgactttattcccatccgttgccaatttcttttcggtttggtgtccctctgttggcacggcattcgcctaaactttgcagaaaatgggcaatttgaacagaaaggaagtctaatcgcagataataaagaaaaaggttaatcagtccctgcccgggccctcaccctcttcaggatgttcagttggtacttcaatttgtccctctcttgcactttggcagcaatttcaggacactcctccatgagctccttcccaaattgcactttctccatgtcatccaaaatcagctctattcgacttatttgtttctgaattttgaattaatgccccaacggtttctcccaaaaattaacacccattaaatattattgaatgtattaacattttagaggagcgaggacaaaaagaacgtaccttattatcgctagccatgaattggcgttataatcacagtaaaaatgtaggaaacctggatagaaaatgtccggaaaaaagttaataaagtataaaaaataattaggtaagtaaatcgggagaatcttcgaatttcagattaaaaataagatttaacacacatttcctctctttatcaattaggaactttctttaacaacaaataaatgtttttgtcctgctcaaatccggtcaaattgttcgcctccccctgaattcgcatcagaagccctccgaaagaagcgtatgcggtcagtcgactcgtttctgcggtgccctcgtcgttctcaatccggtaaattttgccgtacatcacatattcgaacattcgaacccggggaatgttttctatctgaaaatgacaagcgaaataagcatgtcttccgaaaatactcagccctcataagccgaccacccactgatttgtcgtattcgccctcttcggtgagtccgtcgtcccgaatcgaagtgcaaagcatcaaccggaatttgtcgttgattcccatggcgtagagttgggtgttcacatccaaaatgaggtccattttgaatgattcgctgtcacaaaagagacgactgactctgtcgaactttttcccatcggggtcaatgtttttgacggtgaacaaatcctcgaaatacaggctattcatgtcgaaaacttaaaaataaataaaaataaataatagcaaattaaaaagaattaaaaatgttgaaacaaacactttaaagtagagatcggcctgtacctggatccaggcctgtatttttcctggatccaggtacagatacaggccatttttcggcaacctgtattttcctgtacttttgtacagaaaatacaggtacaggcaatttttggaatacaggtacaggtacaaatccaggaaaaatatatatgtgtacgtgaaagatagacattttaaacgggagtatttttcggacgtcgtcaaatatcctatgagcgcgttgctgagacataaacccgaacggaatcattggtttccaatctgggaaaaatatatatgtgtacgtgaaagatagacatttttaaacgggactatttttcggatgacgtcaaacatcctatgagcgcgttgctgagacataaacccgaacggaatcattggtttccaatctgggaaaaatatatatgtgtacgtgaaagatagacattttaaacgggagtatttttcggacgtcgtcaaacatcctatgagcgcgttgctgagacataaacccgaacggaatcattggtttccaatctgggaaaaatatatatgtgtacgtgaaagatagacatttttaaacgggactatttttcggatgacgtcaaacatcctatgagcgcgttgctcaagactgagaatcccgagcagattactggacatttgcaattagagatcggcctgtacctggatccaggcctgtatttttcctggatccaggtacaggtacaggccatttttcggcaacctgtatttttcctgtacttttgtacagaaaatacaggtacaggccatttttggaatacaggtacaggtacaggtacaggccttaaaaacctgtatttcctgtattaatttttaatcactattttttggcgaaatgtctgaaaaattaggaaaaattcaaaaaaaatatcattttattcagtgaaacactctgggtcaagcccactgtgcagagaaaagcctagtacttgtcaatttggcgcatgctttaataaaaattataatgttcttatgagcacaaaatttttgatcaaaattccgatttgtaaaagctacagtttcaggtagccccgaaaatccttatctcaactctagttaaaatcgcaaaaatgtgtcttttttttgaaaaatctgttaacaaactgctttaaaaattgcaaattttatcccggcgacgcctgccggcaccaccagacccccgtcccctccccaactttcccaaaaattttttttgaaaaagcgcaccgttaaaaaagtaagaaaatcaaaaaagggtcatttaggtatattaaaaaatttttggaaaaaattcttggtagagggtaagataggcacaaaatgtaacctaattaagcttataatcatcttttagtattcgaaaaattaatttttagtattttttatagggtaaattttcaaaaaaatatttgtttttctttctcaagaaaaatttttcaaaaattctcaaaatatttaaaaaatgaaaatgtgtacgaaaaaaaagtttaatacattattattaagcaatatttattgtttaattaataataaatacttttaggtatttttacgttattttattaattaaaaaggttttttataaaaaaaaaataaaaaatacaggtacaggcctggctggatccaggcctcgagtggcctgtatttttcctgtacctgtattttcctgtatttttgtacagaaaatacaggtacaggctttttacaaaataccgatctctaattaacggtatttaacatgaaaagtacagtgggggcacaagaagagggcagcgaaggacggaggaggcggatgaagccgcgaagcgattgagccatcccccccccttccgccgatagcggcacggtgaaaaagcgaacgaacgcccccctcccccgtcaccttaaattgacacccctttttttaatttgagtaagaaatcgctctttgaagtttgcgtggtccgtcattttgtgcccttctttttatatgaatgctcatgtaattatacttcaattaagaataaaactttaatgcattgaaagggatcgattgagtgtcgccctttgagttgagccgccatttgacaaatcgccacagtttaggctgtgaacagcaaatgccgaattgcaaacgcttgtgaaaggccttggcaaaagctgttcatacaattagcgttcttataaagtgccttcatcaaagctgtgcaatgcgcatccttaaacattggtcttccggtcgaattgcttgaaatgtcaaattgctaattgtgacttttggacccgaattgatatgtaagaatgaaataatat

SEQ ID NO: 383 - DNA, 2977 bp, Heterodera glycines
  misc_feature (2928)..(2928): n is a, c, g, or t
  genomic virtual cDNA Sequence=SeqID_633; coordinates=1177..1337 ,1868..1974,2734..2977
  coding sequence=SeqID_1011; coordinates=1177..1337,1868..1974 ,2734..2977
  peptide sequence=SeqID_1262
ccagattcaaacagtagttgtacagtgtaaaaaaacggcctgtccctaaattttttcaccttttttaaaagctattttagcggtttgggcgtgtggcaaaatttttgatgaaataacactaatccgtcaataatttatatcatagacaaaaataaaagtcagattctttttctgcatgtaaaattaccctagaaaaaatgtatttatttattttactatttaaattattaaataaatttacgttaaccacaactcgagttgtggttaagattccttaagaaagattaaaccacggttagatgagcataccggttggaaataaaccacggttaacttgcgttaaccgtggttaagaagggagtaaaccacggttaactcaaccgtggtttatccttaaccacggttaaaaagggaaggacgagcataccggttaaggatttttaaccacggttaacgccgttaaccgtggtttagctctaaaccgcgagacgagcataaggcccctgggtaattcgcctgtccacctttgcatttctttctttctctgcctttgaatttttgtgtcttgcgtttgtgcacttttcttttttcttttctctgccgcacaaaaaaaaagagcaaagaaaaaaaaaatgtttttcctttgaattttcgtgggtccgaaacatgaaatgtttgatcctcccttttgtacattacatgcgcattttattgtattaatttgtttgctattgactcggcggaataaaattttcaaatgactataataataaaaaaaaacaatttttattgtattttgaaaagcaaaaatcccaaaatttaccgccatagttttcagatttttttcccactaaaatggtgtcacacatggatgaggaactttcatttgaagatgaggaacaagaacctactccgaacggtgcgccggccggttcagtgtctgtcacaatgtcggaagacaatgtaaaaacattcaaaacttgggacaattcaaatcgcttaaaatgaccaagggggtaccaagttgagaggccagcatttggtctttaaagtcttggtaacaaaaaacgaattcagaaccaaccgattccatggaaaaattgcaaatttttgccattttcaattgcaaaattgtttttttaggattttgacgacatcaatgagaagctgcaacagatgagcaagaggcgcaaaaaattcgtgaaatgcaaaacgaaatggagaagcaattccagtccggcactgccgtgaccggcaccggcagtccggtgataccgaatccgatgtccctggaggagaagcaattggtggacgcacgttccatttacgttggcaatgtatgtaatgggtttgtgagtggcgccccaaaactgaacaattttcatatctttggtacattaaaatttgtcagcaaaattggggttagtccttttgaagccgcactttcaaaaatgtgccgccattaattccgaaaaatcaaattgcatttgtttttctttcatgagtcaaatttgtctaatgggttatgtttagttagacttttggtaatattttcggatgcaaatgaacaccctctaatataaaaggatcgaaaattggtaggacaatttcaaattgaattttcatcacccggaaatcgcttaggaccgacacctgcaaaatttttcatttttttttttttttgctcatttaagtgcgaggttcttttttttgaacagtttatcctattatacgaataaaagtattcttataccatctatcaatcttgtggttttgatgactaaaaaaatgtgtaaaatcttcgaaaaatattcaaaaaattataggtattgcaaaatagcaattgtcccaacaacaatttatacaggtggactacagcgcaacaccggaccaattggaggaacacttccgcggttgcggtgccatcgaacgcgtgaccattctgacagacaaattcactggccatcccaaggggtaattaattgctgttttcttggtccattcactcttaccaagaaagggagaggagattaaagttacatataaacaaaaatttttccatttttttaccgttggatttcgcatttttgcgcttttaagagtcaacaattttcattattcaaaagctcattgtgagatcgaaaattgatacaaaagagttaaaaatgagacctaagacgttcgacaaaatttatcgagttcaaaaaccgggacgcaaaaaaaattttaaaaaagttttaaatttcgggaagtgggggaaccgcgggggttggtaactgattgtgagtcttgaaacatatatcttaaaaacgaagtacatcccattttctaacacattttgctattttctggcttcattcactcttgccaagaagggtatggaagagccatgagttcgcataaaaaaacaagaattcccccacttttcaaccgtttggtttcgctttttgcgactttgaaagttgaaaaagtttcgaattttcgagacctgattatgaggcagagaattgacaccaataatcttaaacgagacatcgcccgtgaaatttctcgagtcaaaacccgaaacgaattttttttttttttgaaaaatttctgaaatttttttttaaattttcggggaagaaaagcggaagggggcgggcgggactgattataataatgagaggggtacattactaattatagcccttttgctaacacattttcatatgtttgccacatttcctccagtttcgcgtacatccaattcgcggacgtggacgcggtgaacacgtccacctcgttgaacgactcgctgttcctgggccgtcagatcaaggtggtgccgaagcgtaccaatgtgcccgggctgtcctccaccaatcggcccccgcgcggcatgcgcggcggccgtggcagcgggcgcgcgcgtgtgattgtcaagtncatttattcggaaaggcgctcgcgcggacgcccgcccaggtggcagaca

SEQ ID NO: 384 - DNA, 3592 bp, Heterodera glycines
  genomic virtual cDNA Sequence=SeqID_634; coordinates=3475..3200 ,3141..2930,2867..2669,2614..1954,1903..1662,1615..1499,1433..1395
  coding sequence=SeqID_863; coordinates=3475..3200,3141..2930 ,2867..2669,2614..1954,1903..1662,1615..1499,1433..1395
  peptide sequence=SeqID_1096
ttcccttcccctgcacttccaccgcttcttccgtcgccttttcgcgctgccgcctcaccacaaaaggcaaacaaaacacctcgaagggcaccgcttgctgcaattcatgcaaatcggcaaatttgcgcccatgcaattcatttgcggagattgccgaaggagaggcggcgagaagacggagcagcacatcatcgggcggagttgacgaggaagacggggcggagagagaaaaacagagaaaggaggaaaagaaaacggagcagcatcacaacaatgagttaataaacggaagaatagaagaaagagggaaaggaggggaaaagggaagagggggcggaagggaaggcgaagagataatgacaaaataaggacggaagacaaagaaaaggcagagataaaagaacagcagatcaatttcattatttttttgatttctttttctttcccttttcgtctctgatcgatcattcgtttgatttgctttccgtggccacctctgatcgaattattctcctcatttgtcaaatgcttctgatctcataccaaaattcgctcaattcctcccattttgcaaatgctttttttgttatatcggaacaaagccagaacaaataaataccggtttaactaacccccgacactttaataaagaagaagaatctggtaaaaatagattaattacatcttttctagaattttatttattacttttttaattaaaactttttatataaaaaaaataagaaaagaaaagcaaaaagaaaaattcaaaatatttttatatttattgcaattcttatttaagtagtaaaaaaagaacaattatattttgaatttgttaaaacattatttgtggtttaaagtttcattgcacataaatcaaattctttttaaaatttatcgcatcaaaatttgtgagagcgacagacacttcgcttttgaaaaagagaatgattcgtttaattattaattttcatattgtaattacagaattattttcttagaattattatttttttctttaaatccatttttgttttttcattaacatttttcaaaatttattttatgctttaaactgctaaagtttcaaaaagccgaaggcattttcttgcgaataatcaaaaaattaatgtaattaagaaaagaaaaataaaataatatttttttgtaaattggaatgatcagcagaaaaaaaagatttgacagtggtaaaaagagaagggaaaggagggatttgtggtgactaatatctgttcagcaaagcataataataatcagttataaaaatgaaaaactaaggcaacaaatgattaatttaatggtcaaattaagtaatggataattattttctgccggacccccggcatttgggggggggggcggccgatcgatcagcggccgctggaccgttggatgagcgaagcgcgttcctttggggacatggattgatcagaataaaggaccaactgattgagcaccccggccgatcactcacctcgccgtcccggttgtacagcaaagtctgcacgttggagcccgtgccgaatgactcttcgccgtcaaataccaaatgatcgggtggcgcattaattccctctctttgtgcccaaacctttggaatattatttaaactttcatctgttggcattcgcactgactttgacactttttccgggcctcagcacaaactcttgagggaatgagtacacaatttcgcgttttccgtcgatgcgcctcttcaatttccattcgccgattggctcttccttggatcggtgggtgttctccaacaccacgtatttcccctcgggcgatgtctccaaaatggacacattgcctttggccgacctttggtacgattgtcgggaggacttttcgccgcgcaaaatgcgctgagactctgaaagaatagaaggaaagggcaaatgcttttggacatcaactgctgaccagcttcgtcctgacggcggatgttctgcgtcttcaccacctgctccaccagctgataaagccccgatctgtcctcctccccctccagcatttttcggtaaatggcaatttcggcgtccaatgtctgcttggtgtccagcaacatttgcagctccaacatcagtgcctgcgcttcgtcgcgcagcttccgaatctgtgcgtccttgtcgttcagtgccgattcgtacgccctttggtcgtcctccacttggtaggccaattcctcggcctgtctctccagcagagagttgcgtccctccaaatcggccaactttccgcgcatgtcgcccagctgcgtgcgcagccgcttcacttcctccttggcgtagttctgctccaagttctgccgcgcactcattgtctgtatctcctgcactttcattttgtaccacgactcgatgtcgcttctgtttcggttgttcagcacgtcataatcgttgcgaatttcgcgaatcgctgaggcgagttcattgcggaaaaactcgcggttttcgccggtggtgtcgcgcgaggccatcgcctgcaagtcttgaatctcggcgtcgtgcgcacggcggaggaagtcaatctcctccagcagagtctgcacttggttttggtagtcgattcggttcagcgtttccttcaaaatgcctttttgaatgccaaaatcccttcggttgcccccttttctcacctggtccaaatcggtccgggctttttgcatttcgccattcaaatgttggttttcccgtctcaatgctttaaggtcttcgtccaaaatttccagccgtcgcttaagcattgtcaattcggcttccaacgaggaaagactctgcaaaagttcttccatcagttttttgtccccttcgtgcgctgtcactgcgttggcattcctttaacattttttataattagcattaatgcatgtatcatttgctcatctctaatggcccacttcttcttcagtgtgtccatttcctcctccatcgctttcgctttcttttccaattcgtctttttggcgttgtgtctcttccaacagtttttttgcttgtcttaagtccgtctcgtacatttcgcgcacattggacgtgtcttttccccatcgtttgttcaaaaagtccaaatccgttgccaattttcggttttgtgcctccagaaaacgtacctaaaaccaaccgattgatacctaattggcctgttaattatcttaattacccactcaccttctctatgtaagtggccaaccgatcgttcagttcgctcatttccttcttttctcgctctcgcgcatcccgaattgcggtggctgtggtggacgcgggataaggcgacaaggggcgactgctgatggaggacgactcgctgaccatcttcagcacacgagtgccacccccgtcggatgagtagcgagtgggcgacaacggccgagggcgggagaagtacgggcgagaggaaatggcgcttcggtagtcgctgctcgccacgctggggggctccatccttaacgcgaaaggacggctttcaccaacagtagcaagtggaaaaaaagaatgattgtgcaaaatgtgtgacgggatgggggagggggcaacggatgagcgcaatcactcgccccc

SEQ ID NO: 385 - DNA, 8501 bp, Heterodera glycines
  misc_feature (4871)..(4871): n is a, c, g, or t
  genomic virtual cDNA Sequence=SeqID_635; coordinates=14..55,108..230 ,284..337,380..460,515..602,667..1194,1242..1338,1398..1581 ,1750..1863,1919..2056,2114..2182,2232..2285,2339..2417,2487..2569 ,2640..2774,2895..2972,3028..3382
  coding sequence=SeqID_969; coordinates=14..55,108..230,284..337 ,380..460,515..602,667..1194,1242..1338,1398..1581,1750..1863 ,1919..2056,2114..2182,2232..2285,2339..2417,2487..2569,2640..2774 ,2895..2972,3028..3138
  peptide sequence=SeqID_1186
tctttaaattcagcatcctcgtgttcgttacgccgtttgcaatgccattggccaggttttgtttcccacacatacacattggcaaaattcaacttttccctgtgaagatgtgcaccgacttccagcccaccatccaaaagaaatgccatgagcgtattgtgcccgttctcctcgaggccatggccgacatgtccgtcccgcgagtggctgcgcacgcggcggccgcaatggcatgagacgcattcgacggtggttttatacggccaaattttcattggtttaggtgaacttttgcgaagattgtcccaagtcaatcatcagtatttatttgccatcggttattgtgtattttgttcattgttttaacctatttgttaagataatggaacgattggagtcagtgctttcacaaactttccagcaaatgatgaccaatggcaaaaaactcgtcttggaacaggtcagttattgtctttttccctttgttggatcaatattattcaaacaatttcagataatcaccacgatcgcttcggtagctgatgccgcccaggatcacttcgccaaattttacggcaatttgatgccccctctcaaatacagttcattttaaagatgctcattgctaaccgaccctttctccatcattttcctttctccgttaagtttttgaaaacgccaaagatgacaatttgaagttgttgcgtggcaaaaccatcgaatgcatttcgctcattggaatggcagtcggcgcggaactgttcgagacggacgccgacagcgtaatgcaagtgttgctcagctcgggagtcaaattcgagaacaatgacgacccccaaatctcctacttcatcagcgcgtgggcgcgcatttgcaaaatcctcggcaagggtttcgccaagtatttggacatgattatgccggccgtgctgtccgccgccgacttcaagccgtctgttgcgcttgtggatggcaaggacacggatgacaacgaggactgggattacatgccaatcgacgagaaccgctcgctgggcgttcacacggccggactcgaggacaaagtgactgcgtgcgaaatgttgtgctgtttcgcgcgtgagctgaaggacagttttgccgcttacgtggagcgcgttatgcaactgatgctgccactgctctcctttctgttccacgacggagtccgttctggtgagcaaaacgaaacaaatgcataaattactcagcaatttgttaagcggctgccgagtgtcttccgtgtttgttggtctgtgccaaagggtacggggatgagtacgtgcgccaaatgtggtcggtcatcctctccaattacatgtactgtgttacagtgaccaatttggcattaatacagttattaccgacaaaatttgcagaattgcgattggcaaagagactgatcttgaagttctctgcgaaatgctcaatggaattgcgcaatgtgtggaggactttggagggaatgacgccattgtgacggaccaagatgtggcgaacattttctgcgtaatttaccaacaaatcgaaaactttgacaagcgacgggcggagagggaaaaggtgactttttatactgaaacaaatattttttgaaataattacgaaataagtaattaaacattagaagtgctaattgaatagttttttcgaatttattattgcctacatgttatctcgagattaacaataagtcattttgttcgtttgtgaatgaattgttttgtttagaagtctaaagaagaggagcatgacgaggaggaccaagagagattagacgaaatcatcgaactcgaaacttcggttttggcccgtgtgtcggacatcatccattaccttttcttggtacaacgatcattcgtcctttttgttgttgtaaatgtcctctttcttctcacagaccaaacgcgaggctgtcatcccccactttgacaaaatggcacaaatattcgctgcccttctcaacccgcgacgccctttccacgacagacagtggggcctttgcatatttgacgatgtcatcgaatttggaggcgaagttggcaaatggaaaacgaaatccccgccatttaattgggagttttgaccttttcagttgagtatgcgctatcagaatattttcttccaaccgatggtcactgctttggccgacaaatatcccgaggtgaaacgaatgccaataatttatcattttttagtttttgtctttttaggttaggcaggcggccgcttacggctgcggaattatgggactgaaggggggacaggtgagtaccaacgaaaaacggcaaataaacaaacatttgatcacggatttcagaattacgcgaaacattgcgcccaaatgcttcagccattaatcaatgccattgagaagaacgggtcgagaagcaccgaaggtaggcaaaggaaaagaaaaaggaacaattaaacggctagattttaaaagataagaaacatttgttcagaggacacgcgggcgacggaaaatgcgataagtgcggtggcaaaaatactcaaatacaacgcgacagaagtgaatttcaacgaggtgagcaaaaaaagggtggagaactggtggattgatggttcgtatcatcggcataatgccaatggttaaggttgtgccgcgtttcgtcggttggttgcccatttggaatgacgaggaggaggtgccgtacgtgttcgacttcttctgcgatttggtcgagtctcagcacgacgcagtgcgagaggacccgtctcgtgttttccacgtaatttttcattatttgttaattacactcattaaaaagcgtctcgcttttggttttgttggcgtccctttggagtgtcgttcattcaaatggcaaaatgccttccttcccttccttcagattattctaaacgctttttcgcacggtgcttttgaggacgactcggcggaagagatgcgattggtcaaaagtcggatggtccgtttccaattgaaataaaatcgaacaaaacaaatttaaaaaatggatttagaagggaataatggcacacattcgtgccaatgaacagttgttcacgcaaattgtacaatcgctacaattgaacactcaccagcgaactgtgctggagcaaattttagcctgaggggggaaagcggtgacaagcgacggaactgatcagagtgatcaatgaaggaatgataagacggacattaacatcggacgaaacggataccaattaaattcaccctttattatgcagatgttgttttgttatcactatcgttatattaattatcaccatacaaatgcgcttttctgtttacgatcctttgcgctttgttatcgttttgaattgtgttagttgtttaactaagaattgttacaaatgtgccaatttgttatgaaaaataagttttgggggcccgacggtaccgataggcgccgccggaggaaaaatagaaattttgagtttttaacagattttcactgaaattttggggcattttacacacacgaaaatgaatcaaaatgtacttttttcaaattaaaattttttcaaatattcgcttcaaaaaaatgatatgtagggctgcaacttttagtgacgaaaaatctcaaaatagttacctaactaaaatagtgagtaaaaattccaaaatagtgacaaaatagtggcaaaaagtgcgaaatagtgacgaataaaggggggggggggtaatctacctacactgtaagtttcattcggaagtcccaccgtcacttgggtacctctcctttgttaggggtggggtgtattttttaggtcgattcttaggggtgtattttttggttttattgcatttttgttaaggaattttccaaaaaatgtcgaaatagtgaaaaaatagtgacgatacgccaaaatagtgatttctagttaccgatagtgacatcagaatcgaaaatttttaatgcagaaatgcgtttttttgagctcctttcttcaaatcaatcgagcaaaaaatttagttaaaacctaaaaatcgcagccctaatgatgtgatatgaattggagaagtaaattaattcgatcattcacaaaaaaaatggaaaacagaaaaataaagaaaattgtacactgcgaaaacgttcactgacgaaagtgtatttgaaggtttttagcaactatttcccattttagcaactatttttggggtttttaaaacctaaaaactattttgacagttttagcaactataaatataagccccaatgaccattatctaggattttcgcctcaagagactaaaaaattcagtttttttttgataaagaccaaacatggaaaatcataaatttttcaaaaaagacaaattacaattgtcgagagagaagaattaccaaattataatcagactcaatattgaaaattttctgatttcgtaatcggacattgtcaattcgtttatcagttcaatttccccgtgtttcaacttttgcttgttcatggcaatgccttttttctcctcaattttcttcttcagctgctgcacggtgttccagtcatgaacatccaattttaataagaccaattcaccaataaatatttctaaaaaattcaattaatagtaaaatttaaaaatatatgtttacgttgagtaataaagcgattgggtaatatttaatatgctaaaaatcaaaaactgcctaaatatttaaataaaattagtgcaacaaaaattttcacgatttttcaaaagctttttcttccttttttgcctaaaatctgtcactgttcatcacacaatttagctttgtccacccccgaaaaataaaaattcatagcttttttcaataattttatcaagaggcctaaagtgtgtcataatgcgtcanaatctattaataaatgggctaaagattaagcaaagaactgaccgtaagtgattattggcaatgcttggctcaccaacaggtcaagagtttttatctcgtactcagtgttcgtatagttctcgattccataattcgcgagggttacatcgcttctaagccgttttcctttgtacagcagcgtttggtcaattagtggaatgttctccagttcttggactttcctcattatgtatagaatggtgtaccatcgatgcactctcatttgtataactttaccgtttggcatttttatgtttatttcttaaaacaatttttagtaattgtttgatcatgatggaaaacataactattctttacatttaatgtatttattttatttacttttgtttgtgcatgatggcgtctaattttagcagatgtaaaaattcggtttttaagaattgggataaaagtcaactaagaaccaattagtggacacaataaagcataaccatttaccattcattacattcaatgtccttattttatgataataaattcataattgcagtaattagtagtgaatggatttcaaaaaaaatttcaaattgccatctagcatatattagttaaaaatagaataaacatttctgtacttattaaggtaccaattttacgattttatgcacttgaaaacgctttccctgtacggctttatataatatcatggaataacgaaaatcttatccccgccaaccgtcagagacatgcaattgtggcttaatttcaagtgtaatttctggccaatttgccccttcgatgtatttggctaattcttgctttaaactgtatccgtttccattcaaacaaagccttagctgatcgcgcggaatgcccactttggctttgatcatccattcaatgttgagcaaggtgtcggtgcttttaacccgcagtctgatcattttcttatttgttaaatcctttacaagaattggcatttcctcactaaatcaatcaacattttgtttaaacattatcgttttttcttctaacgaccttggcaaggcaggtcgtggtaccaggtaaaaaacgaactcattttcatgtcccccattgtgtaggaaaatttgcaattcggccttgttgagctgaatgcctcggaagaacagccgctgctctccaatcggaatgcctttcagctcccaaattttctccataatgtcttgcacattgtcagatcgtttcattgcaaatttcagcattatattgttcaaactgctgacaaatacagatatttcatgttgagtaaaagaggaagtcgtcgcttcgcttggcatttcattcgcagagaaaggcctaataaaatggaaattaattcgaaacaaggactctgtaaaaggaccagatcagcaaaaggcgtttgtggccaaatataagagcataacaagggcaaaaataagtacatcatggaaaatgtacaaaattcaaaaaaaaaacatttaatgtcttaatgttttatgaaaagagtaagaattacaaacaggctatttgatcaatcaaaaaacaattattaaattaccttttgcgcatcaatgcggcaaaactatgaggaacttcagcaattatgacaggcgttgggtgcactgcaatgctcgtagttacggcgcgcatgtttgcatcagacgagacggacactgggcgtagggcgatcccaagcggggatgtatcgtgaaggttggcctcgcttgtaccgggcatgccaaacgtgggcacatcgcgcatgctggcatctgccgcagcgggcgaaggtaatacgggcattccaaacggggacaccgcgcaggtgttggccatgctaagcgtggacacttcgtgcatgttaggattttctttagctgacgacgggcgtaagaccatcccaatcgtagacgaactctgcacgttgtagtcgcttagccttcgaccgtcctcaagctgaatgaacagcatttgctggtcgggtggaatgccttcggtttggtggataagcatcttcactttgtcaacggtttccgattcggcaacttccaattttatcattttgcgcgggactaagcttttcacaaaaatttgcattagtccatggccagtggaaaagtggcacaaaacaatggacaaaaataccaaatggtaatgcattggtgaattattatctatggaaaatgacaaatgttaaatttattatatttcttataatatattattcgtttaaattttttttatatttgccaatatgggattatttaatattgattgatttttaatattttatatcaataagaaaaatagttgacgtcattaaatggaaattatataaattcttgattaaaataatcaaaaaatgaatttaatccatatattttaattttcgagcataattaaattaaagtagcaaagcgctcgctgaattgcaaaaatgttaattgtattgtaattaaaaattttaaataattttccaagggtataaaaaagaaactgtcaaattttgatgattcgaacactcaaatttgtagatctaacagacaatgggtaagacaaaagcctgttactatcccattttattatttctagggcttccatttttaagcataaaaaatcacgaatagacacctaaaaaaggctgaaaaaataacaaaattggcattaaatagacataaaaacccctcgaataggcataaaaataggcaaaattttagtttttataacacaaaaaattaatcaaaaaacttattttggctatatttcactttttaaatgaattattaaaaattttaaagttttttttcgaataaggataactttttaacaaaaaatattatcaaaaaataaaaaaaattaaatttttggaaaaattttttcaatttttttttttttgcatttttgtaaaggatttttttaggcatgaaaacttttcaaataggcacttaaaataggcacgaaaaatgtgaaaaaggcacaaaaaattacaaaaacgaaaaaggtgcaaaaaattggccctgtcaggaatccgatcaaattagcaaaaatgtattaagaaaaataaactttaagagattgagtttagagaaaatttttcaatttctaggggctatttaaaaaaaaattcaggacgatttaggggcaggcctgtagccagaaaaaaagatttcggatgtgggaaatcgaaggtttaacaatctaaattcggcaggtcctggttgagccgacggaccaggtttaaaaaattggacgcggaccttttacccaaacactctgacccatgtcacctactcaaaattagtaataacctgtgtagttttttacaaatccgacagtaaaagatttatcggattaacgaaaatgagttgaagcagatttatccatgaaaaaagaagtgaaaaggatggccgatcatttcgtcacagatcatttcgtcactaagaaaaatttaaaaaaaaaagtttggcacattgccttaaaacaataaaataaaattctttaatatctaaacaaaagtgctagcaaaaagaaagaaataaatttgataaaagtttcaaattgctttaattgtgagatttgaaagggattttctctgaaacaaagtgattaatttagcttctcatccttaat

SEQ ID NO: 386 - DNA, 6928 bp, Heterodera glycines
  genomic virtual cDNA Sequence=SeqID_636; coordinates=6751..6565 ,5982..5731,5112..4842,4601..4122,3841..3687,3462..3291,2682..2619 ,2525..2414,2282..2180,1836..1733,1702..1502,1146..929,619..518 ,275..179,118..1
  coding sequence=SeqID_979; coordinates=6751..6565,5982..5731 ,5112..4842,4601..4122,3841..3687,3462..3291,2682..2619,2525..2414 ,2282..2180,1836..1733,1702..1502,1146..929,619..518,275..179,118..1
  peptide sequence=SeqID_1195
attaccgccaaaaactcgcgcatccgatcgcccgtatcgccgcgctggtgcagaaagaacagcgcaccgaccaacgtgttcacagccaacggtatggtgtgggaattgttttttgtcacttcaaagtatggcatgtaccacataaaattgtatcaaaatttggcacaaattcactgacccatcagtgaggcacggaaaaatgagtgcggagactgtgccaattttggcaacgcaatggcaatgaacacaatcagcagacaggcaatgttgtagtgctgaaaaatataatgaattggggtagggcctccgaccgcgccccccgaacccgaaaattaaggacattttcaagggcattcctcgaccccgatttttgccaccccgaagggttagggccctaccctagaataaccaaaaaaaaaaagaaaataaaaggtcagatttcatataattttaatccctcctcctaaatgtcatatttttaataataatttccaaactgtttgttcacctcttccacatcgttcagtccgttgttgttcgcctgctgtttgcatgcgttgaccaatgccaagtccacgtccaacttgaacccgctggcagcgcacgcttcgccaatgttctgttcaaaagagtaaacaaatagttaccgtatttttatataaaacagtccacctaaattagagcccccgcccccacacctccttgaggggattgaaaaataaaacccctgaattagagcctccccttctttagggggggggggggtggtgaaataggtgaaatattgaaggctcttttcagaaatatgatatttttatggcatactgacatgaacaaaaaaaaaaactgtggtagtaacaaatttcggaatgcacccattggactgtgtcgtcttcatcccgctccctccctggcccaaaacacgaacaattttctgcagttcatctgccgccgaatcgatcagtgagccgagcgagctgatcaggaacggacaacgctggcgcaacacgtcgttcagtgcgccaaacaacaggtcccgaaaggcgatgatctcgccgatgatgataacccgttggaggagcgattcgatggcggacggtgccgccgttgcggtcgacgcacatgttgaagctgtacagacggaggaggagccgggcaacgaagtggacgaatttgcaactgacgaagaggtgaaggaggacgcataatgttggtggtgatgatggtggttcgtccgtcgattgttttccttgcaattcaaatcggaagaagacgaagcagtacaacaaccactgagttgggcaacaatctgtgaaatgtttttgtttaaaaacaaaaatttattgcacaaaaaagtttaaatttaattttaaaacttttttaaatttttgggtgttgtataactgcggcgatcagtcaaatcgctgaaaaactgatgagagcaaaaggagagagagagaaagtgagagaaagagaaagccaaaaaaagagcattgagaacgcacttctcgcagttttgccggcttgtcaaagttgacgcgtgccgcgtgcagtgtctccctgttctccctgaccagcttgaacagctccgtgatttggcttgcaatttgccacaccagccgctcctccatcgccttgatgccgtaagggccgatcagttgggcaagcgcgcgcaattcccgcgggtccgtgtaactttcggcgaacaatgcaccggcgccggtggcggcactcgtctgctgttgctgcggctgttcactggtcacaaatgcttgcaaatggtccgagtacagcaactgtccggtgctcgccttgcgcaacagcacctccaaatacctataaaatggcacgtgatttttttggcataatgtggaagagtgcagcgtcgcatggcattgtaatgctgcaatggcagaggaaatccaacaagtaccgcttctcgagaccacattatgacgagacacaaagaaaaaattcaatgaaagaaactgaaaaaccacccttgtgggttgtgattgtaagtagagtccgggactgggagttttttactgagggttgattttaaaaagtcgaaaaatttggcccccaaattctcatggcttacgacgagacgaaaatacgtcagttctcgatactaattgaatcaaaatccatttatagggaggacctctcgtctcaccattttgagtacacttcggccaatgtctcctgcccatgggcgtcctcccgctgcgattgttggagcatcgcgtcgcggaacagacacacaatgtcataggccactacaaaatgtgtaggggtgccaattttttccaccatgagtcaaaatgcggcacggaccccacaaaaacccggcaaacgcctttgttttccggcaaattatttgaaaaagtgtgaaataaaaataacccacaaaatgtgtccaagtcctgcagcgcgtgcatttgggcacagagaaatgccagcatttcggacgggcgccgaggatgcggtgacataggacaattggcggtggttgtgttgctgtcattctgtgccatcgccggcccggcgccgcctcctacgttcggtgccgtcccggacgttgtcgtcgctgttgcgaaacgtaaatgccggaccagcgacgtcttcagatgccgttccaagttttggtagaggaattcacggggcacaaaaatgtgcctgaaaatttttgggggaattaagcgatttgctttgttttttttctaacaaaaaactctttttcaaaattttcaattaaaaatgattgatttggcgaaatgtttatatgagtacgctgtagagtaaaacaaaaaatgcacttggaaatgtgaatttctttggcactgccaatggcatggcacagctcggccaagtaaagcgcggtggagtcgccggcggagacgggttggcccgcttcgcgaatgctctcgtggccgggcattcgttcgtccgccattttttgttgctgcgcaagctcacacttatctgtttatgaatagggcatatagtaaattaaataaggagtagttcaaagacaaatgccgacggaggaaaaaaagattttggctcaaatgacatacttttggggtgggccaaattttttaaaaatgtataatttttggctcaaaatgacaaaactttttgacattggggtcatatttttaaaaaaatcaagggaattcaagcttgtgccgtcataaaatgcttttgttttccaagaaatcactcattttcatttttaaaaaaaccatttttctgtctccccccccccgtcgttgaagaccaacccaccgtcattttcagctgctgccaacagtttgtaagtggcggccaaaatgcgtgcgcatgtgtgcggcgattggttcaactccatttggtgtttgtccgtgcacagtttgccaaacacttcgatgaccttcttggacagctcgtccaacgcgctgttgcacgtttttagtcctgaaaaacacaaaaaatgatgaaatatataaaagaaattttacgtaaaaaatttaattaattcttagaatttttgcaaaaaagaaacaaattctgaggtaaaagtcgctacatactttgagggtttttaattatttcaaatgatcgcggttaatcacgcgtaattttttcaaatttataaaattttcaaaaaaacagaaaattttttataaatttttgagcacctttctcaatgacaaggtcccgctcttccgggcacatttcgtgcaacgcattctcaaagtttgtggcaatgtgcgcaaaagcaatggagaagcgggactggacgggaaagtcgagcgcatggcgaagatgggcatcgaacaaatgggcatggaaactgaaagaaaatgttcactaatttttttaaataattttttagtttaagtactaaacgattttcagtgtttaattaagcattttactatatttcctatttttattttggaaatttgagtgctttttggattttttaaaagaaattttgcgaaattttttgagagattttgataggaaagccttggaggggatacgaacaaggaaagaaaatttagtcagggattcatgaaaaattgtgtaaattttaaattgccgccgggaaaatgcgttgaaaaacgtgccaataaatactgaggtcgctggtctcgcccagcaacgcgtgcaagtcgtcaatttgcttcaggtggaaaatggcggtgttcagcgccaccgccaaattggcatgggtgtgcagtttgaaggcggaccggctcacgctgctgttggcctggaagcggaaccagtcgagacggacagcacgcgagtccaccacaatgccatcgactggacaaaatttccatggactattgttctcggaattataatgtccaatccatgccatgcctttgacgctttccaacgcgtcggcacatgcacggaggagcagcgcctcgtagtcggacagttcagcaccatcggcactgagctggtggagctgttcagccaacaatggtgcgtcgtagccagcaacgtattcggcatggtaatgggcaatgatgtcggcatgtttcagcaccaagttgcgcagttcgcacatgtagaagagcagttcgggcagaaatctgtagatggaaaatatacacttttaatcagataccaaggccgaaaagctaaaattagaaaaaaattgaagtgaaaaggaaactattttattcatgattggtttttttaaatttttaaagggaaagtcaataaaatttaataaaattttaaagaagtttagcgatcaattggaaaattttcgaaaaaactttgtaattcatcagaaattgtgaaaaaatcgctagaaaatttatcctcacttgtccaccacaatggtggccaacccgctcctggccatcgcctttttgctggagaatgcggcttgcatcagctgaggccacagttcgctgtgccgcaacagccacagcacctcgtcccgggcgtaggccaagcccatccaaacgaatagacacttgggcccaagcagcccgggctggtcgccaatcagcaggcacagctcgcgcagtgccatccgcaaaaagtgccgtcgatgggcatgcaggtggccagccgcgtgcagcgtgtgcacacctggagggggggggggggagtaaggatggcatgttttttggtgtacttcatttatctcacaaaacaattaccaaaatctaagatttgaaaaatatgggttttctaagaattttttgatcgctaaaataagcataaataaaaaaaatttaaaaacaaatgaaatctttaaaaactgcgaatttaccactatttcgggttttacaaagtcttcttctaaaaaatgcatttaaaaaaaaagaaatatctcttgaaaaaaaaatttataggccctttttcttgggaagtcttctggttttcttaggaaatgggaagaaatcagggacagcaggcaaaatgtgtattattttacaattttctcggcattttcccacaaaaacggtactgagtccacagaaaaaccatgccggaaccgcgtttcaattaggtctttaaaaatctaattcgatcaagcaccatcgtaaaaaaattcgaaaatttatcaaaaaaaaaattctcaaaaaactaataatacataataaaattttttgaattaaaaaaaaaattttttggcattaagaacaacattgtgtcctgcgcgcaataattcacaataattcaaacaatgaaacactgactgaccatctttcagctcgcccaccaactgcttgaccatgccgtactgttgttggtgctgctgttgcgattggtggttgtgttgctgctgctgcttgatgtgctccaacacggtgtgcaccaacggttggacaacaatgcactcgtcacggaacaaatgaaccaccaaacagtgctgaactgcccgttggtacagcgggccaaggttggccgaatgtgccgggtccaccagcaaccgatggcacaccgtcagaccgactataaataaatcgtggaatatgtggtgggtgatatgctgacaaatgccacggcatttcatccaaatttatattaaaaatagacatttggttggataaaaaacatttaaataaatatgcaaatttgttggaatagtgctaaagcagttcaaaacaaaaccttgaaacttggcttttatcaattggttatgaaaaaagattgatgtttttacatggttcactctttttcgtcaattgagtcataaaaattccggcatttaagttgaataatgtggccattttcaaaattttccaaattttttgttctttcacaactcaaaaatagcttttttgacttctccatacatttatttaaaagctcattctaaaaaagcattcatgaacaactacattcaagcagaatattgggtttaccgccaacaaatttttctgaaaattatagaaaaagtcaagttcccaatgaaaaatcgtagaccaaatcaatggttttgaaaaaagctgagctcggattcgttaaaattgttgctttttttgcactctgtccccacaaaaatgtgtttgtatataaatagtaaccaccaacaaatgatccactggtccatggtgtccagtgaaaggtattcgcatgcgattgtgccggtctgtgccgcgtaaagcatttgcttgggatgggccaccagcgagagcagtgccgcgtcgcgctgctgttccgccgaaatgttccgcttgaaataaatttcgcgcagcgaatccaacgcggcagcgaccaactgaaaacaaaaatggatgagagggaaattcaaatccatcaatttatatgaagtttgtaaaaaattatttaactctacagcagggatggcacggaattccgatttccaacgacatttgttgtgttggaaccccatttcagaaaatttttgggatcggaattccgctttccaacattt

SEQ ID NO: 387 - DNA, 3674 bp, Heterodera glycines
  genomic virtual cDNA Sequence=SeqID_638; coordinates=1..100,159..232 ,287..466,689..1048,1196..1326,1404..1722,1822..1977,2036..2383 ,2562..2840
  coding sequence=SeqID_960; coordinates=1..100,159..232,287..466 ,689..1048,1196..1326,1404..1722,1822..1977,2036..2383,2562..2840
  peptide sequence=SeqID_1178
ccagctaaagctaatgcaattggtattgacctcggcacgacgtattcgtgtgttggagtcttccagcacggaaaggtggagatcatcgcgaacgaccaaggtgcagtaaagaccggacgtgctttccctcaaaatattgttaccatcccgaatttcaggcaaccgcaccacgccgtcctatgtcgcgttcaccgacaccgaacgtttgatcggcgatgcggccaagaaccaggcaacttttcacaaaatcaactgtttaagcagtttaaactgatttgtttgacaggtggcgatgaacccatccaacaccgtgttcgacgccaaacgtctcatcggacgcaagttcgacgacccggcggtgcagtcggacatgaagcactggccgttcaaagtggtgcagggagagggtgctcgtccgaaagtgatggtggaagtcaaaggcgaggacaaagcgttcttccctgaggtttgtgctgtttgctaaactgctccatccccccgccccagttgaaaattttgaatggaggcaatttcgtatgcttgattctttttcggaaaatctacaatctgaggaattaaagctttcagaaaaatgaaatttgggagggaagaggactctaaaagcaaccaaaattggcgtttgttgagtgtttgcttgttgtacttaaatgtgtttttttttttgcaggaggtttcgtccatggtgcttatcaagatgaaggagacggccgaggccttccttggccagactgtcacggatgcggtggtcacagtgcccgcttacttcaacgactcgcagcgtcaggccaccaaggacgcggggaccatcgccgggctgaacgtgttgcgcatcatcaacgagccgacagccgccgcgattgcctacggcttggacaagaaggggcagggtgagcgccatgtgctcattttcgacttgggcggtggcactttcgacgtgtccatccttaccatcgaggacggcatcttcgaggtgaaatcgaccgccggtgacactcatctcggtggcgaggacttcgacaatcgaatggtttgattttcgaatttgccagcaattcaaaatggttcgaactaaggtttaagaaaaatgaaaaagatagtttggtcgaaccaacacttaaaatgaatgaaaagcattttcttttgcttgtttgaatttaaactgcttttccttcaggtcaaccactttgtcgcggagttcaagcgcaagcacaagaaggacctcagttcgaaccctcgtgcgttgcgtcgtttgcgtacggcctgcgagcgcgccaagcgcactctgtccggttccacccaggccaggtttgtttctttccctttttggcgggtcatttcacaaactcatttgccccatgtaaaactaattccttcaatttcagcatcgaaattgactctctcttcgacggcatcgacttctacaccaacatcacgcgcgcccgcttcgaggagctttgcgccgaccttttccgcaacaccatggaccctgtggagaaggctttgcgcgacgcgaagatggacaagtcccagatccacgacattgtgttggtcggcggctcgactcgaattccgaaggtgcagaagcttctctccgactttttctccggcaaggagctgaacaaaagcatcaacccggacgaggcggtggcctacggagcggctgtccaggcggccattctttccggcgacaagtcggaaactgttcaggtgaacgattaagcctacctatcttaaatttcgaattaaattttgtttttcttgtttgttttttttgactgttgtgtattcctttctttttaggacttgctgctgcttgacgttgcccctctctccctgggcattgaaacggccggcggcgtgatgacttcactcatcaagcgcaacacgaccattccgacaaagacgtcgcagacattcaccacctattcggacaatcagcctggtgtgctgattcaggtaaagcaacggcatttccccttttgattgtttctgtgtgaaaactgttcaatttgaggtctacgaaggcgagcgcgcgatgaccaaggacaacaacctgctgggcaagttcgagctcagcggcattccgccggcgccacgaggagtgcctcaaatcgaagtcactttcgacatcgacgccaacggcattttgaacgtgtcggcccaggacaagtctaccgggaaacagaacaagatcaccatcaccaacgacaaaggccgcctttccaaggaggaaattgagcgcatggtgcaggaggcggagaagttttccaaggaggacgaggtgcagcgtgaccgtgtgtctgccaagaacgccttggagtcctactgcttcaacatcaagcagacaatggaggactcaaatgtacgttttttgtggagtcctttactttttttttattccacctcccgtcgcaaatgattaaaattttggtagcgggcgttaacaattttctgagccctttacaaaactactgtcagaatgggttgagtgagacccaggggactgcggtgttttttcctcctttctatcttttgattttaagctgaaggacaagatcagcgaggacgacaagaagaaggtgctggagaagtgcggtgaggtgctggcatggctcgacgccaaccaggcggcagagaaggaggaatttgagcaccagcagaaggaactcgaagggatctgtaatcccatcatcaccaagctctaccaagccggcggcgcaatgcccggcggtccaatgcctggcggagggatgcccggaggtggcggcgctgctggtgcgggaggagccggtggaccgaccatcgaggaagtggactaagcgagtcgatctcttcgcgatcatttttttgtttgatcgattatttaattttatttttttctcgcgtaaattgtttgacatataaattcattggttgcttacttacgaatctcaccgaacatgcccttctgctttaaaccgtatgttaaatgtaaaaagccaaagacaaattggttcgggaaatcattgataccttgtgtggttagtgatttataatcggaaattcaatattttaaaattcactttatgatcgtatctatatagaatgatattttttgatgtacaattgtttttgactatttttaggttattgcgatcaaattagaaacaaaattgggtaatggtgaagctggtgcccccccccctttttggaataaaaaattttttcttttaaaaagtcgtgaaaactcgttttacggggtttttagggttgctgatcacgaatatgacattcttttcgaccgattccgaatcccagacccgagttcggacaaaaagtcgaaaattaaaaatttttcaattttcagatttttgttcaaactttgtttaaatacacgaaaatgaactgaatatcatcagtgcttcagtaaaaggtcatttaaaccattcttagactaaaatagaaaatcgaaaaattttgaattttcgactttttgttcgaactcgggtctaggattcggaatcggttgaaaagaatgtcatattcgtgatcagcaaccctaaaaaccccgtaaaacgagttttcacgactttttataagaaaacattgttcagtccaaaaaggggggggggcacacgctcaaccattaccaaatattgtatctacattgatcg

SEQ ID NO: 388 - DNA, 3868 bp, Heterodera glycines
  genomic virtual cDNA Sequence=SeqID_639; coordinates=1511..1729 ,2065..2294,2416..2539,2772..2924,3207..3692
  coding sequence=SeqID_983; coordinates=1511..1729,2065..2294 ,2416..2539,2772..2924,3207..3358
  peptide sequence=SeqID_1199
aaaaaatcaaacttagaaaattttccaaggaaaaatttctaggaaaattttttttaataggaaattttaagaaaaaattgttgaaaattttttcagtattttttttgaaattttatgaaaattttctgttttttccgaaatttttcaaaaaaaactagcaaatactttttttctttaaaattatacccttaaatgttccgtctgcagaccagtgcctgtggcgtcttaatcgcctgaggccgttatccgtcagaaatattaaaaaaacaggcaattctggttcttgctgtcttgaatcataaagcagaaatctctgcccatcatttccaacaataaattcgccctttaacaagaaattaaaatatccttttgattctcttttccgctcttatttctacccatggagagacgcatattttacggtcaatcctcacgctttttcgtcatctcctacgaaacagtggccgccattattctgtggttcatgcagaaagaactgcattaagggctgcactaaactcagggaaaagcggaatagctcataccctcaagaagggcacttcgaaattaacaacaaattttgccggtggcgttgttgggggagcggcggctgagaccgcagccaatttaattaggacaaaatgtaaaccccctatttttcaaaaccaactcgtaacttaagcacgatcaccatatttcttcccagtcactgttcggggaccaaaaaagacggaatttttcttggatgaagagtattttaccaacgacgaagacttgcacaatttttttgatgagatggaaaaagctgcaggggtaataactccagcctgctgttaccttggtcacaattaatttttaaattgttaaaaagagtatttccacagatgaagatggtgttctgcgcatgttgatcagaacttcaaacatggaagttgtcagaagcagagccaccacaattaacagacaaacttattttaactgtgacgctatgtgtttgttgccttaggtgtccatatgaccgtagtttaagcattttttaaaatgacgctcgttgggccttgagcaagccattggaaataaaaaatttatttttgtgtattaattgatgtattgaaaaagttaaatattatgatgaagagaataaaatattttattcttaaattgataaaatctaatagtaatatttattcaaaattacataaaataaatttaaatgaaatgtagggcaaagccgcaaatgtcgggccgcaaatgtccgattttggcttggaccgcaaaattcagcaaaaaattgggccgcaaatgtccgaaaatggcccttaagaaatgggccgcaaatgtccgaaccgcaaatgtccgggccgcaaatgtcgggccgcaaatgtccgatttggctggggccgcaaatgtccgagccgcaaatgtcgggccgcaaatgtccgattttggcttgggaaaacgaactgcgctcccttatgaaaattttaataataatcccctctcccccaagggtatatggtcgatgaatcgggcgcctcgctgacactgcgcgtgttggagcacaaacagtttgtgcgcttcgtcaacatttgggcgcgcggcttttggaccattggccgggcggaggacggacgtctgtttgtgtgcggcctcaacaattttggacagcttggcgtgccgccccaatcgccggcgcaccgcaagtccgccgctgggaccagcgacgaaggtggggaagagggaggaggcgggtgcataaatttccacccccctcccccctccctccgattttttaaatttcgaaaaattcaaaaatttgcaaaatacgaattgcctttcttcaacattgtgcaagtttcactttgtacgagttgccattgcttatagggtttataatgagttaatggtttttcgaaaactttccaaaaaacgctcaaaaaaattttgcatttttttacaaaaaaaaatttttaaattttctggggaggggggagttgctcccgggggaggcaggtctccaaaaaatttaaacaaaattaaaacatttccacaacgtatattcagatgacggtggaatcggtccgcccaagccaaagtcgccggccaccatcgccgctggccaagaggagtccaacaaggtggcactgctcacttgcgccaccgcgtttccggccgaaaaacggtggacccatgtggcgggcgtgcagcatgtgatctgtcggagtggggacgacagccaaatttatgggattggcaagaacacggacaacgcgttgggcctcgacacgtggcaggttgtgtatttttgaaatttttctaaaaaaaattcacgaaaatttttgatgcttttattaattatttccgaaagttttccaagaaaacgtttaaaaaaattgaagataaatgttatttcagggcaaccatgacgaggagcactggcgctatgacacactgcagcacatcccattgccggacggagtgaacaccgtggccggcgtggacgcaacgctgggcgccaccatattttggacggatgatggtcagtcagaaaaaaaatttctagcaataagattctcgatagaaaatttttttgtgaaaaagcaaattttttttttttttttttgtaaattttggtggagagattttggggtgctcccataataaaacacttttcaattacaaaatttatctacattttggactcacaattcatagctgatttccacatcaacatttttttttttgatttttcgataaaaatttgttttcaggtcgagtgttcggtttcggctgcgacacggttggccaactcgggctgggcatcaaggaagaggatgagaaggtggtgtcgaagccgcgtcagatcacttcggcacatttggacggatatcgagtgttgggcgtgtccattgccgacaatcatggtaggcatggaaaattagggtgcaccacgtttcacccctccaactttttggaaaaatttttgaaaaattcttattgtgttaatttgcaaaaatttttcgagcctttgcaccaaatgagaaaatggttgaaattttctgaaaaattgtatcaattttacagtagtaagacaaattttatatgaatttcatttcatttctaaatcaggggcctgctggatccaaaaaattggctaaaattttttgaaaaatttgattttttttttctttgaatttgtttttaagcgctttttctcgccgcgtcgattgaccaacaaccgccgctgtcatcagcttcaccaccaccaccaccacaacagcagaaggcccagcagcagaaacaactgcagaccaacggcaacggaatattggaaacaccgattgatggcaaagcttgattgattgatggatggatggatgatttttattttttgttttgatttggatcatcacaaatcattttttgtgtctgctgcccttctctaatttgtttgtcgtctcattttgtttattgttgctctctctctctctctctctcttcccccctctctctctcccctctccacactatgcgcactgcattgattggctttgtttgtctcgatttgtttggcttttcttctctctctctctctctcccgcttctcctcctgttgcttgcttttatcttcccttccttcatccctccctcactggtcaaaggcaaagcgtacaataaattaaatccaattagaggcattgaattggttaaatgccttttaacggaatcgcaaagtacatatgtaatagaattcagagaatgatggcattttgcaatttttgacagcgttcaatgacggtttttgttttgtttgttgtgccctcctaacagtttggttgttttttgaatctgaagcagtacattttgt

SEQ ID NO: 389 - DNA, 7549 bp, Heterodera glycines
  misc_feature (15)..(15): n is a, c, g, or t
  misc_feature (7497)..(7497): n is a, c, g, or t
  genomic virtual cDNA Sequence=SeqID_641; coordinates=1572..1670 ,1714..1837,1882..1991,2034..2265,2312..2367,2408..2509,2551..2643 ,2819..2939,3521..3679,3735..3905,3944..4058,4221..4398,4519..4671 ,4763..4928,4976..5075,5121..5244
  coding sequence=SeqID_980; coordinates=1572..1670,1714..1837 ,1882..1991,2034..2265,2312..2367,2408..2509,2551..2643,2819..2939 ,3521..3679,3735..3905,3944..4058,4221..4398,4519..4671,4763..4928 ,4976..5075,5121..5244
  peptide sequence=SeqID_1196
ccatagtagctaccnttcttctttaaaaaaattgaaaataacatacaacaaaatgaggactcgaacctgagaccccccttttggtgactaactcacagaccactaagacgaaaaaaccaacttatttgcgcttggagcccaaaattgaatcgccgtgttaacccatccttccttaccctttttccaattttcaattcagcccccaaagttagataacaaaattattattgattattttttgaatttttaaaacttttgtccgacggcattctaatgtagtttggaatttgctagttttgcaaagctttttaaaattttgagacaaaaaagtaaaaaaaaagctgaaaaattacaattgcaattgtatttacttgaaatggttaacgtttcacacagttttgattttcagatttcgtgtattattatcttaacaaattaagggtgaacatctaaatggttagaccaaacttctatttttatgttaacccaaaaattaaggcgaaaaaatccacgaagaagaaggtcgctgctcttcccgccgcgatcaaaaagacggaaactaaaaagccggcaaagagtactctttttgaacgacggcctcgcaatttttcaattggtatgagcatgataatattaaatatggtttttatctgtatatttaggccaggacattcaaccgaaacgggacttaactcgctttgttcgttggccaaaatacattttgctccagcgacagcgtgccgttcttgaaaagcgtctgaaaattcctccaccaatcaaccagttcaaatttgctcttgacaaaccaaatagttagtttttgttttaccaatgtactacgattttctaaattcccattaagccaaccagctcttcaaattgcttaacaaataccgtcctgaaactcgccaggcgaagaaagaacgtcttcgtcaacgagctcaggatcgagcagatggaaagcaagagaaactgacgaaacgtcctcctgttgtccacttcggcattaaggatgttgtcaaagccgtggagaacaaaaaggccagcttagttgtcattgcacacgacgttgacccaatagaaattgtgatttgcctgccggcaatttgccgcaaatttggagtgccgtatgccattgtgaagggaaaagcatttctcggtcaagttgtctaccgcaagactacttctgccgtgtgtctttgcgacgttaatccgtgcgtttaacattgttagttattatcgactatacaattttagggaggacagaaacgcgcttaaaaatttggctgatgttgcggtcaccaatttcaatgaacgcggtgatgaacttcggaagaattggggaggtgcgatcatgtcccagcgttcgcaagcacgacaggctaagattgaaaaggctcgccagaaggatgttgggcagaaagtttgatggtagttatcaaaaattgttgtttctctgttgatgataaaatttgttgacttttggtttcaaatttacaatatttgttcataccatcgttatctcttagttcttgaaaatctttttgttatttgtatttgctgtagagatgttttcttgtacgttaaatggggtgccggaatcacacgatcttttggagaagtgtcggctgccatttggtcttcacttacagccattccgtgatttgagggtactctgtgtgcatctttcttcttttgtagttctggattaagggattgaaagtcttgcagacagtcatcacgcggtgcagatattgcaggacatatatcaacccttttgtgtttttaatggacgcccgtcattggaaatgcaatttgtgctatcgcgcaaatgaaagtattactttccttgttgcgataattttttaagccttataacagtgcctgaggatttcgcatgggaccctcaaacgaaaacttttggcgacccatctagaagacccgaactccaagaaaccactattgaatacattgcaccatctgaatacatggttagcccgtgcgaaaattttttttagaaacaacaagttaagcttcgtcctcctcaacctccgatttatttgtttgtttttgacgtcggttccgcagcaatcgattgcggttacctcaacacttttgcagaacaactttcgctggacattgacaaattgcctggccaggaaagggctttcattggctttatcggtttcgattccgctttacattttttccaattcgatgaaaacgagagagagccgaggcatattattgaatttgatgttgaaggtttaactcaaaatattaatgtataataaatacttggcttttccagaaagttttgcgcctgtgttctctggactttttgttgaacttaatgttttcaaagaggttatttttaagaaaacaaaccagtttcgcatttttttagatcatcaaaaaatttatatacaacataccatcaatttttgaacgttctatgtcatcctcaaattgtctcggttctgcacttacagttgcaaaaaatttaattgtaagttttttttatctgtctttaattttattgtttaaaagaacgaaatcggtggacggataactgtttttaccgcatctatgccaaatctcggaattggtgctctgaaatgtttggaattcaacactgcaaaagtatgcgtgagtaaattggtactttaggattttcataccccacccacatttttcatgctaaaactaaacactgacccttatttaaacgtaataccaaaccagattttctttgatttgaagttacgaaacagaaactacttctattagcatgtactaattgatttctcttttacagaagatcgcatttacacctcaaattgacttttacaaaagtttggctctcgaatgtactggaaaacaaattgccattgaccttttcgttgtcggatgtcaaaacgtagatcttcgaacattatgtgatttgttattcttttgttattcgcttctgttaaccatttatggacaagggtggagggattagagggctctgttgcagttcacacgaccataaaaatttttgcaactttagtgcaccataactgttttaagaagcatccaaattaaacatttagtatcattcggtagccctaagaaaatcctctattagcctgcaaaatttcaaatcgttgggtttcaagaaatttatggctaactaaaaatatttagaaaaccaactttgaaattttgcaggctaatagaggattcttagtgctatcgagtgatactaagaatgtttaatttggatgtttcttgaaaaagttatggaaatttatggtcgtgtgaatttcaataaagccgattagagttaggttttttgaaatttcttcaattctatatgaaattatcctacattttccttttggcaaaaaatttccatccttacactgcctttcatctttctctaatttttcgcggaatttcaatcctcataaaaaatcggaatttgcctcaacccttggctatggttcaacaattcgctgattttttgctttttaagctgatatgtctcggttcagcagtggcaccgtgtaccatttccctgaatatcatttccttcgggaccaagtcgaagtcaaacggttccaaatgattttacgacgttactttattcgaaagcttggtcttgaggccgtgttgaggatacgttgctcgaggggtactcaagcaattgattattattgttttcttatttttattgtttaaattcacaggactttctcttcacactttttatggaaatttcttcgtccgttccactgatttgctcgccttgcccaatgtgagtcccgattcggccatgggcgttcaaattaaacacgacgaagtgatcacagccagtcaagtgtgtttccaagcagctttgctgtacacctcgacgaaaggtttcccttatccattgtttgaaatgtcgaaaagtcaggtgaccgtcgtattcgcgtccacacactttgtctccccgtgctcacacaagctgcacatgtattttcttcgctggacattaactcgtcaatatcgctactttcaaagatgggttagttctgttcaggcccgtaaaggagcgaggggcgggaaaccccgccccccccccccccccccccccaccaaataaatgatagagggaattttataagggcgtggccagggaacgagcaaaattggcaattttcaaaatactttcatattgatattttagcttctgatagagctttgcaaggcgctagtttatcagactgtcgtgaggcactaataaatgccgttgtcgatccgaccgtctgttatcagcgatcacatggtcaagttggttccatgttgcgcatgcctcctgaaggtggtcttcaatacatgcccatttacatacttggattgttaaaaaatgtaagtaaaacttataataattcttttattggtttaatttatgtccaaaagaaatccttaaccatactcccgttaattattgttgcttgttatttttatatagtaatgatcgaatttcagagggcgttttcggattctctgcaaagggtcaccatcgatgaacgtgtggcaacttttctgcttttcaaaaatgctccgttggaagttctcttacttgagttgtgcccagctctttacgcttttcaccaaattctttactgcgaaccgaatcaggttgccggacaagcattttacccaatatagcaactgctaatcaattattgttaacgactgaaaatgattttctcaggatggacaggtcccttttcccgaccgtcttcctcctacttatgagcatatctcccaaaatggcatttatttgctcgacattggcacatttgtctatgtgtacgttggctctgccttaaatgtctgtattttgcgttctctttttggcaccgattcgttcgctaaattggattcggatgtaagtgaatgttcgactcttttgctatgactgtttcttttgagtcaacagtaattgaaattgacacttcgcaaagcaaacatttgcatgcctttcttcgccatttacaagaacagagagggaatatgtatgctccagctaaaattataaagtaagcgccttccgaaggaatagacgcgattcgaatttaatttagggatgacagtccaaggcgggaggcatttacgcgacggctcatccaggatcggtcggattcttcacattcttacaacgaatttatgcaattcctccaacgagaagtcagcaaagccagtaaatgaagaggatgaatgaaatttcttgtgatatcttcattttattcgtcaggaaattagtctctgttaataccgttgttcactaattggtaaatacatgtaaatgaatagccatttattatcctgccagaaacaagtccctgagagacccgcttatgtttcggaccgctaatggcccaattttcggttctagtcggttttacgcgtcccatgacgtgtccatggtatttaaccgttacaaaatttcgtaaaaccgaccagaacacacctttctactgatatcattgggcgtaagaaactgacaatgagagttgccagctttgctgcgcaaattgcattagagtcccaatattttacaatataaaaattaaaacaaacataagacaaaacttaaatgacatacaatgtattaataaataagtgaggtgtgacaataattcatttcttaatataaattctcaagggctgtttgatagttcctcgtcgagtcgccaatatttaacaatttttgccgttgtctctcctttttgctaccgaaatttgcctctggctttgatttccataaaatacgaatgagtagcgcggccaaagacaaaacacaaagaaaatagaaaacggagggacccgcggagaaaagcgggcgaattcggctgaaaatcgatgggtaaaagaattcgtacctataatctgaggacaccttttttgctttggctgaataatccctttgctttcagcaaacaatgggaaatatcgcatctggtaaataatcgcaccaagcgccttaattcaaattggaatagataaaccgcaaccatttaaatgatcagcacccattggacttcttggccatttattcgaaatgcactttgaaagtgatgttggatttcgtcgacgtggaaaccgttgtgcaacacggcgtggatccacgccgacttaaagcattgcgtctccaatctctccgagtccgccttttggtagaagtgcgctttgactttcctctcaaaatggcaaattttaatttgggaacaactcactgaatttggttaaagtgactcacttttatcactgcccacggctgcccgcaaaattccttagccttttgttcgaatttgtcgtgttcgtatttgccgcccagtgaaagaacgtcgtcgacgctgaaccaatactcgctgaacccgtacaattcaacgtcggaaagggacaattggggaggggcgtgaactccgttgaaaaagcattctttggctggagaacatttggagttggactcgaacagctaaacgataagtcgtaggggttggttagggattgacaaattcaaccagcgaaacgatgtcgctgacacatgaatcccagtcgccatttccctgaaagtgccaacaaatgttttggcatttttttcactcccccccccgttgaaccacgcaacctttcgtacgaattggtcgtaattctcctcggcatggctcaatttcagcatattcacaggcaaacatccgtcaacgacagtcggcactttcgcgccgtcttttccattgtccgtttcggtcgaatttgccgcttgtcttttgttgttcaaccgcttccacaaaaacttttcgtatgcttttgctccttcattgactccgaagccaagaaaagtggtgacgaacaatcggaaacggaaacgcgattcgtcgtcacgacagccgaggtttagcagctgaacattctcttgcccacccgttgcagcatcggaatggcccaatggaagttcataggcaatttgagcagaagcgccacccatgtcaatcattcctcaaagggcggactaaccaaaattgggcaattaaccaatcatttggccttttccaaattaccccccaaattgtcacttattttgcatttcttagttacctgctgttttcggtcgctcctttttctcaacagaaagtgctggttgtgatcgctcttcgagtgactccgatttggatttgtccaccgatttcgtgaagcgtcccagcatataatttatggctatccaactgtaaattccttctaaaattttttgaataaaatttagatttaaaagaaataaaaggggatggggtttgttctccccccccccccctttctctgtgatttcacaatttaccccatcggccgcttatcacccgaatgtgttggtccaaaatttgcaattttgtcatctgaggaagttcattgcggagatgttcccattaaatctgttgttttctcaaaatggagcgacaattattntgaaatgctcccatttaataacgaacgcactcaaatggcaacagacgcatcc

SEQ ID NO: 390 - DNA, 2802 bp, Heterodera glycines
  genomic virtual cDNA Sequence=SeqID_642; coordinates=652..790 ,847..993,1040..1091,1133..1216,1316..1346,1386..1421,1503..1633 ,1732..1811,1856..1916,1962..2001,2046..2090,2195..2317,2371..2524 ,2590..2705
  coding sequence=SeqID_847; coordinates=652..790,847..993,1040..1091 ,1133..1216,1316..1346,1386..1421,1503..1633,1732..1811,1856..1916 ,1962..2001,2046..2090,2195..2317,2371..2524,2590..2705
  peptide sequence=SeqID_1085
atctgccgacagtttgagtccgcgagagagcggtggtgacattcgtcgtcgccccttcaacaacattttgaattcaaacaatacgccaccgttgaactctgccacgagcaaagggtttagcgcagaattggaaaaacagcggtatttggagaggcccagcagaaacaacgaggcagccaagcagtcgaggaacaaacggcgtgagcgtgagaagttcctggaagagcgtgtcaaattcctggaggaagaaaacaaacagttgaaggaagcccttgcaaaggatcagaagaaaaaaaatgtgcccatgaatcagcggggagggaattacttgtgattggtgtcgatgtttgtggagttttgaatgcattttgtgctttgattaactgtacaataatatattgtccataattcgtgaaaattggaaactaaatatttattatctaatttagatgcatttctgtctttaccatcagttaataagggtgtacgtccccccccccccccctcccccccctctggatcagttccccccaccatttgaagaaaaagcttttcattttttgtgttttcactttttaggtgctcatttcacgcaattaccggttagccagtcattcaaatatcattcaattttttgggtcttgattttgaaggggagatgttgacactgttgttatcgagaaattcgtcccacttttggtcgatctggaagaagagggtcaacttgcacccgtcgtcgatgttgagagtggcacccacatgatttggattcgtttcaataacatttatggtacatatcatgaagcaaatgtttatttctgggtcaattttgaacaccgaattaagttgttgctgtgtcccggtgcaataccaacgtgtcgttagtgcaaacattcttatacaaattggttgctgtttttgccgaatatttcaaggatgttgaggaggaatcaattcgtgacaattttgtgatcatctacgagctcttggacggtattaaatacccaattcctaatttatatttttcgttcttttaaagaaatgatggattttggctatccgcaaatcaccgaaggacgaatattgcgcgagtattttctatttgtctttttctgttcttcatttttttcaggtacataactcaggaaggacacaaattggaggccgcgcaacagccgcgtcccccgatggcggtgaccaacgccgtctcgtggaggttggttttgcatacaaatgccaaaaaggcaatgatgaggacggaaaaggacattatcaactcttgaataattccctgaacattggctgtcgtttttaggtccgaaggtgtgagacataggaaaaatgaggtttttctttttttttatattttattcgtttttttaaaggtattccttgacgtgatcgaatcattgaaccttctggtaattgaaattaatattttttattttttaataattcaggacaacaaatttttttattcgcgataagaagctttttttaaggcaagtggcgccggtacagtgttgcaaagtgaaattgtcggttccgtcaaaatgcgtgtttttctcaccggaatgcccgaattgcgcctgggtttgaatgacaaagtattttcttttaattcaattcaattgttatttttattattgttccttttgtaatacaaattaattaaggtccaatttgatgcggctgggagtaatttaaaaccaacgaagcataaatcccaattagtaatttaggggggagaagcaaagccgtcgaattggaagacataaaattccatcaatgcgtgaggctttcgcgttttggtaatttgacaaataaaagtataaaaaaacaaaatttaattaagaaaatgatcgtacgataagttttattccgcctgacggggaattcgaactgatgagttacaggtacacacaccacgcactgatattgcattttcttaattttccaagattgagcacaattgtcaaaccactcatttgggtcgaagcggtaattaatttggttttgcgtttgttatttgcttaattttacaggtaattgagaaattttcgcacagtcgtgttgaatatatggtcaaagtaaggtcaaatgggaaggttgttaccattattattaaaaaataattattattttttaaattatttgtttaactacttaatattttatgcttttgcgtttgaaggccaaaagtcagttcaagcgacgttcgacagcgaataatgtcgaaattgtcgtgccggcccccagttattcggacagtccgcgcttcaaaacggccatcggaaattgccgttaccaaccggaagtggggaagagcaaaaggaattctcattcgatcttcgcacttttcctttttaggacaattcttttgtgtggaatatcaaaaatttccccggagggaaggaatatttaatgcgcgctcactttaaacttccgtccgttctcagcgaagaagttgaggcgaagcgtccgatcaaagtgcgctttgaaattccatatttcaccacatcgggtgagcgaagcaaaaagtggaccaatgtttggcttaaccacgtaagtaataatccatcaaatcaggcattcaagtgcgatacctcaaaatcatcgagaaaagcggctaccaggcactgccatgggtgcgatacatcacgcagagcggggactattccctacgattgaattcggtgacctgaaacattttaaacgcctctgtatttggtttgaacacttctgacagttcgtcctgtggtttttccgaccgcttccattattgtttgtaattcttaaaca

SEQ ID NO: 391 - DNA, 1229 bp, Heterodera glycines
  genomic virtual cDNA Sequence=SeqID_643; coordinates=167..294 ,379..451,512..655
  coding sequence=SeqID_940; coordinates=167..294,379..451,512..655
  peptide sequence=SeqID_1163
attaaataaagaaccgaacgaaaaacaactttttttagcatttgctctccattcttcgtcaagccgtttcagaagcttttcccgatgcgattgctcagggctcttcccaagtgatcggtaaatgtgaaataaccctctatttgatggatttccccaaacttttcaggaatggtcggatacccaaatgtgggcaaaagtatgacaatcaatcgactgctcggcaccaaaaaaacggcggtgtcctcgacgccgggcaaaacgaaacatttccaaacactgatcattgacgagggggtaaataaatatgaacatttatactttggtcatcatttttacaaaagttttgccgagaattaataactattttttccttttcagttggttttatgtgactgtcctggccttgtgatgccgcagtttggcattagcgatgccgacatgattttgaatggtacaatttttgttttgttttttcggacaacaattccgttttaaattcccactttttcaggcattttgccaattgcccacatgcgcgactatttcggacccatccaattgctgtgcgaacgcgtgccccgccaatacttccaacaacgctactccgtcctgttgcccaagagcattgggtctttgaacgggcacgacctgttgaccgcagtggcattcctcaagggcttcatgaatgcctctggcattcccgtacgtcatgcctttggcacttcaaatgcatttctttttcccctcaaggattgttcgcgtgccgctcgtctgatcctcgccgatgtcatcgatggttcactgaaatgggtcgccgcgccttcgaatgtttcacagcgacaatttgatcaatggacttttaagactattgagctttcaaaggcacatcaacaagagcaacaacggcagcaggtggttgggttggagcatgggaggccaaaccagataaaattgcggatttattgcaaggacgacggtcccgggggggcgggtgaggggaagtgggtttcgcatggttggggcattggggataaacaaaagaaaactaactgaaaaacataagcaagtaaaagcaagtacctcccccttgggtcccggaaaatgagtcagtgaaaattttcatgtcataataacaagttccttgggttttcgaggtctaggacccggtatccatttcggccaattaaaacgaaagtccaattttcgaatttatttgatagcatttttgg

SEQ ID NO: 392 - DNA, 4467 bp, Heterodera glycines
  misc_feature (4396)..(4396): n is a, c, g, or t
  misc_feature (4399)..(4399): n is a, c, g, or t
  misc_feature (4402)..(4402): n is a, c, g, or t
  misc_feature (4405)..(4405): n is a, c, g, or t
  genomic virtual cDNA Sequence=SeqID_649; coordinates=1215..1081 ,898..841,787..638,574..452,408..212
  coding sequence=SeqID_938; coordinates=1184..1081,898..841,787..638 ,574..452,408..301
  peptide sequence=SeqID_1161
tttttgagcctttttacctgcgagtaacgcgtgtaccttacccaattgaacgccacaaagacattgaaagtgaagaaaattgtctctggtaaaataaacggtaaatgaacccaatttaatatgggagaattttagttgcgctagctcttcacaagttaaatataaaagggttatacctatatatactaaataccaattcaacattttgaatgacattgtatttaccaagcaaaaaataaataaattgagaacgtaaaaatctgtaatacaataattggaaataattatgcattggtctgatcatttggcagattgaagagaagcagcaagaaattccattgcttcgtccagtccgtcgcctttggtcgctgaggttttgaagatttggaatgtcctgtttcgtatcgcctaaattgaaaatataaaatacaaataagtttggacgacagacctccaagcccaacgccttgtgaacttccgccagggacagacagccatggatgtcctgtttgttggccagcaccatgaggatcgcgttcttcagctcctcctcctccagcattgacaccaattccttgaatatgaattacaattatcgcaaccaaacttttgtgagggtttgtcacccgaaactcacttgttttgaaatcccaactcggtctctgtccgcagaatccaccacgtaaatgattgcatcggtgttggagtagtaacagcgccaatagggccggatcgacgtttggccgcccaaatcccaaacttggaatttcaagtttttgtaagtcacctaaaaagagagaaagtaagctgttttattttaaatggacgacattgaatgacctgctccacattaaagccaatggtcggaattgtcgtcaccacttcgcccacctgcagcctgaacaaggaaaaggcattaatatttcgaaatttcatgttcaaaaaattgtttagatttcttcttcaatttcattggaaagtggaagaccgattcgaaactttgttttttttttaaatccaacccattacaaaacataatccacccactattgtgtttttctgtagcaattttaaaaatgcctgtaaagaatggtcgttttgccagcaccgtcgaggcccaatattagtattcgcatttcccgatgaccaaacaaagacttgaaataagagaatagttgccccatccgcaaaaaaataaatcaggaataatcaaaccaaaaaatattaatggaatgagaaaacaagttttaaaaaagaaaaaaaatgacgggaaaggtcaatcgacgtgggtatttatggacgacgcagtgaaggcataacagagggagggagtgacaactgacaacaatacttaaagggcgctgcaactaaattagtcccaaccccaaaaaaaagcacaagcatattgctatttaaaaattataaaatactgtaaatgatcgaaattgacttaacacagtgcccgaaaagagaaatgaaccaataaatagagagagcagagaaaaacacacctctcattttggtgtactatttctttatctctgttaataaaaaactgaatttacttcgggaatccttgttttattttttccggtcggatatatgtatatccaaaaaaggaaacaagcataataatcgatggaaaggaaacaataaaatattccgattgacgtctattattattcttcagtcctcagcaattccttctccacataatcgaccagatttttcttgcgcaatttttctaagtcatccattggcggaaaagggttctctaaataaaacacaatcagaattatgatggaaactctgatgatgagggagtttctcgacctttcagttctagaacggcaattgagtaacggttccagaactctgtctctttgttgactttcgacttgagtcgaatggtcggcaatcgatagatttcggtgtacgactgatcgattggataatgcgaaaaacggggcaccaaaatagaccacattttgtcgaccaaatcctgctcaatgaaccaccactgaaacatttccgcggtgtaggcacagttcgggccacggtaaatgccgagttggatgagctgtgaaatttttgaaaccatcagcaaatagttgccaagtgccactgaccctctccacgtactgacggcactcttccgctcgattgtacttcaattcgcaccgttcttctctgatcactctgttcaccaacttgcgcaccaattccaagtgcccacgcgggttgggaatgtacggaagtttaagccgttgcggccgatgtccgattggcacttttaaacgcgggagggacgggagcaaacgatgggttgacattctgaggaccaaaagagcggagaaatataaaaaggatatgaaaaatgatgaaacttaaatattaaattaaaggtaaaaaacaaagcaacaaaaaaaagaaaacgaagatttatatgaggcaataagttaaaagaaatgataaatcaacaactaaaacaaacaataggtcataaatcaaaatggagtcggaaatattcgcaattttcgggcgagatgagatggcctgtgccgggggtgcactcggcactgaccggacattgcagacagggcaccgaagccaacggagacggatggagttgctgcttacgaatcgcactgaaaaatgtgacgaaatcaatgcaaaaaattcgccacaatatgagataataaaaatttaccgatatgtgtggttcaaccgcttctcaattttaccgtccagcacagcaatgtccaaaacactgattgtgagaagtaattgtttaattgttttgtttattgcacacctctcaacatccgcgacgcccaattggattcgacaaaggcctttttcgtggatataacgggcgacctgaaaaaacaacaaatagacgagcgaaaagtaatgtgcctaaaataagtttttgttagtcatagaaatcctttggtttgaggtaacactaaaatgtgcaaaaggctcttccgcacttcgtccgactccacaaaagacgcctccctctgcgcgtaagggtcgcccgggtgtttctcttccgcggcgcgacgccgctgctgaaaagcgcaggaaaatttaaaaagcgataaattaaaattaaaaattgttgggtttctgacaatgagaacttaagtaatgttcgaatgccatggaactgccgagaaaaattaagcaattccaagtcggcgggccaaccataaaaggacacaaaagaaactgtttttatagaaattttgggttcatgtaccagcagccaattgacgcagacgtggagcaatgtttggacaaattccgagtcgagttgttgatccgagtaaaaagtgccacctgtcagtgtgtcgtcggcctccaaaccggacagaatgtacctgtaaaattgaaaaatagaagcgatttaaacgcaaattaactgttttagttaattgggtttcgtttttttgcgccgaattttacgttttctttgtggtgccggccgccttaatgcttcgcaccaattttcgctgctcaagcgccttcagaacgcgcctcagctgcacttcgttgaggcccgaacgttcgcgaatgtcgcggatccaaacgcccatccgctgcgactcttcaatgatggagaatacctggaggatgcgaacaaaataaagaggaaaaactaacggcaaaaaatacattcccaagactgaccaattgttcctccgggctggcgttgttcaactgactgcctcgttttagcctcaaaatgaaccctccggcgccgccaacaccttcgcccgttggcacagtctcacgtaacatttcgatggtcccttgggccaacagccggttgatagccgctccgagctgttcagtgacagaggacgaagcatccgtaccatccgcagaatcatcgccaaccgcttaaattgtggtaaaagaaacgcaaatatttatgtcaactattaaaccccgtattttaagtatcaatttgtacggaattgacaataaatgtgcgtttaaaaaaggagcaaaataaaacaacagcacaaacaccttgaagaagtcgcgcattgctgagcccttcttccggatgttcgcccaaaagacgtacaatttgttgttccattcactggcaaaaagttgtatttgaaaaagccaaggaagcaataaaataaataaagggaatagaaaccaaaaattgaaaaaaatatgatttaaaataacaaaaaaataaagaaataaatgaataatcaccgcgtacaattaacacatttaaaattccattcataattattcattttgttcatttcgctgctgctgattctgagcatcgttctgttgttggcgctgttcctgctcattgtcagtgcccaattcgcccgtcgcattgtcagctgataggccnccnccnccncccctgtcaaaaccaatgcgccaggaagtgcatggattaaagagtccaagcgggccttaatt

SEQ ID NO: 393 - DNA, 4344 bp, Heterodera glycines
  genomic virtual cDNA Sequence=SeqID_650; coordinates=3122..3211 ,3256..3537,3663..4037,4093..4344
  coding sequence=SeqID_879; coordinates=3122..3211,3256..3537 ,3663..4037,4093..4281
  peptide sequence=SeqID_1244
aaaatttcggaccgggtcagtttagtacggccggtttagtacggccgttttagtacgaggggtcgttttagtacgagggtcagtttagtacggcaagctgtttttgtccaaaatagattctactgcttttttccgaaaaaatgtttaaaattaataacataacatatttatcaatgtgttaacaacaaaaaaaaataacaagcattgaaaaattacgggcgcatttcataattgcgagaaacaccaacgagcaaatgattgatgttatcgggattaacattgacattggcatggtaattgtggtcattttggatagccgggttattgttgatggcattgtagccctgcaaaagtcgaagaattctttcatcggcggcacgatatttgggcttctttagaggagggacttcaccagcgatgcatcgtgagatgtctgcatcaattgacttttgctcacatcgaattgtgttgatgaagtggaagacagtaggatgggtacaatcaaatgcccgttgaagttttcgatctgtcaaagcaccgttgaaccacggtctcccggtgtaattaaaaaaattgagttaacgtttcaaaaaattcaccaattgaagacgcccataagttgttgaggaagttgtgcctgcaaaacagtgaggccagcagagagatgatggacaggaagaaaagccatagaggtgatcattttgctcttttcagcaaagacggcattgttgttgtaagtcttaatatgaacaattctattggaaaaatacaaaaatgcaatacctgagttaaaccctcggcagcaattcgtttcttcatatttcccactaaatggaaaaagcagaactgcacacgacagagtggcaacattgtacggacagcaatttttcataataccgctccattccgaagtcgaagaacgagtaaatatcaaaattcttaatatggaaatttgtgaaatttaatggtttttattttttcacctttgcggtccagcctgtccctgaatttgaaaaacgccggtatctgccaacaaaaaattctcctcgtcattctctgttcgattgtacattctgtacgagggcggcaattccaatgcgtccaaactgagtggtgcagcaggtggtacatcttcgtcatgacgaacacgttttataacctaaatcaaaggaaaaaatcaaactttggcataaaaatttgcaaacgttgacctttttgtcgcagctttggtcggaaccaacacgggggttgcagtgttctgcaatacttgcgcacggattgtagccggcgcttcgcacgtctcaactgcacgccgcttgagctgggttatatgtcgctgacactccacatgtgcggcgctcatgtcgcatgtgtggcttccaattattttgaggacattaccattaatgtcagtgtgaaggcgccctgtatttgaaaaatagtttttattttattttatgcatttacctttgcatttgtcgttagctccgaaaaactcgcatcgccaatacttccgaagtccatcgtcactgagtttgtgaagaacataaagtgaaccctcatgttccagcttctccttgtttcgctttgtctttatttcctgattgggctgttccatttgtattgtagctaaacatagatattataagtttttccttctttataattgacaaaaaaaacatttgtaacagttatggacaaaccgaccctcgtactaaaccggccgtactaaaccgaacctcgtactaaaacggccgtactaaaacagccgtactaaaccggccgtactaaaccgaccccgacccaaaaatttgtctatgtttgaatttttttggcgttctgtatttattttttatttttttggtcactacctccaaattagagtgccacgggaccgggaccgggccgggaattcccggtcatccgaggtcccggtcccgggttttgaaaagctcaagtcccggtcccggtcccggtagggcaaccgggaaccgtgaaaaacaagcactggtaagaatgggggtctgagtgaaaaattagtgaagaaaattggagtcaaagggaaaaataaaaaataataattaatatattctttaaaagtaacactgcccaagtgtgcaaatggcctaatggctagtctccttgactttcccttcttctttcccctggttcgatccctcaacagaaactaacatattttgaatttttttttgtatactcgtgggtttcctatagagaaaaaatgattcctcatagttttttttaaattgatacatattttatcattttttaaatgaaaatcctaccaattgagcttaataatcccaaaaccaacctttttttgctgaaaatctgttaacaaattacacccaaatttcaaaatttcccccggcggcgcctatcggcgcctatcggcaccgccggacccccttcttccccaaaaattttttgaaaaagcgcgccgaaaaaatgtgatatgaaaagcaaatattaatttataataatattcaatcatttagtccaaaaaatgattaattgtttgaaataattaaagaaatttgtttgaaaaatttcattaatttaatttagctttaacttttggattttattaaataaaaaacaaaataaaaatttaatgttgtattattttagttgaaaaaaataaaaatttgaattttttaaaaaaatttttgaatttttgaaatttcccggttggtcccggtcccgaaaaaaaaccgaggtcccggtcccggcttctcaggtcccggcaagtcccggtcccggttttacccaaaattcccggtcccggcgcactctagttttgatgctctattacaaacccaaattattaaataattgtaaaacattatgccaatttatcaaaatttaaaaaaattctgaggattttccccaaaagcctcaaaaatcctcaaaatttctaaaaaagccacaaaatgaggataaatcctcagatctggtaaccctggtaattaaggaattgaaatttagggtaaattttcaatgagtttctttcccatgctcatccatttggccgttttttcaattttattgtgaattgtttcttttgttcagaaatattgtttgctatttattcattgtaatggccgaatacgatttgattaagcgccttattccctttttcgacttgcatcttgtcattccgttgttggaatacatcgaacagcaaaaggtctttttttaaaaaccatcgcaaattgtaaaatcacttttcagatttatgacgaggaatccttcaaaaaagtgcatttggccgttcttcagaagacgaatatggtcgacagtctcatcgaagggtggggcaaagacgagcgccttttggagcagtttcaggcgaagaagcagcaggtgttggaggagagagaacggctcaaggatatgtgcgactcggcagcagaaattttggaccacaaggacgtgaaggaaatgacggagagcacaacgcgggacagagaggggaataacaaagtgttggagtacatcggagaacgcttcggggtgacttttcattacactttttaaattggcaaattcaaattgacaattccttgaaaaataaggaaaatctttttaaaaaggaagaatgtgttctggaatacatcacactgtgacacttatttcagttcacaatggagatgcttgacagtctgtacaaatacggaaaatttttgtacgaatgcggaaattatttggccgcctccacttatttggacttttatcggaatttgatcccccaacacgaccccaactatttgaatgcccaatacgggaagttggcgtccgaaatactgctccaaagttgggaccacgccaaggacgacctgaacagactgcgcgcctacgtcgactcggagccgtttggctccgaattggaactgctgcagcaccgggcctggattctgcattggtccctttacattcacttcaattacccgaagggccgggacgaagtgatcgacctttgtctgaaccagcagccctatctgaacaccattcaggcaaattcgctgcgataaatcaatcctttcttattcgaattttcacttctttaagattctctgtccccatttgttgcgctatttggccgtttctgttattaccagcaaaaacaaacagaaagcgagcctcaaagacttggtcaaaaccatcgaagtggtaagcgggggagaatattgtcacaacaattggaattgggatgtctttatttgccattttcgggttttgcaacataaaatgttctaaaaaaccaaagaaacaacttgtattgtaacatatgtgagtggttttaccctttctcatttgcag

SEQ ID NO: 394 - DNA, 6486 bp, Heterodera glycines
  genomic virtual cDNA Sequence=SeqID_651; coordinates=4684..4607 ,4556..4436,4392..4345,4184..4107,4063..3932,3781..3713,3207..2834
  coding sequence=SeqID_864; coordinates=4629..4607,4556..4436 ,4392..4345,4184..4107,4063..3932,3781..3713,3207..3076
  peptide sequence=SeqID_1097
aacgatgatttcatccgcaaaatgtccacggtgtccatggaggaggccaagggggaagaagccgtcggcagcgaagaagtggcactcgaaagcgcggccattccgtaatttgcattcaattgaagaaaatgcaaagaaaaagcacaggcacatcaaccttggcaagggctaccaggcgaaggtgaagaagtggtccgagagagcgatctccgcgcaggagagagaagcgatcgcagacagagaccagccgttgttcgagagtcgggcagtcgaacacattcccgaaacggcgcgtaagtggcggaggatgcccgattactcacccatcattccgcgtttcgtttcacagttgccgcctacgaaacattggcatgttcagtggcagtgccgaaaccgggcagaaacaaagaattggcactgaacgttctggcggagaaccaagggaaccttcaggcggcggtgatggatttgctgcgctgtgacacactcgactgggagcagtacccgaacatcttcaagaactcgtacgtggacgtggacgactggagccccgaggaaatcaacacgttccaagtgggaaaaagaggggagggagcaaaagacgaactgaggaagaaactgccattcaggatgccatctacaaaagtgagaaggacttccagcaagtggcgactgaggtgtggtgggaggcgaagtgaagtgaatgttctaagaattgtgactaaaagacgggggcaatcgtaaaatgaaaggcattgccaaagagtgggctttttatagcaccaaaagaggaggggggggattcgctgagtgaatccggcgacgtttcccttctcccctccacagcttggcaatcgcagtgtgcgcgaatgcgtttctttttactacacgtggaaaaaggcatgccccgacgactaccgaaagctgagaaatttgcgcaagaagcggcaactgctggaacaacaggtgaaagggggaggggcaagccaaatgagtgacttcctacgttttcagctcgattacgcctcaatcgcatgccgacagctttcccattcggaaagccaacagaatggaggcacttcggaggaggaggagggcgaggaattctccgagacggagtccgacatcaccaacccgtccctgctgggcctgtccatggaatgttctcccgccggcctgggtcgtaagcactcgttgcctcggggcgctcttcccccgggtgacttcgccgcccatccgtcgtccgcttcttccctcctgcccaacacttcctcggcacttttcaattccgcttatccttggctgcatggggaaatctttccttcgccgtcctcctcgtcaacttcgacgacaaacaacgaccatttgcagggggcacagaacggaacaacaaacgccggaggagaaatggggacgacggacagaacagaagggacgcagcagcaccacaacgaatacggagggggacaccaccacaaccaccatcacaaagtcattagcgattattagcaacaaatggtgggccatttcagattcgaagcgtagcgaacgcaaaaaaaggtgcacagccttcggccgatggtttcttccattgtcgcctttgtgagaagaggtcgcttttcttcgtccgttttcccccacaattccccccccaaagttcagatttgaaaaggtcaaatctctgaacgcgcatatgaaatcgcacgcgatgaaagcgcgggcggaggccgaagtgcaaatgcagcacaagcagcagcagcagtcgacgtcactgccctttccggtgcctaccaaaaaggaagcggcggacagcgcttgttggggtcgttgggccgcccccctcggccccgtcgcttcgctcaatctgacaagctcacaagcagctgttgcggctgctctgaacaacctcaacaggcagttccagcacagcagggccaagcggtgcaagaagcaatgggtggcataatggggagcaatttgctgctgaggaacatgctgcagtacggaccggcagccgcagcggccgctgcccaaggcgggggcgccgcaacgcctgggggcacggcatcgcagtggaccaccacgcagcacttcaacgcgtagcgaagcggctccgctgcacatgctggaacgggatgacccaccgactgacaaaacgcacttataatttaccacccttagggggattcccccctttggttttttactttccttttcccttctttttgctccaccggtgatttgccctccctttttagcacaatgttcgctattcacctctctcccccattttcctctctttcttgccctttcattcttttgttttctatttcttcctttttcccatttactgcttctgtccaacttcctctccctttcttttgtttctcatttatccatttacaatcactcagcagagccactcactatgtcaattaccatcccggttaattaatatacaaaataacgctaataatcaaagttcgttgaataaattgtatttatacgtgtccaatcagtgggttaaaattaaatttaaaatgcctttccgtgtgcactccataaataatacagtaaactcacgaataatcagtggaaagggcgtgtccttttgtttatgggctgaaggtgaccaatttcaattctatcggagtccagaagttatttaaaaaaattggatttttctcgacggcgtctattggcgccgccggcaacctcttttctctccgggaaagtattaatgtattttagttgagaatgaattcaaaactcttgaatttaaaacaaaagctattttttaaaattggagtgactttgtgcttattgttagccataatcattaaacttttacttataaaccaatacaaaaagcatgtgtcaaaagttcccactgattatcatccattgataattgatgcataggcatacaaatggacgaaagaaaagagacgaaatgggggggggggggggggaacgaacgccgcacaaacattcgtccgccggaaattaaatcactttcacgcacattctcacaactttgttttgtccaccctgcgctgtcctccgttggctaactcagcaacatccgcccgtttttttgtcccgcaccggctgagacggaccaatgcgcacggcggacgcattgccaccggcctgttgaagagggcccatgcgatttttgatttcagtggccattgtgatgaacgcctaaattggctttttttaaagagccaacgattttttaatgatagtgctccaatacaaagctgaaaaccccgggatttgctccatttttcccccggcgacgctatcggcactgccgacccataatgatctccttaaacagcgaaatttggcccaaattttaaatagatttgaaaacagaaacaattactaataataaataagtaatttcccaaaaagaaagagaattggcacaaatacaatttattttttcatagacaaattctcacaatcattgttttcattgcaatttgtttacagctgtgcaactctttgaaaaggctttttaaccttaaaaacgggctgatttttgttggggggtttaaaaaattttcgggtttttatttattacataacattcctgctccagtaaattgttttttttggcatgtaattcatgggagaatcacatggtaaataacccacaattgaatttaaaaaattagttattaagtaagtgctgactgacctgttcaacattagtggagtttttggcagaagtctcaaggaatggaatgttcaattggtcggcatactcctgcaaaagtgtaaagcttttgtagcaaatatagagaaaggttttcgagtatccaagaggaccattaattctaaataattcaaaagccgaataagagagaaagtaagttcaattcaaaagattaaaacaaaaccctccgaaattttaaaccttggcaacattcgtctctatcgcacgtttggtggtcaaatcgcatttattcccgacaagaagtttattcacactctccgatgcgtatcggtcgatttcctggagccattgcttgacgttgttgaaggagtcctgagaatgaagaacaactaaaacaagtataaacactgtggacctggtctgtaatgtcgtaaacaacaatgattccgtgtgctccgcgataataactggacgtaatcgtgcggaagcgttcctattttgtaaaaacaaatggtcgtaaatataacggattggacaatagaaagttttttttctttttttttgctacgcgctatatggaaccaaaggcccacctgtccggcggtgtcccactaaaataaataatgaatggttaatgtatatgggtcactcacaatctgaagtttaatcgtcttcccctcaagctcaatggtgcgaattttctaaatgaatttattagcacgatttaattattatttcggatacgaaatcaacgccgatggtcgaaatgtacgactctgtgtaggtgtcatccgcaaacctaagcaacagacacgacttgccaacaccagaatcgccgatcaacagcaatttgaagagatagtcactggagaaagtgacaaataaagcaaaatgtatgatttctgagttactcactattcaggattcatggcagccattcttcaaatcaatctttaacggcaattaataagagttttgccaagttttataaaatctgaaatgtctgtattgcgcattaataaaaaaaatattaagaaaatgcaaataaaaaagctttttgcttcgtgtcttctttcacaactcatcaattcttttgcttctctttcgtcgcattcgcattatgctgcacatcacacacagcacaatgttctgttcacatttgttcatttgtccgtgtctctgtctctctgtcattgcctttctttcccttcctttgcttatgtctttgtctctatccccttttaactttctctaactttctcatcgaacagtaattttcgctttaataactaaattttattttacctaattgaaaattttgctacccctatttgtctttctgaccgcctaaaaattgggaaacaattttttagtccagttattttctttaatgttattcatagattcagtttctttttattacaaataaatgggacgtcgtatccgagctcaacgcaaaggacggggtgggattttcaaatcgcacagcaaacatcgcaagggcccggctaaattgcgcccagtggattactccgagcgtcatggcttcatccgaggcattgtaaaagacataatccacgatcctggccgaggggcgccattggccattgtacaattccgcgatccatacaaatatcgggtgaagaaagagacgatgattgcggcggagggattgcacactggacagtttatttactgcggcaagaaaggttcgtttccacttttcgattgataattatttccaatactttggtttggctatattcaagtttacgcgtccaatcagttaccatccttagtttcttaggtgataacgttttcttactcatatattcttggtatcaatcgaagcttaaagtctacagaagtttttatatagtaaaaatctgagaaaatacaacagacaaatagttattgaatatacgcaaaaaatgatgaatttcgggtttctcattacatttttcttaatgcaagtattgcgcttatcatacatagcctaagaaactgaggatagtcactgattagacgcgtaagctggaattgagactttgttttatactagggtctgtccagttttaaatgtccatagtattttatgcgtccagccatgcttttgatattaactcaacaatttatatttttagcacaagtccaaattggaaatgttatgcctattggagaacttccggaaggtacgaccgtctgcaatttggaggagaaggccggtgaccgtggacgtttggcaaggacttcaggttgttattgtgcaccttcccttttgtcccttatgtacatccgaatgttaatttattcattatctttatcataaaggtaattatgccattatcgtcgcacataaccccgacacgaagcgcacgcgaattcgtcttccatctggtgccaagaaggtcgttccatccgccaaccgtgcaatgattggtagttttactacagaatattatgtacctgagcttgggtttttggctctagttgtctagggattttggtcaacgtccacgaatctattttgaaaccaattccgaattcccaatacttcttaaatattgttagagattcgaattcgtcgaatgtgtgtcctcttggtttttattttcaaaaacattgacttttcaaatggttcgtttaaggcattgttgctggcggtggtcgcacggacaaaccgcttttgaaggcaggccgagcctaccacaaatataaggtcaaacgcaactgttggcccaaagttcgtggccatggaagaacccggtcgaacatcctcacggaggaggaaacca

SEQ ID NO: 395 - DNA, 2931 bp, Heterodera glycines
  misc_feature (2897)..(2897): n is a, c, g, or t
  misc_feature (2902)..(2902): n is a, c, g, or t
  genomic virtual cDNA Sequence=SeqID_652; coordinates=1636..1434 ,1374..1303
  coding sequence=SeqID_998; coordinates=1636..1434,1374..1303
  peptide sequence=SeqID_1260
gggcacaacggacggtggaccggagcgaatgtcccgtggcgagaaaagggaacaacccgcgcggcggtagcgaaggattttgcttggggagaagggcgagcgccgcgtgaaatcgggggaagagactgtcgcggggactcttttccaatccgtccacgtcgcggcacttcactcagttagattcggccattttgttaccatttccgaatttcattttcgtttcgtcccatggttttggcacctaaaattaggccattttcggtctgttctcctcccccgggaccgtccctgggttgtggtctatcatagccccccccccactcaatcagtattcgtccatccccttcttctcccccgcccccttccccacctgattgatcagtttgtcctcggtgctcgccgagtgcggtaagtccatcgttggctgcagttccgccatgtactcgttggggtgttccatcagttggtgcagttgcagttggccttcttcctccagacaaagaccgcaaaatcgacagtttgtcgcgttattattggcgtcggcgattctgtggcccaaatgttcttcttcagtgtcctttttgaagtcgttctgtgacgagaaatacgattaataatgacagaaaataaacgtttttactaattaaatgcactttttgtttcccattttgtaattgtaaaacagacagaaacagtctgtccctttgtcagttttccgttcgatggtttcgattaacaaacaaaaaaagggggagagaagagaaaaagggacagacaaaagccccccttttgcgaattgagaagtgttccctcccctctttcgtcccttttccccgttcttttcttaccctttcccccgtcgttctgagcagacgcgcgcccccgacgagcgacggcggcagcgtctcgtcccctccgatgatagagagcagctgtttcattgggttggcccccgccagcgacggctgctgggcccccgccgcttccctcgtctgctgctgctgcggcgagtgtacccccaggggctgattattctcatcatttgcctccgtcccttcgctcgtcgttctccgctgcgtcgattgttgctgttgctgctgcgtttggtgttcaatggcattgaaattcgaagccgccggcgcaaacgacggcagagcgacccttttctgctgttgttgctggtttgtctctgcggtatccatggacactgccgtcggttgcgaggcggacgacgacgtcgcttttggcactccgcgggctccgccgagtggggccgactgcgacccgccgccacccgcgtgcattccatgcgactccctcttgtgcaacttcagctcctctcgcgtgttcatgctggtatggcaaatgtcacacctaacggtgggaccaaaccaatgacaattcgccacccattccctctgctcatctccaacctgaacttcacctcgcccttccgttctttgtccaccgtgtcaatgttcgctatcagctgtttgttctcgtctatgattatgttgtgcattttcagcatgtgcgtcctcaggaagtacttgttgcacacctctttgttgcacaagtcgcaaaagtttttgctggtggaggaatattgtcgtttctgaggcggcggtttgttggactgaaattgtggcaaacattaaaaagggggaatgaatttcaattataaattcattgctttccgaactttaaagaaatttaccggcgccggcgtatgtcccctgcccattgctccgttttgctgcgtcgacggccctcccgtcgattgtaccgttgtggctgaaatagcgccgctttgaccgtgttgtgcctgggcaaccgcggcgaactctgcgctcagtttcgccaacattgcggcaccgtcaaactctgtcggattaattccgccaaaagcggacgaattgttgaacatcagcgaaggcgttgtgccttgtgagaaagggttggagccgagcaactgtcctgaatttaaagcccactcatctgatgctcttggaactttcaattgtcccctcctttctcaccaaataattgctgctgttgctgttgcgtcgtcccacttcccccgttaattcccgcagctgctaacattgccaatgcgttaacagtcgactgagtgtcgttgctggcggtcgactgttgctgctgctggggcgcatcggtgccgccgatgtgagcgatcaattggtgttggaagagggcggattggctgggaaagtgtttggcacactgtgcacaagcaaacgacgaggaggggacggaggaggacacattctgctgggattggtggtggaggtcagagccggagagagtggcgggcggagaacggacggacgacggggaagggcacctgacgaaggaaatggtcaaaggccgtgatcaggcagaaagaaatgccaagaatgatcagagcaaaaacaacgcgtagtcagtggttccccacctgttcatgtcagtgttctgttgctggttttgagcgtgtgccatcagttcggccaaatggagtccgccactgccaagcagttgctccaacgcattcctttcgccttccgtcgcgtttccgccgttggaaaggccaagttgggctgccaattgttgcatcacagccatttgttgtgaatggtccggagagagtgcttctgaatgaatgggttgaaaatattacgttacgctgcaaactttctcttaattagttttattgaaatgccaattcaccagtaaatgccgtcgtttgattgtcccccggaccatttccgctaattgtgccgggcgtcgatgaaagggataatttcggagccaatcgtccaacgggtggcgattcgttgtggtggtgtgccatcaattccatttggggtggctgaactgattgtgaggcggaatgngacgnacggagtgttcgtcggcagagaattgggc

SEQ ID NO: 396 - DNA, 4587 bp, Heterodera glycines
  genomic virtual cDNA Sequence=SeqID_654; coordinates=1..161,221..316 ,361..501,552..840,931..1133,1442..1531,1616..1717,1791..2029 ,2078..2128,2234..2426,2571..2659,2710..2866,3075..3203,3253..3294 ,3339..3554,3608..3799,3849..4136
  coding sequence=SeqID_981; coordinates=1..161,221..316,361..501 ,552..840,931..1133,1442..1531,1616..1717,1791..2029,2078..2128 ,2234..2426,2571..2659,2710..2866,3075..3203,3253..3294,3339..3554 ,3608..3799,3849..4136
  peptide sequence=SeqID_1197
gtgggtgccgcggattcggaaaacgcattatgaattgcccagaggatctgattgtgggtggaattcgaagggacgcccagggcgttcaaatccgacacgccgaggcttttcagacggtttttttggttgcttctgctggcgatgtttaccaacgattaattgtgagggctttctttttttaatgtattttggttgcgttcaacaattacttttctttcagcgctccaaaaatcacagaatggaaaagttcggcgtctcctttacccaggctcatgccggtgctattattgcggcatggcaacgaaatttcaccaaagtgagtgaaccaatcgacgaacacagccaattctaattgttcagagtatttacgaccacacattgaataaacctgcccagggaattcgcgtggtgcatccgctggcctcaacttccatccaggacatgttggagcagttcagcgaattccaattcttcgtcatcttcatcggctacgtgcttatggtttaaaacggagaatgtcctctaattgtattttggttctttactaacagattatttacgctggttggtcccaagtgcattggcaggggtggtggttttcggtcaagtcgagttgtctgttggccattatcggtgtgctggtgatcactttggcatcggttgccggcctcggcttgtccaccgccatgaatattcacttcaacgcggccaccacgcaaattgtgccttttcttacactcggacttggcatcgacgacatgtttcttctgctgcacaactacaacgatgtgctggaagctgtccgacaaaaagaggtggcggtgttgctcaaagagactggtgagtcggggaatgcctcgggggtttcccttcttttttcgggtcacttttcgtctttcatcctttttctcgcttttctttcacctttaggcatgtccgtgctgatcacttccatcaacaatatcctcgcctttctcaccggttgcattttgccaatccccgcgttgcgttctttctgtggtcaggtggccattctgctcacctccaacgtcctctgcattattcttctcttccccgcgttcattgcgttggatttgcgtcgacgtaaagcgggccatcgcgacatgagcttcgccgcccttttctgttgttgttgcaacagcagttgttttatcggtggcaaaaaaggcggtggcattgaaaatggaggccaaaagcatgccaaaatgatggagggcggggcattcaaaaagcgaaaggtttttattatttaaattattttgtgacagttttgctcgtaatgtgacgacgtaagcaaagaaaagaaatttaagtaaaacaataaaaaatgaaatgcaaaataccaattcattttctgtttttgatccaacttttgccattctttcaaattcaaaggttttccatttgtcagttggaggagtgcagcagtcgcaaccaattggtgaagaccgactccacggtgaccacccattcctccgaaattgacctgcaacagatgagtgcggctgtgttcggccctccctcgtccggcccactgatggcaaatgtcaactttggcccttcctcctcaccaccttcggcctctaacaataagccggtcacttcttcagcaacaaagtcgttgcacaaatggtacacattggtcgggtttctccacggctattacattccgttgctcaggcggccaattgctaaggtaaagggccacaattttctgattcttcgatactctatgaccttttggtcttttacacattttctccgtttagactgtcgttctgttggtgtgtgctgcgatgttcttgttcggttgcttcggtctttactattcgcgcattggactcgaattggccgatgttttgccggagcatacggcgccagcggcctttttgaaggcgcgcgagcgatacttcagcttttaccctatgtttattgtgccgaaaggccccatggtggattatgcgaatcagcaacacaaattggagcagttacggagggacatcggtcgacagaatataattctacaaccatcttttaatctaaaaatttaagcaaggtctaattttgtcatcaaagtggacggggagccagaacaatggtggatgatgttggtgacccttaacatttttaatttatttcaaaaattggtgctaattgcactgctggtggaaattccatgtccaaatgaattaataattcatttcatttccaggtttatgcgcacttggcttcactctctccaatcctctttggaccgtgctgctaaaattggcatttttcctgacgacgatctcaagaaaatggcggctgacgcgttggcacgcaatttcacactttcagacgactttctattggctagaaagttgctttgttctgctggacaacggtttaactgcacggaaatggtatggtttagataaattttaaattataccaccgacgggaggagaaggaattgcacttttttttgtgcgttaatttaggcccgagactctcgggccgagagtcaatttttttaattctgaattactttcttcaatattatacagcgcggtgctaaattgattgaggacggacggatcaacccacgagggttttacaattatttgactgcttggttctaccaagacaatatgatgtaatgccatttaatactttttaattcaaattcttcgtctttttgtgcaggtattacgtgtcccaagcggcctttttcccgacgcctttgccttggcatttttctgccgctgatgaaagcgttgtgccgcccgccgatccgcttctctactcgcaaattcccttttacatgaatggcctcaccgatacgcagtcaattgtccaaatggtaactatttgagataaaataaaacctttgaagcttacaatttatgggttaccccacatttgcgcctatgtctaaaatcggattcaaacctaattttttcataccaggtagcctaaacagcattaaaattatgaaaacacagtattttggtttattaggagcattaattctcttgttcgaatctacgggtttaattggcttttgttagatcaaagaaatccgtgccatttgcgaccggtacagtgcggacggtcttcctgtttacccttccggcattccattcacattttgggagcagtacctgaagctgactttttatttggtgtccgcgattttggttcgtttttacacccattatattatttgacctacttaaattaatttagattattggagttgctgttttgttggtcatttcgattataattgtaattcccgccacaaatgtttttccaaatacccattttccaagttcaacccttgggcagctgcaatggtggcgataatcgttgttaccatgacggttgagttggccggcttcatgggcgtattcggcgtcaaaatgaacccaatttcggcagttacgcttatcactgcagttggcattggcgtcgaattcactgctcacgtcgtcttggcttttttgacctcgcttggctcgagggatgagcgtatggtcgcgtgcttggtatgtttttgttttgccagtccaaatttggtatttaatttctctgggcttaggaacacatgttcatccccgtcatccatggcggactgtccactttgctgggcattgtgatgttggcattctccgaattcgacttcgtcgtcaaatacttctttgtcgtgatgaccgcattggtcatcatcggcctcatcaatgggttggctttgctgcctgttttactttcactaattggaccaccgtgcgaggtttgcctgtctcttttttctttctttctgttattaattttcctctcagatcactcctgtaaatggtagcaatttgttgccgtgtccggcgtctgaacggtatcggcccgaagacagtccgaactgcttcaccaccccttcgtccacccatcatcaacagtcggacgagcaaaagagacgacgagggtgtaaacggatgttagcggtggacgactcatcgtcggcatcgtccactgaagacggtgctggtgcaccagcattcagcaaatctgacgaagatggtgaacaccaaaagcagcagcaatcggtagactgggacaacacagtgactaattaatacaatgaaatgagtcagttgaacagccatcgtcagcacgattaccacgaatcattgtcaactttgtatgaggcgagtggggaagaaagggagcagcaaaatcagcagaacacaccacagccgaagagcaacagtggcagtggaggagggggaggggaggaaaccaacggcaagacgagaagaacagcctctttgtccatgacaccagccgaccgaagattttgaacgataaattatatattgtagtaatacactttcagacacctcggttatgcctattttcatgttctatatttctgttcaacttttctaaatttttaattcatttgcaaacacagagcataatgagattgttttaaaaaactgaattctttaggaataaaatacaaaattttaatggtcatttagctcaacgaaattgaaagaactttaacaatgaaaaatatggaga

SEQ ID NO: 397 - DNA, 3966 bp, Heterodera glycines
  genomic virtual cDNA Sequence=SeqID_655; coordinates=3788..3722 ,3651..3499,3454..3384,3291..3112,3055..2996,2945..2804,2691..2567 ,2507..2433,2361..2135,2079..1977,1918..1812
  coding sequence=SeqID_947; coordinates=3788..3722,3651..3499 ,3454..3384,3291..3112,3055..2996,2945..2804,2691..2567,2507..2433 ,2361..2135,2079..1977,1918..1812
  peptide sequence=SeqID_1170
tgggacttataataacagcctcttctgtcctaccattggaattgttcttttgcttggtttgtgaatttcctcgaatgtttcttcgtccgtttcagtgattgttaccgtttcttcgacatcggccaaaatctgaaggttgtttggggattgttgctgttggtagtcactgcgtcgcctcccccccccccttcgggacataatttctccgatgaactattaattcccattattagttaccatgttcaaatgttggtcgaaggcatgcagtcggccgcggagttcgcgttcctggcgcagctttacataaacacgctcgttaaggctgagtcggatcaggtcaagcggttcctcaacagcgtccaaagttgccatcgaattgtcacagtaaaaattgaaatgattttacaaaagggtaaaaccagagaaataaggcacaaagtgcactgattgtgaacatgtgaaattcccttgtaagattgagaagaatttaaatgtaacattcaacaaataaacaacaaaacgaagcaaaaggattatcgttttcttttcctttctccgcccatccgagtgccattgggtttgccactttttctcttttctccgcccatccgacgagtgccaccgtttttgccattttttctcttttgtttcggtccgtcctttctctcactgttcatcctttctttgggattctggctcttttctctcattttgccttttcgtccaaaagtgttagcttttgccttatttgtcctcttagtgccagtttttgactgtttacgcatatcctgaaataaaaaacgaattttcatatgattcaattctctttatttgggacagcctccgctaccgctccttacttacttttagaaaaagatttattatggaatcatggaattaagcactttactatagccctggaccgtagagccccgctccccccggtttgtttggtgtgactccttcagccacctttttcattcgtttgtccaccagtcgataatgtccgtccggtcggctcattgagcctcgtttgcctttggtgaccacttggtacgtcactttgcgtttctcatttgagcccgccttcttgtatagcctgcagttatttaattcctgccaacatcaccaatttcttggcccgacctgcgcagttcgcgcactttctccccatgctccatttgctcattgtccacaattccctccgcctttttcttcgccttttccatgcgtcgtattcgccgttgtcttttgcgtgcctttgcttccgccactttttttattggccttgtgttcaattcgcgttgttctcgcttcgcgtaaaagtcaacgcgttcctttagttgaaatgcaattagagaaattcaaaaagcttctctctgaatggcttatgctaattagttactcactttgtctaccgggggctccaactgacagtggcgtttctcgtcgctgacaaaccattccggcaatgcttcatcgttgcttgtgtacctgatcaaatgtacaacaatgtaccaaacattttaatgccaaataacctattccaggcccagtcctccaagtcctgtgcccgctttttcgagtaaatcatttcctcgcccattgctaattgctccggcgttaacttcggctttttcgcgcttttggtgcccaatttatgttcatctgaaaaacaattcggccatagcaacttgtcgggttcgcttttcccaccttcttcctcaattgcttcgtttagtccgtcatcaaattccttctccattttggtcatttttgtcgttgctttctcttcgtccttttcctcttcatcgtcatcctcatcattgctctctttttcctcctcctcttctttaattcccttcaccgcttttgccgcacgttccgctaaccttttcaccgtttttaaagaaaacagcttaagattcaaaaagtgttattccgccaattggttaaacccttccccattcgctcacctccaaatcctcgcctatcgtcggctcgtccccctcgtggaccatcttcagtttcttccgttcttccaagttgcgctttgccttcaacagttttctctttcgtcttaagcaaaaccaatattctttttattttatgatattcgaaattgactcatcactttttcagcgttgccttttcttcggcttttgctgttctgatcagatcgtcgatctcttccaactctttgaattcagtattttcctccaactcctcgccagtatcaccctccaccatttcttcagccgattttacactttctttagacgctttttcctcctttttctgttcgtcaaccaatttcttacgccattttaaaatgcttctcagttcggcaggtccacaaacctaaacgggtttttttctgttagtattcactatatttctcattgtccagcttgtctctgtcactaactcactttaatgtctttcaaacattctttgatttcattcgtcgtgtgttcactgttcagcactctttctgagtcgagcaccttttaaatatgaaatgtaaaacaatacgcttctaatgatttgtccagcatccaccgaccaattccgaggcccggctaagcaattgaagcgcatttttggacgttacaaattcggttgcgcccagtccgctgtgttggccaagcaacgcgtcgtttccgtagccaagtgctttagccttgcgctctttacggcccggatgcaaaaggagtcgttgtctttggaataagaaaaggatgcaataattcaaaaaaaaaataataatttatccattacaaattcttttcgctttcgtcaccgcctccatccgtttggtcagagaacacttttttagaatccaacaattccgatggaactttgtcaggcttcgagtattgttcacaaacaacaaaaatttcagcagattcgagccgagaagcggacggtttccaaacatggacccaaaattaaaaaaaggaaattacttttgtaaatagcgaaatttaaatacttttctgaacaatttttcaaagacaccaatcaaacattgcgagtcggctgatcgaaaaatctaaacaatacaaaacaaacaattaagaaacgaaaagtattcctaattataattactttagtcacgaaaaatccgcccttgcgcaagacttgggtggccaaacgaagcgcggaaagtgtcaaacaattctgctggaatgcatcgtgcgcccaattggttccaatattcggtgcgccgtcgtgcaacacacaatccgcctcccaagtgcccaactctttgcgcaccgcatgccgagtcaaaaaataaggtatttaaaaaaatcaatttttgaaaaagggcgggaaaatgataacattttgattcgaaatgaatgctgctcgtgtcccaccttttcttcgattatgtctccctgcaaagtgatgcaatttttgatcggtttcatgggcacaagatcaactcctgcaaacgaaacgacttaagacaaaacattcgctctctcccaccaatcctcagggaagagactggcatttgctgctcggccacttgcagccaaccgccaggcgcagcgcataagtcgacgagggcacgacagcgctgaaggaattcgaagcgtttgttaagctgcagcaatttaaaagcggcacgtgagcggaagcctaaattttcgggggcataaaaagacgtaaattttgtcaaaaacagatgcactccttcacagaaacggacccgcttctttggccaagaagtagaacttgtccttccgctgcttcccgattttcgtttttttgcccattcttaaataccatcaaattaatgcatattccaaaatgtagtaaatataacagcgaaattttaactacttgaaaaaaatacatgacaaaataataattttattaagtgaaatgctctcgatttgaagggattaaaaacataaaaatggataaataaaacatcgaaaacaaaagtgctgt

SEQ ID NO: 398 - DNA, 2191 bp, Heterodera glycines
  misc_feature (2184)..(2184): n is a, c, g, or t
  genomic virtual cDNA Sequence=SeqID_656; coordinates=60..172,215..340, 397..488,537..788
  coding sequence=SeqID_862; coordinates=60..172,215..340,397..488 ,537..707
  peptide sequence=SeqID_1095
agataaagttttgaatgatttaaactgagttccaattgtcggctgtgagtacgtttcagggctcagatggcttcggccgcgccgcccctcggcccttctttggggcagcgaggcgtaaacgtggcgaacttctgcaaggagtttaacaatttgacttcgactattcgatttggtgggttttcgcgtttgtgttttcctacatttgatttataaggtacaaatttgcctgtgtctatccacgtcaaaccggacagaacttacgaaattgacattagcactccgaccaccgagtggcttctgcaacaagcggcggggatacgacgtaaccggcaggaggaaggtgggaaattcaatcgctccgttctttccctggcaaaccctttcaatgcttttcaggagaaatcgtcggaatgatttcggtgaaacacgtatacgaaattgccaaagtcaaatctcaagacaaatctctcattggagtgccgttaaaagtaaagacagccaaaagacaaacttgggtaaattagccgatcttttagaaaatttgtcaattggtcattgagagagcggattcgattggcatcaaagtgcaaaatgaagatttagacccggaagaatataggaaattcctggaacatcgtcaggaagttgtgcaaagacaattggaggaaatagcgaagcaagaagaggccaaactggccagaacatgatcggattttgattcattgttttctttttctcttcagcttatgaatgaacgtcaagttgtgtaattacactcattcgttcgcttccaaattacccttttgaatgacttttccgatgagtgaggggagcggagagaatggtccttcccaaaagggtttcttccgcccgcgcaattatccgtcaccaattagcgcattgggttgccatcgcatgccaccaatcctcacaaaatcctcctcctccaatggaggcgtcacttagcttttccgtcttgcttcttccattggcttttttctcgtcaaatgccttttttggtgggtcccctttttgcggtgctcctccattccctaggcccgtgtgcgctcgctgtttttgctgtcgcccgtgagactgtccatccctatctgattttgcctgcctcccttccaaaggccaccctttgttcgttcgtgctgctttaattgtcagtctccgccggtggtgccgttggcccctgccgtgccctccccctgctccgtttggcatcccatcgcccgtaggtgctgctgccccggcgccgtttctgttcctttgccccaacaattcgcgcagcatcaactgatcatggccaatgagttcggtggaattgcgccagcgccgttcgcagtgggaggcgaaagggccgcgcaatttccaatcggaccgatggaagcgcagcatcaagttcagccaatcatttatgtgatcgaaagtgagttcgtacgaaagaaaaaaaatgccaaaaagtgaaatagacggaaagggcggacaagtgccaacggaaaacgaaagcgcaagcgaagggacaacgacacaaaggacgacggaggaaggaaaagcggaggaaaagggaagccaaaggacgacggaggaaggaaaagcggaggaaaagggaagccaaaggacgacggaggaaggaaaagcggaggaaaagggaagccaaaggacgacggaggaaggaaaagcggaggaaaagggaagccaaaggacgacggaggaaggaaaagcggaggaaaagggaagccaaaggacgacggaggaaggaaaagcggaggaaaaggaagggccaagcagcgaagaatcggctgaagaaagtgtgatgaaagaaagtacaacaataaggacgacaatggaggaagaaaaactattgggggaggaggaacagagcaattcaaagcggacaacgaccaaaagagcgacagcgaaaggggcaaatttgaaacggaaagtgcccccggggctaaagcataacagacgaagggtcacaatgagaacgccaatcgccgagggaaagcgccaaaaacaattcgatgaaagtgggggagaaaccggtttacctcagttcggccccaacgtgtttttcaactataacttttttctatgtcattcaaatccaacaaagttgatatcattcgaaagcttaatgtatttagaaactttaacgaagctattgcttcgcgnattagac

SEQ ID NO: 399 - DNA, 3166 bp, Heterodera glycines
  misc_feature (1513)..(1513): n is a, c, g, or t
  misc_feature (2985)..(2985): n is a, c, g, or t
  misc_feature (3030)..(3030): n is a, c, g, or t
  misc_feature (3089)..(3089): n is a, c, g, or t
  genomic virtual cDNA Sequence=SeqID_658; coordinates=1533..1340 ,1293..1078,1028..839,701..543,492..413,358..101
  coding sequence=SeqID_921; coordinates=1519..1340,1293..1078 ,1028..839,701..543,492..413,358..101
  peptide sequence=SeqID_1146
tttcaagtttttgatttttatatttacaagcaatgtttttttttattttcgggccttaaagaatcgaaaggatgttttccccgccggagtaaacactcacattttctttgtaactcgacgtcctgatgataaggctgcggtccaataagtccaaaggcacaccgtggggagactcaacggaagtgccacgaatgttcacaatgccgcggttggtggccatcaccaaaatgggcgaaaggtccgattcgatgtaacggttgatgaaggagaagcactcgaggtcgaacatgtgcacttcgtcgacgaacagaacacccgggattatttgcgctttgttttcctcccgccattccatcacctttcatttcatttaattttgcttttcgtgtcaatttgtcccctttttcctcacctttttgtcaatttgctccctcacttcgcttttaatttcgcccgtatcgcccgaaaaaaccgccaaatacccggaggaaccttaaaacgcacaaataaacggtgccgtaaaattggaatgtgtttcttacgcgaattgatcacatcaatgtcgtgcaatgaaattgtgttaaccgtttccacgcgggactgaatttcccccgacggacaggcgaccaatttgtcctggggcccaagtgcgtcgaaatcctttgaccgggcaagcgaccgcccaattttcgaaatcttacctaaagaaactcgcattcattggatctgtgccatttgggcatcgaattcattaatacatttgtggaaaagcaaaaggtgggccccatttgggttaaattggcgtcccaatttcactaatgccaaattatgttttcaccggttgccttgtcaatttggatgacgtcgccggccgtgattcgctctttgatgacggattcagtcattttgtttccaatgtcgtaaattgcttccatgtccgttgttttcagagtcaatttcccaactcgtggcccggcacccgactggggacggtcaatttcgagttgtacgacctcaccgcaaaggacctgcaaaggcaaaaaagaggttgtgtctgagcgtccatgccattgtcacctcagtctcctctttgattcgaactccaattgcctttcggaatgactgagtcaatgcttcgggtttactcagatccatggaaaacacttcactggccgaaatggaaatgaagggcgtatcgccgccaattgacttcgaaattcccatggccaccgccgttttgcccgtccccggctcgccaacaattagcaaagctctgcccgcaatttgtccatccttaagcaatcgctgatgaaaatagaatttaaattataaattcgactttaatcatgcgaacaatcaatccggctgccttccgtgccgcacattgtccgaccattccatcggaaataaaaattggttcgaaatttgcctttaagccgagaccagtgatatgggaatgtgcaccgatacgttcgactttagacacatttcttatttcgaaattaccaattcnagacatcggaaagaaaagacagaaaatctacctaattaaatgacaatagtagaaatgcataaaataaacacaaaggaaggaatagtatttacaatttgaacgtaattgagcttaacacgcggtattattttaccgaataaaaaccacaattacagtatgaaatattatattaggtttagggattttgtaatttttttaaaatagcgcttgaaaagatgcgcatttctaaaatgtttctttcttttcttcacactattttctcctttattttcatgtttttccttcgctattttcatttttcttgtgatttccttacaagtgactgtctaaggatactgtattttctttgacgccattaatttcctactttcatttgtcattgtttgaaaaaaacgcgttcggtgcactgtttttttagaatttcggttattgttcgaaatttcgggtgtttatggttcgaacttttaaattccttatagttggtttcttactttcattttcaactttatatgattatattttgattggttattgtcctctaaatgtttttcagaaaatgtcaggctcatcatcagcatcaccaaaatccctcaaagttgagctcaaagatgagccaaacactgatgctgttgactctttgaacaatttggaccaaaggaacaacggacattcaaaaaacttgggtaaattttgaaaacgcaaaatttaatgttttttttattattagaacctggcacgtctttcgatgatgatcaatttaccaaaagcaatgaagcagatgctagtcactcttcacatgacgcgcattccgacacaatggatgttggcgagggattgcccattgagtcaatgattgacaaagacagcccaattaagggctgggaaactcctcctcaggcatccatttccgagtttttttgaaatacattttttcaaggaatctgtcaatggcatggttcaacctcgcgttgtgccacccgtcgggaaaccaacacgctggacaaatcaattagacttcattatgaaagacctgctcaaacaagccaaaaaccacaaacacgcatggccttttgtccgtccggttgacgcaatcaaattgagcattccagtaaaaccctaacactaaaccttaacaaactgcaaactcatttataggattaccacaaagtcattaaaagaccaatggatttgggaacaattgaaaggaggctcaaaaacatgtattattactccgccagcgagtgtcttaaggtaacgtctcattgtccacatgcttttggggcacggaatccttaaaattcttccttaaacgcattttgttagacattctcgattctaagtgttccgttttggtgtaactacgccttgcaattagagagaattcggaaaagtcctgaaaaggatgttttctttttataggacatcatgactgtcttcaacgattgttaccttttcaacccaccgcattttgnggtttataacatggctaaagaactcgaacaatttatgctgacganattgactaaaatcccacctaatgtaagttctttttgcaggattttgagcagatctttgncaactgttacaaattcaatcaatgtgaagatgacgtcaccttgatgtgcaagaatgttgaaaatttgtaccgcgatc

SEQ ID NO: 400 - DNA, 1685 bp, Heterodera glycines
  genomic virtual cDNA Sequence=SeqID_661; coordinates=1612..1272 ,1227..1069,1027..822,778..510,462..175,130..41
  coding sequence=SeqID_889; coordinates=1612..1272,1227..1069 ,1027..822,778..510,462..175,130..41
  peptide sequence=SeqID_1119
ataaacaaacattaggatgcacatctatttcctttatcatctaagccttgaaacctcccaagaaggaagtcaccaaattcttgagtttttcgtcagtcgcggttgtgagttggccttcttctcggatgacctaaagagagagagtatttccctgggaatactttattagaataccttcagcaattcctgctcatgcgctcgaatgtgcgcaaggaattcacgctcgaagcgcgtgatttgagacgggtcgattttgtccaaatgtcccttcacgccggcgtagataaccgccacttgctcctcaatcgccatcggcacgtactgaccctgcttgagcagctcagtaagacgaactcctcggttcaacaactgctgcgtggaggcatccaagtcggatccgaactgggcaaaggctgccacttcgcggtattgagcaagctcgagcttcatcgaaccggcgacctaatcattcatttgtactataaataaaaaaatagtcgagaaataacctgcttcatcgactttgtctgtgctgcggaacccacacgtgacacggaaagcccaacgttaatcgcaggacgaactcccttgtagaacaactcggtttcaaggaagatttggccatcggtgatggagataacgtttgtaggaatgtaggcggacacatcccctgcctgtgtctcaatgatcggcagagcggtcattgagccgccgccatgagtctcattcattttggccgcacgttcgagcagacgcgagtggaggtagaagacatcacctttatacagatcgataccatcaacgtaccaacagaataatacctgggtaagcttcacgaccgggtggacggcgcaacagcagagacatttgacggtaagcgaccgcttgtttggagagatcgtcgtagataatcaacgcgtgtttgccgttatcgcgaaaaaactcgcccatggcggcgccagaatagggggccaaaaactgcagcggcgcagcatccgaagcagtggcggaaacgatgattgtgtacctttcatttaatacatatatttaattacgatgaaaagcaacttcattgcgtccgtgtcagtgagtcgtttcacaatttgtgccaccgtcgatcgcttctggccaatggcaacgtaaatgcagtacaatttcttcttttcttctgtgcttgagttgaaacgcttttgattgattatggtgtcgatggcaatggcagttttccttaatttcacgtaaaaccgagtgaatgtgtggataccactaacccagtctgacggtctccgatgatcaattcacgctgtccacggccaatgggcactaatgagtctaccgcctttacccccgtcaacattggctctcgcacaccaacacgcggaatgattcccggcgctttgacttcaacacgagagcgtttgctgacattgattggaccttttccgtcgatgggattgcccaacgcgtcaacgacacgtccaagcaaagcctcgccaacgccgacatcgacaattgaacctgttcgctttaccacgtcaccttccttgatcactttatcatttccaaagacgaccacaccaacgttgtcagtttccaaattaagtgccattccctaaaaaaaacaatgataaacaactaatgctctaattgtaagattcttgacctattcaactttttaattgaaa

SEQ ID NO: 401 - DNA, 6447 bp, Heterodera glycines
  genomic virtual cDNA Sequence=SeqID_663; coordinates=6096..5885 ,5782..5616,5453..5291,5243..5083,5041..4918,4761..4582,4335..4207 ,4151..4079,3963..3915,3851..3774,3632..3505,3124..3053,3006..2943 ,2864..2781
  coding sequence=SeqID_936; coordinates=6096..5885,5782..5616 ,5453..5291,5243..5083,5041..4918,4761..4582,4335..4207,4151..4079 ,3963..3915,3851..3774,3632..3505,3124..3053,3006..2943,2864..2781
  peptide sequence=SeqID_1159
ataaataaaaaataaaatattttattattttttcaattttttatttattttagtcctcatttttcttcgcaaacggattcctctgttgacttgtgtttatgcacaattctttgcaccactttcatctttaaattctgcactaaatctgttttggataagcattgatcgttttgtggcattggcattccccgttttgtaattttataaatttttattcttgaaattaatctaaccttctttaagttttcgtaacatctcaagattttccggaaaatatgtgattatagccaatgttttttccatgtcaatcgctttttatattgtttatttgtcgtttacttttgatctacaacatcccgaaatgtaactaattaattaattaactaattgaaaataatattttttatatttaaatagtatggtctattgtgagcctggtgatatggtgcaaggtgaagtgtatttgctcgctactcttatcgtggttatttttactttggctacaactgtaatttatattatcatggctattatgctaaagggtaaatttaattacataattaaaatacataaatttaaatgactattttacaattgattattaaaacaatagcttttcatttctcagtgatcagaagtgatcagaacaacagcaacaattcttcacagtcccaaattgaaatcactcgtcgcattttcaaatcattggctgtgatcatggcagtgatcttttgcctttggttcaccagttgtctggtggttaacattgtggggcgcggactgatcacaagtgatccgtcatctcaatttctgatcacacgattagtggtacaaatggtcacaattgcaggggcgatcaatgcaccaatcctatatatttgcaggcaaatttagaattaataataaaatcttttttttaataaataaaggttttttagcaaagaatatcgtgatatcttgaagagtgagttcggttgggtcattaaattgtggtcaattcgaattcaaatttcatttgcccatccaaaaaccaatcaaaatgcttctgctgctgttattgttgtgtcaagaactttgaaaaattcaaacgaaaatcgagtgcatatccgatgaaaaaaagaaaatgttttaatagcaaataattgagccatatttttacaaaattagattaatttatgcctttttagaactgaccatctaaccaattaattcttgtaactccgaaaaacaattttaataaaattattatttttaggatatttttcaacagctgccatttccatgctcttttccacagtcaagtcgtccacaaggcatcccatccacagacaactcatccacatttttctcggataaaaattaaaattaaatgggtgcaaaatgccgatgaaaaataaaataaaattgatgaaacccgccatagtttgagtcgataatgaatttgagagtttgtaaatagtcaatgctttagcaataaatgcaaaaaaaattttttaattttctaaaaatgttctaatctgggcagggactcgaaattgagccaaaagaaagccatattagtactcacaaatcagtgcgctggattacccctaaaaataaggtcggtcggtcggtttcggttaaaaacggaaaaaaccgaaaccgaaaaaaaccgaaaaactcaaaaaattctcggtcggtcggtttcggtcaaaaaccgaaaaccgtaaaaaaccggaaaaaaaaaccgaccggtccgatctctagcaaaaaccaatgggtttaatgatagacccatgtcataattggaaaacagcacagccatgcccatcaccaatcgaaacgagattttatcaattttattttatttttcatcggcattttgcatcatttaatttgaatttttatccgagaaaaatgtggatgagttgtctgtggatgacctgccctgaccccattttctcgttggctaagaatttcttcttacgtaataagagaagctattgtaacttgtgtcatcaatataacaaaaaaatatatatggccctgaatgtgcgcgtgccttttccataaataacaataaaaaaagaatttatttatgaatttgttccagaaaaaaatttgctgttaattaattatgaattcaaatattgaatgcatttagataactgcttcagcatgaaatgaaataatcaaaattagagctaacccccaggaaataggtcagttccagcagttgccaacaagtgtaaagcagggttcttgacccaaatttgaaattaaaaaattcgaaattcctaacatttttacggcaggtttttagggtcactgttgatcttttcgcttctataataaagcctgaaaaaagcaagcaacaaaagacatttattgtaaattttggcaaaatgtttattgtgaaattcacattttggttacaaaagcaaatggcagcactaaaatatcattaaatggcaaaatttaaaaaaaggaaaaaagtgcatataaacacacagtctgggcaaaagtgttggcgtatttgaaaaaataaacaaataaaattaaattactttttttttaatttcaaattttaataaaaggtcaggcaagaagagatggaagaaggcattgcaaaaaactaacacaaaaaaagtgaaatgaaatataatgaaaaaagggaaggagcaataaaaatatgattcggtgccttttgaaattggatgaatttggcagtatgacaattaataaaattaaaaaaacaatttaatagaaaaaaaacaataataattttggtgaaacggcgtttatcgagttgttttggtacaaacttggcagcgcgaaatccgagaacgttgattgcccgccttcagtgtttgactttgtgggatcttaaaggaattttggtggataaaccgtaaattacgaataaattaaatggtaattttttaaaaatacagtagctttacagtaaactgttgctggtcctcaatggttgtcagccagaaactgaatttgttggcgaagaaatggctgaaaatttttcaaaaaatgataagataaatttaaagtctagcaccatgatccccgggcaccattgcactcaatgaacggagttgttcggaaatcttccaggcaagagccgggagagctaaatttagtaaattataaaattaatttaaaattattatttaaaataacaaaaagattattatgttttaaaatataaaaaaaaattaaaaacagaattgagtaaattctatcaccttaggtttttttcgaccaaaaattcgttgaaatgaaattttcttagaacttttaaaattaagcgtttcttgataacattcaagagcaattaatataagtgttttctttagcattaaaatttcaaaaaaaacattagttttcaaaaatgtttagcattaaatataaatttttgtctttttatgctcattttttgaattatatgtcttaatttccattttattatttttaaattgttctttgatttttcaatttttcaaattttacctcaacgattgtccgcctccttccgcgccagcaccggtgtgcattgcaaacgaataaccaatccacaatgagctccatccggccgggcaacttggaatttgaatggattgggaatggacggccataacctaaaaaatgaaaaaatggaaaataaaacaatttacgattattttttaatttaaaaatagaaagagagaaattgcagggaaaaaatcgaatttttttttaattttttcaatttattcgattatttctctaaaaaagttcacatttgacggtgcttcacaaacggcacaacgcgaaatgtacggttcaatttgttgctcattgaccggcatcattggaagctgaaagagaggtaaaaaatcaatttaattgaaattaattttatataatttattattttgtacagcttctcccgtggcaagccaatacgatttgtcgttgcgcgaagcgtaactggaatttgaaacaattaccgtaggaattttatttaattattactggataattttaatttttaatttaaataatatataaattttggaaaattcaagaattttcttttgttcacttgcaaacatcgttgaaatcacaaaacaggaatggcattgtggagaagcgggccaaacatgagccggcatgaccttaattcgtttaattaatatttaaagggaattgcttatttcttaattatcatacccaagtcttggttgtgggccttttcgttcccttccaaatacagcagtgaatatccgtcccacagttttgttgtgtcttgtggacattgcggtacttgagcagtttgtgagtgggtgacaatgataaaaccttacaaaatgacaataatagatgaatttattttaaaatttattttaaaaaaatttgtaggaaaaaatttgatccaaaaaagttttaaaaataattgacctactaatgattctcaatgaattttttagaatattttattttgatttcaaaaactgtcaaattctttgaatttttagttggcatttgattacgatataaaatttttttaaagttatttttcaacgaaaatattaaaattttacttaccgtctctgaagcttggtccggctgggcctggcaagccaggtagacctggcggaccagacgatcctggcatgccctccagcccgggaaggccgggcaagccttgaatgcccttctcgccgggaaagccgggttgaccagggtagccggactcgcccttttgtcccgttgtgccgggaatgcctaaacatttatttaatgttgttgttgttgtttgaatcgctcggttaggtatgaaatatagttttaaaatggaaccaaataaggtatatatgttaaaaaacttaagttaaggttagtttgaaactcgatatgccttcctataccaatattgttcacctgatgggcccggtagtccgtccagcccgggctgtcccttctctccgcgcagtccgggcactcccggcggtcccggcaatcccttttgacctccttgacgaagcggttccgcaccaggcaaaccctatcgaataattttttctgaaatttttttcacttttctacctcaggcccaggtggtccaacagggccgggcattccctgcagtccgggcaatcctggcaggccggagtcgcccttggcacctggcaaaccgggcagtccagactggccagaaaagccaggctcgcccttttggcccgggaagcctgggaggccgacttcgccttgaaattgaaaaacattaagtattttctattaaaaaaatacccacctttagggcctgggaaaccaggtaatccgggcaggccaggtgcacccggcacacatgtgtcacccttctcgcccggcattccaactgggcctggaaaccctgccggtccgggcagtccgtcttcgccgcgttttcccggaattcctggtattccaggctcgccctggaaaaagacacaaaacaaaatttttggttcgaaaatagaaatttctgtgcctttatttaagaatggaaatgataatatgataattatgcaaacatcaaaaatattttgttgttaaattaatattctcttttttttcttaattttaaaaaaaattcttgccttctgtccaggaaatcctggcattccatcttcgcccttttgtccaggtattccaggcagtcccggaaagcccgattcgccctttggccccatcggccctggcgtgccgtctctgcccggaattccggggaagcctggctcgcccttcaccccaccaacagattggcctaaatagataaaaaaattacaaaaaaataaagaaattataattgggaagtcaaaaaatttaaattcaatgaaaaattcaaataaattcgtgaaaaatttacccggtgctccaggcgtgccggggaagcctgagatgcccttgggtcctggtatgccaggcagaccgtcttggcccggtgcgcccgggaaaccggcatcgcccttctcgcccggcattcccggaagtccgtctcggcctggtgctcccgtttcgcctttggagccaggaaagccgggcagcccatccatgcctttgaggccatctggcccaggtggacctgaaaattttaatttgattcttaccggtatttctcgaagtcagaaacagagttacgattccaatccgaggcagcctatcatttttgcaaatttttaattttaattaatgtttaccatgggttccggaccctttgacagcttaatataacacaattaaaaattaacgtctgtgaaatccaagaaaggtatattatgagtgataaatacttagtatgtatgaaaaacccaataattatgaaaatatttgaaaaaaaacaaaaattttcgtaaaaatttattattaaaagccccatttttttttttataaattacccaatattgagggtaaaaaaaaacaaaatttttt

SEQ ID NO: 402 - DNA, 4832 bp, Heterodera glycines
  misc_feature (122)..(122): n is a, c, g, or t
  genomic virtual cDNA Sequence=SeqID_664; coordinates=3115..2925 ,2873..2807,2676..2564,2491..2357,1674..1607,1552..1386
  coding sequence=SeqID_1010; coordinates=3115..2925,2873..2807 ,2676..2564,2491..2357,1674..1607,1552..1386
  peptide sequence=SeqID_1219
tgattttgtacaaaatttaataaccggacccacccggtcgggtatggattttaaaaaccggggttcgggtgttgaaaaaaccgggtatatacccgggtcgggtacccgtacccgtctacccntagaacagagtgaactttaagaaatcccagagggtttctaattttattaaatggacaaaataatttttggtctttttgtgcgtgaacattgctgccaaaagtcgttcattgcataaagagatattggaaatgattaactcattcaattattaaagaaaacagagattcattaaaaaagcatttattgttaaaaatatggcgtatttggcttgagaaatgttaaagcacaacaaaaggtaaaaaatatacagaaataatggcaaataatttggtctggttttgaagatgacaatacaaaaatgtttaaaggttaagggtaaagtaacagccgaagggtttttccttaaataaaataaatctttttttaatctcatacataattaaaacataaggaaacccccaatagattgcattcgcattttgtttttgcttaatgatcagatcagaaatgctccaccaaaacttcgggaaaattctctgacaatcgaatacgtccttgtgccatattttccgttttctgcttaaaattgtgttggcctgccgttctctgcattccttcgtctccgatcggggtggtgggcggcggacccgcgggagggtggcgttgttgtgcgagtggaaaagtcggattgtggggcccgacggaagtgagcgaagggacaggcggaaggacggctctaaaccatgcgagtggtgatgaactacaaaagtgtcaaagttcgactttctccgctgttccgatccactcgaaccgtcgttggaattgttgcttgtttgactggtagtcgcaccgaactgttcctgctgcacccgcgccaatttgttatgactgttgctactcattggcattggacagtaatttggtgcctgttgtcgcggttgaaaagcaatgggcgcgttttgcaagttataaatgtttggggctgtaggataaggcgaaatggacggcatcgaggcatattcgctaatctgttcaatcaaataaaaatttatttatttctttgtgattaatttttattctgccaaaaataccatagaagttccggtccccaaattcgttggttggatgaaattgggttgttcctgggctctgtttgagtaaaggactgtcccctgttggtggggattggctatttccatgtgttggaattggttttgcatgttggacaatgtgccgtcttcgggaaacgatgcacgcaaattgagcaattctgaaaagaaaagtgcaattaatcagtacgattgtaataaataaataaataccacctgcgctttgttccccaaaaatgtaataacattgttccgtgaaggtgaccttgttgaccacatgtgcaatgaatttgtccttcagcagccccgaggcgtatttcctcgcctcctttcggtcgtccaatccatcgacatttccaataagccaatcgatgagagcactgcctaaacacacggaaattgctcttgtttttgtgccacaaagtttgtcaaacctaccgagaaaagacctgggaatggggattttcagccacgttcgatcgcgaatgtcgaggccggagttctaaagaataaaggtaaaatggagacaaagtgcggcgacagtgccaaaagtaccggcatagccaatgtttggatcactttgcgtttgtcactgtgtacgtccagccgatgttgctgttgcatggacagaatgactccgcccgggccgacgatcgtttgagccgcaccgccgccggaccccgtcgaagtgctgctgctggcgggcctttggctgggaacggaagtcggcggtgcgaaagtgtgcagaagggaggaagacgtaggcggaaaatggccagacggaatgggcgttggcgtaccctccgaaccttaacttaccaatgctttaatggttgaacaaaaaccccaaagttttgctgcacgagggaccatactcatgattagttcactttgacaaattttggctttcatttactacaatacataaatattattttagtttaacataatcaaccagttttgagccaccttttttattttgcccttaatggaaatcaacccaagcaacaaaattcgtctgttatagtcattggtacctaatttataagtattttccgacaaaaattggagtttcattatcaatggaaaacaaaaattcttaatgcctatccaaaattgttgtccgttgttcaataccaattcccacccaaattaccctcgggaatcgcgttcatcgcattcacaagagtgctggtcatgcccctgactgcgttggtgtgctgaacccacgcgtgggtgtcaatcggtctgaccggctcacgcgatggcaccgaaaaataattcgttcggttggcatcgaagcttttagcgactgttagctttatcggactaaaggtggtcagatttggcgttgtttcgtgctttcactttgattaccccctcgtgttcactgcccttttgagcacttcgactgcctggtcgttcttgaagttctcgaaggatatgtcattcacctgcaaaatcatatcccccggctcaatacgaccgtccaaagcaaccgcaccttataattgaaacaaaaataaaaacgaaaaacaattttccattaactcaccgccgggcataacattggcctaaaatgggattgcgaagggtagagcttatcttgacgggacttaccacataaatcccactgtcgccgcgaggacacgactgaccaacaatggaaatgcccaaaaaattcaccgtgttcatgttaagctgcaaatggcaaaatggggcaagtgtccccccccccaattccctctttaccgtcacagtaatcacttccaatgccatcgaagtttccgtcatagacgaaagtgaagaagttcgcgatggttggcgacgagttcgctggttctgtcttctcctcctgcggtgtatgctgtagtgctggcgtgacactgaagtgatgttgtccgttgaagttgacaaccttaaaacggtgccacaattcattgcttaaatcaggcattttatttttgggtgccatttgctgactctaattccgattttgcaattcgaatgtggctcagaaaccataaatttgatgagttgccaaatgcggcgccgccgccatttccgttgctgctgcttttgatacatttttttcttgaatgaccaacatcccgctcatcctcctcacattcatcattgccagaataataaccactcattaatgacgctaattattcaagaattcattagagtactaattaactccattatcacagcgaaaatcgggaattgagaataaagctagggtaagtctcattttatatttgggatttgttttcgggagcagttcgtttccaactccacggccgaaaaattttttttttcaaatctagaaatttgtaaagaaattttttaagcgattttcttaaaatcttatgatgaatttttagcttttgaaaaaattcccgggggaaataatacgggggggggagaaacggtgcttgtggaaatgtaatggaccctttattttctcccattccattccagatttgacaaaggatgaaatgcaaagcgattatttacccccggggggcagtgatggccaatggcaactcctaagggcgtaatccttcactgtcgcactcgaaagggaaagaagttcccgtccccgtctctctttggttggtcatttaatgcagcaaatggacaatccgtcacaacaaaataactctttttccggggggggggggcgagccgaaagaaaaccgcagcagtataaatgcgtgtccagacatttgctcattcaatgaatgtgccaattagaaatgtccatttgtcgttggaatttaatcctcccaattttgacattttacaattcattaattaataattttcaactcaccgtgactcatcgtccgaataaatccgtccttccgtctctgttgtgtaaatagtcgaatcttcgaaggctttatgacggttcccttaattttttttctacttccttgtaaatcaacttcaaaaaacataaacactccaagaccgaatatgatcagttccaccctgacatggaaatttatataaaaaattagcctaaaattagaaagaaaaattcgcccaatgttttctataatgtcgtttttgactagccaataatttcgaaaaaattaaaagcacctgagataatgtgattatcaagtcgataacgaggacgatacaaatgggagtttggaataggataaagcggagcggggccggggacctgaaaatttaacaaataacttataaaaagcagggacggtcccaggattttggcttgggggggggcacctccccccgggcgacgaccttttttttttttttttgcttttcacacccgttttttatgtggcgcggtttttgcaaaaaaaattttgggggacagggggtccggcggtgccgataggcgccgccgggaaaatttttgcggttttaaatgcggtttgttaacagattttgtccaaaaaatgaccaaattttgtgattttgagccatttttagcagattttcattaaaaatttgtggattttttgaaaaatttagcgacatttcttggaaaatttgggtgaggccaggtctgtggggtgggggtaccagcccagcaaggaaaacctaaaattttcagccaaaatattatttttccttaaaaatttttggacccgggggggtcttggggggggg

SEQ ID NO: 403 - DNA, 5370 bp, Heterodera glycines
  genomic virtual cDNA Sequence=SeqID_665; coordinates=4660..4587 ,4533..4448,4406..4280,4232..4038,3955..3865,3818..3715,3670..3525 ,3483..3042
  coding sequence=SeqID_995; coordinates=4660..4587,4533..4448 ,4406..4280,4232..4038,3955..3865,3818..3715,3670..3525,3483..3324
  peptide sequence=SeqID_1267
atccattcgaaaaacacccaatccaaccaataagcgtctgtttcacggcaccccaaacttcgttttctctgtaaatcctgcggaagaaacccccagcagtcaacttacattaatacttaacgaaggcacttaaagaaaaaagggggaggaaataccggaaatccattgaaacgaattaaaaaagattttccgagatgaaatgaaaatgcaaaactgcacagtcgggaagagaattacgatgcaataaatagcaaataaatgacatcacacaaaagtcatcctctaaatatcaccagaaatttcagtcagtgaaaatgtacaaaccaaagacaattttggcaaataacttacaattagccgtcaaatggaactgataaaagataaagcgtagaattttggcgtctgtccatctctttgcttctctggtgtgagtctctctctctatctctcttccgcttctttgcttacgtctccgtctcattccgctgactttccctgccgtttgtttccgcatccgttgcgctgtcggccgatgtcgaaaggttttgcgcaaagttttcgtccctttgcgtttgttgaggggctatcccgggagagacgctcaaatattgctggaactgcagcagtgcagcgtccaaaagggtcgaaatgttccgcagggactgaatgcgcgcctcgaccgcccgtctttccgtcccttccattgcggcaatttcagcatcactgagaccggcaaactgaaaatggcaatggcccagtgaaaacggaaacagaaaacgcaccagcggaggttgtgggaaaggcagaaacggagggggcggaggcaaacccccgaaaggctaaaagaggggaaagaatgagagacaatggcaccgaatgtacaaccataaagaaaggctgctgcggagaccacgggaagtgctgcgcttgttgctggcttggctgctgcgtcccatccgttgctgactgttgcggctgcaccctttcctggtcaagtgtttgaggctgttcaccgacggaaccattcgcaagcgatgccgccgcctgctgttgctgttggggattctgctgcgccttaaattccattctgattattcatgccacagttgagaagtggccacctgttggggttgtggcgccccaaattgtggcggaggcgcaaaggcaaaaggcggcgccaaaaagggcggcggatgttgtggcgggaagttgttctgttgttgggccgctccaaattggaattgaaactgaaatgggtgggcaaacggcggaagaggagcggcgaagagacgctgggcctggggtggcggcgcattttgtgccggggcagcggtagacggacgccgttggactgaacgaaagggcaaacatttccaaactgaacgagcaaacaactcaagacgtcggttcgacaggtcggacaagtctgttgccgctggaaccacgagcggagacagttcgggtggaagatgtgattgcatggcaacttcttggcaccactttcgacggtcatttcctcacgacaaataatgcatgtgttgtcatctgaagagtgaaaaaggcaatggcacaactgactgatacttttcttctcccactttctgcccaatcctgcgctgttgccagagggaacaaattgttcatggcatttatggccctccttgacagaatgacgtcgttgacagcctttcggaaggcacgaacggtcaaataaaagggacggatggcgaacagagggaaagtgtgcatctggaagagcggtgagaaagaaatgtataaatttttttacaaactttaataaagcaaattttccaaaccaacactataataaaaaaagtttaaaaatattccaaataaaaaatttcgtaagaaaattaataaaaattgtacatgttgaaagatttttttaaattaaagtttgaattctctgtgtcacaacgaaccttcatcataacagcagcaaaagcgaggtaaagggcacaacgaagaaagcctagaaaacttgcagatttcaggaaaggagaaacaaacacaacttgtcagcagctcggcatataacatgtacacagctttgttttcccaggggtgcggcgaacgcaaatcgtgcaaatgcaaaatgtaattgatggtcatatgcgcaaccattgtgagaagaacggcgtactaattgaggagggaagtaattaacgtgcaaagcctcttttgcaattattattataatcataatcctattttgataaatgattccaaattaggacctcaaatccaaacacaatttgagcgccggccccccgcatcaaagttgtgaagaaagcgtgagaaatgaagtaagagtcaatggcactgagaagggaaatgatccccagaatcctggcatggaaaagcaaagtgagcatgggactcctctccttaaggtatgtaaaaataaataaaaatgtgaaagggtgtaaaaggaattgaaaattaccatataatcgacgcggtcctcagcgagccaatgaaatgcttttatgaaaaaaagaacaacaaactgaacaacgaacaccggcgaaaagtcatcgcgaaaaacggctgaataaaatcaatgaattcgagtcggacagaacacgcacttactgaatgccaaacacgtctccatcagcgtgtgccaaacgcgttcctgggcacgttcgacctcggccactctcagctggccgaagaaaaggcatcgaagcaacgaaaagaccaggtaactgaggacggctgcttggaagtaaaggacctaaaataagcaaacgcaaatggaaatgaataggggagagacgaactcacggccatggaagtggaactcttggaaagatacacaacggacgggtagaactgcttcttgaggaagaaagcattcaaaatggtcaagacggtagagacaaagcttgccaggaccacaaatgacaccgaaattcggaccattctctttctttcttcttaaaggaactgatggaacgaaggaacagacagacaataagacagaaatatgagaatctttctaagaaacgaacaaatacataaaataatttattcagaagcggaagagtcgcaaagctatcacatggactaaagaggagtggaagagtttaaacagaagaaggaacgggcgaatggaaccgtcacaaagcgattttcagaaagacctaatgatgaccaacaattaacacaataaagaatgggtaataagttaggaatatttggtcaatgatttgactgctgtttaagagaataaaattctgtgagtgattatgatgacaatgtgaaggaatctccgcagaactgagtttatcagccgatcaggtgaggaaaatcacaaagaacacaaagaatgccatcagaacgccgaacactttgataatcagccaacggttgcgggaaatgttgttgaaatacttgagcaactcgtggtgtgctgcctccacgttgaggctgctctcctccacatttgagtcaattctacataatttaaatttaaaatgaaaaccaattaaaccaacctcgtgatcatttcgccttgttccgagacgagagtggccaactggcggaaaatcgtgcccagctcagagatgctgctttcaatgctttccatggcgttgaaccgggattggtggaactgctcggtatcgtcgagcagtaaagtggtcttaaaccaagtgacgtgttccgctactctcccattccgtccacctgttcctgcacccgctgttgctccaatttatccatgtccaacgcaaaggtcgaagaaccgctggaagcggacgccatttcatcgtgcagaagaagcgaacccactgaaatgaagcaatttaaaagaaaaggcaattggtaaacactcactttgtccattgcttgtcgaagggggcaaattcgaaggaattgccgccgactgactgaacttttctcgtctctctcttttgaacttcaaattctaaaaatttacaaacttggtgtcgtaattaaaggactgtcaatacgaaaatttcctcctaaaatccgtccctcggttttacctctgttcgaatctccagcacattttggaagtttttgctaatgttggcgagcttcgactgcaacccaaccacaaccaacttggagtggttttggctttgttgctcctgccgcaacgaaacggaagagccgccggaagtgcggtgagtggccaattgctgcaaattggcgatttgtttgttgaggcccgtgatgtcctgaaaattgtttggtcaaatgccacctccataaaattttcaaaaacctgtttgataatttgtgaaagttcttcaacttccccagctctgtcatcgaacaatgattttttcttggccaattgtgccaatttctccattttggcacatgtcatacttaaatcccgaccaatgcgccttaaaaccgattactaccacagaaaatgctacaaaacaacttggccaattggttgaactgaattgaagaattaacgattttttctcgttcgctctttcccatatatccatttggctgctgtcgaagctgccaattaatgtaatttcatatttattgttaaaaaaatccaacaaaccaacctgacatgactttgccactgttctgaattccgccgttcggtcgcgaaatggcatttcggtcggcaacaacaaattgttcttgaaaaataaaattgggcatattttatcgttggcaatcgcggaaaaaaattaagacatttttaagaatatatattcatttcactttgtgtccgttttatggataaataagcgtggccaaaagatactggtgggaaatatacttaaaaaaactccaaggtacggataaagcaaagaaaaaaaagcaagtcaaatacaaataaaagaacttacattattttcaatagaagacaacgatttgctgttaatcgagtcggctgttacgtcgtttgaaatttgatcagtaaatgattggatagaattcttaattttgctgattttaaataaaggattgttagcccatcaatatttacttgtgcaatgttccaaaaattggacgcagctggcgcaattaatgatgaaagatttgcgaaggacgaagaagggatgggttgtgtcgcgtgtggatgttttggtcgctgttgcggcgaggagggaatggaaagaccgtgcgaaggattcgactgcaaaatatgcgaagttccttcaaagtcagctgagctgttcaaactgctgatgttgttgttattgttgttgtgacgtcttcgtgcctctgtcgagtaaaacggcaattcagacattcattcagcaaaaaatcctttttaataaaggctttattaaagattaataaaaagaaaaagggaccggctggctaacattaagcatt

SEQ ID NO: 404 - DNA, 4396 bp, Heterodera glycines
  genomic virtual cDNA Sequence=SeqID_669; coordinates=217..348 ,631..725,948..1083,1204..1323,1394..1436,2046..2354
  coding sequence=SeqID_1019; coordinates=217..348,631..725,948..1083 ,1204..1323,1394..1436,2046..2206
  peptide sequence=SeqID_1226
tccccccccccccgaaaattttcctggctacgggcttgttactgaatctaattttactcttctcttcggtatcttttaatccaaatgaaaaatgatgccctttcgttaattactaaaatttcttcagatgacgaggaagaggaggaagagaatgccgggcccacccgaattgacatggaagtggcgcgttgccgcgccaacctcggcgaggagggcccctactttgtgaagatgcccaactttctgaacgtcgtgtcaaaaaaatttgacccggaaacgtacgaggacgaagtggaggaggacgacgcgctggacgaggagggacggcgaacgcggctcaaagtcaaagtgagccaactgaataatggggccgggaccaaaaaatttgatagtaataggccagcactcacctctcaaatgattttatctataaagtaccccccccccccccgaaaatttcaagaaaaaatttttgaaaaattttcagctactttttttgaaaaattttcaatgaatccaaaaaaccaaaatttcttgaaatatactggccattaaaaattatccgagaatcaagatcaggactcgaagcattgggaaagtgctcttgacaaatcatcccccaattctcagatggaaaacacaattcggtggcgcattgcgcgcgacagtcagggggaggagaagcgcgaaagcaatgccaaaattgtgcgatggtcggacggcaggtggacaaacacttttaaatacaacagaggaaacaattttaaattgcaacccgaattaaaaattgcaaattaacataaaaaattttacttttcgaatatattatactctcatttgtcagccctttattttttgaaattttttaaaaataaaattccccaaggaattggttgggacaattcgtctttgttccatggttcccttatttgtccccactttttcagcatgtccctctatttgggcaaagagatcttcgagattgagaagcagcggctgatggacaacaaccatttgtacacgcgccaagggaccgcgctgcaggcgcaagcgctgttccgtgaaaaactcattttccgcccggtaaacacaccgacaaaatgatagattttgaagggtttttcttcaaaataaagttgacgtggtcaagcggaatggaaaaaagtcatcccataaaaagtcactgttttattttctctgaagcattccaccgaaacgatgacccatcgcaaaatgacgatgaacatggcggagaagacgaacaaagcgcagaaggtcaaagtgttggcgcaagttggcgacaaccccgaggcagaacgaagggtgggccaaatatggaaacattggcatttttcaatgccaaaactcaccaaagtttgcatattatgtctaggaactcatccggacggaggaggaaaagctgcgggccgcggcgcgtcgcgaggcgcagcagcgacggatcagagaacggccgcgcatggccggactgacgccgggcttcctggagggatacgagtcgggtaaacagtttgggaagagacatttgttagtggacaatcattgattattctgctttttctatggttgataattgtgtgaaaattgtcagtgacaaatgaggcaaaaactaattgccttttttaaaaagcgcccaccattatgcctatgagtttattaagtcgcaaagttttgaactttggattttgtagtttcgctatgattggttttgttttgttttcccaccccctccttttagacgagggcggcgagtcgttggcggccataaaacggcgttaccaacacgcgccgtacagtgcggggggtgcccacgacggcggtgccgccggccgtcgttcgtcgatggcgggcggccgcggcggctcctcggacgaatcagcggaagaagaggagcgcgatcgacgggcgcgcaaggcgataaacgaggcgaagatttacagcgacgacgaggaggaggtgggcggcgcgagcggcacagggccgataaatggcgacggcgcgggcgacgactcggacgcggtgagcagagttgacagacatggcccccaatgggcaaaaacactcccatttattttttccaaaaaattgccgaaaagaatcaaatatttgtaaaaaaataggagccaacacacaacacaaacagcagcagacatcagcctcaacagaagaagaaaattgtcatcgatgaggacgacgaatgacaatggcacagaacagcgaagggagtgacaatcggcgatttccccaaatgggggagggttttttggcagaagtcgaaaaaatgtcaaaatatggttttttgtgctcaaaactttatgattaaaaaacgcggccagactgtatgttcaaattgccttctcagttccaaaaaatcctgaacaacgccccatttttagtgcattttgtctttggttcaaagggtttgactgatttgacaacgacaggttcggaagcagtacctccgatcaccgtataaccagctttacaaactcttgctttcggattggatttggtgcgtgcgagggatttttcgttcggttcgaccactctttgtctaaaatgcaacaaaaagtaaaatgagtttcctgaaactaattatggcagaagatagagcgcccacacccaataacactttgcttttgagtaaaatcctatttattgctccccccccccctcatccgtttctgtgtttggttagtaattttccgtttttttgcgtgtcattcgtcgccccccccccccaaacaaaaagaaacatttgattccatttccataaattatggtgtgactgattgatgactgacattttttgtgtacagatgaaacgtgtaaaaacagcacaagcccaattggtgggtaagacccccggcccaagcattgaaaaaccctccccattttgtcgacgagtcacttatttttccgttcccgaaactctggtataattttgggctttcaattcaaaaaaatttcgccatccctgtgcgtaaatgactaaaaaaggcgacgacgaaagcggcggtgaagcagcggcggcaattcgtgtgctcgtgacgggtggcaccggactggtcgggtcggcaattcgacaggtgctcgtggcgacgggttgtagggatgccgaaatggcacgccaggcctctcaatgatggcaaaatgacaagcctggctgaagatggcacttccatcccccgcccccccatatttattttgtcgttgaattttgaatttgccaaaggtggtgacggaggaggagcagcaacagaagccccagcggttgcaggagcagtggtttttcgtgggcagcagcgagtgcgacctgaccgacttggagcagacgcgggcgcttttccgccgcgttcggccgacgcacgtggtcaatttggcggcaatggtcggcggactgttccacaacttgcgccacaacctccaattctttgtcaagaatttggtgagacagtgccaaaaagaaaaataaatcccacataccgtatccatttgggtttactgtattttttgaaagggatgtctcaatcatgggtgggatgttctattaaagaaaactgtatcttaattaccatatgtcttcccgaaggcgatctgtcaaaatgttctccaatgctgccatgagactgacgtggaacggtgcgtttcgtgcctttccacgtgcattttccccgacaaaacgccgtacccaattgacgagacaatggcacgtgaacaatgaacatttatttatcttaataaattttatcgatcatatggttttatcgtattcctaaattacgactcccttttctctaaaataaagtccctcttttgaggggaattgaaaataaagcaccggggctatatttctggtcaaaaaaagggaaaacagagataaaagtcaaattttagagggtctcaaagaaaagcgtgatttttcaggtacataacggaccgccgcatgacagcaattttggctattcgtacgccaaacgaatgatcggtgagttgcaatgatcagctaaataaattcaaatttccaataaacaaacagatgtactcaaccgcggatatgctcaggagcacaatcgaaagtatcgagaaaaaataaatattttatttttgattaaataattttaaactttctctctccctctctctctctctctctccccgatctctctctaataattaatgcgtcgagattgccgacatttttgaacgagtgttccaaaggtacacttcggcagtgccgtgcaatgtatttggaccgcgtgacaattacaatttggagaacggtaagagaaaacgcaatggacagaagagcacagacaaatctttacggagagggaaaaactgggcaatgcacgaaaatatgaaaataataataaaa

SEQ ID NO: 405 - DNA, 2988 bp, Heterodera glycines
  genomic virtual cDNA Sequence=SeqID_671; coordinates=599..725 ,773..887,927..1046,1166..1308,1361..1462,1510..1629,1840..2016 ,2157..2207,2254..2371,2415..2587,2827..2937
  coding sequence=SeqID_901; coordinates=621..725,773..887,927..1046 ,1166..1308,1361..1462,1510..1629,1840..2016,2157..2207,2254..2371 ,2415..2587,2827..2937
  peptide sequence=SeqID_1129
attttcgacgaaaattttcgaaaaatttttactagggaaatggcctaaatacgtgaatagggaactggccatagggaaacggtcatagggaaacggcccatagggaaatggtcatagggaaatgagtcgatcccttgtcaaacacttgattataaatattttttagagggtcacaaattatctatgcaaaaccaatgataccaagcacaagggcgtagcagccagacccttggcttcggagggggatgaagtcaaaaactcgatttttagaggtgtatttttcttttttcagtcgatttttaggggtgtatttttcgttttttctttaaatccctggggtgtattacaaaaattttagttttcgccaaaaaattactattttttgcaattttggtctccaaatttttacttttttgggtttcggggcgggctttagcccctcagcctcccctccccctgcctacgcccttgaccaagcattagccaaatatcggttaatgccgaattactttttgattagtataccacacctcattttaagtgatgtaccactttttaatctcgcatttgagagctttacattttcttccattatctatttaagcatcgttttcaatattatggcaacttccgaagcacccaattatgcattgtatgaacatgcagtgggttacacactattcaagatcaaggaatatgaagacattggtcaaatacaaccagaggttttcatagatgactaagggttgtacatttgttttaaaatttataggtgcaaagtgcgatgacagatgctcagcgttttcaaacgattgtccaagttcatgcatttgacccattcagaaacactgaggcggcgcttgaaaatgcgaataacattgcggaaggttttgttttttattttcttgtttgattattgtttttagggattatccacgttgatttgctgaactttttggaggctaatctaccgaaaaaaaagaaaaaggttctgcttggagttggtgatcagcgtttgtcagcttctctagtagaggcattaccaggtacattttatttttgcgaccaatgaaagattatagcaatcatcgaagcacgaacccattcgctctttcatggaatcataatttaagcgaaaaccatttaatttttcctcattttttatgtattcgtgttgctttcaatggcgtcgtgcaggaattgcttcggggcattcggatgcattttcgcgtgttggccaaggatttgccacatgcacaactcggaaaggcacaactttcattgggccatagctattcgagatccaaggttaattcaataattggtaacggatggataatatgaagttctacgatttaaggtgaaatttgacgtccatcgtgtcgataacatggtgatacagtcaattgcactgcttgaccagctggacaaagacatcaacttgttcggcatgcgcatcaaggcttgtccattccatcgcgaatttattcccgtattgtttgaatttaggaatggtacgcttaccactttccagagttgattaaaatagtgccggaattatacaaatacgtgtgttgtgcaaccgcaattatgaatcgagaaaaaatggatgaagcggtggaaacgaaagtcaaaggtactaccgagaaaatttgacaaagtttaaacacaacatcactctgtacactaattgtattttagtttggtgaaattttgaaacaagggggtgacgtcactagttcggaaaatgccaattttgatttggttaaattttatttttgtttcgtggtgggccatgccgcctcaactctcacttaatattgtaatttcattttctaacaagaaaaatttaaagagattctggaagatgaacaaaaggcagctgaagtcattgaagcggctcggacatcgatgggaatggaaatttcggaaatggatttgcacaacatcgaactgttcgcaaaacgggtggcatcgctttctgagtatagacagcgtttacaccaatacatcaaggtcaaaatatttagaaaacaatatctattttatgatataaaattatgaaaaacgaatttataaaacaattacttcacttttaacttcgctccttaccaaattcattatatgtccattaattgatatttctataatttaaggatcgcatggattcgtgtgctccgtctttgtcttcattaattggagaacaggtacaataccaatttccgtgttaagaaacaaatcgctttgttttgggtcggtgctcgactgatctctcacgcgggaagtctcacaaaccttgccaaatatcccgcgtcgacaatccaaattttgggcgcagaaaaagcactcttccgagcactgaagacgaaatgtctgattctcaaatatcatatttttgaaattccgattttcagcaaatacgccgaaatatggtcttttgttccattcgactttcattggacgcgctcaggccaaacacaaaggtcgtatcagtcgtttcttggccaataaatgcagcttggcctctcgcatcgactgtttctctgatgttcctgtgccctctttcggcgaagcattgcgtcagcaggtaagcatatccgaaaataaccaaacatgaggaaggtcaacgagaaacactaagggtcgggtttcgataaacgaatataaaacaaccataggtttatattgaaaccataaaaaaatatatgattaaaaaggggaagcaaattaagattgttcaaagctgcttttttctaacaatgaatgagttatttatttgacctatgtaataaatgtttaaatcttaagatgtcaattcctgtttaggtggaagagcgtttagtttattacgaaaaaggagtcattccgaagaagaatcttgatgtaatgcatggagctgttgaggaggcgacagtcgaagttgaaaaggtgtcttaattaaaaaataggttgaaaatcaagaatttttggttttatagtcattccggc

SEQ ID NO: 406 - DNA, 3902 bp, Heterodera glycines
  genomic virtual cDNA Sequence=SeqID_672; coordinates=3902..3802 ,3735..3619,3565..3406,3117..2984,2927..2867,2814..2678,2337..2220 ,2174..2069,2002..1853,1772..1573
  coding sequence=SeqID_937; coordinates=3902..3802,3735..3619 ,3565..3406,3117..2984,2927..2867,2814..2678,2337..2220,2174..2069 ,2002..1853,1772..1681
  peptide sequence=SeqID_1160
actttattatcaatagggctgccaaaaatatgcacataaaatcgtaaaatatgcaccaaaaatcgtgaaatatgcatataaaaagtgaaaaatatgcacataaaattttccaaattgagggtgtaatttctcaaaatttcttcaaatttgttaaacataaaaatcttcaaaaatggctaaatgtggtattaaaaatcattttaggagaaaaaaaaacatgataaagcaaaaatttactcattttttgcgaaaaatcaaccaaaaagcgaaattttgctttttttgcttatttttgacataaattaaccatttttttgagaaaatttatttattcaacatttttcgtgaaaattttgctaaaaaaatttttttttttggaaaattttccggtttttgaggtcaaaaaggccaatttgtctgttgggggccgatctattagaggttttttggaaaaacgccaaaatatgcacataaatcgcgaaatatgcacaaatatgcacatggaaagtcatcctagaagcttcaaatcaagctaaaaacatgtttttcgtgcgcttcaggcttcccgcaatccaggaaaaaaatatgcatgtgcatatttttggcagccctaattatcaatatgtatgtgtgtttgtttttgttttttcctactgaccctttgcatttcaatttgttggagcgattgcattgggcgggggttgtaaacgaactgaacgaattggcgggcattggcggcaatgaaaagggtgaggaacagcaaaaaaaaaggtggcggagagaatggaagacgaagcatcggagggagggaaaggacggagaaaccgacctaaaggggaaaatgccaaggaaaaatgccgaaaagtgacgaaaggattttgggaccatcagggaaatttgagcaatttattctggttatgcatgtaaattaagagatttggcgacggaaggtcatttgggggtaaatgcgaagcaaaggaaaaagggcggatgggcgagacggagcaaaaggcggagggaaagggggggagggactggttttggtgttggtatttggtacatccgacggtttggcgccgtcgcaacttatgggatgatgacgaacgctcaatgcaaaacgatgacaataaataagtgaacaacggagcaattgcagaggatgagaaaggcgaaagaaagcgggaaaaagggacaacggaagcggaaacaaacggagaagcggaaaacgaacaacaaccaaaggatggataagccaattgcgttacttctgaacaattaattaaggaaagaaagtccgctcccatttgatactctctaagcaatcggaatttcgagaaacaaataaaaatattgcggtgagaggtcgccgaatcctttttcattagttgagggatgttatacttacaattaaggttatagaaaaaatcggcagattgggctttatagaagagtaaattgggacaagtgtcgcctctccatcctttcagctttttgttgtgcaatccttcacttaaattttcgcttgaagagagaggtcattgagtttcgatttggtgaatccagaaaatgtgagaccagaacaatatttattttttgttcaaaaacaatttcctgtaaaacaacttatatgaatgaatatttgcaaaacaacagtaaagtcgcttaaactctcacttccttctatggcgttattcttttcgggtcgcgcggaaaaagactggccaaacgcacgttgggcaacccaaggaaaagcatcgtcacgcgttccaaacctggtttcaaaatatgtagtaaaattacggagaaaagatgcggcgggaaggggggggggtgggctgctgcccccatttaccaattcctccccccgcatgtggtgggcatccaaatctgaaggcgtctatgtatgactgaatcttctcaatgtctatcccgtgcagtttggcacgttcggtgagcattgccgagtcgtgaacacgctgggcaccggaaatgatttcttcgcctaagaaaaagaagaaaatgatgtgttagaatccacaaggataaactactctcaattaggcaatacctctcatgaacatgtcgtaactattggaatatttggtgtcatttgggtcgggcattgtatagaaagggcggacagccaatgggtatttgtccagaacatagaaatccttcaaatttttttcatttccctcaacactgattccgtcactcaccgtttgatatttctcacgcaccaatctgcccaaaagtttttcatttggagtgctcaagtcttcttcatctccctgctcaacaccagctttctttaacatggccaccgcttcggggtatctttatgaaagtaatgaaaaatagaatgtgagggaatttgcagaatttaagtcaatttaaatgcactgattataagaatgtaggagccgtagaacatgatgagcacatccactattattattttacccgtagaaagcgacaatagaatagtctttgtcggaaaagtttatgtaaacgaattttcaagggcaaacgagtaggggaacaaccaaatggttctacgaaaaaatgatgccaagaagattagacttaaaagacccattggagaaaacaaaaccccataaatataaaaacgacggaatgggagaataaatgtgaaagtgtatttaaaataactcactgcaaaacgagtggactttgtgtaaagagaaacggctcggctgggtattgccgacggactgcttcaatttcagcaatgtaattgcattgcaaatatttgaacaggtcaatgaacatctcagcaatagtttgaagaaccttcaaagcacggtaaaagaatgagacgatctaattatggtgtatggcctacttcgtggtaatggaaattgaaagccatctcaagatcaaggccaataaactcggtcaaatgacttaaaaccaaagatgaaataatagattaaataattctccaagaaaattgtcctaccgatgcgtattactgtcttcagcccgaaaaacggagccaatggtaaacacgcggccaaagtccccagcaattgccatttgtttgtaaagttgaggcgactgagccagaaaagcatggcctttgaagtaagaaaccttaaaaaagataaagatataatcaacacataaattcatcctaaatcttttcaaagaattttttaaattcatcggtacgcaattttgacaaaaaataatatatgtcactccaaacgccaattcgttgctaatcattaacgacaacgggcacctgacggaagacattttcccaaatggaaatttaatttaggcatttattgtaaagaaaatgatggcatattcaattagaagagattatgccaaatttactaatgccgtatgcattttaaaacatttaatatatccaacctcaaaaacgtttgcaccgccttcactggcagcagaaatgattttgggagtgtgaatttccatgaaaccgcgagaggacaaaatcttgcgaaaggcgtcgcaaactccgccctgcaaacggaaaattgcctgactcgtttgcgttcgcaagtcgagcactctaaaaatgtgaaaaataaggaaatggacttgtcatgcctcccttcgttttacctgttgtccaaacgagtgtccaatttgactacggccaattcctcttggtcgttgtcgggccgaaccgcgtcttcaagttgaagcggaagccgaggctctgcttgcgagacaatgaaactaaaagccgaacaaatggcaattgctaatgcactgcttaatctttgccatcagaggagcactcacaatttgtgcactttaatctcaacatcgctttgagtgcaagcagtgaccggctgaggggtgcgcgccacaagcccataaacatcgacaattgattccttaaa

SEQ ID NO: 407 - DNA, 4266 bp, Heterodera glycines
  misc_feature (4132)..(4132): n is a, c, g, or t
  misc_feature (4170)..(4170): n is a, c, g, or t
  genomic virtual cDNA Sequence=SeqID_673; coordinates=3299..3123 ,3025..2840,2787..2494,2442..2231,2169..2018,1944..1840,1794..1635 ,1585..1324,1247..1074
  coding sequence=SeqID_907; coordinates=3299..3123,3025..2840 ,2787..2494,2442..2231,2169..2018,1944..1840,1794..1635,1585..1324 ,1247..1074
  peptide sequence=SeqID_1134
agtccatcgtggtacgctttcgcagactgatcacgtcgaaacgcccgtgtaagtctggccaatccagcgccaattcattggcttccgtcccgattgacgaaaagcacgagctgaggtgccgggcattcgtccgaccaattcctccgcgtattttccatggcatccgtttcgtaaatggtcggactgtgccacaacaaatccgcttgctcctttagtcgggcggtcacttttctaatgcaattcgttggcattggcattaatttggacccacgggtggcaatggccgacagaaacggtgacaattccgccgatcatgtccaaatatttgttgccctcaatgtcccacaaaaattgcatctttcccctggcaattttcagcggctgtttgtaataagcaatggacgaagcgggcaaaagaaaacgacggttcattttaagcaaaaatcaaaaaataattatggacggaaattttttttttgttcttttggaaggaatcttttaatgatattacaaacaattagaaatgatgtgaccgcaaattgagaaaaaatgggagggaaaggtcaacgaatgcggaggagggacatcaaatcgatgaaaggcaattctcagcatgacaatccaagcagtaccttcaatttccctatcttttccattttgaagaacacaaatctatcataattggtttatataattaaaagtgataaataaatttgcagtgaatttatcccaattgttcgttcatgaaagacatcaaaaatatttaaattaatgggtctcaattctggcaactgtaaaataggaggttatactagttttaacttaaaatatttaaacagtcggaacaatcatagcactcccattttataaagtgccgtaattcacacaaaggcatagaatcaacgcaaaaatcaggcaattggcaggtcactgtacaagaacaaaagagctactgcggcacaacttcggcacgcctgccactttttgcagtcatcgcattcggattttcatgccgcgcaatcagacgttcaaccatcacctgaatttgcaaaaaatatggacctaaattgtgattattcaatagttttcatcaagcgaattaccttagtgtatttgagtctctgacacaaatctttaggacatccgtatttctccaaatattggaatttgcaggtaaagacattcttctgctggtctatgtatgtggcggcactcatcagcggacacacaatcaatttggagtgatcctgaaaagacaaatcccataataaatgtgcagaaatcaccaatattagaccattcatgtgtttattcaatgcgcacctggaagaagttgatctgcagagtgccgttgctcagatgcaagacaatcgccgactttgtccggaaccacgtgttcaggcagggcagccgcgccaactcgtcgccgtcccgcatcttaatgttggcgcccgccttcatcagatgctcgttcatgtacgaccggaagaacttgagcagagtgatcttcttctccagcgcctgcgggtatttgttggccccgtaaaagtgttcggtgttgttccgctcggtgtattgcaactgactgaaggccaacggaattggcatttctaattcaacggagccaaactcacttcccagccgcgtccaaaatgactttggtgttgtcgttgaacagcaccccgacactgttatcacacagctggtagcccagtccgtacttgtccgagtagtcgacccaccgagacacccaaaagaagggttgcgccctcggatcttcgatctcgtctgagaaaatcagaatcagtcaggtatttatcacaatcactgatccatcacctttgtccgcttcgctgaaccgctcgggatttgtattcagcagagagcacagctgcgcgtacaaatcggacaagtagaaatcggccggcacatcgttgttctcgcctaaacggaagcaatcgctgcaattaaacattcgcaaatgcggcagacccgcggccatctcagtgatgagcaccgatgccacgtcctgctttaccgccaccgcctgcggaggcactttcgtctcggggacggaggctagcggcgcatgtccagtgaaagcggggcctttggcggcacgaggactggggacatggtccaactaatagtgagaaaatgttagttctagcaaaagggaatgccagttccactcacttcgggtcgccgaatgagtccgcctgacaccgcctgcatgttgaacttgggagccatggtcagacatgaactcggcaacactttgggcaaaaagccgtccgtgaagaattggaagttgagaatttcggtgacccgcggtcgcctcgctgggtccggcgccagcagacgagtgatgagggaagccgcgtctttgcctattttgggcggaatggtgtactggttggccttgatgcgattgtacgtgtcctaaacgaaatgaaacacttgagtgacaagttatgaaccacaaaaaagcaccttcaaagtttccgtctcaaatggcggcttccccaccaaaagtgtgtagagaatgcagccgatcgcccaaatgtccacttcgtacgagtgccctttcttgtccagcatttcgggtgcgatgtaattgggcgtgccgcaaagcgtcttcttgcgctccccgtcgtagtccaccaccgtggccaggccaaagtcgccgatcttcagctgcatttccgaattcagaaaaaggttgccaagcttcaagtcacggtggatgattttcttcccatgcaaatatttgcaggcttcgacgatctgaacaatcagtggctaaagttggcaaaagctaattcgaaactcggctaacttggaaagtgaaatagcgcgcttccggctcggtgactgcctttctgcgcttgtgaagttccatgagagagcgccgcgaacacaactccaacagaatgtaaacattgtcatcatcctcgaagaacccttccatcttgacgacgtgcgggtgggcgagcgcttgatggatttggatttcctgagccatctaaacttttcaaataaaactcactcatccgctcaattcttttacttttttaaaatcatttgtttattttggacatagaaattgtgccagctttcaccttgtctcgctgatgtttcttcaccagcagtgttttggacacgactttgcccgcatagattttcttcgtttggttgtccgtcaactcatagcaccgtgcgaagccgcccttgccgagaaaaatgcctttggtgtaagtccgttttgtgacgttattctgtacgatgaaaggcacttccttcagcacaggctttgtccgcttttgtgttgacatgaaagtaatacaaatttagctatcttaaaattatggaaatatatgcattaatcattttttaaaaattctcgatatatattaaccaaaacggcgctacttgcaaagagcgctcttttgaaattatcaaaaagcaaaaacaaaaggggggacccttttgtttgcaaaattttttaatatttggtcatgaaaatttattccctggggttcttggggtccaagacctcgaattagatgtcagattcgtgatcagcgacctctaaaacccccggataacaaatttttcgtccctctttggtttttttgggaatcccaactgtaagcatcgggggtcttaaatctgtaaatgccggaaattaatttgacttcgatatttttttaattgtttcccttccctaattcagtgacatttacgagaattgcgaaacgattccccaaaaggattgcctctcgataaattctgtcgctgttgccgccaaatccgtcaaaggttttctcgtatttgtcggtcggaaggatggctcaattgcaattttttcgccatcaaacgcattcaaagaaccgctgaaagtgctgcagggacacaaatcgaatggtaattacttttccaatttcctattgactttatttttcagtctgtacacttctttatgacgaaaacacgggccttctcatgagcggttcatgggtatgttatacctttgttatcacattcattgtcagacttttctccaaaaagcgcatttttgttttgttactccattacattgaaccccccattttgaggatcacatgggctntggtttggcccgtcgccgatttgctggtcgaggatggntcccgaagttggcattggacttctgtccgggcatacctgctccgtgtgggccgtttcggttgttcccgccaaacccgtgcctatttttttgaccgc

SEQ ID NO: 408 - DNA, 5642 bp, Heterodera glycines
  genomic virtual cDNA Sequence=SeqID_674; coordinates=5401..5198 ,5131..4672,4608..4444,4275..4164,3863..3736,3568..3430,3368..3253 ,3141..3017,2731..2543,1598..1385,1222..1031
  coding sequence=SeqID_1005; coordinates=5401..5198,5131..4672 ,4608..4444,4275..4164,3863..3736,3568..3430,3368..3253,3141..3017 ,2731..2543,1598..1385,1222..1031
  peptide sequence=SeqID_1268
tgatattttggggacgaagagaaaaggaagaaaaaaaatttgttgattaaaaatacaaaatttccaaaaacactgagcctaacaatgtttaacaattttcatttagtcgaacaaagaattctgaaaagcctcggcacgatcaattgatggaggacaaatgaaattggggagcaaatgacgaacagaattgagcagatgaagcgcaagttggacaaaaaggcggcacaaagcgcaaacgacgaggaggaggacgaagaagaggtgacggacccccagggggaggcctggattctgtcaaattattctagaattttttgtgccattttggggtaacgtctaacggcatccactcttgtacagcccggcatagaatctcattcaaaatttattacgattcaaaaaaaaaacgctgagggcgggggtgcagggacggtcccaggattttggcttggggggggggtacctcccccggcgacgacctttttttgcttttcacacccgttttttttgtggcgcggtttttccaaaaacattttttgggggacagggggtccgggccgggaaattttttgcggttttaaatgcggtttgttaacagattttgtccaaaaaatgaccaaattttgtgatttcgagccatttttagcatattttcatcaaaaatttgtgggttttttgaaaaatttagcgaaatttcttggaaaatttgggtgaggctaggtctgggggggggtaccagcaaggaaaattctcaatggatgggatgttcgggttccaaattttgcaaatacaatttaagacaaacgttggtaataatgtctagcttgtacccccttcctccttttttgtttaaagaaccaccaaaaacattttccggcgctttttaagggtcgatattgacctgactctgactatacgaattaccaaatttttgaaatttaagtagaatttttacagcaacaatcaaaaatgctcatcattttgaggtcaggcatgggattttaaaacaaattaggacgtaattcagaaattaaatattgcaaaaacgcacgtcaaagtattggtatttgtagatgatgccgccggtggtggtcaccgccggcgcaatgtttgccacgtccacaaaagcgttggggaacagaaacaagtcgacggcacagccccacttcacgcactcctcgcccagcttggcgtagaagtcgatggacggcgtcagcatggtctgtgcgtaaaatagaatataaattttgaattttcaatggtaaaactgttaatagtccaaaaattttgtcctgcaacttttcggctggcatttttcaccgatttttttgaaatttttgctaaattagtgttttttcaaaaacaaatttttcaaaaaacacaccttctccttgtccgtgcccaacagcttgcgctcctcccggttcttcagctggcccggcgcaccgtccagcacgggcaacgacgtgtggaaaatgaacagtttgccggcccggtccgcgctgcgcaacgcgtccagccccgcctggatggtcgggcccagcgcagtttcggtgatgcgtgtgtgcgcaaaattgttcacaatctcgcgcaagcaactgaaaattcaaattttgaataaatattttttggaatttttctttttcaaaaaaaaaactttggtgaggtccgtaaccagaaaaaattcggaggaggtttttcttgaaaaacaacattttttgcttttcggcccctaacattttcggacattttttcaaaagtctaattgtaagcaatatcgtgttaagacatttgcggtccggacctttgcggcctgctgaaaatcggacatttgcggccaacggaacgtcaaatatcacttttttaattccaaaaagacatttgcggcccgaatttttcgaccccaataccagaatagggctcatttatcgaaaatccttttttctcttaaattttcgccgaactttattcaatctagtaattctttttcaaaaactgtgcttgtcaaaccccaactagagctcaaaagttgctagtaagtctaccaactactgtagagatctgagatttcctaataatgttctccatcattttgggaattgttttgctgatattgttttcctccacttcattgcttccagttgtatgggggttaggatttttttctagaaaacttgatcagcttattagaaagagcattaaattcggttaaattggatggaaaataattttctgagatttttattttgttggagtcgaaaaagttgagccgcaaatgtcgtttttcgctgtggccgcaaatgtccgaggcgcaaatgtccgaccgcatttgtcgggccgcaaatgtccgattttcagcaggccgcaaatgtccggaccgcaaatgtcctacaaccagcaatataggcaaaaaataggcataatttagcaattattcgccaaacattgaaccatggtttggtccaatttaagagaattgtatgtcattttcattacaaatttaacaaaaagttggcaatgtgtggcagacagaaacactcacacggtgagcgcattctcggcctgttcaaactcgaccaagaagccgtccacgaacgggacaaacacttccgcaatgtcgctgaccaccagcatttcggcccgaccgggctggctcaggttgtagaagtgcaccgtctggtcataggtggccagcccaatgcgcatggaggaggcgccggcgcggaaattttccctgaaatttttttttgaaaaaatcgctaaaaaaatctgtcagccccctcctcctctaacccatagagagcagctcgtttatccctccgaacagaactttttcccattaaaaacccaaaaaaaaaattctaaagaaaattttatttttgaaatttcagcgattttttggaaaattttttaaaaaagttaaaattcattataaatttttgaaaaacggtaaactttttcattttcttttcttgaaattttcgtatgaaaaacgtagtgcactgccgccacacacctcggcaactccctgagcatgtctttgatgttgcggcagaacagctcgaccagcccggtgcgcaccgcgttgtaggacacgtccagcatgaaaatgtatgccggctgcttgggcggcgtgccattctgcaacaaacatttacaattatggttaaattgattggccccaaaaattgaattaaatgacaaaaatggtccaaattagcgtgaaatagccccccccccctccgtactcactttgcagtactgtttggtggccacaaactcgtaggagcccaggtacagctcgggccgatgctgaatgtcagtgcgtcgtccggtgtgatccaaatgcgcaaaataaccatcctccactttaaaagcatcacacaaaatattgaatcgttgggtgaacccttgtattaattaacatgcctggtgtgctggcacggcagaatggacaccgaaatttgcggcctccgtcaatgaactccatgaacgggcacatgtacgccttgcaacgctggcaccggaccggcccaatttcacccaaatcgatcaccggtggcggatactgcggaattttttttcaaaagaattatttttcgtcgaattgtctctgaattcctatcctcgaaacttttttgggtaaaaaaaatcgaatcggattgatttctgacaaattttttcatttaaacccgagaacgtggcgttaaaaaagtgaatgatttcgcggcgtacctcggactggtgcagcttggcaaacggacagatggccaacgacaggggcagttgggtggccttgaccatgtcctggctttgcggcacggcatacagtgttgagcgcatgaatttcggattggcattccctgaggggaagaaaaaggtagaaaaatgggaaagagcctgtttttttggtccaagatggacccatcaaaccgtgtggaaaacaatggaaatgtgttagacttttgggaaaattcaaaaaaaaaaatttatcaaaaattataccaaaatttttttttttaaatttgaaacgatcagtgtactatttttagcgcctccaataccacatcaatggacttaaaaaatcatttccatcccggcgtaaaattcaaaaatttgtaaaaaaataggcctagaaaatccgagggttccacaaaaaaaaccttggtcctgtgcgatgatttccgtgctgacaagcggtgggctttccgcttgcggaaagccggtcggaaacagtccggaacgcgtgctctggtcatcctcagccacttgaacctaaccaaaatgatcaatttaaaaaatggcggcctaaatttaagcgccaatttaaaaaaatttaaaccgggaaaatggcgacgacgcaaatttaagagccttgccccccctcgcaagaattttccaaaaaacgtggactaaatgaagcgcagcatttccaacacttacaaggcttggcatcatgtccgggtcaagacgctgtcgttgcggctgtggcggttggccaggtggaaaagcgctgccctgctttaaaaaaaacattttttttaaattcccatttattttgcggctcgatgtttgcggtccgtacatccaaaaagggctttttaggctctaattcagtttatgcatccaatcaatgacaaatcctcagtttcctaggccatgaattttcacaaagcaaaagtctcgggaacttagagaccggaatctgtttttagtcatagcaaacggaagccaaattacttggaccgtaaaatccaaccgaaaaagcctgaggctgttgcggcatggaaggaaaagcctggggctgttgcggcatgggagggaaaccctgttgttgttgttgttgcggcatgggagggaaaccctgttgttgttgttgcggcatgggaggaaaagcctgctgttgttgttgcggcatgggaggaaaagcctgctgttgttgttgcggcatgggaggaaaagcctgttgctgctgcgacacaggtggaaaagtgggcggttgttgcggcatttgagtaaaagcgtcttgttgcggcattggaggaaaattctgttgttgttgcggcacggcttgctgttgcggcatgggtggaaaagcctgttgttggtgttgcggcacggaaggaaaagtctgttgctgttgcggcacggattgctgatgcggcatgggaggaaaagcctggtgctgctgcggcacaggtggaaaagcctgttgctgttgttgcggcatggatggaaaggcggtttgttgttgcggcacgggaggaaaagcctggggctgttgcggcatgggagggaaaccctgttgttgttgttgttgttgttgcggcatggaaggaaaagcctggggctgttgcggcacaggtgggaaagtgggcggcgattgttgcgaaaacatttttattttctaaatttcagcaatatctctacataaaattgagttttggtcgataaaacattttggtacattactctttgagtcatggccaatttttcgtcaacaaagagagttatcaggtccgtttttgggtattaattagtgcactaattgacgtttcttttggcgtaaataagacctttttcacaccattcatttttgagaaaatccaattttctaaaaaaaaaaactttattgtgcacta

SEQ ID NO: 409 - DNA, 4876 bp, Heterodera glycines
  misc_feature (81)..(81): n is a, c, g, or t
  misc_feature (91)..(91): n is a, c, g, or t
  genomic virtual cDNA Sequence=SeqID_675; coordinates=2995..3070 ,3114..3239,3309..3429,3476..3566,3660..3761,3806..3886,3930..4098
  coding sequence=SeqID_904; coordinates=2996..3070,3114..3239 ,3309..3429,3476..3566,3660..3761,3806..3886,3930..4014
  peptide sequence=SeqID_1131
atttccaccgtcgcacctgctgcgcctaaaattatcattaaaaaaagtattgcaaaacaaacaaaaaaaccgatttgattnggatttctgntgtaaaattctgatgttacatcgcgcatgaagtttttccaatcggtcactgtagcacttcccaattccatttgaaaaatgatttcatcgtttgaaaattttcgtgcccaatagtaggaaaattcaaaaaccttaatatcaattgattcgtgtaaatttggcctttataaaaaacttgtttaggcgtcaaatgggctccttcaaaaaaagtgcctttgtaaaatccaattgttggtcgtttgctatcatgttttttcactgcattgcatatccaaagaggttgttgtcgatcttgcttccatttgtagctcatttcattgccacagtcgcaaaaacgggtggtgtgtaggagtttaagttctttgagccatttttcgaaatcgttgtctggaagagccaaagctttggataaatcagcaagtttaaaatttttaagtgcttccattaatctaaaagcaattctgataataaaagagaaaaaaaaatttttgaaaaaatttgacccaaaaccgggatccaaactgaatgagtaccttttccgcctggtttggggtgtctatgatgacttttactagtataatgcctatttttgactttttgtgcttaatgcctatttttgtgcctattcgccatttttggcgcttttttcaggattttcggaaaaattcttaactaaaatgaaaattacacccctaagaatcgatccgaaaaattttcacaaaaattgatccccaaaattcaattatttttttcttaataaaaatttttgaaaaaaatgtccttattcgataaaactttaaaacaacaattgaaatataagcaaaattaagttttttgattaagtcgtttttacgtgatttgctacctaaatagtgttaataagaaaaaaattttttgcctatttttgtgcctattcgtggatttttgtgtctatttaatgcctattttgcgattttttatgcctttttaggtgcctatttcgcgattttttgtaccaaaaaatggaagccctaattatgaatgatcaaaatcaaaatgaacagcataaaaaagcattgaccaatattttgaattagcgcgcaaaggcaactcgtacaattaaaaaataaagcataggctcaagaaagcctaagtttcggcctaaacctaggcgtaagtctaagcctatgtacgagttgctttttgtacgaattgtcataacacctgaaaaattaatattagactaatccttagatttggcgttttttactattgaatgctcagaaattgctcaaatggattttggttttttaaatgactcgactaacaaatgggggaaaaaccaacgcaattattatgggacatcatatgttgacaaggactttggtggagttaatgattcggaggaggaagagatgcttcaattggaagaagaggacgcgatttcccggcagaagaaaattgagacgggaaattcgttggtcgattttgattgtctaattgcaaattcaacgataaagaacaaaggaaggagcaaactcttcgaagtccttcacatttcagttgcaaaagaaacgcctgaaaaggaaactgcgcaaggaaaaccgctagaaaatgtaattcaaatttactttaccagtaataatgttgcgcagattggcagaacttttgaacaaaacgtgtgcgatctgcagtcagaaacatcaaccgatggagggaatttcgacgatggaggaccgtgcgtttcaaaagaaatgcggcgaaaaataaattacgaggtgccaattttaatttttacagtgctataattggccgcttattatgacgaggacttttcagattcggaagaacaaaggcattcgaaaggacaaagggcgaaggaaagctaaacagcggcattcgcgggtgatgaagcgaacgcaatacgaaaaagcactgatcaagcgcaaatcgcaggtatttgttgggagcagtaaaaattttgttgtggtatttacctttaaagccataaattacttttctcaggtcccaaacatgcgtcgggaaatggagagatatgatggtgaaaagcgtggaattcgtatttctacaatccgttccacaaaattttaatttttgattaaattctttcttgcttttttgcgcacaatgccacagttaaatacaataaaattatcgtttttacttccatcaactaattatttgtagaaggttaatgacttcgcgaattttaagactttggcaggtaaaaatgaatttcattgattaatctgcttggagttttcagcccggagctccccgtcctagggtatttttgcctgatttctggataaaattggttgagcaaccgagcaagggttacaaccgtcttccaaaaaatgccgctgcgtttgagatcgacctcaaaatgtcgcgaatggatgtccgcgaatatttggaaaaaatttacaaatatccggttcgggatgtgcggattcgtgtcactatgggggatatcacatgggaccaccccaaagaccgggacaagagaagagcactttggaaggaagaggaccgaaagattgctatcgtcttttttaaagtatgcgaatactaatgacgcactggaatatccatgttcatttcagaagggtttcattgctgaagtcccggatctgttccccggccgtggcaccgatgctgaaattgatcagatgaagaagttccaagagcaggacgcaaatactttcaacagtcgctttgtcaataggggaagggcagggataggagaaatgctacctatttaatgctggaatttttgttgataaaatgcgatgaatgtacgaaaacttcgaacctaattaaacatgtttaatttactaaaatgggcttgctcattttattttctattttgttatttgttacttatcatttatttgatttcaccatgaaaccaacaatcgatttgaagcaggacatttccaagtacaaggaacgcttccaaaaacttcatcataaaagagttgcttttttaccataactttattttataaaaaagaattaaggaagagtcaagaaaaataaaccacgaacacgtcgtggaggaggatcgacgtctgaagttgcccaacaattttgaggcaaagcgaaaacgacaagaatgggagttggaggagcttgtggcaagaaaggtgaagtgtaacggaaactcgattttatttgcctttgaactgattcgtctaacaaattctttttttgaggaagcggaggagcgtggcgaagattatgacagaataaaggcactgggaacgcaagcagacatcgccgacaaaatggaagcggcaaaacgaagaaaagcaaaccccgacacgggatttgcgagtgagccatcccagccgagggaaagtctatttatcgtgaaattaaggttatgaagcgatgtcaattcggcaatacgaaagaatgaccaatgggataaagccggacatggaatcttaccaaaagatgaaaggagtcgtgtaagacgctgactattttttgcctaatttaagattttatactcaaaagacaacaactcgtgattactaactgttatgcttttcaccatttagcggagaagatcaattctacgcaagtgcaaatacgttgatccaaggctcgcattatcccaccgacaaggcactcgataaactttcggaggatgttcataaccagtgagtgggacaagttattccttacgtgttggttcacccaaaaggatgaagaaacgtgaccagtaccaccgccgtcggatgttcgaccctgatgccccgattgacttcatcaacgaacgcaacaggtgggtgtcggaaaaaggcgaatcgcaacgattgtttttcaagaaaattcaaccacaaattggagcgctattacggcaaatatacggcagatattaaagaagatttggagagagggacggccatttaaaagaatagtgaaagcgaaagtattgacattgaaattggattaaatcacagataatctttgaaattggattaaatcgcagataaatcctattttcttttggaatttcataaacattttaaaaaatgttgttacttaatgcttgattgaaattaactatttcaaaacccaacatattctcgcgtccctacccaaatgaacattgtgtgtccgtctcaccctgaagcggatttggtcgaagatgccagggccggcgatttgatttgtactcgctgcggtttggttgttggagaaaggttgcctcagttttttgctcctaatctttttccatttagactaattgatgttgggactgaatggcgttcgtttagcaatgaaagttcgggaaaggaccccgtccgtttgtttattcgttcattttcatcatttttttgctctttgcagtctcgcgtcggtgcccctgagaatccgcttctttccggctccgacttatcgacttcaattgccgtttctttcggatcggacagtgatagagcgtaaaaactcctttttattaccttttttgaaagaatttaaacaatttccagtttggcaaatgcacagaggaagcttttgagcagcaccgatcgacaaatgacacaggtaaatgttttgtgattcaaagattttttcttcctttaatgcgctcgtcatacataaaataaaaggaaatttctttttttttctctcatggctcctttcggcaccgccaaattcctcactttattattgtaagagttacctatattttcaattatttttttatcttgggcaactgaagcaaaatgaacgcagggagaattattattattttttttgttaatcg

SEQ ID NO: 410 - DNA, 1980 bp, Heterodera glycines
  genomic virtual cDNA Sequence=SeqID_676; coordinates=1..213,445..699
  coding sequence=SeqID_954; coordinates=1..213,445..633
  peptide sequence=SeqID_1265
catatgacggaggaggaaaggcgcaattacttacgaatgaacccaaaaatcatcaccaaccaacagaacaagggcaaatacaaattcctgcagaagtattaccatcgtggtgcctattttctggacaaagaggacgatgtgctgaggcgtaactttgccgaggcaacgggcgaagacgtttttgacaagtcggtgttgccgaaagtgatgcaggtgaggcgagaaggaagagggagtggagggaaatggacgagggatagactaaaaagatgagaaagagagagaggcagtggaagaaaagcggacaaaaaaatgagaaaaagagagagagagggggggggggggtgagagagtggcaagagaaaaaggggaactccgttcagttagaaaatcattgtttgggtgcctttggccctgtccacctctgatccattcgatttttaggtgaaaaatttcggcaaagcgagtcgctccaaatggacccatttgacggcggaggacacaacggaccaccagggagtgtgggcaacgccgaccccactgagtgctaaatttgtggcaaaacacgcggcggggatgaaaaatgtattcgaaaagccatcagcaaaaaaacgaaagattggtggggattgaatgactctgtgcttaattaaatgataaatttggcatttaaacggatggataaaatttgaaaaaaaagtttttttaatcgacaaaatcttttacatgaagctgtaaaaataataagtgcaatttgcgcttgacttcgtttgttcgtttgcttgtcttttgaaaagttcggtcattattttgtttttaaattaaaaacatttttgaatacaaagacgaactccggttaattcaactgtttcgtgcaaattataaaatttcagtgatcttatgaaaagatggccattgattgggccgattggtcagcccggggctgcgacgaggggacccattttgggtgtccccgagcccaacagaccccagaccagggcattgtcaagtgactattcgaaaaatttagatagtttccctctctattggaatagtttaatgagtgtaaattaaattcaacgaaatcccctgctgatttaactgattatgagtcactttccctcccccctccccctccctttccatttgtctcatccgtcgtcgattttttggaccattttactgacaatccttcaaatatttgtgactgttaataaaataatccaaaatttactacaataaaataacggataataaaatgcgttcttttcgccgtttctttgaatttctcatcgttttaaacttttggtcgcacttttcgtatgcgaaagaggtaataaatgcagacaatcagttaacaatggacccgaaattgtacttcgattcggacgatccccaatggctgagttggatcggacaattctcaaaagagatgagtcggtgttcgttgaacacggacgagctgaattctgtgcgttttgtgccgtcattgtcggcttaaaaccattttgaaattgtgccgaaatgttcaggtccgagtttgtaccagggaacagttttacggtccggcgggggtcgaggccatgaaacgcagcggcgaactgtacgcagagcacagaaacggtgcgaaacagtacaaacaaattaaaattgcattccacttttattactgtaattaattcatttaatatacacaaattccctaaaaatattttgctattcttaacaaaaaaaccctaattaatttgtcggacatcgattgtggccgcgtgttggccaatgacagcgcttacattgaggagcgcacacagtccgagccgttgacctttgccaacgccggcaataccttggcggtcgactgcgccaccatccgttcccgttactttaactttggcaacgcggagcaaaagtacaaaaacgagaaagggaagaaaacggactttccgttggcattcatccgattagtgtacaaggtgaacg

SEQ ID NO: 411 - DNA, 6785 bp, Heterodera glycines
  genomic virtual cDNA Sequence=SeqID_677; coordinates=299..483 ,921..1127,1452..1780
  coding sequence=SeqID_943; coordinates=319..483,921..1127,1452..1634
  peptide sequence=SeqID_1166
agcgcttgatgccgaaacgattccgacccatttttgttaggttttcgtgtggcaaaattagccaaaaaaaatttttccacatttggcgttgcgcttttgcctctgtttaggtgtcattcaaaaacatttaattgcattttttatttgattaaaacaaaacttttttatgtatgtataaacttgaacaattgctaaaacttaatcattcactgtaaattaattaattatccaatttgttaaattgtttatctatgtaaattcttccatttttttttacaaattgatttaaaatttagcattttccattaaaaaaataaaatggtgcgcacattgaaattccatgagaaaaagttgctgaagaaagtggacttcatcaattggccggccgagttggacaacagtcttcatgagaacaaaatcatgcgccgttaccatgtggagaagcgcgagcactacacactgtacaacaaactgtccagagaggtacgacgaataatgaaatttgaacttgtgggcatggttttcatggtaaaacgacgaaaatatttccaaacttttgaaaattacaactgcttaggctgggcctcccaggcttaaattaacaaaattctgtacgttttgcaattgatgcgttgcttttagcgggttgggcaattcgggttgtccgcaaattcaggctgatggccagggggttgggggtggtagaacccgggaatttcgaaatttgctgacctcggtgcgctgcatgattgaaacccaaaaaagggttgcgattttgatcgaaaaattcgacttttgcagggttttttttggggggggggagggaggggtccgtgccggattattgagttttttgacgggtttactgggtttagaaccagagtttttccttcctcataaaaaaaaccttttttttgcagatccgagaaatggccaaacgcatccgcgagttggacgacaaaaacccgaacaagttggtgttggcacggatgctgctcggcaagctgttcgacatgggcgtgattccgaccgcggacacgctcgagcgatgtgacaaagtgacggcatcgtccttttgccgccgtcgcctccctgtcgtttgccacaaaatgcaaatggcaccgacggtaaacgcagaacaaaacaagcaattgcaacatgcattttcatatgcttgctttgagtgatggaaatttagggtccattttttatacggaaaaattttcaaaaatgggggaaaagtatttttgtgaaattcaaatcttgttgggtaaaagccttccggtccacaaaattttaaggcaccgcctgaaaatttagggtcaatttgtttgaaaattgagtaaaataaaataaaaaatatccatttttcctggattttatagggtaaaacctttgtacgcctacaatattttctgtttatggacacttttcagttatttcgttttcaggttaggaagtccagccaactggtggagcagggccatgtccgtgttggtgtcgaaatggtcactgatccggcctttttggtcacgcgaaaccaatcggatcacatcacatggacgcgggaatcgaaggtccgaagacatctcagcacttacaacaacgaattggatgactttgaggggtgttgatttgaagaagccaatgaaataaaaatacatgaaaaagacgcatataaaccatttttttttgtttcactgcaatttgtttgttttgttttttgctttttattgttgttgaactgttttctcatggacggtaaaactaaggaaccataggaattttggaaagaaccagaaaggccggcagaaaatgcattttcaattggaacctaaaaatttgttttttaatttaagataaagtttgccatttttcggcaacatggtttttaatgatttcggaaaagattctttttatctaaagctttcgaatgacacaaatttagttggccataaacctttaaaaattaactttcaaaatttttaatgttttgaagaaaataattgaaaatattgttgtcgtgtagcggattcgaacccccacccttttccctttactgtcttgcaaaagccacttgaccaccatacaaacgaatttttcgccttttcgggatgccatttctagcagggatggcacggaattccgacatttttggggcctcggaattctgatcgaaatttttgataaaggtcggaatttttcggaattttttttgagtttttttttcaaaaaattagcaatttttgtacaattttctgttaataaattgcattgaaatttttaaaaatttcccagcggtgcctatcggcaccgccggacctaaaagtccttaattttcttgaaaatgtgctggaaatagctaaatttggccattttcgggtacaaatctgttaaccaatagcatttttccggcggcgcctatcggcggacccctccccctattacccaaattttctttggataaagcgcgcagcaaaaaagggtgtaactgtcccaaaaaaaaaaatcaaaaataatgtaaaattacataaaaatattttgaaaatcattaaaaaaaatttaaattaatatagaaatatactaaaaacaatttgatatcacctttacagggttaagaattttaaaatgtagcctattaaatattaaaaatttttttaaattatattttatattttttgaaaaattccgacttccgaaaaatttttgagcctcggaattccatccctggttcattgtcattggctctattggcgtgctagaaaatgccgccattggttcagttccggaacaccgaaaatcttttttttttttaatatttttatgcaatttttatgcccaccccaaaccataattgtgcaaggagaaaatgaaaaaatttgccaagtgacctcctcccaacccaaaacgtcaccgaaagattttttgtcctgaattttcatccgtaaaaaaaatattttttttaggatttacagattaatagctttttcaagtgctttcaagcaataccaagaaatgtttaagatgaagttttgtggttttttactgacaaattaaaatttaatttcataatttttttcttactttggaaaatgttttatttttttaataaatttccccccccccccctccctccgattactcacttggagtgccgattggagatgtctgcgcaatgtttggtgcatctgttggggctcgtccgcccggcgacagagcacggcatggcaccgcagttcgggcttcatccgcttgccctcgtgctttacaaaaaacgaagtaaaaaaaaactattcccaattttaaatttgtttgaaaaaaccaaagctaagggttcaaaaatcaatgttttacgtgccgaattaggacttgtatctgggtttcatatttggcctggttttctggccaaacaaaaatacaggaaatccaaggcctggaatcaaatttttaatcaattatttttgtgatttttaattgggtcccaacttttccatttaaaaactccgagaaaattgttttttttttgtttgaaaaaacgaattaaatttttttcattgaaaaaacgtttagaaatggagaaacatagccaaagcagcaagcaccttgtaaatccagcagaacacgcgctaaatttaggggaaattaaaaaaaaaaatttttttttgcacttttaccgggtattgactgggcgccgccgaccaagtgattcggtgcgtaaaatattcagtgacactgaaaagtgtgggaaaatttaaatttgaatttcttacatataaaaatttacgaaaaaaaattgctggtcgttaattaacataaaaataattttttatttgaaattttagattttcaattaaaaacaatcaccacggcaatttttttgccgtggttctcaaagaaaaaaaagttttcaaacaaaaaaataaaaataaggagagggagggtagtgagaaaggcgtcgccggtgaaaactttgaaatttttaatcaaattgcaccaaacaaactcacccaatgcacgtctcggccctgagcccagaccggcacacgcacaggcgcatcgccaactgttgcgcctgttgctggccaaaagtggcgccggcgctgtggcgcgtcgcgcctttggcgacggtggcgccccacgcgcgcgtaatcactgccgaggggagggggaggaaagtgttaaaaatggaaaataggacacaaaaaatataatttaaaaaaagcgccaaaaaacgcaatggcaaaaatgcaaaccgtaatttttgaaatctgtctattttttgcaaaaagccgctacaaaatcggagggtgggcaattgcgcttttaaaatttaagggcctttttaagtcgatgaattgaaaacggaaaaggcttaaaacaatcttctttgtctgttgggccaataattttcatggtgttagaagttaagagaaatttcaatgaatgaatgccgcggaaaaagcccaaaaatcagggcaatagtaacgaacattggtcctgaatttttttaaaatttatttaggtaacccgaggcgctgagcacgcattgccttattttggctcaattactaacccgaaccacaggctcgaaaatttttcgagaatttaaaaaaaaatttttggaattgcctggctattattattgctcacaaccagtttcatccaagatcccctgcgtcattttccaaaagattgcaagattcgtgctaattgtaagaaataattttcttaaagcaaaaaaaaaaaaaaagattttcgggacaaataaagagaagtaatattgaaaaaaacacgaaaaaaatctgaaaaattggttggaagactcttttttccaacgggtaccccccaaggtcagaaaatcctttaaaatttcaaccaatttcagtcctaaaaattcccaaaaaaattaaaaccttccaacggacggtcaatggacgtgtcgcccttgcccatgattgtcaacatgttgccgagatatgtcacctggaagacggacaaatgtcaatacaaattgaaattgacctatttcgagggtcatattccccctcccccccaaaaaaaaaattagaatttttcggtaacaaatggcaaaatctaatgataacgaaaaactgcaaccagatccgttgaaaaattgggcacatcccttccaaggccttaattttcccaagtttaggattttaggaacgtggttgctgtcagttttattaacgttgatcaaatggcagagattcgaactaagcctttagacagtcaactcaaacaaaaagtttttttccccaaaatttgtccccaaaaattttctaataaaaatttacaaacttgatgcgttggagaaagggtgtatattcggtgagggactttgggatttgctggggttcgggttgagattttggggtcaaggaaagatttacttaattttcaacaccactttactgacaaggaattagagaataaggtgaattgcaattagaaactcaaacaacagtaccaattaagcctttgggcgtttgttgttgttggatgacagtccacggagaaaagcaccaaatttttgtagttttattacaatgattcaaaagcacaaaatatataaaaacttgagagaacacgaagacaaagacgaagaccaaaaggaaaattaaatgaaggatgcaaaaatattttaaattaacgcgaaaaacaatcgttgcaaaaaacaataaaataaggataaatcattatttatcctacgtcccccgccgtttgaagaccagtgtcctcacggtctgatcgccgcgcacctcccccggatcagcgaaagacgagcgcctgcgagatggtgtcggtcgaggcggtccagcagtgaaattgtcacaatggaaaaacattctgaaaaaataaaaaaggggatgattgtggggggggggggtgatcagaattgtggcaacggatttcggccaattggagaaaaatataaaaagaacaataaaaatgcaataggccatgtatgagaataacattatggtccgaagctgaagaaataataacaaaataagtaaatttaagtcattgcgagccgcttttccacattttaaattcttataataacgaactgggggcatttacaaggataggcgaatttttgatcaaaaatgggcgagagaatttaattgataataggcttgggagaagaattttttggctattgcttggttggcgaaaaacatttttgtacttggaattaacaaaaacacgtcgtcgtcgttcccgtttggtctgtttttgatccaaatcctcatttttatgacggattgcattaatggctaatttgattggtgggctcgggatctttttggggattttttgaagtttgacaaagggggtttgatcggttttgttggaagcaatctttgaattggatgaaaccttttgaatgaattttatgcgtttgacaggggaaattgatttaatcacttcgttggaaatgattctcgattgtatggggcgcggtacaatttttagggaggagattcgaccagagtttggcaatgaattattcgaatgttttggactctcaccgaaattaattatttcatttgtaattacatttccgatgtaatatccaagagaacttaacgcattttgtccaagaacaaaatcgtaagggaaaggttttttggtgaccacacaattaattttgccttgccaatttcctttttccatcggcacattcagtactccaatcactggtactcttccacccgtaaaagattcgacttcaaaagggatctctgactttcctt

SEQ ID NO: 412 - DNA, 3474 bp, Heterodera glycines
  misc_feature (9)..(9): n is a, c, g, or t
  genomic virtual cDNA Sequence=SeqID_680; coordinates=674..813 ,920..1162,1210..1393,1517..1647,1695..1815
  coding sequence=SeqID_874; coordinates=682..813,920..1162,1210..1393 ,1517..1647,1695..1775
  peptide sequence=SeqID_1105
acggattgntattagggattttaagggtcggagaatccaatacaatctttgtaccagagccgcaaatagggatgaatttatagattcgtttattgtacaaaaaatcaatggatatttgtttaataggctgaatctctgataaaattcccttttaaatgtttttcctttttaaattcaagatgttcgaatggatgttggtgttgaaaatgagtcggtggtactcaaaatcggatttgtaagtgctcattcaccgccacaacttttcatcccttttcttcgattagctcaactttgattccgacaatttgctcgaacggtatttggacgactatgacattgtgcttgttgatgaccaaactatggacgttccattattcattttggaacacatcaaacataaatcagcccattgaatttatcaacaaaacaatagccattttgttgttttcacagtctttggttttgactattagcacggattatttgccaaaatttctgtctatagtgaatgtttcttctgtttatcctttttattgtaaaatataaaatacattttatgtccttttgtctctttgcattttgtgttatttccatttgctaatttactcttaaaaatttttatcaaatttttatcgctcgcttttaatcattttgtgtagtaattatttgtaggcctttgcgatgaaagtcatcaacgagtttggctatcgtcaagatgcccgaacacccagccaaatccgcaacattgtctatcaaatgggagtttactcacacgcggacggctccgcttacattgagcaaggcgagacgaaggtgggcggtcaaagttttttttaagtttgtatgaattttctgtcgattggccattttttaatgttttgctttttccttcattcgctacatttcccctctgctgaaggtcctttgtgcggtttacggtccgcacgaatgtcgcttccgatcacgagccaaagaagacgaggccattgtcatttgccagtacagtcaggcaactttttcggttcctgacagaagaaacaggccgcgtggcgatcgtcgaggcaattccttttcccaccttttggagagggctttcgaatcagtcattttcacacatttatatcctcgaagtcaaattgatatattcttcgaactccttgaggcaataatttgctttttacattttgatgctttattttttaattttaggctgacggtgccaatttggccgcctgtgttaatgtcgccagtttggcactggctgatgccggcattcccctgcggggactgctgtccgccgtcgaatgtggtagtgctgatgggttgccttgtgcggatttgagttctcgtgaacatagtgaattggtaccacgcctcacaatggccaccgttggtgagtaaatcaggagactttataatgagaagttggggggggggggacatggcgaggggagggaaaagaggaaaattaagcgaatgactaattgtaagcactgaaatcatgtcatatgtttaggaggtaaagacgaaattgttcttatggacatgaaaaacctactccacaaaaatcatttgccgtctttgttacaaatgggcgtcaatgcgtgtgcccaagtacacatttgtctggagacagctgtttttagagtaaattataagcacatttgagggttgtttatccattttaattgcagcatgtcgaagcatcgcatcggaaaaacacagaaagtggaaaacaaaattcgcttttgaacagaattgttgaaggtcgctaatcacagatttaatttgttggattaataaattcatatttttgcattgaaatatatttgtttttaatcgatttccatttgtcttttatttttccaattcattttatgtattctttcttaaaaagttcatcactagttgatgctgttaattcctcggagtgtgcgttgtttttatggcggtttgttggatgtttcgtcactaaatgtggggaatgccacgcggatggaattgttacgaatgtaatttgctgaagccataaaaattaatttgttttgcttggaaagtacaaagttccttttagcgctttttccacgccattcgccgtttcccattgttttttgtcggtttcgtccgtccgctgccttcaaacatttgaaaagcgtcagcaaagccaaattgagagggaagcgtccgaactttccaaattcattgactccctatgcaatccgaacgcatttaagaggcgtcctgatgcactctttgctcccgtctgcgctttcatatttcttatggtacaatcagttccatttagaaacgcattggaggaatggatgtcgcggctgtcagctttttggattcgttgaatctaaccgaggaaaacatttcgaaggaggccatctcgcgattcagcaaagaggtcgcttttttaaaaaatttctcgactgatttgcagtttttttaaaattttttcattttcttttctcatacgaaattttcaatcatttttaggtttacaaaatgtccgctattcaactttctcagctgttgaaagcgactagcaaccgcaaaattgagcaccccgtgttgatcaaccacatttgcaccgcactgaaagagtaaaaattcatttaaaacattcaaagaaaatcccccactaagtcaagaacgaatctcgtaatattaatatgttcaatgtgcccaattgaatcattttgggattgctactagtacaatataaaatgtgattgtgagagactttggatattgtctcaatgtctttcaaaaatgccctcctaaaatccgttcctccattcagccgtcctttgcctccgtctctccgccacatttgtcaaattgctttttacttgtccaaacattcgttcctcgataagccgcttctcaacagaatcaaagaggattttttggtttatgtccgaaatgaaatcatctcgaaaacatctttttcacacattgtgatcgccttcggtcttcccttttttctttctttttttattttcaaatttcagctttttttcgtctgactgatcgacatttttggcaacaaataatccaaatcatcgaaacactggcgaatcgccctgaatagtgggtttaataattgtttgtttcaatcatcgctttaaaaagaaaaggccaaaattctatctttcatacttttttaatttaataagaatttcgtatgctatgatttggacgatccaatgttttgattgttaggaaagcaaaaaaatatttggtcatttttatttcaaaatctattaagaaaccaaatcaaaatttatccggcggcgcctttctgcaccaccgagcgcatttccaacaaaaatttaaatagttcataaattgcttgtttttacgcttgcgttgccccctcccttcctctgttatgttcttttctttagttcaactgctctgattgaatgcgttaattcgttggctgtggtaaatgttcatccgaaa

SEQ ID NO: 413 - DNA, 3692 bp, Heterodera glycines
  genomic virtual cDNA Sequence=SeqID_683; coordinates=2392..2105 ,2054..1786,1638..1507
  coding sequence=SeqID_974; coordinates=2392..2105,2054..1786 ,1638..1507
  peptide sequence=SeqID_1191
tatttattttgatgtgatagtgtccgaatttccattacccgttcaatgcttctagtagtccacttattgatgtccaatttaccgggagcgaaatggaaaaggaggggggggggggcaaccaaaatttttgcgaagggggtcgaggggggggggggggtaagcggccaattttgcgaaggggtcccggccatgtaaatcgacgacctttttttacttttcaaaagcacttttttgcggctcgcttttttcaagaaaatttcgcgaacaggggggccagcggtgccggtaggcgccgccggggaaattttttgaaaattcgagtgcaatttgttaacagattttcactaaaaactgccaactttttacgatttttttagcaagtcgacgacttttttgttttttaaaaacgtttttttttgcggcgcggtttttaaaaacttttttggggacagggggttcggcggcgccgataggtgccgccggaaattttgactaaaaaattaccaaaatttgagattttgggctaattttataagaaaaaaatagtatttttggggtccggcggtgccgataggcgccgtcgggagaaaaattgagaatttctaacgaattttgttaagaaaatagccaaatttcagaaattcccctcgctacgaccctccccccttcgccggcgaccttcccctcacctcttttacaccggcaacccctcgttcccttgtaaccaaaatttttaattttttttttttgcagaaaatcctcgtaaatttagttcgggaattgtaaacgggaggggattggtctcttcacctatacaccccgagcaattgtgcgtatcgtctcgagtcgctggtcatgtccggcaattggcccgaaataggcatttgatttccgtttttgtcaataaattcacgcagagcagctgcgaggatccaaaagagatcgacccattctctgttcggtgcgtcgcccgtcacagccgatgcttttcggtccaacagtacttttttgacattttccggcacctcaacaaataagagtaaatcaatttaaacactcatatttcgatagtttccatagctttcattgattcttacgttggatttccgcattcctttcaacaaattttgctttgcttcagtgaaattttgctcgtccaacgaccccttatcgtccggttgccgcatcttcattaaaatctgttcaaattccttccgagttttgaatgaagtaatatcaggaaacaaagctttgtcattggcttttgtctggctacaaaaaatgcattattttttacaattaaaggatttttggaagcgataattaaatttgtgcatccctccatttttgcaatttttttcgtttataagtcttgaaattcgtttccggtagtttcgctttttcgatttagtatttgcataagcagcgacacagaaaccgcaagaaaacatataattttttttgtcaaaaaagggagaactttttaacatttagtgaaattttgacctttttcgccatatgtcaatcgctttaagataaagaagcaaaaagggagtgtgtgagtgctgctcatgggtcatcgattcgaggttagtttcattggccaattgaagcagttcgggaaatgggaagtccaacctagtgaaaggaaggtatgttaataattagtggtcgagagttgcaaaaaatacccctccccaaactttagaaaatttatctaaaaatcgaagtaaacgatgagaaggggcaaccgtaccttcccactccccatagcattatgcttaccgcaagtcataagcagcattttctgcatgattttcaaaaatgtaatgttcccgaaaggacagtcgcaaatgacccatcattccacaaacgttggcatatacaaaaggaatggcatgctcaaaaagaaattggtccagctgacgcgcttcgttagcagttagactggtgccaatcaccagcgaaaattgcagaagcatttggaagtcctgtcgtttgaattccccgaaagaaattggatgatgctgaccgtgcacagaatggtttaattcctttaaaaacaaacacttaaatggattatatttatccaaaaaataagcaccttcaaagccttgacgagacattcggcacggctcgaacccaaagaaccctcttcaacaaaaaagttctgcccaaaatcagcgtggtccaccaacgccttgtcaattatatggaaagaaccgatgccagcaaggacgagactcttgagcgtttctgcagccaatgagttggagccaaacacacaaacacgcgcttgttggattgacaattgaccatcatcgccccaaaggcgaatttgcctgtcatatcttttttgttgctgatccatcaaagaagtttcattatccatttttttgcttaaaatacgaaaaataaaattgcaattgcaccatttatgggaaataaaaagtgaaaacgaaacttccaagaaataaaaacaaaacaatcataaatgtttgttttttttaatttggccgataataaataaaggcgcttaagcataaataacaaatcagtgaggctctggaacatggccatcgacataaaaattcctcgtgattttcgggagtgtcactctgatgccctccaaatctttgtttagaataatctgacaggagagcctcgagttgggcttcagcaatggggccatgtcgagcatgtcttcttcatcttccactgcagctggcaatttgtcgtagtatttttcatccacataaacatgacaagtgcaacacgccaacgatgcctcacaagctccctcaatttcaatgttatacctaaaaaaaagatgagctaattaccttattcaagagtaccggtgagcaagatacatggcattgtcgccgacttttccacgtatttttttctccgttccatctcttgtcacgtaggttatgttgaccacttcttcttccgacttagggtcttcgtattcgaaatcacccgataacattttcaacgtgtggacagtttctgggtgtttagtgtaataaatggaaacaaagaccgcttcaacagtgtttcagaaaagaacgctcgcaaaggaagcattgaattttaacaaaaatctagattaaagcatttaagcaggattgggattagtcttagatcaaatgacgtccttggatctggaccacaccaaatggaaaacaaaactgtctggatttgaccgttttaaaagattacataaagtgcccattttattcatttttcgaatttgaaccttttaacacagagtccagaaaatgaacacctgcatcaaaaatttctttgatgtgtagatgtggttttttgtaagatagtaaatggaaagggggtgaaagttcgtcggtaatactatacacagcggcccaattttgggctccaagtacaaatatgctgggtttttcgtcttagtggtctgtgagttagtcaacaaaaagggggtctcaagttcaattcctccttgtgtttgtgtataaatttcaattttttaaagcaaataaataaaataataataaatacagaacgccaaaagaacaaatacaaacagtaaaaggtacacactatattttacccttgattttatgaaatttttttagcttataacttggccaataatagaccaaaaaagaccattttgtgctcattttgaagggaaaattctgaag

SEQ ID NO: 414 - DNA, 4845 bp, Heterodera glycines
  genomic virtual cDNA Sequence=SeqID_684; coordinates=1286..1399 ,1448..1687,1733..1857,1902..2114,2161..2305,2350..2495,2557..2665 ,2722..3012
  coding sequence=SeqID_830; coordinates=1286..1399,1448..1687 ,1733..1857,1902..2114,2161..2305,2350..2495,2557..2665,2722..3012
  peptide sequence=SeqID_1070
tggaacattgatagaagaggctaaaaaagaccaagacatggcccttaaaactggcgatgaagagcccatcagattattgggcaaaagggtcaacgaatttgaacaggtagggttcggtaaccaaggcttggtttttgattgtttgtgccaggaattgaactcacaattgttgccatattggaggagggacaatttgcgtgagcaagtgaagcaattacggatggcaatgaaaaaactcaaaaaggcattcaaaaaatcgacgaaggacgaagagaatggcactgaaacagctgaagagaaacggagcaagggaaagagcggtgcgaaaaagaaagctgaagcggtggagaattgagatgacaggcgaagtgttgagctgttttcataccttttttgaggttgagggggggggggggggtcggcccccatctttcgtcataaatgctccggaggagggaggcctttgtaatcgggaagaggtcaaagggggaagggtcgacgaaggggggggggagagaaagagtaatacgatattccgggtgcaccccaaaatgtttttccgacggcgcctaaaatccttatttccctaaaaaatgacaaaatcgcaaacattggcctttttggacaaaatctgtaacaaatcccattaaaattacaaaaaaaaaaaaaatcccagcggcacctaccggcactgtcggaccccatatttcccaaaagttttttgaaaaacatgccgcaaaaaaggtggtaagaaaaaaaggccgtttacatggctgacccccttcgcaaagttagccgtcaatcccctcccctttgacccccctccctttttttaacgtatgactgtttttgccagcgattggtgtgacactgtcagtgttattgttggtataatattttgtttatatataatttgacactcaatattataaaccttaataaacaccttcgttgggttcaattgccaaaaactttaaaaaaatttggtatcatttgaaagataagaaattaggtttataattgagattcaatttcttatgcataactagttacctaatttgaactcataagacttgcttttaatgatatcaaagaactgagaagaaaaaatttcttgcaggctatgatcagataatcggtcccaaaaaatccaataaaaataagtgttgcaggaaaattagcacagattttcaaaaaattctccatggggaacaaaaacaggacattggctgataaaacttgaaaagatataacttttgtgttaggcgtgaagtaaatttttgaaatggaacaagaacaacaacaaaatgttcatcacagtgggcgcgaagtgcgtcagatgttcatcgactttttcgtcaaggaaaaggcccacaaatattaccattcctcttccgtggtatgcaacggtcgtttccgctctccctttgaccattggcattttcagattccccacgaggatccgactctgttgttcaccaatgccgggatgaatcaatttaagcccattttccaagagactgtcgacccgaacagtgacatggccaagctgaagcgtgcggtcaacacacagaaatgcataagggcgggtgggaagcacaacgacttggacgacgtggggaaggacgtgtaccaccacacctttttcgaaatgctcggcaattggtccttcggcgattatttcaaggtcagtcgtctcctttttttgctattctgtttttaaatgttttagagggaaatttgtacatgggcttaccagttcctaacagaatggttgcatatttcgtccgaacgcctttacgtctctttttttggcggcgatttggccaataatttgttgccggacgaagagtgtcggtaaattgtaactgtcaaatttaattttattcctgttattcaagccaaatatggttggacatcggtgttcctagtgaacacattcttccctttggaatgaaagacaacttttgggagatgggcgagacgggcccttgcggtccgtgttccgaaattcattatgaccgaattggtggcagagatgcggcccatctggtgaacgccgatgacccaatggtggtggaaatttggaatttggtcttcattcagttcaaccggtgtcttgtgagattggcagccattagcatgactttttaactttagggaggagggcggagtgttgaaatcgttgcccaacaaacacatcgattgtggtctcggctttgaacgtctcgtcgctgtggcgcagcaaaagacttccaactacgacaccgatttgttcaccccaatttttagcgcaattcaggaggttgtaggtggtgaaattttgctattgtaagtttggagcttcaggggaccggagcccgcgagtacactggcaaagttggttccgaggacgtcgacggtgtggacatggcttaccgggtggtcgcagatcacattcgcactttgaccatcgcactgagtgacggggggtcgcctgactcgaccggaagggggtactcacttgggagtttaaaaatcactgatgatgatatgcaatgcttgctttgtttttagttatgtccttcgtcgcattttgcgccgcggagttcgctacgcaactgagaaattgggggccaagcccggcttcttcgcctcgcttgttcccgtggtcatcgacattttagtactttgtttttgtggtctggtgtatgggggtctcttgaaaaccaatttcttaagggcgacacttttcccgagcttcgaaaggacccaagctcagccatggaaattatcaatgaggaggaggcacaatttctgaagacgcttcgtcggggccacgttctgtttgagaaagcggtcaatgctttgccttcgggcaataaaactttccccgggagcatcgcgtggcgcctctacgacacttacggatttccgattgatctcacccaacttatggccgaagagaagggactcactgttcagatggacgagtacgaggacagcaaaaagaaggccagaggaaaaaaataagcctttaaaccaattttttccgttattgttatttgaaaggtccctgctgttctaataaatatttgttttggtctccaatcgttcggctaatcaaaatccgccctcaaaccccttctctcgtttccctttggccgccatttcgatcgatctattcgtcttgctttaccgcttttttatgcggctgacattgcccttccgtcgcttttccccggcggcgttgggtctcttcccttctctttgccaacgattcacattttcaatgccaattttaataaaatattgttatgttaagttcgaaggcatttttcaattaccaaaaatgggaaaactgagaacccattaacactcattagggtatttagaagataatccttagtaaatttcagtcaaatcgtactgctaatagcctccctttggctttttgcctttcgattcgttttttttggtttgctaattgcctattaattaactaattctcttaggagtccatcgatcattccctctctctctccctccctcattcattttccgattttctcctcgtcatggtttattcgactgagctcggctatgatccagagtgagtttggtctggcctctttccatctttagtccattttatggcgttttgtccttgtttttttaattaattagctaattaagtgagtgggaagagtgtgccgagtccgaccactttttggccatgagtccattcactcgcatttgcctgagcattggcactgtgatggtttccgtgctgttcttttgggtgttggaggccaacaaacgaaggcaccttaggaagaacgacggggaaacggaacagaagcgagggattggggcgaaaccgacggaatgggaggacgaagaggaggagaaagagacggtggacagcaaattcgcaagggcagcggaggaagcggcactcaaagtgaaagaaaagtgacaaaaccgaaccgaaaaggacgaccgatttaggcacagcccgaacggaggcgcaactccaagcgcgagctgagcagggcggaggaggcggaactgctcgcatggaaggcggaggtgcagcggacggcggagacgcggctgagagcgtctgaagagccggacagtgacgcggaggggcggagagagagcagcgaacggcccgaaggagccgcgcaagaagcagacggaccgcaaaaggggaccgaagagcgacaaaagcggcaaaaggaaggggaagaagcggaacgactagcagagacggatcaacaactgatttgggggagggatccgcaactgatcagcggaaaacaaacagcggcgagtgatcaggaacaagtggcatttgaacaaccatcaaatagacaaaaacaacaatctctccctgatcagcaaatacaaacggtgcagaaattgcctgaggcgagaacggcggaattgctggtgccaatgagtgaatgggccaaaacgaagcagtgagtttggccgattgcagtgaaaggtgtcacccgaaatagatcagaaatgctattttaattatgatattgtcgttttttcttctgtttagcagaagcttaatgaataaattaatgctttttgtcacggaatgcctttttttggctttttggttgttggcacttcgtccgatcactgatcgattgtgtggactgatcactcagcttgttctcccttccaaggctgattcgtatcgttcaacaatccgacgactttgctttatcccatccgggcgccactccgccgagcaccccgccgaacggaattggacagaatgaattggcggcacattatcgcgtgaaggcggacgaactgacgcaaaagctgagaaacgaa

SEQ ID NO: 415 - DNA, 7208 bp, Heterodera glycines
  misc_feature (12)..(12): n is a, c, g, or t
  misc_feature (7196)..(7196): n is a, c, g, or t
  genomic virtual cDNA Sequence=SeqID_685; coordinates=5538..5325 ,5232..5093,5046..4883,4780..4621,4533..4311,4103..4000,3828..3612 ,3484..3334,3239..2960,2885..2757,2641..2389,1801..1656,1590..1492 ,1295..1224,1149..960
  coding sequence=SeqID_883; coordinates=5538..5325,5232..5093 ,5046..4883,4780..4621,4533..4311,4103..4000,3828..3612,3484..3334 ,3239..2960,2885..2757,2641..2389,1801..1656,1590..1492,1295..1224 ,1149..1048
  peptide sequence=SeqID_1113
aattacaattanttattgtaaatataataaataaacaaacttaaaaaaacaattaccaaatgtacataatccatgattgacagaaaataggaaaaataaaaagaaaaaataaattttggacatttttcaatatactaaagaaaaagattaaaaaataaattaaaaaatgatttcaataaaactctctttttaattaaggatgtttgcatagatagccttcataaaatgtggattatttatttggattccttcagattcgagttgttttttaattataataaaatttacacgaccataaaaatacattatgataattagaacaaaaaataaacaaatttaattttaggagttaatttaatattttgtaaaaaatttaactgaaacccaaaaattttggaaacgaaataagctaacaaagaaacttttagcgcttgataaactggttttttctttgcccaggaaaagcatgtccggattaagtccaggccataagcattcccaaaattaaattttcaaaggaaaaactttaaatttttgttggtctacaattttggaagattttttcatatcttctttaattttttattattttttaaagtcggataaactgcaaagagccatagtttaagcataaaacaaaatgactgtgataatttacaattatttttcagcagaaaccaaaagcaggcaaaaatcagctgattttgtcattggcattatcaagccaaaatattcacttaaaacagaaaatcatgtgaccaatttgggccggattttccgacccaaccactcttaaacataggaaatgcaaagacgtgggaaaaacttttattttttttgaatttatgttttcttaattataccgtagtaaaaggcctatttttcagagtggctataatatcatattttctggattggttataatattctgtgatctgtaccatatttttactaattaccaataaatttaaagttcaaacaaataaatgtgccaataaagtaatccaattcattcatcattctgtgatcacttcccaaaaaaacatttcatttttttcgtcctccgcgttctttcaactgaagttgcactgaagcattcggcataaaattgtagtaggccaaactctgactgtccttcatgaaaatgccctgttgaaatgggaaaacaaaacgttagccaattaatgcaaatgacttaaaatgggaattaaatttgtgttcacctcgtagactaatttttgtttggttgcaggaactccgatctgctcttggattaacgattttaacgcagtgacctgaatacaaatcgatttatgtgcaagccccaaaatagtcattaatttgttaaaaaactagctttaatttttaaaaaagtggaaaaagtttttaaaagcacgtataaaaaatttgaaaaattaaaacccgtaaaataatacttgcaaaaagccctgctaataacgcattgcttgatcatcctaacttatgactgaccgatgaactgatgtccaactgaatttgtactgtgttccccttcaggttccattcatcattttgcggcgtagcgatttgcacagcgatttgaccgtggacctgtaagcaattaaagatatattttttcctcgttttagcaaatatcggtggagaccggcgctcaccttttgaagccaacgttcttccggttccagcgtttcttcgcgcgggcgtttgtttggcggctcatcgccaacagaggcgccggggggcggaggaggaagcatgaaagagccatgcggtggacgcatcatgccaggaggaggcattccttgaggaaaaattagaaaatgaatggatatgccattgagtaatccatttattgtgtgtttgtccaaagaacaatggggtgacttcattattactatatttagggctaaaccgtgtttcgagttttatttagaaaagatagtgtttttgaatagcattgaaaaggcattccaattatttgggaaatttcactaaaatcgaaaggaacggactgatcctcatcatacataaacaaggggtgcgccagtcagaccctcatacgtcggacgtttggcgcaggggggggggggggtgcgccaggaccaatttttcttacgtcggcccccaatttcccccggcgacgaccttttttgttttgtttttttctattctgaactttttttctgacgaccttttttttattcaaaccaaaccaccttttttgcggcgcgtttttccaaaaaactttgtgggaaggggtggggcggtccggccgtgccgataggcgccgccgggaaaaattattgaattttctatgggtttcgctacggaaattgtcaaattgtaacaccttgttcatgtatgatccccatatatgtgtttgtttacccggttgcatgtgcggtggcattgcgcccataacgccgtgcggtggcatgcccatatgaggcggaggtggcatatgcggacgaccgcccggcggctgcataaattgcggtggcatttgctgcggaggacgcatttgttgttgttgctggtgctgtggtggaatagacatttgcggcggctgttggggaaccggcacaattttctgcacattggacgcaatgccaccggtggactgatgaggcggagggcgctgctggaaacacaaaattttggcaacaaaaaaaccatgttatcaacgaagcaacgttttaaaaaatctatcttgatattgtatattatcgagaagaaaaattaatacaactatttacaggtggagccattgaatgtgaagtcggcggttgtccaccgccgaattgttgtgagggtgtcgaagtcgggggcggcatcgacggcaccattcgttctgcggctgggttcggcaaatacccatgctgtcgctgaaattcaagtgtaaatctttccaccccctccattttgcctatttatatttcgtttaattccgtcctctaacctggatttcgctgatttgctgctctaacgaaacactctgttgcgctgcgcgagtggtagcatcaatcgtcgacaattgtccgtcccaaatggtcttcgggtccgaacgcggcatttgccgttcctcctcccccaactttttgccgatgattgtttgttcggctcccttttcaccaataccgaaaatgtctgttcgacgttcggccaatttggcaatatttcgactaatttctgccccgggcgccatcactaagtcttcgtcctggcgatccatttgttcactaaataaaaaaggtcttaaagaactccagcttttaaccccattttttcaggcgaagtaccttttaacttaaacccccttttgccaaaacgcaccggtctcgttgctctttgaactgtgggtcaacggtgttgtaacgcacatgctcgtgcagtttgtctgcaggaatgcgttcgtttgtcagcggcgaaattatgtacttctccgtggaggcagccgcagttttggacaccggaccaccacgcgctgaaaacaaataaaacaaagaattaaactcatcggaaatcaaaaatattaacagttaaagttattgagttgacaagtcctcgtaaaattaccagaagtcaagcattaaatattgtaaaatacccacattttttagggtcgtagtcgcggatgattacgctgccggcggtcggcgccgcgggtgccggttgcgtcagcgttgagccggtgtgttgcttctccgccccgatgttcaagcgttggtgcagttcgccagccgcatcctccgccgcttcgattgcggctcgttctttggccgtttcctcgtcacccgactcggcgccgccctcctcgtccgactcgaccttagcgtggggggtggggatttttacaataaacatatttttaaggcttcaattgttttctacaaacagtttgcgattgcctcgaatccccgtgcgaaatttacccccttcccaccccatgacctatgccggaatatctttaaaaaaaaactagatcattgttcccattacatccatcgccacactctcagccgccgctttggccgcttccgtacgttgttgcaacagaattcgtgccccgacatcctttggcgtgcacaggggcggcaaatttactaaaaaaataaaaaaccgaaccataaaaataactgacaaatagtttgaaaacaacatttgaaataagaaacccctaaagatttctttgcaatgaatcagggtaaaatgagatgataatggctacaccaaatcttgcaaaatcattgatttaacttaagagtggacctaatttaatcgaaattcaacccgaaaaatgtaaggctcacgtgtttcgctgggctgaaagtccaccgtttggacaacgacaaattcgtgccagtcgatttgattgtacgcaatgcgctccttctccaccgcttggtcctcgcggtccttcagcgctttttggtggcggtcccaaccgacgcggtaacgcacgtcctccaagattttgtgttgagtgaccgaagcacgtaaatcatccacaatcgtttttggcgggatcagcacctgtaaataaggattttaaacgggcaataattattaatcttagcagtcaagtcaatgtagattctttttgaattgccataaataaaccttcgtatactgctcgaccagcttggtgaagtattggaagttggagtgttgaggctttaagaaatcaaactggaagtttcgcacctcacggttcatcagctgagtgagaaattgacggccgttccgcgccacaaacaaagcggtcaaatggatgagatccctgaaaaaggaggggttttgattcaaaacgatggaaaattaaacacacagtaagacaaaaaaaaaaagagaacttgggtaaaaagttcaatgcgccacttacaaatcgaatgcgtttagcgtcaaaggatcggcacagaattcgaacggtttgggcggcagccgcggaataaattcggcccgctgcacatgctcacggacagcctccggcaacttcactttggactgagtgtccgccgatgcaacgcccgtctcaaattcattgacctgaaaatgagaaagtacccatataaattgacatttgcttaaaaaccttgttgcgatagtaggcaaagtatgggtcggtagggttgagaaagttgaaacgcatgttggaagcctcgcgctctttgattttcatctcaaattccaatccgttgcgagccacgaaaagcgccgttttgtccacaattgctgcaaagagaagaaaaaggcgttagttacaataatatggagcaattgcgaaggcgaaaatggcaaattcactaaaatgaaaaaagtcgaacttcgaatgtcgggcggtggaatgatcaacccgactatttgtttgccactcattgacggttcgatgttctgcgcgtcctcctcccgattggacacgcgtagttcagccggcaccgctggagccgccggttgtgcctgaggcgtcggtcgacgcaccaacggtttatcatcatccaatctgggaatcacaatttgcaagggcggctcttgcgccatgatctgaataggctagtaaatttaatcaatgcttttgtggttttgaaaccgttttgactttttaaaaagcatacaatttaaataacgaggcttaaaaaattaataaaaaattttggcgtaatgttttcttactttgctaaaaagatcgaaatctaattctatggtaacatgtgatttcgtcagaactaatgggatggacgaactggccgctttgataaatatatttgttgagtgattctacgtgtgtggttttttatgaatttaacctcactcatttgcttctttgactttttgccctgaaaaaatgagtcaaatttaaaagttgttttcggtcaatcatgatgagatacctatatatgaaattatgctcaaaagcaacattctttgtgttgaagtttttaaagttaaattttgttgccgaatggacattggcaactgttgcatttgcctgggtgggttcggcgttgcacagatgggcgtgctgccgtgcctgcacactttccaccactcatgcattcagcgcgcactgggccaaaatgcgcagtgtccgctttgccgtcggcacgccaccgacacgcaaattgtgagaccgaaatacgaaggaagctgccgcgaggcgggcgatttgccaagaaaggttgtcgtgtttaatgggcgggcgccaatgaatttgaatttctgttcgctttatggattttagtcactattcgtttattcagactagatggaatttaaattagcaaaatttcctttcctcaggccatgcgtgccgcgttagctttttacgaccgcaccgttcgccaccgcttcgccgatggttcgtcgggaggcgaagcacagcgcgaggaattgaaactttgtctcaatgtgctggtttttcctaaaattgttttagctgcgtgttcatttaaaaattccattgtttttatatattttattttgcagcaattttatcgtctctgttcatcaaattttaattttacgacagttttcagtcattggtcagcactttggagagcgctgacgcggagagagaggcgaaatgggaacggctgaagcaatttttgagggtgtgcggaacggccgcaatttttgccgttttggcatttctgttcactttgtattggccggtgagtgagcgaagggattaacggtgctaatttaagcaaaaagtgccattcacgtgggatgaaattattctacaaaccgttagaaattttttctacggtataatgaatttgaaacttttcgaacttaatttgggttgaaaccgctctaaaaatttgaattttttactttttgttcaaatccgggcaggaatcaacaaaaaatgaagggtcagcgacccttaaaacctccaaaacctgacgtgtaaagaaggccgctttatcccccccccccctcaaattggccaatttctacgcttctttttcggctcagttgttctcttctctggcggttggcgttgtgcgcaccgtttggactctgatcagttctctgcgcgatctgttggtcgcccattggcccgatttgctcttcggcggtttgctcctcagcactttcgtcgacatggaatcctccgactcgcagcaacagcaggcggaaaaacgcaatattgtggaggagccacagaatatggcggaatatgatcgatgatncatcatcccccc

SEQ ID NO: 416 - DNA, 4377 bp, Heterodera glycines
  misc_feature (49)..(50): n is a, c, g, or t
  genomic virtual cDNA Sequence=SeqID_686; coordinates=1831..1782 ,1740..1575,1502..1457,1411..1331,1287..1218,1173..1098,1051..929 ,884..783,657..543,364..270
  coding sequence=SeqID_853; coordinates=1831..1782,1740..1575 ,1502..1457,1411..1331,1287..1218,1173..1098,1051..929,884..783 ,657..543,364..270
  peptide sequence=SeqID_1091
ctgtgagaacgtactgaaacgaatgaaacagggcaattaatcggaatcnncaatcagccaagattaccacacaggtccggtaccatccgaattaattttcatacatttgatattttatcacatgcgaatgtacgaaaatggaccttaagaaagctagtcgaaaatgtacggacggaaaaagtcatgtaatcgtaagaccgaccccaattaacagcaatgacactttagtaattaatttctgggaaaatttatgcataatgaagcaatacctttccattacgagtgaactgagcactgcaaatcggggctccgtcatgcgcgcgggtaaaagtctcaatgcatcgattggaaactccgtcccaaactaaaaaaaaagtgaaataaaggacaaaaaagaagggggccgtgagggagaaggacaagggctgaaaacctaattctaaaaacctccatttttgggaccttttatcggcgaaaaatggctttaatgagtcgactccctcgcccctctttccatatatgacctatgtctaataatcgaccttttacattcccatcacgacttcccgtgacaaacattcgcgcattttccgaatagcacacatccgtaatggaatcagaatgttggtccttcggtattggagaaacaaagcattgctaaagaaacagattcgatgaagttttcagaatcatgtaaaaaatgttttctatgctatttaaaaacggaagaacatattgaaagcgattttaaacaaattaaaatctaaaaatatggatggtacctgtgtttcggcactataaagacgcaaggtcggatgccgagttgcgcatagaaaaaactctccgctcggatgaaaactgaccgcagtgatcggctcgacctccttccaaacatttcattgtaaaattctttcagaatatgacttaccgtgatcgttttcattgcccttttaaccgcagtttttgaataatcgaacattttcagcgtaaaatcgttgctgcccgaaaggaggacggactcgcggggatggaaagcaacgcaagtgacttcctagcaaaaagaccaacgattcttcgttaagtgtttttgttgtcacatcgaggtggtcataaagggtccgaatgaccgggtgatgggcgtcggggccggactcactcagagtcacgtcaatccttggtgggccaggttaacaaactgcaccttttggggaacttgcctggaaatgattttatcgacatccaaaattttaattgaacaatcattggaggccgtggcgacaagagctcctaaagaaattaaaatgtaaagcactaaacgcgaattgaataccatctggagagaaagcagccgcccgacacggggccttgtgtgtggtgaggtacacagtttcgtacaaacttggttcagggccttgagaaacatttgtctttactcagatttgatgctatattatacttgtcgggacaacatcagcatcgaattccaagtcaagcccagcagactcaaacccaccgaccttttgtcaatgaaataaatggtcataaaaggaaaaagtcagtcatcaaaacaacacctgcaagattgtctcccgttctttagactcgggatcttccacaaattgtttagctattgccacaagacgaaaaagtttgtcagatggaggaggcggtcgtagcgaaaggccaagcgtttgtgccaagttcagtgccaattgttgatgaccatcgtaaaagagttggctaaaatggattattgaaaacaaaaatcaaggaaaacatacccaacaattaatttgtacataaagtcccggtcttttaagtctggcttcattataaaaactgtttttaacaaatatctaaaggtatattgaaaattaaaactaatgaactgaaaaatgtccaaatcagaatgtacatcaaattggttaactattaaaaaataataggatttggaataagtaaaattgtaaaaaatgagcaatgttaattaaacctaacttatgccaagtggcgagggatccctcaggcttagtttttagaatcttaatttttaaaaaagcacatttttctatttttgggttggggcccaaacgaccccgggccccaaaaacgggggcccaaacgaccccggggcccaaaaacgggggtccaaacgctctggtcccgacccgtagtgctcgtttaaaatatgaacagattattatatttggcttaatgttttttttaataaaataccgtaacaaaaaaaaagaaaaaagaaattgattttcttggtagccattgcaacattttccctgcatttccattccgtcttattaaattttaaaaatgcttcgtttattggtttaacaccttcatgatgctgacttttccgactgtatcctttgttattgatgggattttgcggcgatctttagaatttggtgagtttcgtatttcttcaggcaaacaaaacaaaatttttaaaaaaattctaaattttactatctactggagaagaagccgaatgggctacaacgtcttgtgatgcccactgccaatgtcagaagcagcctctagcttcattccaaaacctattataaagcatcaccgcgataacaacaaaactaagattcggtttaatatccttatttggaaaaggcagtcaacgaaaaataatgggaattaaattcatggatcaatcgagctttttggtcatattatggaattaaaacaatcttgagcttttaatgattgtgatttttatcaccctattgttataggaagcattaaaaggttgatttcataagactcaagagtaaatcattttgagagcaaaaggaaatattttgaaatttttcttgttacataggtgggacgatgtttctagttaagtaaattccaaaaaattatctcaaaaacggggttcctaaacaagaaaaatgccgttttatttaatttttaatctccaagtggaggccagcttataaaagccattcaataatgtcaaaatagctaattgtaagcaaattgtacttcagaactaattttcatttttcttaacattttttagtctattaaattcaatttctgcgacgcaataatttttaatcattggcattggtcgctctgcttaatttggcttgcaatttaacacatataaattaaaatttagagtttaaattccaataaatcacgttaaattcattcggtccattctttcatcgtttaaagcgcaaacggtaaattgaccatgtaagttaaagatgtgcggagaattggagcatcagaatgagtcaattaattgcggcaaaagctttgaaaaatgtgttaaaaaattcaaaaactaaaaaacggtcatcgtgaacgtaaacacactaaaaatcaaacataaaaatatgtattaaaacaaataaaatttttcttccaaagctttgagcctaacgaaattaattaaattgcatggaaacgtacattaacaattaattttagattttctcctccatcgtcaacaattatgtccaaattcgaaggagggttctcttctcatgatgttcgctttttgcttcttccatctcgtaaactttgctttagtcctatggctatggtcaaatgccttccgctttcccttccattggtggcgctgcgcccagtgcgcctccttttggtaatttgacaattcgtgcactacagtttttgaattcatatttaggcttttctggagcaccgttcggctcgcatgcattcggaggcgatattccgagcccacttgacgcggaaatccaaattgttctgagggaaattcagtcggaagtgcatcagctagagaacagtggcgaatacggggaacaattgaaaaatgcgcgtcgactgttggccaccggtaagaaatttgagcagcaaaaaccggattgactgcttttgaataataaatcccagaagcaaccaagctcgagaataacatcgacccagaatggctcgaagtggacatcaacaaaccgatcaaagtctccaagaaggtgctcatccccagtttccgtcatccaaaggtttcttccccaacctttttcattaaatataatcactgttatttggattcagtttaattttgtgggcaaagttcttggaccaaaaggcacgactttgcaaaatatcgccaaatcatacaaatgtcacgtgtacattttggggcggggcagcactcgcgaccgaaccaaggagcaggtaattctcactcaattttgtttttcttttcatttcttactttcttttgttctcataatggctatttctatcgcttggtcttctcaaaccaaatttcccaggaaatgctcagcagcggcgacccacagtacgctcactacggtgggcctttacacgtcaaagtggagacgactg

SEQ ID NO: 417 - DNA, 4714 bp, Heterodera glycines
  misc_feature (4658)..(4658): n is a, c, g, or t
  genomic virtual cDNA Sequence=SeqID_692; coordinates=2346..2537 ,2624..2948,3008..3246,3290..3523,3657..3766,3824..3989,4035..4286 ,4400..4549
  coding sequence=SeqID_927; coordinates=2346..2537,2624..2948 ,3008..3246,3290..3523,3657..3766,3824..3989,4035..4286,4400..4549
  peptide sequence=SeqID_1151
tttttaaccacttataattaccggacaaattatcctcttcagttttccatttcatgttggagtcctcggatgaagtcgctttgccattttcttcgatttccattcctttcggtttcttgaaatgctttccaatttgattatttatataacaaaagaaatttaacggcgtcactactaaaataaattaatgcttttgaagagaacagttcagttttattttaacattttcagacaataaataaatctaatttaggtgtacagtagtgtatacagtatgaccgtgcgacgattatacataaatggagggggggggaataatcttcctttgtccatcctataaaaatttctttatttgctttcaccacgggcctttcgccatgcttcagctcccgagcgacggccctgattctgtgcttcgcttccatcacgaagttgagggtgggcagtgagaaactccaccaattcaaaggccatttgctttttcagcccggcagttcgatcatttgtcaattgacgagccaatcgtgcgttcaacttctttagcaaacaaaatatgttactaaatcgaatctccgctcacatttaaaaagttgcgaagaacaggttctctcacgctggtacgccttttcatcgctgctcggtggtcaaaatggtaacgccatgtgacatcttggacatggtcaatggcaaaggcaaaaacataagcatgtttctttccccatcccttaaacgggtagaaatataaattactaatttttattacatacaattatcatcgaatatattttccttatttgcctactgactttgtcgtacatcaacggagtgtcaataacattttcgcagggatcacaatgcaaccagcgctgaagttggtccgaataaacttcaacccaaacatggtccaaattgtcagaaatccagctaaatcttaaacgatttaaaaaataaaattgtctggaccgagtttgaaatcccattgatcgacagcaaagcgtaaaacagtttgcgtactctccacaacgacctttccgcgtttccaacaatttgagcgggtcgttataccgtgggaaacggatttggtcgccacatttatcacagcgaaacagctcaactcgatcggccccgttccttcgctcctcctccgagggtattccgccgccctcttaaaaactcacataaatagataggtacgcctcgatcaccgggttttccttcaacgccacacttttcgcattttggatggtttacccagctgaagaagccatggaaccagccaagcaaccctttggccaaatcatattggttcacttccccatttgttgttgccttttcacgaagttcttcagcgggaataagcgaaagtgccaatgtttgggatacttcgtcctcataaatcgacatctgaaattcgagactcaaataattaaaaatcatttggcgcaccctttgcgattgtgacaccaatctttccaaccatcgcctttcttctgaattggcaacatgcgcttccaaagttttctttgtggtagatcctttcccaatgtccggggaattcgctaagctggcgatcaaatgttcaagtccagcgggatcagcgccctgtactctgcccatttcctgaccatttaacagaatcacaaaagtcggcatggcacgaactgcgtattgttggcaggaacctgaaagtacatagctgacaaaaaatattcgatcatttaatttcaactcttctcctttaaaaattaaatatggagtaaaaaaaagcattaatttgtcccttgtgattttctgtttagtcccacctcgacagcgatcaacgtcaattttcagaaacactgccttttcagcgtatcgaatggaaagtgaatcaaaaagaggcgcaattgccctacacggtccacacctattgagagtttaggtaaacagatgaaatgacattttcagattaatgacttaccaatttgcaaaaaagtcacagacaagcaacaaccgagagtttgcattggaggaaatcgcctgttggaaggcatcgtcatcattaatgtgttgaacaaccattccttttaaatattagcggagtgagtaatgtaacagcggacttcctgaaaataatttttacattttttggtgattttttttattatttgatttgaaaaagggtttttttgaaaaacgtgaaaacccttccattgtacggaagacgaaggatactcataatttttttgttataccaaaacaccaacaaaaaaagtttggtttaaaaaaaattcgaattttagtttagctaatcgtcttaacaagaacacctaatgaatttttttaggtttatttgtttactggaaatggatgatttgacaacgacggaattgaaatggcgaccagcagaaagagctaatgatgacagcttaccactaaaacctcttaccgatattgagagacaaatgaatgaaattcgtacagaattatttatggcaagacaggaggaggaagcgataatatcacggatcaaagatgaatttcggcaaacgcagaaagttttaggtcaattagaataattattttatttaaaatgtttgaaaattaacagttaattagtatttcaggtactgataatttccagcgtctgttcgatcaatcagttgctcgcattaatgccgaatttgaaagagtcgggtccaatgctcgtcaattggccaattcgcttgattctgtctctgccttggctcaaaatatttcctgtcgagttgtcgcgttggatcttggaaaaagccgtgttgtggagtgtttgcaaagagtgaacgacttaaaagaccttggaacctgtgcattcggcgtgcaggaggcattgcgagctgaaaaatacgaagaggcagcacaacatattcaccgtttccttacgcttgacacggccgttttcaaaatgggcgaccatcgggagagcaaaggtcgacatggaaaaaccatttccattaaaaatgtttttaactaatcaacattttttcagatgctggatattccgtgaaaaattcttatgaaatccttagaaatgcgaccagtgaattaaagcgcatcatcgaacaacgttttgacgaggcgcagtcctccggcgacgtggcatcgatggaacgctttttcaaactttttcctctgatcaacgaacacaacagcggactgcagcggtttgggactcatctttgtggtcaaattgaggcacttggtgaccagaattttcgtattatgcaggtgttcatttcactttaaattccatttattttattttatttaggccggtgggactgacgacaaacgcaaaaacgtactttatgcggacactttgacaatgcttttcgagggcgttgcacgtatcattgagctgcatcagccgataatcgaaaatttctatggcccagaaaaattactgttgctgattgagctgattcagcccgaatgtgacaaacagtgcgtccgagtgttgaacacgttcatccaacgaagacattttgaggagaaagctcagcaggtgtttttttaattgcgagaatatctgcagtattttgtaataactatttacaataattgttaacccgtaaatgaaggtgttcactttgattgacaacactcgaccaatttcctcgaatttggtccaaactcagcaaaattctaacgcaaccatcgatgccattgagctggacttactgctttctgaagtgactttgatgcacacccgtgccgaactattttggcgctttctccgtcggcgactgtgtcgacaagcaaaaggaacgacgaacaaatcattggatgaagcccaggaacaaagagaaaaaggtgcaacagaacgccatatggatgagtcaacagatggatttgacgaagacgagcaacaacggagagaccatattgaaaagctacgcaagcagcgagaggaacacgcgatcaaattagacgcggtactgaaccgatcgggacttagcacgaaaatgcaggtggcctaaggaatatttaaagcgtcataaacccgtatatatcaggaactgatgggcaaatttgtactcgtcgaacaattttatatgacgcaatctgtgaggaaagccattgacatggacagcatcgaggagggcgcgctgaccagcactctgttggacgacgtctttttcattgtccgcaaaagtattcgccgttctatcagttcgtcgtcggttgactgtgtctgtgcaatgcttaataatggcgcaacgcttttggagacggatttcctcaaatacattagtgcgcctattaaggtgatttagggagagagcagaaccattcacattttttgataattgtagtattaatagtctgaccatttgactttttgttcgccatttcactttccttttcccatttaaattagtccggctatccgtccacgggttggagtgccgaaagtgcttatcaaacagcacaaaatgtgatgcaaggaaaaggcgaagttgtcgggggtttggaaaagcaacggagtgctttcataacagcactgaacaacttgcgatcatcaattgattgtgtgaatacgcttaagtctggtctttccgaggatttccacaaaaacttgccacaggtatgtgtataccttattctgtgctcaaatgtattggaaaattttcgggttnaatctgacatgtatgaaccccggatatttaaataaagattaatttaaactgaattt

SEQ ID NO: 418 - DNA, 5115 bp, Heterodera glycines
  genomic virtual cDNA Sequence=SeqID_693; coordinates=4831..4700 ,4547..4356,4294..4157,4094..3910,3861..3822,3775..3703,3656..3550 ,3497..3396,3080..2988,2897..2749
  coding sequence=SeqID_899; coordinates=4831..4700,4547..4356 ,4294..4157,4094..3910,3861..3822,3775..3703,3656..3550,3497..3396 ,3080..2988,2897..2811
  peptide sequence=SeqID_1127
ccccccccccccctccccctttaataagaacatttattccccgccccccgcggcgacatttgatccctccgtcccccgccgccgaagggatttatgtggcgtatttttcgcttgtcacctttttgcatttgcggcgacagctgttttacaatttcgtattttcatccctcgggcacataaacatttcagagaacaaaaaaaatcagaaaaaaagtaaattgtgtcggtgaaaattgtccgtccgattcgatcctctaaattttcaataaaattcgtcccttttcggaacaaattcaatttaatggccaaaatacaattaccattcatttgcccattttcgggccatcccatgcccgaaatttgtgtttgaaagtgtcgtttcgaaattcttcgcttttttagcaaagaattgtcctaaacagaatttggctaattcttctgtttattctctgttcgctcagcaataatcccattttttgatcatttacaaattttaaaaggttcgttttcattcgctttttcccaatgtttacgacgcttaataaaagaaaaagaatcttaagccgacttcgaaatagttgtaatgtgacgactagtccattagtcatttcagtgatcagtcagtccgattatttttaaaataccatccattagccatttaaatgagcactgatcattccgcctgattactatcatccatcctttaaccatttacacttgagagtgatcattggtccgttcatcggttcgatcattcctttgacatccttaacggtttcttctaatcacccctgattttgtaaagggtctccattctcttcagccaacgtcatttctgatcagtcgttccctccgtttatttctccgtccgtcgctttgaattccttctcttcgtttggccatcatttttctctctcggcgctgtcgtcccaacaaattttccctgggaggaaaagcaccgataaaacactgaaatgggcttgaaaggctccaagccgaaactgtccaaggaggacctggagttcctgaagaagaacaccaacttcacggaggaacagatcaaagagtggtacaaaggcttcgtggtcagtccgtacactttgcgaggcctccgtccgttcaccgctttttgtccccgtttagcaagactgtcccaagggccatctgaccaaagagcagttcatcaaagtgtacaaggtcagtgccatgccgatttaatcggtcggggactgactttagccctactcatgccccgcttcttttcaggactttttcccctccggctccgcggaaggcttctgcgaacacgtgttccggaccttcgacacggacaacagcgggttcatcgacttcaaggagttcttgctggccatcaacgtcacttcctccggcacacccgagcagaaactcgaatgggcattccgggtttttgaatttcgaattcaaaacgatgccattgcctttgtcccgttcagatgtacgacatcgacgggaatgggacgatagacgagaaggagatgatcaaaatcatcgaagtacacacaaatgggggcttgacatttccaacattttgccgtttttaggcaatttacgaaatgttgggccccgaagtgaccaaatcggcggacgattcgccaagaaaacgggcgaaaatgattttcgagaaaatggacgtaaataatgacaaagagctgacactgaaggaatttgttgacgggtgccttgcggacaaggagcttttccaggcaaattttgtctcagaaataaaaaataaaaaattcaaacttttgccggaaaatcctcacttttttcctttcctcgttttttcagattctgaccaacgaagtgaagaaataatagtgccggcgccgcccgtgccgttgcccccccccgccgctcttctcacattccgagctgaactttgcattattattattgcttttttccatttgcatcacatttttcgtgctctcccctaagggcactttcgccactctccgctccctccgtcttcacttattatgttttaatttttgtctctaaataaattctccccccccccctccttagaccatcattaagacaattatagcaattagataatgtgatgattagttcgagatttttatgcaattcgctttgcccccccccattttttgtacgcatcgcatctctcccaattcccccgtcctttcgttcaccgcacaacaaaaaaacattttatccatttttgttcaattcgtccccctttctcattgatttctatgtttattgatttgtattttgttttatgttccttttgattattctccatttttgatcaatattaaaattaaagcattttctactttttccttcccgtgtaaaatttccggcaaatagaatttgtgcgaaggcttttcctttttttgtcaaagcatccaaattttctaaggacataaaaggagaagtgaataaacattgaattggcttcccttcccttcccggaacattccctcccccttttctttgcctctgtccaatgggcacggcttttcctttctcaatttttgtctgccatccgccgaagccaatttccgggctattgaagagaattatagtgagaaatgtaataaaaataaagagcctgggaacggcaaagggttctttttttgttaagttggccagggaattttgtaaaaatgaatttgagagtgaataacggaggggagaaggggaggagaggccgttttaaagcaatgcaaaacgaagtgtaaaaaatttataaaaaaacaattgagagaacattaaaaaacggtcactcacggagatcacttcttcggctttggtttcatctcctcgtcacacccgtgcagaaagattttcgtcacattattcgccgtgctgtattcgaagccctaaaaaccaaatttctcattttatggtgtctttttggcttggcaattctctttcaatttgtccgctctctgcgccccttcaattattaccttgctccaatcataaccgatcgcataggccattatgtttccacccgaatgaatggcgcattttgtgattggcattggcaaggcatcggaaccctaaaacataataaactgaggctaatggcttttgttgttgtttatccgtacaaacattgaaatttataaaagttgacaaagttcacaattttctgaatcctttgattaaaattggcacaatttttattttactaaaatttaaaattatagttgtttttcttatggtttgttaaaaccttttaattttttaaatctaactagaccgaggatgatcaaacttaaaaacatacgaaaaatataaaacaagactttctaaggttgaacgctataaagtaatcacaaatgctttttaataaactgtttaataaaacccaccttcaatttcgtccgcgcgtctttgtcccaaaaggaatattttccgtctgcgcccgctgtggccaatgtttggtgggtcggatgaaaagcgacgtcattgacctgtagcaacggaaaacatttaaatcgatggaccgcccgaaagatgacccaccgggtaaatctcctggtaattgttgatgagttcggctgaccgatggcatttgaaagtgaaattgtccttcgggtcctttggctgcaaacattgaatcgccactcgtcctaaaaagcgaaaacatggaaaattacgattagattagtaatttgccttcggtggagccaagagcgaatccattgggctgtcccgtcattttgtctttgaaaatcgcaatgcaacgactctaaaatgaaaacgaaattcgagagagtaaaaggttttgcatgcacctgaaacttcaactgagattccacgtcttgaatttcagagctaaatggaaaaaagaatgaatgctagaaagctctctgaaaaactcacggtgttccgtccaacttatacattttgatgtgtctgtcggccaaagcaacgaccatcagcgggaaaaccatgtcggagcagtacacgcgttcaggcagttggatggttgccagggagttttgggtgggcaattggcgcatgtcccaaaaacgcagcgtccggtcccaacttcccgtcattagacactgaaaatgttgaacattacattcaaattctatagtggttacagcccctccaccgccaataccgaatattggggtgtcgctatccaatggcaacttcgcactggctcattgtgcgtgccaacaacagccatttggtttgagcctaaatcccaggcgaacgcttgtttgtctgcaccagcgatgaatatttttgagccgtcctggaaagagtacattttttggaaaattttcaagtctgattacaaaacaaaaaattacgacctccgaccaatccagcgaaagaatgggcgctccaacattttgcattgccttcggttcaaccattccattttcattgacctgccaaatgcgacaggtgttgtcccaggaaccagcagccaaaaaaatgggagacccggccaccagcggattgaatttcattgcctgcacagtgtcatcgggagcttgtggaaccttagaaaacaaactcaatcgagccaattgcagcaagtgtaaaagcagttcgcacgagttaaaaaacccaagatacatttactacatattttatataaatccgaatcgaaattggcgcgacattcacacaacaacacatgctgtttcgtcacctcgatgtcctgctgcgttgtggtcgaagtgctgggctgcacaactgcggtgttcgcagcgccaaagagaccaccactcggcttgctgccaaaaggcgaagaagtgccgatggacgaaccaaacaaactcataccagaattaacaggacacacataaaatgtcggttaaaaaagtcagatatgtaagaaaaaatcatggaattgctaaagaaagacgaattactttttttaaaagttttcagaaacaatttatacacatttatcgatgatctgccaattttcctcgtttatgtgattcaattccgtcgcaattttagccggcgactgcttttccctcctttcctttttcctctttcttctcacttctttacaagccactgtgaaattttataatcaattcaaaaataattttgatt

SEQ ID NO: 419 - DNA, 5516 bp, Heterodera glycines
  genomic virtual cDNA Sequence=SeqID_694; coordinates=1558..1719 ,1775..1897,1938..2070,2555..2697,2754..2977,3267..3499,3541..3689 ,3902..4000,4047..4217,4271..4388,4443..4579,4830..5024,5074..5169 ,5222..5272,5319..5516
  coding sequence=SeqID_914; coordinates=1558..1719,1775..1897 ,1938..2070,2555..2697,2754..2977,3267..3499,3541..3689,3902..4000 ,4047..4217,4271..4388,4443..4579,4830..5024,5074..5169,5222..5272 ,5319..5495
  peptide sequence=SeqID_1141
tgattttcaataaaaaaaaccattgtaaaagtgcaaattgatttaaattaaactatgtttaaacattatagaagttgaagcaatttaaaatttataatcaaaatttcaaaaattttgaaaaagtcctggtcccggggggatcccggcccaaaaactgggaccgggagtcgcgtttaaaacgggagtccaggtcacgggtcccgtcccggttcattttccaagtcccggttctggccatttcaaaattatgagctctacttatcatgatacattgctgattgttcttcaattgttgcgctcaattttgtaaattatacgattaataaagcctaaaagtcgggtcctcaaaggaatattaaatttaaaaaaggtttaaaattaaacaactatttactttataaaaaaattttttgttgaaaaaacaattccacaaaaaatggttctaaatatgttaattttttggtttttgaattttgctcttggataggtaatttaaatagattatttatcatttcaccactttttaataaatgatattaaatcatttaagtaatttaaaatgaatacgaataaaagaattcgattattatctttattgattcgtttaatcattaataaaaaaatttacaactttcacttaattgattaatagggatgggaattttatgcgaatgcatatttttttcctggcttctccatgctctaaatagtgggaaaaacactttcttttttgtgtttgcgtataaaaatcgggacttttatttgcatatttttgcatatcgagattttggtacatatttgcatattttggctttttgtacatatttatgcatatttcgccattttttggaaaatttgttaacaaaaatgcaataaaaacggaaaatacacccctaagaatcgaccgaaaatttttaaaaacacaccactaagaattggaaattttctcaaaaattcttcccccaaatttttttttcataagaaaatttttgatttaaaaaatgtcaatatttgctaaagagaattttataaaagaaatgtagaagcgcattggcaagtgcattagtaaaaaatttttttttattgaatttgcacccctaattttcaattttttagtgcatattttacgatttttgtgcatatttggtgcatatttcacgactttatttgcatatttaccgtatttcctcgattataagccccggggcttctattgttcaacccccctccaaagggggcttatattcgaggggggggggggcttcccgtataatcgaggaaatacggtatgtgcatattttggccacttttcgtgcatattttttgcatccctgcaaataagggtctggtgtgagttaagtcatactgaaatgtcagtactgaaatgactgatctcagaagaaggtgatttttctcatttctcttccttctttcgttttattcgccatcgccacgttcacgtttaaaaatgtttctacaatgttaccaaccagcatctaaaacattttaaagaaactttgtttttttaatattttctagagagtacataaaatctcaatgccattgcgtttggatgtaaaacggcgattgctggcgagatccgatcgcgttaaatcggtggatttacatctcaatgagccttggatgttgatttcactttacaatggctttgtgcacatatggaattatgactcacaacagctcatcaagtcatttgaggttgtcaaaattgttctttttctacaatattttgatagagccttacaatttcaaggtttgtgatctgcccgtgcgtgctgcaaaattcattgtgcgcaaaaattggatcgccactggttctgatgacatgcagttgcgcattttcaattataacacgttggaacgtgtacatcaaatggtttggttcataaacttaggctaaataagaaaatttacaggaagcgcattccgattatctccgatcccttgccgttcacccaacccaaccatttttgctgacttcatccgacgacatgctgatcaaactatgggattgggaagacaaatggaagctgaagcaaacatttgaaggttcgaactggtttttgtcgaccatgggctataaccaaatttctaccgaattttttaacaaattttgtcaaaaactgcaactccgttcatgattatccgaattgagtgattttgctttcgacggccccgagtattctcaatttccggtgcaaaattttattaattttaaaaagattatgaacaaaaatgtttggaaaaccagtttataatacaacgaaatttttgaaatttcagtaaaataaatattttatgatatttaaattataaagccaaaaactggctcgggccccaggtgaccaagtactgcctgtaggcgccgtctgggaaaaacgaaagttactaaaaaaactatttttctccatgacatttacaattggatttttgggaaattacaattaattaaaaataccaaggcttttaataaacatttcttattttcttgcataaaggttttctcaatgctttttaaatttatcatcttaaggacacacacattacgtgatgcaattggtgataaatccaaaagacaacaatacctttgccactgcatctctggacaaaacaatcaaagtttggcagttcggaagctcagtgcccaattttacgcttgagggtcatgaaaaaggggtcagtccatggatcccactatcattcgaactttgggtaatggtttatcgaaataggtcaattgcgtcgattattatcacggaggtgagaagccctacttaatttcgggtgcggacgaccggctaatcaaaatttgggactaccaaaacaaaacttgtgttgtcacgttggatggtcattcccacaacgtgtccgccgtgtgtttccaccccgaattgcccattatcatcaccgggtccgaggattcgaccgtgcgcatttggcatgtgaacacaaacaggtgaattcatgtccatatatgaactttctttttgatttttatacgattattttcgtttggtcccatggcttagtcagaattccctaaaatttgcttcctttcttccatgggtttgaatccgcttcatgtcctgataatttacactgattatttggcttatgattataaaaaatgctgttcacgtactgaacaattatgtcgaccatttacaaaatgaagccataaatctataaatcccaaattgcttttcaattttccttttttggaaattgtttttcttttccgacagacttgaaacaacgctcaattatggtttggagcgtgtttggtgtgtcatggcccagcgcggctccaacacattggcaattggctacgacgaaggctcagttgtcatcgcacttggtcgagaggaaccggccgtatcaatggatcccagtggcaaagtgatttgggcacggcacagcgaaatacaactggcaaacttgaaaaccatcgaagagcagacgcttgaaaacattcagggtaatactgaattttatttatttcattctaattcatttaagacggggagcgattgtcattggctatcaaagacatgggatccacggaaatatatccgcaaaaagtgcagcactcaccaaacggacgctttgtcgttgtatgtggtgatggcgagtacattatctacaccgcaaccgcattgcggaacaaagttggtttcggtgccgaacattattggacaaaggggggaaggtcaattttcattttcgcacagtaatggaggcaatacgaagagagtatttttattcgtgcgataattttgacttcttaaataagggcggtgaggagaggaggggtatttcgcaaagaccaaacactctctgatcagtctttgatcctctcccataataacactgctttcagtcctttgggtcgagtttcgattttgcatgggcaaacgatgccaacttttacgctgtccaggagaattcgcagctgatcaaattgttcaagaatttcacggttcgatattacggcttacttttttttctagaaaagtaacatttaggaacttctccaaatccgacccgatgtgatggttgagggcattggcggtggtcatttgctcgctgcgcgctctgccggttctctgcttttttacgattggagcactggacatttgatacgccgtatagaaattgcatccaaaaaagtgtattggagtgaaaatggagaaatggtgactgacccaacacaattattcgaacaaagtcatactataacattcgtcaggttgcgatctgtggcgaccaatcactttacatcctaaaatacaactctgaggcggtaacaaatgcaaatgtggcggacatcggacccgatggcatcgaggatgccttcgaagtgatcggtattgcgcacaaacagaaacgacatgtagcgtatacttttttttacttgttaggcgaattgggagagtcggtgaaaaccggcttttggattgggcactgttttatctttacgacgactctgaaccggctcagctattacgtgggaggggaactggtcaccatcgcgcacaccgacagacccctttatttggtgagtcaccaatgctaaccttatttttattttgacgttcctcaccctcttagctgatgcatcttgaaatgagaatgcatcatctttatttcttaaatggtgcgttcttcacataaagatgtgaaaatgatgtttccatgtatacacattcttttcaattttccattgaaaagaatgtgtgaaatggatacgacaatcagtttttacacctatcagaattaaaaatacagttttattcactggatttcagctcggttatttgtcaaaagagaaccgggtgttcgcttgtgacaaggaccacaacattgtctcgttcaaacttttgttgtctgtcttggagtaccaaacggcggtgatgtgcaaggattttgacacggccgatcaaattttaaaaatcattcccgaaaatctacacacacgggtggcacaatttcttgagaagcaggtagaaatagaaaggttactaataattttaagcattgtttttttcatagggatttaaaaaacaagcactggcgattagcaaagatcctcagcatcggtttgagttagccttgtcacttggtgatttgcccgccgcttatgaaatggtattgaatttaaatgagaaaaggaagggttttagggatttgttgaatttaggccaagcaagcggacagtgaggaaaaatggaaacaattggcacatgcggcggtgattcccttttaaactttgatcaaattcttttacaccatttaagacaatcaaatctgagctccgtttggcaggtgaatgccttgctaaggccaacgatttcgggggccttcttctgctcgcttcctgcgccggttcgaatcgtttggtaaattatttacgcgttttcatgcggttcttcatttctcaatcatttacaagttcatttttgctgccggtttaagcaagaatttcattaataaat

SEQ ID NO: 420 - DNA, 4978 bp, Heterodera glycines
  misc_feature (4952)..(4952): n is a, c, g, or t
  genomic virtual cDNA Sequence=SeqID_695; coordinates=1..169,212..486 ,558..660,703..814,872..950,1009..1184,1350..1621,1675..1838 ,1904..2052,2110..2296,2347..2432,2487..2623,2682..2765,2817..2851 ,2915..3140,3190..3336,...
  genomic virtual cDNA coordinates=3459..3711,3767..3861,4649..4978
  coding sequence=SeqID_840; coordinates=1..169,212..486,558..660 ,703..814,872..950,1009..1184,1350..1621,1675..1838,1904..2052 ,2110..2296,2347..2432,2487..2623,2682..2765,2817..2851,2915..3140 ,3190..3336,3459..3711,3767..3861,4649..4879
  peptide sequence=SeqID_1236
ccaatcaaagcatgtgctgacaaactggttgagggaaattgaacaatttggcaatccgccagtgtttggctaccaaagcagcgaagaaatgtcaaaaaacgggacagaattagcgaaacaggaggaggaagtggaccaaatcattaaggacaagagcaagggcaaaaaggtgatcgtcaattttgcatcccaattttaataaattctttagagcaaggctttggcgaaaactgtggctgccaaattccaatggcaaattatgcaatcgttgggcctcaacgacgcagaaattgccgagttttccaaatccgagcattggctgacctatttcccgcccaagtgtatggcggacctgcgcaaaatgggccttgcggtggactggcgacgtgccttcatcaccacagaggcaaatgcctatttcgactcattcgtgcagtggcaattccgaaagttgcgctcagaaaatctcatccaattcggcaaaaggtgccattcccgtgtcatttttatcccttggattgttatcataatgcttatgttgttctcattcttgacaggtacaccatttactctcccaaggatggccagccgtgtatggaccacgaccgttccaccggcgaaggggtcggcccgcaagagtacactttgatcaaaatgcaggttaccatcaaaaagtaaatttttctgttccactttttttagattctggagcccaaacccaaagttctgtccaatgtctctgcttccaatggtaagccaatgtttttggtggccgccactctccgccccgaaacgatgtacggccaaacgaattgtaagttgattgtttgtgatttcatccaaaatctgtgatctattcgttcattttcaggcttcatccatcccgacatcacttactccgtgttttttgtgggtacaaacgaccaagagattttcatcgcaacggaaaggtttattaggcaacggacacaaattaatgtgctctaatgtttttttgtggctgtttagggccgctcggaacatggcttaccagggcatgacggcggagaacggaaaaattcgctttgtgcccggcgtggaaagagtgaagggcgcggaattgattggctgtgcgttgaaggcgccgttgacgagttttgagcgtatttacgcactaccaatgctaacgatcaaagacgacaaaggtcaaaagcatttctgggtgttaaatgattggtccaatttgcctaattaggcgacagaataatggcaaattgatttatgatccgttaatttaacgaaaaacgcataatccgtttatctgtaaaaaaaccgtgcaacaatacagtgtttcttcctttttcctccaggcactggcattgtgaccagcgttccgtccgacgcacccgacgactttgccgcactgatggacctgaagaaaaagaagcctttgcgcgagaagtacggcatccttgacgagatggtgatgccatttgagcccatcccaatcctcgagattcccgagtatggtcgtcttgccgctgtgcacatgtgcgaaaagttgggcatcaacagccaaaacgatcgactgaaattggaagaggcgaagaaggagctgtacctaaagggcttttaccagggggtgaggggaattaaataaattgtttacaaccaaagcatggttttgtttcgcaggtgatgttggtcggcaattaccgggaccagaagacggaggtggtcaagaagctgatccaagccgacatgatccgggatgggcaggcgtgcaaatatgtcgaacctgagaagaaagtgatctctcggtcgggcgacgaatgtgtggtggcattgtgcgaccaatggtcagtggaaatggcaaacttagtcttgattcatttttaactaagaattgtactggttgttgtaggtaccttaactacggggacccggcatggaaagaagcgactcgcaaatgtttggcttcgcttaacactttttcggatgaagtgcggcgcaactttgagcacaccatcgaatggctgcatgaatacgcttgttctcgctcgtttggacttggtaaaacaattaacgccaattattcacaatttctattatattttttcggtttcttaggcactaaacttccatgggacccacaatatttgatcgagtcgctttccgacagtaccatttacaacgcttattacactgtttcgcatttgctgcaaaatgatatttacggtgctgaaacgggtgaactcggcattttaccacctcaactgactgacgctgtttgggattacatattcatgggtaatttgtttgttttttattatttaattcgatttaatgtatttttgaaggtattccatatgattcgactaaaatgccaattgaagaagcaaaactgaagagaatgaggcacgagtttgagtattggtaccccgtcgatatgagtgagtttttatttattcatcggcactttcttttaatggcacttttatttgaaggggtttccggcaaagatttgatccaaaatcatctcacttattacattttcaaccacgtggcaatttggcgtaaacagccgcagttttggccgcagggaattcgtgcaaatggacatttgttgttgaacaatgaaaaggcaactttaaaatatacaaattcataaatgcaactttctcatttatcacgcatttcagatgtcaaaaaatactggcaattttcttacgctttttgatgcaattgaacttttttctgccgatggaatgcgattcactttggctgtaaataaatcatcgaataaaaattgcttcaaaatattttttccttttcaggacgccggagacggaatcgaagatgccaatttcatgtcagcccttttttaaatcgcacttattacactttaaaacacacagatagtttactttttcaggtacgaaatggctgatgcgggcattctccgcttgtacgcctttctctcgtgggcttcagaaatggtcgaagcatgtgccaagggcgaattgcgcaaggacggcatcgagacttttgcggacaaaatattcaacaatgaaatgaaccgtctcattttggttaccggcgaccattttgagcgtactcttttcaaggaagcactgaagaccggctttttcgagtatcaggtgggtgaaagcaaatgttttttggctagtgattcggtttctctttgagttggcccgtgacaattatcggcagctctgcgggagtgaccaggcaatgagtgccgtgttggtgttacgcttcatcgaaacacaagcgattattctttcgccgatttgtcctcatgtttctgaacgtgcctgggaattgttgggaaaggtactttcgtattttattgtgccgttttagaacacaaatttgattttatgttaaatttttacccatttcggcaccatttatcactcatttaccctctattgttgattgttttctcgttttagcccggccttctcgtgaccgatgctcgctggcccgtcactgctcctgccattccgttgctcgtcgaccagagcaacttcatccacaacaccgtgcacgagtttcggctaaggcgcgacgcgaagctgtgcccgaagaaaaaggacccgaaaaagcaattgcaacctccgaagtcggcaacaatttacatcgcaaaacgctatccgtcatggaggggaaaactcatcttggaattgggacaaatgtacacggtcagttatttattatcggtagctaaattgatcgctaatttgttttttgcgcctttaggacaacggcactcttccggacaaccgaacactgctcgaaaagctgagcaaaccagaatccgcggaagagaagaaggagcgcatgtcgttcgtacaggtacagttttaaccgcatatttgatccccgtggctacccgacttttggggatttgcaacttttggacccgacatttggggatttgcaacttggggacccgacatttggggacccgacttttggggatcccgacatttggggattttattaaaacaaaaaaaaaatatttaaaaatttataccaaattaaacaaatttacgattgcttttgccagagttaattccattgcaagaaaaataaaataatttttctaaataactctgtttccggacacaaatcacaatacattttagtatttacagtaaaccctttccattttttatttaaaacgcctttcccaagggccaacgggaacagaaattcatcaagggcattcaaaaagttaaaggcgactttactgtctaattgcgtacagcaacaaaatgccgaggtccatcttttctgtttcttagagtccggaattagagttgattttaaaaatattattttgttttttcttgcaatggattaactctggcaaaagcaatcgtaaatttgtctaatttgggataaatttttaaatatttttttttgttttaataaaatccccaactgtcgggtccccaaatgtcggatccccaaaagactttcgatccccaaatgtcgggtaccctaagtgttgggtccccaaaagtcgggtccgtccccaaatgtcgggttcccaagtttcaaatccccaaaagtcgcaccacggatcccgtttccttcccattatcaaaatatactaaattttttcgaacatttttagatgttccgcgatcgcattgctcagcgtggcatttttgcggtgacgtcggaagaggaattcgaccagaaggcagcgctcagccaaatcagcgactttttgctctcgactttacaactggaggaggtgaaattcgctgattcggccaacgctccctccgatgtcatccgaaattcgtgctgtcccggcgcaccgttaataatgtacgactttgttgagacaacaaacaattagggctttggttgacaattgaatgtttttgttgattaatttggcttgtaaaaatgcgtaagtacccaaatgatgnagacatacaccgagctttatttgttg

SEQ ID NO: 421 - DNA, 2911 bp, Heterodera glycines
  genomic virtual cDNA Sequence=SeqID_696; coordinates=2583..2460 ,2301..2109,2009..1919,1864..1799,1742..1679,1627..1468,1393..1336 ,1268..1209,1107..967,902..858,777..579,454..355
  coding sequence=SeqID_1013; coordinates=2583..2460,2301..2109 ,2009..1919,1864..1799,1742..1679,1627..1468,1393..1336,1268..1209 ,1107..967,902..858,777..579,454..355
  peptide sequence=SeqID_1220
tctggcatcatttgaaagctctatgtgtgctctatatttacatgccaaaatagaaattaatgattcaacaataaaaaagttatggcacgcggcgccgaaaaagccaagaaaaagtcaatttttgaggttttttggccataacttttttgtaaacggatgaaattttttgaaattttgcaggctaatagagaatctcaagagctatcgaatgataataaaaatatttaatttggttgataatgaaaaaagttatttgaatcggcgccgaaatggcccgcgccgaagtggccggttcccatttaattcatcataattcatcatttggcccatctattgattctaatccaaaatcggaacttggccaggcgagagaagcacacgtggggtgtcagacagcgcgacacgcgcagtcgccagtgctcctcattgatggcactcatgcacttgtcaaaatcttaaaacacttcttccacctttattatattccgaaatccaatcgaatgccgcggcttccctcccccccccccctttttcccgccgatggctttgcctcttttggccgttgcttttgcttttaccttcaaagctttccaccgacgagcgtgccaacattttcgattgcatttctgaagaaaaattggactcggcacggaaatgccaccgttcgttgagcatttggcggagttttgacatgtcaatgggccactcgttgatggcaatgtttttgtaggagtggcgcaggtgataaaagtgcgcttgtcggcacggcacacggacctaaaagcgaagaaacggggagatgggaatgagattagaaagagaattggacgaccggactgaaaggaggggggactgacctggacgaagccaaaccgatggatgcccgattcgtgcatgttcaccttcgaatgggcaaacaagcatgagaaacggcatcctaattatggtcgttaattggttgcccactgtgtccacgcgactcgcattgaccgccacgcgcgttttcatccgccacactttgcaactcgtcttccatttggagtgggcgaggaattcgaaattgaaactgcgcaaagtgttttgagtggatgggtcggggagaacgaactttaaagtgggggctaatgaagcaaatagcggaataattaaaagcaattagcaatgataattaaggaatagcaggtaaacaaaggaagcgaaaaacgcacttggacatcgcgatgttcgaagagcaaagagccggcatttggatgctgatggaacagatcctaacaaagggaacaaacggaagcattaaaaagcattcacagggagtaaaagcattgcccttttgaccttgagtatgtccacgtttattcccggccgaactttcattgggtccaatggcatcaacctgaaaaagcaaaaagggaccgactgatcggaaggaaaagaaaaaacgatcaatgcgatcgatggcagacggacatgtcgtcgatgtccgttatgaccaccatttcggcgaacggcttgacaaagtgcagacagttgacgtgagactcttcaatgcctcgggaaaggaccaatccgttgggattcgcatcggaaagcaccggccatttgggccacacgcgcaaatggacaatgcctgacattagtttaattggtttttaaatgaagatttagcacaaaatttgaccaatgcgctgatactccgtcagaatttgaattgtgtctgccgaagcggattgaattgggaaaaccttaagggggggggggggggaaattgaggacaataggcacagtttcagaagaaaaccattttggaggcgcccaatgccagccaaacttcgatgcccgtcaccataatttgccattcggtgtactgtacaaaaaggcatcttggtcgggcactctcctaccgtgtccgtgttcctaccgtatacattggtgccacgcaaacgaccaaagggaactttttgggcccaaagtgcaaaggcttttccaatggcacctcaatggaatggtcactcaatgcggaagtggcaagggacagaatgtgccgatttggagtcagcctgaaaggggttgttggactgacactctgagactcattttggcatttttaccgaatgctctccgccgttccgtccgccaattggcactccgccaaatgtccgccccacgcgcaaatgtcgttggccgccctctttccctggtgaatgcgttcgatgtgcgcctcactaagcacctttttgctgtcttttccttcgctaacacagaacaacgcgtgcgtttgacgaacgtcgccgagaaattgaaacacccaaaacggacgaaatgatcagaaaagtattgatttattggcaaatcaaaaaaatccccgcgattaaatgacaatcgatcggtttttggccctcccattccattggcattattccgttttcattgattggcatttaatcccacacaaaacaaacgtacagcgaaatgaccccgcacattttgctcttcgggcggtcgatggaacgccccgagaacaatcggacgccgaccgatgcgtttcactatgaaactgtcgccgaggttcttaagcgtccacatatttgtggttcggtggtaaagggcgaagccgaagacgagtccgccaaggacaacaacgagacggaagaggagagagacaaaacggaccgaaggggaggcggaggaagagaaagaggggaacggcgagggagcggacgagcgggggagcggaagatacggcacggaggagggcgaagcgcagcagaagagagcgggacacgcggaggaagaggaggaggaggaggggcaagcggaaccccggagggggaggaagaaacgacggaaaagcatggcaaattggaggggcgggaagcggaggagaagtgatcagcaaatggaccgacggagc

SEQ ID NO: 422 - DNA, 4348 bp, Heterodera glycines
  misc_feature (52)..(52): n is a, c, g, or t
  misc_feature (4293)..(4293): n is a, c, g, or t
  genomic virtual cDNA Sequence=SeqID_697; coordinates=1405..1589 ,1638..1776,1870..2018,2062..2371,2554..2811,2860..3027,3074..3273
  coding sequence=SeqID_875; coordinates=1416..1589,1638..1776 ,1870..2018,2062..2371,2554..2811,2860..3027,3074..3273
  peptide sequence=SeqID_1106
ctaaacaaaaaagaggtaaaaatgaggattcgctttccattaaaagaatcgnccaaacggacatcgctgatccatcaattttatttaataagactggcaaaaattgaacatttttgggtcaaagaaatataaagaaattattgtcgtttccggaccccaaccaataagcggaatttgtttcaatttttaaaattttgccattcttgtggtatttcttcaaccctgaatttggatttaattttttcaataaaaatgggtaattttttttaattttaagcaattttcttagcaaatttcattaaacttttcctggctgcgcctaacggcaccgccaggaccccaatcggtaaacatcgaagcttaaacaattttatttttaagtgtttaataaaagccacaaattctcggttaatttataaataaaaattaaaatggaattaaacacggcggtttaaaaacatgcactaacttggccagcggaagcacttggtgcgaatgggttgtactcctcgatgaccgattgactcgttgaattgtttccgactgatgcagccggcgaaaccacacgctgaacagccgggtcctgagggaaaaatgatttgtaaaaacagaaaaataaaataaccactaacagaaaggtatttaaatgatcgtaccttaaaagggtcagcaaatgggtttccgtccaatttcgacattttctatgtaatttatgtacctaaattctcatcagatattatggtaataatgtaatggtgggctcccttttcgaaaaaaaattttaaattatgagttttgggccgccttgatcagtgatcatgaccttgaaatctagaatcccgactcaaattcgattatacaagtattgacatgaattcgaaacccaacccggtttagcgaaatttttacggcgtaaaaaagtcattttacacgggtgccaaaaggacacaccaaagcgaaaaaagttaggtatgcacctagtcgcttatttgttagccatattatgtaacaacattatgccatttttttggatttaaattccaacaaattaagaaatctttttaatcttaacaaataaaaaagctaaattttaattttttcgtcttagactaggggacgattaaaaattagccgaatgctttctggtcgatgatcatgataacaattttaatccctaattttatggtaaaaattgcatacaaaatgcatcaaaaaggttaaatttctctacccttaagctatggaaaagaaaaattgtaaaaatgattgaaaaacataatttcatcccatgaaaaacacttgtagaaatttcaccccattctcggttttttgtcggccctttctctagagaagtgccaaaatgacaaaatctaaatttttaagcgaaaacaaatttgtttttctacgagtaagcaatgggcaaggaaaagatccatatcaatattgtggtgatcggtcacgtcgattccggcaaatcgactaccactggccatctcatctacaaatgtggtggaattgacaaacgtaccatcgagaaattcgagaaggaggctcaggaaatgggcaagggatcatttaagtacgcttgggtaagtcgtaatccaaatcatgttcatgttaaaatatattttttttaggtgcttgacaagctgaaagccgaacgcgagcgtggtatcactatcgacatcgctttgtggaaattcgagacaagcaagtactatgtcaccattattgacgctcctggccatcgcgacttcattaaaaacatgatcacaggttctgttttgcaatacctttgtaagccattgtcgttataaccatgataattttcattgtgcaaattaaaatttaacaaccaatgatttgcagggacttctcaagctgactgcgctgtgctggtggttgcttgtggaacgggagagtttgaagctggaatttcgaaaaacggccaaacgcgtgagcacgctttgcttgcgcagactttgggggtcaagcagctcatcgtcgcttgcaacaaggttttgcttttgtattgtttcctgaaatagttctcctttccagatggacaccactgaaccgccattcgccgaggcccgttacacggaagtgatgactgaagtgtccaacttcatcaagaagatcggttacaacccagccaccgttccattcgtcccaatctctggcttcaatggcgacaacatgttggagccgtctgacaggatgccgtggtttaaggggtgggcgatcgagcgcaaagatggcaatgcatctggcaaaactctgctcgaggctcttgactccattcttccgccgcaaagaccaactgacaagccattgcgtttgcctctccaggatgtgtataagattggaggtttgtttgtttgacacatggctatttcatttgttgcatgtcatggcagttcgtataacagttcgtgcaataggcaatgcgggaaacggctcataataagcttggcttaattttgggttgcttggacttggacttaagtttatttatggtgctaactgctattgaccccatttgttgtttaggtattgggacagtgccggttggccgtgtcgagactggtgttctcaagcctggaatggtggtcacttttgctccgcaaggcatttccactgaagtcaaatcagtggaaatgcaccacgagtccttgccagaagcgcttccaggagacaatgtgggcttcaacgtgaaaaacatctctgtgaaggacattcgccgtggttcggtcgcgtccgactcgaagaacgacccggcaaaggagaccaagagcttcacagctcaaggtttaacattataatcttatagcagttgtaacacctatgcacttttagtcatcatcatgaaccacccgggtcagatcgctgctggttatactcccgtgttggactgtcacaccgcgcacatcgcgtgcaaattcgccgaactcaaggagaaggttgaccgtcggtctggaaagaaagtggaggacaacccgaaggcgctgaaaaccggcgatgctggtagaacaactctatataatcagaaatcagtctttaatttttctagggatcgtcgatttgattccaaccaagccgatgtgtgtggaggcattcacggactacgctccgcttggtcgtttcgccgttcgtgacatgaggcaaaccgtcgctgtcggtgtgatcaaggcggtggagaagactgaaggcggtggaaaggttaccaagtcggcgcagaaggctgctgcccctggtgggaagaagaaatgagaaacgctgataattggaatggattcgatttttggatttgttgttttttttggccgtgaaataggcccgttaactttgggttttgttggataaaatttgttttaatctgtttgctttttggtattggttttttccagcaatgttttgcaatacgtttgtccattgggtgggtaattctgttgaagatcatctatgttgacccgttccaggcagcaattgtgcgcaccttttcgtagttccattcgtcttttaaagcccagaatcggctgttattctgtgctcgctcaaatgtcaactgaggttgaaaaggcgcagaaagcgaagccgggcggagacacaatcttcgggaagataatccgcaaggaaatgccttcgacaattctttatgaagatgacgaggttctttcaaatcgatctattccttcattttgttgttttttaggtgctcgcgtttaaagacataaaccccgaggcacccgtccattttttggtcattcctaagaagtgcatcactgctctgtccaacagcgaagagcaggtttgctgggcattttatatgaattggattgtttccgctcttcccaaactcaggaccaagcagttctgggcaaactgttgctgacagcgaataacgtggcaaaggcacagggtctctccaacggatatcgcattgtgatcaacaacggtcgccatggatgtcaaagtgtgtaccatttgcatttgcacgtgcttggcgggcgtcagttgggctggccaccgggttaaacacttggaaatgtcaatcttatcgattgattttttgaagggacttctggcacttttctacacactttgttggggaaatttggctattttaaatgattactgaaatgacattaatttattattgcatcatactatattccccagataaaaagtgcaaaaatgaataataaaatctaatgatttgtaatatgacttttttcctgacaatgatcgttttattccccgttttgcggctgttcagtattttctttccanagagcatgttccatagtggtacttttccttaagtgatgaaaattcatattcgttt

SEQ ID NO: 423 - DNA, 5360 bp, Heterodera glycines
  genomic virtual cDNA Sequence=SeqID_698; coordinates=5360..5178 ,5135..4871,4812..4710,4659..4578,4532..4434,3730..3668,3592..3491 ,3427..3391,3331..3199,3128..3016,2769..2678,2553..2294
  coding sequence=SeqID_959; coordinates=5360..5178,5135..4871 ,4812..4710,4659..4578,4532..4434,3730..3668,3592..3491,3427..3391 ,3331..3199,3128..3016,2769..2678,2553..2444
  peptide sequence=SeqID_1177
cgacataaccgacagaacaattattcctctctacttttggcttttggagctgcgtcaatgtcttctatatctacattacgtcgccaagtgaagaatgtggcctgcaattacactgatgcacaagtaaaagttagagaggcgaccaggttatcccaaaaatttgcaaaccaaaaaaatcgagcaatttagcaacgacccatggggaccaaccacagtgctaatgtctgaaatcgcagatttaactcacaacccagtttcattcaccgaaattatgtctatggtttggaaaaggctaaatgaccacggaaagaattggcgtcatgtatgttttttgtcacaaaaaaacctaacaataaaccttcattaggtgtacaaaagtttggtgctccttgactatttgataaagtgcggaagcgagaaagtgtcagctcaatgccgcgagaatctcttttcaattgagacactcaaagtcgttgcaattcatgttttttgctaaattttttttaataggatttccaacacatcgaggacaaccgtgaccaaggattgaatgtgcgtgcaaaagccaaacagatggtcgctttgttgcaggacgacgaaaaattgaagaatgagcgagcccgttttttgttgactcgaaagcgcttcattcaaaacggatcttctgggatttcatcggacggttcgagacgatctgttggaaggagaaacatcgaaacaggcgcaacgggtgaatcaatctgaaagcgttcatttttctttgcttttcgtctcttgaagatcctgaatttgaagaagcgcggccgtcttcccttggagaggaggaaatgcaactgcaaattgcattagcactttcaaaggaagaatgtgaaaaggaacgtgaactccgtcgaggtgatgacatccgcttgcaagtaaatgagtttaatttttaccatttactaatattatgctattttaatactcaactttgatatacagattttgatttttaataaagtttgaaattatagttaaatatattaatcgaggcataattcagtcagactggtcgagcaaattcattaattttagatcgcaattgaagagagcaagcgtgaattggctcgttcttcaagtctttcgtctccgtctggtggaattgaccctgtcgaaaaacagggcacctccaagtcgcacggagctttggatgatttgctttcattgggactggatgacgtgttcaggagtaatattccaaatgcgactgcgccgggtagttctgcacaaacacaacaacagccacctcaactgggcgttttcaacgacccctggtcgccacggccttccacaactattccaatggttgaaactgcgccgcctgtctccgctcaccagacaagtattttgtccattctcttttgagcatttctcttcccacacagttattcaaaacgacccatgggcacctgcggcttcttcctcggatccaagctttgtgtcctttggttcttcgtcgacgactcgaacaataaatcccgatgggggccacgttctcggtcctctcatgcagtcatcttcaaccaaaaatgacccatgggcatcatttgaaacacaaagttttgctgcatccgaaccaacgaaacaatcatcggatgatttctttggaaacattggtgaacctgcacaaacgacgaaccaaccgacaagtcagggacagcaaagagccggtgtaaagacacccgagtcctttcttggaggttttcaaaagttgcttttgcctaatacaattgcaatttaagagaattctgctcttgttaatcttgataatctgcttgggccttccaaccattcgactattgcccctaaaaaaggtgattatttcttgtttcgtgccataaaattgttcacattcaaccctttcagcgactaatccgtttttggtcggttcatcaacgactgccatgaccaataacaaaaataatccattttcaaccaatgaaaggccgagcccatcactaaatgaaatgatgcaagcaaaaaacggtggaggagcgtactgatcattttcctctatttatgttcaaattctaagagccaccccttcctaaatattcttgtcatgcggactcacattttggagtctgctctaattttcccccgttcataagcacatctattcgtgatttcttacttaaataattgtactgacccaaattttaaatccttattaatggaaaagtgatattcatgataaaaccccgcattctgttgtttttatgtatttatatagggacaaatgaaataaaattaataaatttatgagcaagtttataaacgaaggttggcaaatttgctttagcacaactgacggcactgaatgaaacggataaatttcaaaacgataagtgaattatgaattctttttggaattgtttgcgtcctttggcattttctttggctctcaaggcaactgttcattcgtcggaatccaaacttcgggtcgcgactgttcgtttattatgtgaattacgcgagcgaaaatatcgtcgggcgaatgtccggtgaccattcctaaaagacaatttgagcaaagcgattggcaacactaattacttagggacgggattatgtttatttaaatatttcgtgattttaaataaaaataaatcccatcctactagtggccggcatttaccggtgaacaaatccccgaagttttgttcttggcgttgacaccgttcaaattgcttcagggcatcttcttcactgagcaaagagtcccattctctgaaggaaattacaataaattaggcggatataaaaagggaagcccagcaggggaaaatgttggtggcactgacttttgttagaattcgaattcgctgttagggattgaccgtaatgggaggaatttgtgaccagcgaacccaaaccccgtgagaccaagtttaatgggctcaaccagccttacaattagcctcacaatcagtgttaccggatacagtacccaatgatcgcccgtccttttcttaccgtaattgttggtaattaagcggcttaacgaaaaccgaaactggataaatatgggctgtgttttgcagtcgccgtatcgcattgccggaaacgtccaaaatgcaatgccttcccttaagccaaaagaaaaagtaaaacaaagtcgagaaatgccgaaatttgacaattcctccaaaaacgtacagattcggccacttccatcaccgccgctacgctcgtcccgtacaaattgttttggaattggcccgcttcaatgaaaaggttgctcttcacgtccctctccatttcggccttcgtaacgaaataataattgcgtctggagaataaattgaaatgaatcgaagaaagcaaatccaattaattgtcgcaaattacccgtgcacttcgccttcccgcggtgggcgagaagtatctgaagagagacaattagtgacggaattgtacgatgctaattagggaaaagatggcccattacgtggcacacagctgctgaatctgtcggggtgtcgactgaccaattcgtcatttatgcgatccttcaaagccccgagcacaatgaccgggcgaacgtaattaactaaaagcgaacaaatgccaattaacttataattttgtggttttattgcatgaattaatagcatacaattcggacctgttcgcagttctaccgtaacgtatgaatgaattggctcatctgcgatagtgccgccgcctgctaaaatggcgaatattaattataacttttgtggatatttgttaattcacaaacagttaaacaatccaaaagcgagattgagagagggagagagagaggggggggggagagtaagtgagagagagggggggggagtgaggagtggggggggggggggagcagaggaaaagcccacactttctaatacaaaatccaacggaaaaatacaaaaattcggatgttagcgataaattaggcaacgatgcgcaaaaggcaaaatatatatttaaaaaatcacaatatggacaacagaaaaagcaatgcacggcctaaagcaacgaatggctcggccaggtcaaaaagccaaccgcaaacttttgctcactgtgctgcggattttgccgatgccgtcgacttccatcgccgacgtgcgtttggaccgtctcactgtcgctggcaacgccgtgccattgcgcgcgattggcctcccccggggggcgacccattttggcagtcccatgacacaattgagtccattcccttcctatgctcgttatgaattttatgagttgataaaaaaggaaaagataagcggataacaaatattcgacggaaagtggcaaatgaatgacggggacggaatgccaaataaaagaaaaaagacagaatgccaaacaaatgaatttgcaaagggtgggcttggatttgcgctgcccccactcactttcgcctccgtccgagggatattcgttcagtttctcagtcgatttaacgaagggaaatttgcgagaaaaggaaagttggctgcgagaaccgcgtcggccttagcagtgaacaaattgcgcgagagtccacaattccctctcaccgtccaatccgccgccgccgaatccgccggcactcactgacgcgtttctgcccaaactttgactgccagcgttgaagttcacctgacgagcaaaagggcattacgccatttgattatttgcccttcttccacctgtttgcgccgctgtctctcgcgcttctccacccttttcttggacggaatgattccctcggggccttcgtccccattttcggcgacccttcgcgcagtccaccgtaaatgcacaatttttgggaattcattcctaattataagccccagcatgggctaaccagtcgtcgtccgccacactcgtcacatgcaaaatgtcgccgtaccgaaaggcgagggaacggtgcggcagcaccgcatccccgcgggaggggtcgttgtcgaagagggctctcacgtaaaagtcctgtcggatgggcattggcattatctgctgcggagggggcatcgcatcgggtggcaaatagggcggctgttgtggattttgctggagttgggccatttcggcacgggcacgttccagtttctcctcgaatctctgatactctgaagaacacaatggaaaagcgaatgaagcggggagatgaccctggggcagatgttggagcactaattgaacttcggagtaattggggatggccttgagggtttgtgccgcttgcgcgtgggtggaattttgcaggtcgacttcgttcacgcgcagcagcacgtcgccctgacgaagagggatggataggcacaaatgccaaaacaaacggcgaaacggccagc

SEQ ID NO: 424 - DNA, 6822 bp, Heterodera glycines
  misc_feature (6762)..(6762): n is a, c, g, or t
  misc_feature (6806)..(6806): n is a, c, g, or t
  genomic virtual cDNA Sequence=SeqID_699; coordinates=3474..3342 ,3292..3088,2912..2612,2556..2441,2360..2296,2106..2000,1954..1864 ,1793..1680,1372..1124
  coding sequence=SeqID_987; coordinates=3419..3342,3292..3088 ,2912..2612,2556..2441,2360..2296,2106..2000,1954..1864,1793..1680 ,1372..1124
  peptide sequence=SeqID_1202
ctttcctcctctcttcatcctcctcctccacctcttttcctcttcctcatccttcctctttcctccctttccctcttttctttctcctctcctcttccgtctcccttttctctcactttcttcctttcctccctttatcctcctcctctttcctcctctcttcatcctcctcctccacctcttttcctcttcctcatccttcctctttcctccctttccctcttttctttctcctctcctcttccgtctcccttttctctcactttcttcctttcctccctttatcctactcctctttgctcctctcttcatcctcctcctccacctcttttcctcttcctcatccttcctctttcctccctttccctcttttctttctcctctcctcttccgtctcccttttctctcactttcttcctttcctccctttatcctactcctctttgctcctctcttcatcctcctcctccacctcttttcctcttcctcatccttcctctttcctccctttccctcttttctttctcctctcctcttccgtctcccttttctctcactttcttcctttcctccctttatcctcctcctctttcctcctctcttcatcctcctcctccacctcttttcctcttcctcatccttcctctttcctccctttcactcttttctttctcctctcctcttccgtctcccttttgtcactctttcttcctttccttccctttcctcctcctcctattttcttcctcctcattggttgccatcgccgtcgtcgccttcttccgcatgctcaatcaggccaataatcgaattgtcttcaactcgaacttttgagtcggcgcgtacctcaacgatgccctggggccaattattgaataagtgaacaaataaaaacaaagaaaaccaaaaagcggaaatggcattgtgacgcgaatgaaatttaataatgcgaatggggtggcaaaaatgggaaaatgccaaaccatgggaataaatttcattattttaaattctctaaatggggacggattttgtttaacttaaaaaacttttcattaacaacgcaccaatttaatccgttatatattggtcggtttgcaaatgtgagatcaataattgtcaattaactattaaataccctcatcgttatgcttttgcccagccaaacatcgccctccaaacggacgcttttcactttttccatttttggaatttgaggaattcgccgttcaaagtctataagtgaagagaagtgatcagaaaggcacacatttggcagcagagagacacgctgtcgcagcacaaaagaatcggcccagaattcgaataaatcagaagaacggacgcggaacagatcacgagtggatttgacctgatcagagggagagagagatagaggagatcaaagtgattgactgatcagaagacggattgattggagattggagggagagagagagggagagagagagagggagagagagagagagagggagagagagagtgatagagagagagtgagagagagagagtcagggcagggaaagagaatgatcagcagaagacgaattgatcagagaaggcgttcaaaggaaaatcagcatgaattagggagggattcaatatgaacacaaagtaacagactgataaaagataagactttcgtaaattaaaaagaccggtaaaaagcgttgtcgtgaaacgtaaattgcccatgcgcggccgggaaagtttcgaatggcaccgccaatggattgctccaattgcacgacgcgttgaccgtctgataaacgctaaaatattcaatttgataatttagaaaattgtcaaattgatggccgtttggcttggccaaataaatgccttttcattggcgagaatttccattttgaatttgtccaatcgctttttgaccacgcgaagattcacccaaatgttgttagtgttgaacatcctttgaaaatggcagccatttgaagcttcgtgttcattttgttacttgaacgtccgcagggaacagaattcgtccaaccgatccgacggcacttgcggacattccaaatgcatcagacgctttcccccgtccaattccaccaatgtgccacccttttgattaggcatttttatttttcattttcaccccctttttgccccccccccctccccccactcttttgtccctctctccccctttctttccctccccccccgccccctccgctctctctctctctctctcctccctttgccttttgctcccccccccccctccctgctgttcctctgctggtccaccttcacgtccgcttgtgtccgttccgtcatttccatcacataatcggcctttccgtccgcaattactttcgcaattcgttcgtcaaaaatggcaccttttcggcaaaaaattgccagaattagttggttgttttggttgttctacttgtgttgtcaatgttggcgaaaaatgccaagtcccttccgttcgccaaaagttcgtcgagcattccgcactgatccaaagcatggaaagcattgccatggccaggcgggtaccaactgagaaaaaccaaaatcgtcaaaacaaagaaaagcaacgagcagagcgaccgacccttcttcggcacggtcatcccacgagttgggcaccggacgaagagaatcggcaaatattcggggacacttcgactggcaaaagcatttgacagcagcgacagaattggcattttgtgcccagaggaaggctttggtttgcgcatcggtgttgaaagagttcatcaacagaagcggaacgggggagcgcaagtcggcgcagttcaacagaatgcggtgctgctgcagggcgaagtccaaaaaggtgagtccgtcacgcagttggaccagcgatttgggcccggaacagcccattgtagtgcctgccaaagccatcaatgtccgaacacttccttgtcatcctttgattttccctttttcgatcacttttcccacttttctctgtccatttactcattctgctgatcattctcccccctccccgccctttgcttttcatccgatcattcgcttctccttttgtcccccttcgcttacccaatcctccgttcagttttatcaccgcaattcgttccaaaattgcccttctctcctccgatccctccaccttcggcaaatgttcgtatggcatttgcttttcctttgccattggttgtatttcctgccaattcactttgtgcggatcctccaaaaattggcggaaaagttgccgaaacaatgccaaatccttctcactttggcactgattaatttagatcaattcaacaattgctaagctttttgaagaaaacctcggaaggattgaccagcgaagggatgacactgtccaattggtccattaaatgcgcaccttgactttcattttccatcgttggcactgatcggtcagtggtgatcaatccgacggaggaaaaatgagtggagactttatttattggtgaacgaagaggccaaaaagacagacagacaacaccacaaatggagttaattcctgatcagagtttgtcccgcccactttctccatctcccctctcgctctctctctatcttttcactctctctcttttctctctctctctcttctcttttatctctttctttccttttctcccactctctttgttttccctccacaattgcccaatatttctgtccttccgatcaaggtcatctcccttcttctcacgcgccttttccctctaatgaatgaatgaatctgtgatgaatggattgaatggatgaccttttctcgtcatcgcaatattggcttatttttgtttgttgctgcggttcatacgcaattaaaagttgaaaattaaaaaatatatgcctattttaaaataaaaaaagaagaagatgatttaaagggggtaaagaaagaaaatctgaataataaaataaatacactgctgggcagggttgttccgggttacccgatacccgaaacccgaaacccggcctttttctcgacccgaaacccgacccgatgattttgggtcgggtttcgggtcgaaataagcactggtaagaaaggggtctgggtgaaaattaggtggataaggaaattgagaattttttttgaaacgattgtgttcaatggaatcgaaaattttgtatttgtttttgttcattattagggctgccaaaagtatgcaaatgcatatttttttcctggcttctccatgctctaaatagtacgaaaaacactttcttttttgtgtttgcgtataaaaatcgggacttttatttacatatttttgcatattttgggcctttatgcatattttgccatttttcttcaaatattttccgattttggtgcatatttggtgcatatttcacgactttatttgcatatttatgcgcatattttggccacttttcgtgcatatttttggcagccctattcattattatcctttttctaaagatattttgtatgaatttcttgaatttaagcaaagcaaatggctgaaaaacctgattccatttggttttatttccatcgtctactgatttaagaaatcggttaagtgcagaaaatttggagaagcttctttttttgcatcggaatttaccaatttataatttttcttattgatttttaaacaaattaaaaatttgtcaattgacccgatacccgaaacccggcctttttctcgacccgaaacccgaaacccgacccgatgatttttcggccgacccgacccgaaacccgacccgatgatttttctcgacccggaacaaccctggtgctaaatagtgaaatgaggtgaaaaccaatatgcgacaggtgaaatgtccttcgataattggtaaaagaggtgaaaaacaataggaaataggtgaaatgtcctggtgaaaagagcgaaacacaataggaaacaggttgaaatgtcctgtgataagtggtgaaaagaggtgaaaaacaataggaaacaggtgaaatgtcctgtgataagtggtgaaaagaggtgcaaaaacaataggaaataggtgaaatttttaagctatagatggtgaaaagaggtgaaaaataataggcgacaagtgaaatttactgtgataagtggttaaatgaggtgaaaaacaataggaaatagatgaaatgtcctgtgataagtggtgaaaaaaggtgaaaaacaaaaggaaataggtgaaaggacctatgataagtggtgaaagaagtgaaaaactataggcgacaggtgaaattttcagttctaggtggtgaaaagatgttgaaaattctaagaacattgatgaaattctaaagaagggatgaaaagaggtgaaaactaaaaacggaaataagtgaaatgtttcaaaaacagatgaaatgacaacgaacgacggtgagatcttcgtgagtgacgataggcaaaacaaaacaataattgagatagaagctattttaaactggtgaaaaggcaaagaaataatggaatatgtagaaaaataataaaaaaatttaagagatttaccttaacaatggcaaaattaattgctgttaactgtgcaaaaggaaagttttgtgacgggtattgttatcacaaacacaaaaagacaaaaaataaaatttggtggaagtgtgaactttatcaacacggatgcaaaggttggggttatgagagtaacggtgagtttttcggcactcgaatgcataaccatcctccatgaccaaattctacttcaaattgagggagaacaatagatttgaatatgttaaacatataaatcagattttacattggaatttcaaaaatatcacgtgaaattatttttcctctcagcgtgcgtgattttgggtaactcaaaacttgaaaaaaaagtttgatatttccctactctgagcttttgaatgagcttaatttttgttcataccggttcaatttcagggattgaataaatgacaattaaaaattgcggctaacaggtgcttacctacactttaggtcgttcccaattgatggtccaccagaaagttggcaccgggtgtttggaaatcaggaagtttgggcatcagaaatttaatcaattagtacagctaattagacatagggtaggttaagcgtctacttttttccgccttagaccatggaaacgctggagactgcttggctttcaaatcacaatgccgtcggtcggacatcgtcgtcttccccagccgtcggtgtcagctcaaaaagttgagccattctcgtcaccacatgctaatcactaattttatttctactaattagaaaatttttcacccacaaatggttgacaaatagactgaactgcgttttattttgcagtagtaaggcctaattttgaaaaataacagaaattttttggcagagtaaaaaaatagattaaatgaattgccatttaattgaacaaaaataaaataaatttcgagacgacaaaaatgaaattattccctttattatgtttaattatatttttaataattgtcaaaattggatcagaaaagaaaaaacttcagcagaaatcatttgatgcaatatttggagaaaattgggaagaaaaagaagaagaaaggcgaaatgaactcaaaaaaagagaaataattggaaaatattataaaattaaagaaaaaataaagcaaaaaggaagaaaatattcagcaaaagaatggaataaaattgaacaaaaaatagcgaaaaaattggggacaaacaattgttatattaaaaaatggattanagaatttggtcttcaaaaacaaatacagaaaagctacaaattanaaactgatgaagaaaa

SEQ ID NO: 425 - DNA, 5141 bp, Heterodera glycines
  misc_feature (4916)..(4916): n is a, c, g, or t
  misc_feature (4918)..(4918): n is a, c, g, or t
  misc_feature (4928)..(4928): n is a, c, g, or t
  misc_feature (4948)..(4948): n is a, c, g, or t
  misc_feature (4959)..(4959): n is a, c, g, or t
  misc_feature (4965)..(4965): n is a, c, g, or t
  misc_feature (4969)..(4969): n is a, c, g, or t
  misc_feature (4975)..(4975): n is a, c, g, or t
  misc_feature (4985)..(4985): n is a, c, g, or t
  misc_feature (4987)..(4987): n is a, c, g, or t
  misc_feature (4997)..(4997): n is a, c, g, or t
  misc_feature (4999)..(4999): n is a, c, g, or t
  misc_feature (5001)..(5001): n is a, c, g, or t
  misc_feature (5008)..(5008): n is a, c, g, or t
  misc_feature (5010)..(5010): n is a, c, g, or t
  misc_feature (5014)..(5014): n is a, c, g, or t
  misc_feature (5020)..(5020): n is a, c, g, or t
  misc_feature (5023)..(5024): n is a, c, g, or t
  misc_feature (5028)..(5028): n is a, c, g, or t
  misc_feature (5032)..(5032): n is a, c, g, or t
  misc_feature (5034)..(5034): n is a, c, g, or t
  misc_feature (5036)..(5036): n is a, c, g, or t
  misc_feature (5038)..(5039): n is a, c, g, or t
  misc_feature (5043)..(5043): n is a, c, g, or t
  misc_feature (5048)..(5048): n is a, c, g, or t
  misc_feature (5050)..(5050): n is a, c, g, or t
  misc_feature (5052)..(5052): n is a, c, g, or t
  genomic virtual cDNA Sequence=SeqID_700; coordinates=2866..3055 ,3273..3339,3380..3516,3567..3680,3784..3906,3963..4119
  coding sequence=SeqID_1006; coordinates=2894..3055,3273..3339 ,3380..3516,3567..3680,3784..3906,3963..3977
  peptide sequence=SeqID_1216
aggagaagttcgggttcgaaacaccatttttatttcctttttattgtgattctaaaaggattacgtgcaaactcgtcgactccgtcaactgccgaatcagccgtcgtcgaatctgccgcgggtccgtctacctcgagtgggcttaccaatggcattccgatgttgagcattgatcgtcccgctgcgagttgtggcagtgcatcttatccaaagaacagggataccataatgccgcaaccgcccgtcactcctagcaaccaaaatgaagaaccattgcccgagggatgggagacgcggatggaccaatacggacgccgttattacgtggaccatactacaaaaagcaccacatgggttcgcccgagctctatgccattgccacccggatgggagtcccgtcgtgacccgcgggggcgtgtttattatgtggaccacaacacgcggaccaccacttggcagagaccaacggcggacatgttggcggcgcatgagcaatgggagtcgaaccgttcacaggccatgcatcagtgggagcagcgttttctttacacggtatttgttactgaacaatttaaaaatgccctcaaactttaagcatcacgatgatcctctgggaccattaccggagggatgggaacggcgtgaagacccaaacaccgggcgtcattactttgtcaaccatcagaataaaactacgcaatgggaggacccgaggactcaagggtcagagtgattagcgcaattatatttatgattacatggattactgtctttaggttaacggatgctccgctgccggaaggctgggaaatgcgtatcacagagcaaggtgtgccattctttatcgaccacaacaacaagacgaccacctacaaccacccgcggactggtcggcctgttggtgtgttctttttgttcctacccaaagtgattgttcaatttcagggcctcttggtggtcccggcttacacatggctgccgacaaaacattcaaaaacaaagttgctcagttccgttatttgtgctattcaaacagcgtgcctaaccatgtgaaaatttctgtgacaagaaacaatttgttcgaggattccttccaagaaataatgagaaaaaaccccttcgacttgcgtcgtcgtttgtacattcagtttaaggcggaagatggactggattacggtggaattgctaggtattttgggttattatttgtttttattaattgactaaataataataataactttcagggaatggtttttcttgctctctcacgaagtacttaatccgatgtattgtctgtttatgtatgccaattcgagcaactacagtctgcagattaatcccgcttcttttgtaaatcctgaccacttgaaatattttgagttcatcggtcgcttcattgctatggtgtgttgttgtgacccaatttactatcgtaactaactattagttttacaggcacttttccatggaaaatttatctacagtggtttcacgctcccattctacaagaaaatgcttaacagaaagatcactctcaaagacttggaatcggtcgacactgaattttacaattccattgtttggagtaagttaacagaaaacgtcataattataaattattaaaaataaaagttcgcgacaatgacattgatgaatgcgacatggaattgtactttgtggttgattatgacctacttggtgaggtcaaaacgcatgagctgaaggagaatgggactgaaattgctgtaactgaggccaacaagaacgaatatattgaactgctggtggaatggcgtttcaaccgcggaattgagcaacaaacagtggcatttttcaacgggttcacttcggttttccccctccaatggcttcaggtatgaacttttgtatttagcccttaatttatattgttttttagtatttcgatgaacgtgagttggaactgctgttgtgcggaatgcaggagattgatgtcgatgattggcagcgacacactgcctatcgccattacgctgttcaaagcaaacaagtgatttggttttggcaattcgttcgctctttggaccaggaaaagcgttcaaaactgctccaatttgttactgggtaacttacaattagtttttaaatttactgactgaatcgttatttcacttttcagtacatgtcgggtcccggtcggtggtttttcggaacttatcggttcaaatggtcctcagctgttttgcattgaacgcgttggcaaagaaaattggttgcctcgttctcatacttgtttcaaccggtaaacaaccgatgcttatcaattagcttcttattgtcttcatactgatttaatttaggcttgatttaccgccctatcggtcgtacgaacagttagccgagaagttgacagcagcaatagaaatgacagaaggctttggcaacgaataaaaatggggacaaattgagatatcgactctctctaaataaaatgtgtactgaccttgattcagaagcattgtggccttttatttttagtgttaaggtattattgataagcccaatgccacccgattgtgagccattcattgctgctgtttttgaaaccaaatatgcttatcttaataaccctgtgatataatatgattggaaacaacttaagcacagaaccaaatttttaattctgcatccaatgcatttcaatttgtaagactactttcaaagcatcctaaaccctccctagatcgattctgtcattaattagtcaattttttatattacattacaaatttgtattgaatgaattcgatgaggatcacaagcctttaaaaacattcttgtctttttgtttcacctttaaattgaaattgcctttattatacagcaattcgagtgctacaaatagttcgaaatggtaactgcggaagataccgttaaaacaaaggaagaagaccccaaaaaaacgacaacggacgacggatcgagttcagaggaagaagtgcccgagctcgaagagggcgacgttactgaagagcagaaaaaagttgctgaggcggccggactcagtgagcaggtggctgattgattggtggtgtcatgacaactcgtacaaatgcttacaatttgactaggcactttcgaaacacaaattggacaaaaagttcaaacaaattaacattttttgtcttaaaattttttaatgtaggagttgccattaacctgattggtttgggcagggagcccatcgaggcattgatgtgctaaatcaaataaatcggaacattttaaaggttgccgaaaagggctccaaacaatcgcgttctgaaaagaaggctcgtaaactattcagcaaacttggtatgcctttcaaagttgttcattttcttttgtttataaggcctcaagcaagtgcacggcgtttcgcgcgtatgcatccgtaaatcgaagagcattttgttcgtcatcaacaagccggacgtgtacaaaagtccgggctccgacacatacgtcgtttttggcgaggcaaaaattgaagtgaggcatttgccatcgttcgtttttcagcttggtatttttatttggaggatttggcacaacacgctcaaatcactgacgtggagaatttgaaaccgccctcaatcattcgcgatgttcgcaaccgaatcacaccggcggaggaggaaagcgatggcgaagaggtcgaaagagtactaaaaaaattgataggaacatggagcctggacattgcgacaatcttattctctctcacatctaaatactaactaaaattgtgcttttcaggctgatgctactggaattgaagaaaaggatattgagttggtgatgtcgcaagcaaatgtttctcgaaacaaagctatcaaagcattgaaaaaggctgacaatgatttggtgaacgctattatggtgagtcatccgattgaatgagtgacattctttcgttatttctattcataattcaggcattgacaatgtaggaggaagccagaggaattcagagaaaacttattgttgaccttcgaatttttgcttcaatatttttcctacgggaatccagttcttttaccattgctgattatgttactttacgaattttgcttataaaaattaaaaagcgtactttgaccctttaattctttcatttgctaagtgggtctcgggtcttttcaagtgcagcgatccttgcgacttattcccaacatttgttgttaccgatcactccaattgtcaataagcagccctccaaattgattaattaatgagtatgaaaggacaaacgaatatccaggcaattaggttaaagaaatatttcccgtcaatcgatcactgattccctctaaaagtgccatcccctctaataattgacgaatgtatggacaattaaaacataggctacgaataaatcagtttttatttcaataaatgggaaccattctatttaaaacaatgaagaatttaagaaattcgtatatttttgataacaagttgccatctttaaaatggtcggcagagttgcgctggtgacacagcggaaaatggttatttttgggacttagggaaccaacggcgtagccaaagagggctaaagctccccgaaaaaccaaaaatgtgaacgaaaaataaattgtgcccacgatgaaaaatcttagtgatttagactttccatgaagtgaaatgcaatggtttgggaggtgagtttcttcataaatttatcatattacactctggttttttggcactaaaaagagaaaatttggcgttacgaagaaaaataaaaatggatttttttttcttaaaaagatttgttttgttttttacttttacttgttcaaaaataaataaaataacttcctgtttcccacttttggataatttttcctttctgcactaatcactaataatcaaatgcattcccnantccaccaatntaattccaaattcatattanataatcataancaaatnaaanattcanattcaacccnanaccaaattcnantncccaatntnattnccttantcnntttncctncncntnnaaanacttntnanaattctctaaagaagaaccaaagactccaattaaggagttgtggcctggtgggatattagggtttgaaataagtttcattctttttttt

SEQ ID NO: 426 - DNA, 3046 bp, Heterodera glycines
  misc_feature (3021)..(3021): n is a, c, g, or t
  genomic virtual cDNA Sequence=SeqID_701; coordinates=2919..2809 ,2748..2642,2143..2079,1539..1421,855..757,560..410
  coding sequence=SeqID_893; coordinates=2919..2809,2748..2642 ,2143..2079,1539..1421,855..757,560..410
  peptide sequence=SeqID_1245
tcttgtcggcacaccactccaaaacatccataacccatagttcccaaacgtttcgccaaatcattttttggaaaaagtatccgcgaaaaaagtggtttaaaaagcaaaaaaaaaaaccatttaaaatcagggctcctaagttttttttcaaaaaaaggacaaacgatacccgacccaaagacccttttttaaagaaaatggagctctggtggtgccgataggcgccgccaagaaaaagaaaaaattttgaaattgggagttttgttagcatttatatcagcgaaataaatcattaagcacaaaaaatttaaaaagtttggggaagcctaaaataaaggacaatcttagaaaaaaggacactcgggagccctgtttaaaatgattgacaaacattcgaccggtcggtcacctttattgtccgatcaccgctggccgacacaatgtatttgtgatcaaagtccaccacgttgaccgccgcccggtggccaacgagcacccgacgcacttcaatgtcacgaggcgatgccatgtcccaaaccgcgatggaccggtccttggagctaaattcgccagtaataaatttattttaaaaagacaaaaattatttcaaatttaatttgtgagaacgggggtacgtacccttcagctaaaaattttacgagaaaattacaagaaaaaacttgaaaattttctttttttaaattttttttaatttgttggggcaaataaataaataaatatgtgaaatggcagcaccatgtgaccagcatgccgtcctgaaatctcaggtggagaacagcttcacaatggtggaccagcgtcttcagttgctcacccgtgttcacgtcccatattctggaaaatgttttaattatttaatattgtaaaagcattttttcatcccccctcacaatttggctttttgcgcgaaatttgttaaataatagcgagaaaacaaattttctttgccaattcgatttgctccagggtttacccaaagtcttggttttagtattttttgaaaaaaaaaatggaaaacccaaaaaagggaagggatacacgctgtactgataattttcatgaaaaaatttccggagcaggtcgtttgccctcccccagaaaaaattttcaaacctagaaatttttcataaaaaaattcttaaaaaaaaaaaaaatttgaaaaacttagtagttcttcataaaatttcgaaaaatcgctgaaaggtttttcaaaattttttttcttaaatttccttattaacaataagaaattttctaagaattttttttatgaaaatttctaggtttgaaattttttcgggggggggggggaaatgaggtgcacgcaaaatttcatcacatcgactacggccttggtaccattttgacatgccattgaaaattgagtttcatccttcacctgactgtcgcgtcactgctgccactggcgatcatctggttgtcgtactgcaggcacagcacggagccggtgtgcccgctcagtgtttgcacacagccgaggctgggccgggaccaaatctgagggggaatttttaaagttagaggtttaaatagaatttatagcataatatttcttagctatgttggctcattttttggccgaagaaaacccatagattagagacgttttaataaaaagtacagaaaaaaattataaaaataaacacgattttccatttccattgcaattaatcctccaatcggcgcaactgtcaaaggatttagttttttgggatttgtaagggagcaggcccgtagccagaaaattttttcggaaaggggaatccaaagacgtttgttttttgttgctcttctggcaaaaattaaaaaaaaatttcttcagttattttagaaacttgagcgccggggataaaaagcaggcatttgtagccaattttcgccaaaaattacattttccaatttttgggtcaactttaaaatggaaatgagggctccggtcctgttgtgccgagaggtgctatcggcagaaaaaatggaaattttgaccatttttattaacagatttccaccaaaaaattgtttgttgtgtgggttactttgattgtgttgtcgcgcagtcccgagatgatcttttcgtcgtcgtattggagacagtagacacctgaattggaaaatgaaaatgtgctcatcgatgaatttatgttttttggacagagtgaaggtggggggaggcataggcctaaagaatcatctcgtttccgcaaaggaaacaattttattttatttttccaaatttattacaattagagattttttaaatattaaaattttttcataacaatttagttcatgaatgttttttttatactatttgcatagaaatcattttaagtcatgttttgaaaacaaaacgattagaatatcgtggattctcttttaaaaaaatctcaataaaaattagaaaacttaaaaagtttctaaaaaaaaaaattttcggtaaggaatgtaatgagccttttttgaagaggaccggcgtcgaaatgcattgagccaagcattaaaaaattggcaaaccaaaatcgggtaggtttttaactccggatttgtgtcgacaaatgtccatacaccaaaaaaataatagttttcctccgccccatgcctttgctattctccgattggcaattgatgcgctccaatcgatgtcgtccctcgcgccaattctgctcaatttgccgaatgtcagcagtgatttttgggtaaagttcgctgaattattcgtttttttttaaatttttattacaaaatcctccatttttgtgtgtgtaccggtagaatttgtgctggaactccaacgcgtcctccccgttcttcggctgtctccacgactgagaaattgcgcgtgtcgcctggtccttggagcaaaagaagtacttcttcctggtgaagtgagggagagggaagaagatttaaatgtgaaaatttgaaaacattttggcaaacagaaaaaaatataaatttacaaataatgttaaaaaccanataataaactaactatttttagcat

SEQ ID NO: 427 - DNA, 3470 bp, Heterodera glycines
  genomic virtual cDNA Sequence=SeqID_704; coordinates=616..685 ,731..754,800..872,917..1207,1259..1452
  coding sequence=SeqID_885; coordinates=683..685,731..754,800..872 ,917..1207,1259..1365
  peptide sequence=SeqID_1115
gtagacaatgtaagcattgatgccttcgcctcgcttttcataggctcggataaaaatttgaatagagccatcaatgagaatagatgacaatttgtctaaatgctgatgaggagattgggaagaggaaggagtcaacggagcctcgggagactgattatgagacggttcgttgttggaaaattcggcggcagtgctaaatgaatcggaagccggcgaaataacaagccgagattgttcgcattccttctgcaaatatagtaaaaatatgataggtaatttaatttaactattttatttaaccgtttctggcgatttttgttcatcgagctcctcgtctgaatttgtgaaaaggtcttcgcccccaatcattccaataaatatttatgattatttaattatgaaaaaggctaaaataaatatgtaaatgacctcgggatacgggaaatgaaaaacaacacttttttgtgaatgatgcaaaaacaaaaaaatttaatttacttaatttataaacattatgccaaaaatttttttcgactattttttagcttttcgttgttttttttttgttgatgttggtgtagatgatttgaaaagtagagctttgtgtaacaagtaattttaggtaatttcaagcacattatttttggaaagcttatttgatttatccatcaacagctgcaaaatggtaagggttttatccggttacccattttttttaaatgttcattttcagacgattagcaagaacaacaaggttttggtcttgcttttgtactggtaaaaatggctatgtttgtagatgatggcgcacctcaactacaaaatgaaggtgatcgtccaggattcacgcgtttttatcggatacttcaaaggttggcaccacaatttttctctgagtccattttcctctttcaagcattcgataaacacatgaacataattctggccgactgtgaagagatgcgccgcattaagcccaaacaaggagctaagaagtcaaacgtcgaggaggaaaagcgcattcttggcctggtgttgctgcgaggggacaaaatcatctccatttcggtggaaggaccgcctcaaaaggaggattctggtgtgcagttgccaaaggctggcggactcggtgggcctggacaaggacgaggtgccggtcgaggaatgccgatgggtgtggtgccgccaatgggagctgttcctccgggttcgcatctcatattatttcaatttgtttacactgcctttgttttttcaggtttgcagggcgccgttcgtggaattggtggtcctggaatgggtgggcccatgcagcccggatacatgcaagggatgccgcagggaatgccgccacgtccattttgatgctcgattttgttttctttgttcgaccattatttgttttcttacttttacacaatgatctgtttgtttgataaataagttatcgaactttgcttttgacatgtgtttggctgtattgcactttgccagtttataaattattcgttttattgtatcattttttccattcattcttgatattagaaatagaaatgccgccaaaaaagcaggttgagcagcaacaccagccaattctcggtcgattaggcacgaatttaaaagtgcatttaatacttttttcggttgaccaattccccttgcctaaattgttttcagatgggcattcttggcttaccgaatgttgggaaatcgacgttcttcaatgtactcacaaaatcggaagcccaggcggaaaatttccccttctgcaccatagacccaaatgagagtcgagtggctgttgaagacacccgattcgattggctggtggagcactacaaaccgttgagcagagtgccagcctatttgaccgttgttgacatcgccggactggtcaaaggtggatgaagctttttcactattctcatgagcatttcaaattcaggcgcatctgaaggccaaggacttggcaattcatgtaatatttgattgattgtcgtccttcactttcgttgctcatttaatttttttagtcctttcccacgtcggcgcttgcgacgccctcttccatttgtgtcggtcctttgaagacactgaagtgacccatgttgaaggtgtgccaaaaaatcaccagaacatttattgaataattttaggtgacgtggacccaatccgtgacttggaaattatcaacagtgagttgcggttgaaagaccaggcatatttggtgggagcgttggacaaagtggagaaattggctgtccgggccaatgacaaaacgaagaagttggagcacgacactttgttgaaggtcaaagagttgctggagacaaagtttgtacggcaacacgaatggaatgagaaggtgagacagaaaggggcgaaatttggaagaattttggcaaagtttaggaaattgaagtgctcaacaaacaccttttcctcaccgcaaagccaatcgtttatcttgtgaatttgagcgaacaagacttcatcaaaaaggtaggacagccaacccaaccaagttttgttcggttagcccgaaatataaccaaaaacattttcagaagaacaaatggcttccgaaaatcaaagcgtggatcgatgagaatgacccgggcgctgtgagtaaacaaaattctaaactcccattccgtaaatggccctttacaggtattaatccccttttcgggtgcctttgagttgaagtcggttgaactggaccccgaggcgagggcccaattcttcaaagatacgggtgcttgcagcgcacttgacaagatcattaagactggctacaagaccctttgcctcgagtatttcttcacgtgagtaagcccttcaatttccaaaacaattaatcatttgtcaaattgaagagccggcaaagacgaagtcagagcatggaccatccaaaaagggaccaaagcgccgcagggggctggacgaattcataccgattttgagaagggattcataatggtgataatataaagggaatgatggttggataataaatatgacaatgcttttgtttttaggccgaagtaatgaaagtggccgatttggtcgaattgggcaacgaaaatgcagtcaaaggagcggggaaatacagacaacaagggaggcaagtgccaatggggccaaatttgatggtaattccggtcttttaacaggaactatgtggtggaagacggggacatcatcttcttcaagttcaacgctggtgctggtttgactgctgccaaaaagaagtgaaagccgaaggtcgcatttggtatttattttctcaatgcctctcaaaaaaattgaaatgttataatattttctgaaccaatgtgaggttttgggattttgcaaaatttgtgtccttttaataggaagcttccttttttgttttattgtatttgaatttcttgttataaataaaactgcttggtttatgatggtttttgaaattttaattt

SEQ ID NO: 428 - DNA, 4103 bp, Heterodera glycines
  genomic virtual cDNA Sequence=SeqID_706; coordinates=374..656 ,697..772,1052..1111,1166..1228,1279..1406,1460..1545,1590..1810 ,1875..2169,2574..2804,2847..2897,3089..3264,3320..3428,3484..3575 ,3657..3854,4039..4103
  coding sequence=SeqID_877; coordinates=704..772,1052..1111,1166..1228, 1279..1406,1460..1545,1590..1810,1875..2169,2574..2804,2847..2897 ,3089..3264,3320..3428,3484..3575,3657..3854,4039..4103
  peptide sequence=SeqID_1108
tttgtcaaagtttcacatattcttacattagagacgcctccttgtatttctgtatgttttgttggagattcatgtgtctttagacattggacggtttcagtcccgggtctgtaactcttcagggagtggttgccgccaaaattttttttcatattctttcatagagaccgagaggagtcgattgatattatatttacattttcaatcccgtcagtatcttcacttttaccaaaaatatataaattcgcaccctactcatttccaatgtttttgagtaatttttattttgaaagctttgatcaaaaataggtacatatgtacctatgtgtcccggaaaacatttttttgtcccgttaacctcgtttaattacctgttttagacaaatttgtttgttttgttgaatttccaaatgctgcttattttaaagaattgttttggtcggcttcatgttatttgtcatcaacttacgcgcagaaattttcgtcttcttttgcatcgacgaaaggaattttccgtattccattaaacttcctgtccacaaaacgaatgaataaatgttttagaaaccgattttcttcagcgtcggtcagccaaagtcttctttcactggtggaaatgcatcgggcggtagcggcggaatgcctcctaaccctttgtcggttcgtctcggcaccttttctaatactttcttttagtcagggcatgtcaaactggcagaaaatggctgttgcagctgctgtgattgtcggactgcaatacttcatcaatcgggtaacatcttttgtaggtgatggcaaagttggtgcttgagagaggcagcgatttgagaaacgattgggggagggtaagtttttgtaaacaaaaaaagtccaattccgagagtgatgagacaaattttcaatgttgttgacccattttcctttttttctcaacttttgattatcatttattccaactaaaattcacttagcgtttcttgcgctgtttttcataagaccacagtgttgccattgccttttttgttgatttgctattactccttctgtttagctcgcttacacagaaatatcatggaaacagttctacacggactttttggaaaagaacaatgtgtgctaatgatttggcgttacacttaacggattccccgaaccattcgtttaggttgaacgcctcgaagttattgacaataaatgggtccgtgtcattaccagggagccaacgcaggtgacgaagcgaaacaaataaacggttgtatttttcatttgagaatttagaccgttttttacttcaacatcggaagcgtagacacttttgagcgcagtttaacccaggcacagcaacatttgggcatggagacgagtcagcagcaggtgccggtgttgtacaaaagcgaaacggacatgtgaggaggctggcaggccattgccaaataaaaaatgaattcttttttttcagagtcggaatgattccccatatggttaactttcttatcacgggcatcttcctgttttacatgttcagaatgtttcgagggttcggaggtgatctttcgaattattcacatcatactttctcaaaaacccaggaaaaaagcccggccaacgtggcggcggcggaggttttccggggatgggcaatctcttcggtgttgggcagtcgactgcacgggtcatcaacagagaggacgtgaaaacggcgtttgcggatgtggcggggtgtgaagaggcgaaaatcgaaatcatggaatttgtcaactttctgaagaaccccgcacaatacaaagcactgggcgcaaaaattcccaaggtcattttgttgattcattcgaattttcatcttaattagccatccttatcttctttttttgcagggtgctcttctgactggccctccgggcactggtaaaactcttctcgccaaagcaactgctggcgaagcaaatgtgccatttatcactgtgtccggttccgagtttttggagatgttcgtcggtgttgggcctagccgagttcgggacatgtttgaaatggcgcggaaaaaggcaccatgcattctgttcattgacgaaattgacgctgttggacggaaacggggcggaaagggcgccatgggaggccactccgagcaggagaacacactgaatcaattgctggtcgaaatggacggtcggagcggggatttgtactacgggcatagaaaaatcaccccttggcaaaacacaaattttcgcgagggggggacaaactgcaccctcttcgcattgggaggggtggactaattgtaagagagtttggagtgggggaatcgttaccaagtctatcctccgcgagggtgcaccccaaaatttcgccggccgaaatttcgccaaaaatattttttaatttggaaattttcaagaaaattcttagaaatttttatatggaaattccaaggaaaaattttggaaaaaaaaattttattggaaaaaaaaattttagcttatttcttgaaaaattgacccaaaattggtcttttttttgcccgctggctattcatccatccctttattggactgaatgccaaagttaagggttttcaactgatgaatcgaacgttgtggtcatcgctgccacaaaccgcgtggacattctcgaccccgcgttgatgcgtccgggccgatttgatcgacaaatattcatccccgttcccgacatcaaaggccgtgcttccatcttccgcgttcatttgacaccaatcaaaacaaccttggacaaaatcgagctttcccgcaaacttgctgcgcacacgcccggattttccggttgcgttagtcacatgtcaatttattactgtttcttttcaggcgcagacattgccaatgtttgcaatgaatcggcactaattgcggcccgaggttccttttttatggatgcgatttcaatctcgctcctctcctggagcattcccccgtagtcttcgaaatttttaaaaacaaacatttttcgtttttaatgttatttttttctatgaaaaatgtaaaaaaacttttagtttaggaaaacccctctaattgtaagaaaattagaaaatttgccgttgttttagatgcacacgatgaggtgacttccaaggactttgagaatgccatcgagcgggtcatcgccgggatggagaagaaaagtcaggtcctgcagccggacgagaagaaaacggtggcgtaccacgaggcgggccatgccgtggccgggtggtttttggagtttgccgacccattgttaaaggcaactacttattttccaaaactgatatcaattatttattttcccattgttttgggtgtcaatcattccgcgtggaaagggcctcggctacgcgcaatatatgcccaaggatcaatacctttactcgaaggagcagctgctggacagaatgtgcatgactttgggtgtgtaacctgtgaattttgtgtcacttaatagcgcttaaatttctaattttaggtggcagagtgtcagaggaaattttcttcgggcgaattaccactggcgcccaagacgatttacggaagatcacacagatcgcctactctcaggtgggcatttgcattagtaatcagttttaaatttcaccaataattaaaatcattgttgtttttgtcttacgttggtttcaggtggtcaaattcggaatgagcgagaaagtcggtccggtgtccttcgacactccggagcctggcgaaatggcattcgataagccctattcggaggctaccgctcagctgattgaccaggaggtgcgcgacatggtcagcgcggcactgcggcgaacgcgcgaacttttgatgtcgaaggtggaacagatcgaacgggttcgtgaaacaatcagaaataattaggagagaccataagcatttacaaaaacggagaaaaatttgaccttcgtataaaaaatcgggcccgagacacccccccccccctgtcccaatcgtccgttgtatggcccttgggctgagtcaccccttggcatgtatgattcatttttcttatttgtaggtcgctcttcgactgttggagaaggaaatcttggcaagggaggacatgatcgagttagccacacgttt

SEQ ID NO: 429 - DNA, 3134 bp, Heterodera glycines
  genomic virtual cDNA Sequence=SeqID_708; coordinates=570..731 ,801..938,985..1038,1123..1287,1341..1484,1552..2001
  coding sequence=SeqID_845; coordinates=570..731,801..938,985..1038 ,1123..1287,1341..1484,1552..1773
  peptide sequence=SeqID_1084
accttttaaagatcgcggggggggggacggcggtgccgataggcgccgccggggaaattttgaaaatttgagtgctttgttgacaaattttcatcaaacggtgctatttttgcgactttaagtcaagttctttaggaaaaattaaggctttttataggcgacgcaagggaaattttttttggaattatttaaaaaataggcaaaattttagggtttttttaccccctctcctcttacgatcgacaattttcctcacaaatcggaattagtcgatcgtaaaaatttggaatttttaatgaagtttgttaaaaaaataaggcaatttttctttataaaatttcttttttcacattaacgatcgactttttcgtggatttttttctctctctcatttttcttttctccctccctcccttcacccccctcccaactttcctcaccccacctcttacgatcgactgtcctgaacccttacgatcgactatgagaccccccccctgaccccccctgtgcacaggtattgggggagaggttcttcttaatgtataaattgggtttctcgttttcagattctgttgccaaattcgtgtctcgacaatttgatgcgtcgcaacattcagtacccgatgctcttcaaattgactaatgtcggcccggcccttcagaggggcacccatgccggtgtgctggagtttctggcggaagaaggccgctgctatttaccttcctgggtgagttctcggaacagaaacaattaaaatttcctgttttaattgcattggatcaatttctctattcagatgatggcccaactcgctctgagggagggcgacctcatcaccgtggagtacaaagcgctcccgaatgccacttacgccaagttcaagccgatgtccaccgacttttacaacatttcaaatccccgtgccatgctcgaggtttgactaacatttatcgagcggttgataaatcctttttccacaggtcgaactgcgcaagttttcctgtctgaccaaaggcgatgtcatcgcagtgcaggcaagcaatcacgagaattgttttttaaattgttttttgatgtcctgccattccctcccacaattgttcatttgttcatttcagtacaacgaacaagtgtacgaattccaagtgaaggcactgaagccggaaaatgcggtgaccatcgtcgagtgtgacataaacattgaatttgacgctgcggaaggctacgtggagccgaacagaacgcatcaacaacggaatgagatggtcgcagcggaggaagaggtgaacaattagcgtaccaaaagaaaaggcaaataaattgactaattttgtagcagcagtcgcatccacccaacgtgttcaaaccgttctccgggtcagggtttcgtgtcgatgggaagaagccgcgatcggtctcaacaagttcacagcaggaggcgacgagcagctcatcctcttcggcatcttccgggcgacaggtaaatggcatcggcatttcagaaatggttgccttgccttcatccaagtctaatcacttcctttaagccttcctctgggattgcttcgactgcgtccactgcgcgtgacgctttggaggcaattgctgtggacgaaaattacatccctggggagttgcgttttgtgcgtcgtccgtacaaaagcaaggcacaaagggacaaagaggcgcgcgaaaaggacaacggagggacgatgaagccattcggaggcgaagggaacacaatccgaccgacgcgaggcggacaatgaacgggggatggacaaaagaatgacttgtggagaaaaagactattgacgaacggatgagtaatgataaaagtccttttgacggttgcattggcatctaaaacaataaatgattttggatctatccgatctatacaattgtcccgtaaaaataatattggtgaatgttatatttaaaaatgttgccgaaatgcatgctaaattcatcaaataaatttgggacaaattgaattttgttcagtattgggtagtgttgtgcacatcagcgataatatcgcacaggaaattgttgaaagccaagcgcaattcttccccctctttgtcaatgttcgatggaattacctcaaaagaatagtcaaaaactttcactaaaaattgacattctttgagtttttttaccgaaattccgcccatttcggccggtagtcgaaatgcagcaatggccgaatgattggtgctttcgtttgtgtggtggagaagcacaagcaaatttttggaactgatttcggaacgtaaagcaaattcggaatacctaagaaaaggcattcattccaaaggacaaaaaatgcattggcacaacaccaaatgagcaggtcgtctccggaggatatttcgggattgcagacaaaaatgatctgaacggttctgatcatttgttggtcaccgcgaatgatttgtgccctttagtcctttctgtgattgattccaacagttttggtcggtttcactcatctccttggaccatttaaaagtcattgctgatcgctccccttcataattcggcactccctcccacattttcggcatcccttcctcggctgtgctgtctttccctcgcccaccccattgcatcggtgtcgtatcgccggccaacagccttcgaactttttgtctccgctgcagtcccacaattccacctgcaattggtggactctcggctaattcgagtcttgagcttcccccccccccccccatttgcttttcccacctccgcgttcactcggtccccatccaattccaactgattgctttcgaattcgacgatgcgcaccccttcccattaatggcaattaccatttgactggtcatttgtgctcttttttcaccttgggttggtctgtactccttggagacggcgtcttgcgaatcggccaaataattggcaattgatgttttgccgctcttgaaaacgaattctcgaaagttaattgggtaattgccaacccgtgggggtccaagcacgagtattttgatgttaatttgttgctccgttcgctcttccgtcattcccctgctcattcgttttgttttttcgttttgttacccttaaaaacaaaaaatactttactttccgttaattttgg

SEQ ID NO: 430 - DNA, 3944 bp, Heterodera glycines
  genomic virtual cDNA Sequence=SeqID_710; coordinates=2385..2303 ,2200..2087,1994..1844,1710..1660,1599..1485,1269..1085,843..562 ,428..336
  coding sequence=SeqID_858; coordinates=2385..2303,2200..2087 ,1994..1844,1710..1660,1599..1485,1269..1085,843..562,428..381
  peptide sequence=SeqID_1029
ccccgaagaaatgatttcccaaaattcgactccaatttatttatttttttcttgaaaagttgcaattgtgcgggcgaaattgataaaaaaaatgagtcacttttggaattttgcataatactcggatttttccaggaaaaattttaacaccttttttcataactattttgctctttttcgtaactattttagtaactatttcaccatttttagcacttaaattttaggtgctaaaaatcttaactctattaatcagccataaaccaggggtatcatttatcaccgaaagtttccgaatgcaaaagtcaaaacttcgttttatcctcgaccccatttcgcagcatataaaaaatttttgtgaaacaaaaacatcgtcttggtcaaaaatcgtcatcatcctcctcttccgctgctgccatttcgagagcctgcaaaagtcgaccatgtttaatcaaactgttagattggagtgccattccccgcccccaattaaaccgtaaatgaagtgcctaccctccgcctcgttcggttcggtcagtcctatgcccctttgcactgtaccaactgttcacgcctgcgctgctcgtcaatggtctccacctccgggttgcgcatgtccgggtaccgcagtgccttcaccgcctggtggtacagctccaacagttcgttgacccgcgcgtcgaattccctgcggggctcaaccccgcgatattggtcatcggtggtcccaaatttgacgtagtgccgcccgcccgccaacgggtcgccggcgaccaactgagcacgaacaatgccctctttgatcgccttgaccaactcgcgatgcgcctcctgctcggtcgactgaataggaaaaactgagccaaagaaagcgaggaaaacactgccctttccatcggagcgatttgtttttatggatggtgtgtgacaaaatttaaaaaatatttgacagggaaaatagttaaatttgaagctgaaatggttcgtcatcaaaattcaactccatcaatccccccccccacattgattctctctttttcaatgtgaaatttgtagtaattaaatgcaaaaaaaaatgaccaacattcaatttggtggccacgtcggacacgtaaatgcgcgaatatgtcgtcgaaattttgcgaattgcggtccgaatgacgctctgatggatgcgctcgacaagcgcagcggtgcggtccttcacaaagatgggcccgtgctcgcgcttcgtctggtcaaagccggccacgtcgccaaggcgtacagctgatgagggctcagcaatttttgtacattttaaaaaagaaaccacaccttttctttttaggaggggggggggggggggggggaaatttatctaaaaaattgttgcccttggaaacatcggactctaaattttcgtcgggaatggatgacaattagagacaacccggactcaaatgtccaaatgtgcgtttccattcgccgcgcataaaaccaactttgggtcagcagcaaatacggcgccaacacgtggcgaagttcggccgtgcggaagagactgcgctcggggatttcgccgatgagcaatttgaccagcacgacccatttgttcacctgcgaacgatttggggaaattaaagcccaattgaatgtggcatttctgcttgtgttcacttcctgtttgaagccgacggcgccgttttgtggggcctttcgaagtgcgacctgagaaatatttggaagggaaaacaatgcaatttcaaagcgaattgtttgacccaaattttagatgttacaaaaataattttactttttcaaattttgtgtacaacccttaaaaattggctcgtgccaaaacctcaaaatgtttctctgccgctttgtacgtctcggcgtcggtgcccttcaacgcttcgatgcgtcccaaataataaaaccaccgggcccaatcgctgttggaagccgactcgggcaaattcttcaacgcctccacaaaatcctgggcagcactaaaatgaaaccaccgcttttcatgcaaaaaaatgaatttataattttaaatgtctattaggaaatgtgaatttgcttaaaattgtgaaacctgaggttgtcgcagttgacaaaaaaggccaacactttgaccgccaaagtggcgctctctttgttgttcttctccgctttaagcgcaatcagtcgctggttaagttcaccaaaactaaatttacaatttttaaacgatcggattagtttaagaaacaaaatgttaaagggaaagcggacaaggaatccattttttaacaaaagtcgcgccgcgcacctttcgttttcggtcctttccatgtcgacgtcattcgccccattgacgtggttgttgatcattataacaaaaaaatacttcagacagaaatactaagcaaaaaaaaacaatataacagagcaaaacaatgaatttttaagcaagtacaactgaaaatttttgattctcgggcaacggaaacggaataaaattgatgattttaattttagttattttttggcgtaatgtttgttgcatttaatttaaattcaatgaaaaaattttaaaattaaatctggaatttttcgaatgtacgcgtaagggatacaccgctggacatctaaacgtggtacagaaattttttaaaattagaattcttatttttgtatttattgtctgaaaatcggaatattagtaaagctactcggacaatagttctgatattcatcaatcctaaaccatggaggatttcattaaatatcaaattatttgaacatttgcattttttgattcattttaacagataaattaaaacgagcaaaactcgctaatacaaacaacaacaataattacagaaagacttagaagtcctgaggttaatgaatttatataatttattatggcactttgtgctattaattatgtgacaaattgctttttgttcgccaaatattccgcacattctttcatccacggctcttccgaccgttttgcgttgtcgcttttcgtttttggcatttgattgttgctccttttctgcgctttcttcctcttcaccggcttctcccctttaagtcccaacgcggaaatgtccggcacaatttcctcgttggccgtgccacaacagagcaacacttcgttgatgtcttcgtccccctaaaatttgagcaaaattaacggatttaaaaaagcaaaagcgaacttttattgaataaacgcatgggaaaatggtggaaagcactctcttcacactttgagatgcttcttcgtctcgagtgaccaaattaagcgaaagaacgccgcctgagggggaatttaatgcattgggaaagagcagacgaagggcgttaggtaattaattaattatgtgcctttttcgacaagacaactgcgcatttgcttcagcgtgtcctccgtgacaaattgggccggtggacagtaaaggccgccctttccgacactgccgccggacaaatcgaccaaaagcacatcaaattttggacaatctgtacaaaattgggcataattatttaattggccttttaaattgccgaagagagtatgtaaaacgagtagaaattttccattttgtggagcaaaaaaaaacaccttgcgcagaattttcgcgcaaaaaatccatcgcatcgcaaatgaccacttccaatcggtcggattctgtcggaaagtcgaaaagttttcgtgcaattgccaacacctcggggtcaatttcgaccgcaacaatttcggactgaaagggaaagactattttttaggggggggggagatttaaaatttataatttggtcaaaaaaagtttaatgaaaataatgcccaattaatatacagaaaataacacagcgaaacaaaaagacaaactaaaacacacacctgcttgaacgtgtcgtgcataaacttggcctaaaattcccactctgataatggc

SEQ ID NO: 431 - DNA, 3242 bp, Heterodera glycines
  genomic virtual cDNA Sequence=SeqID_713; coordinates=1096..886 ,754..578
  coding sequence=SeqID_852; coordinates=1066..886,754..578
  peptide sequence=SeqID_1090
gcaaattttggcataaaaaaaggaaatttccaaggaaaaaccccaaaattccaatttttttgtggtataatttttctttttctttaagtaaaaataaaagttatacaaaagttttcatttaataccaagcatataggtttttccccaaaaagaaaaatgtgatggcctaagaacttgatgacattcatgggacgcataaaaaatagagccctcttcttactcggtaaatgtcaacattcctataaactagtatcaaacgaaagcttagtctcgggaacttcaaacggaagaaaagagcaaatagtgttctctgtccagcattcagttgtaaaacttaaattaagcttatgatttgaggcaatggtagaggacattggtcccgaaattttttacaaagtatatccgagacaatcacagataatgaccatcactttgttttcgaagaaatctttttgtaaacccgacttttcaacaaatccatcaaattgcggtagtatgaataaacaaaattttctattttcatgtttcatccattactattgtatttgccttgccctgtcaaacaaaaaggccaaacctccaggggccgctccccccggacgttgcggacgatcgacggcagaccgttggccaaaacgtggcggtgggtttcggtccttacgcgcttcacgcgaacgattgcgcacgactttgctgtgaatggcacacgagacacaatagtgcaatttgtgatagagtttcggcagtgcgtattctaaagacaattgtaaggtcaacccaacggggaagctttttatgtgctctcaataacattttttggtaatctcaaatttaaatccaattcgaaaatcttacgaatgcgtcggaaataagcaaaaaccatacgatcgtaaaccgacgcgtcagtgatgtcgcggacggctgccgcctcgacaatattgcggacgacaaactttttgatggctttgtcctttggacatgagcggccgcagttggtgcaacggatgggctgcacgtggccgcgtccctttttgttgcgtccgttgttgcgtctctttttcgtcatggcgatttaatatttatttttagaatcttaaaataaaagacataatttgaaggaaatgaatttaatgcttgacgacataatttcttattctcaagtctgtctcaattattagtttttttttgtatttttatttgtgtagttagatagtttaaaacatatacataccactatgggtcaactccactgtgcagagaaaagcctagtactatctcgtcgtttctctttttctttgtaatttctctcactttggcgtactatctcttcattttaattatgtaaaaagtaacatttacttcgctacgtttaactttttttctatacgttaaacctacaccaaattttgcatatcgatagagaaaagaattctgcatctttctatagtgaatttaattttgtctatggtcaaactcaaaagttgtaaataataataaaaacgtatttctttttcctctcattttggcgtactattttcaagtctctaacacatgaaaaaacatcaaattcgcaaattcctataattttggttatacgggtacaaattcactttggacatttagaaccaatagaaaaatgattagtttcgcattttggttgaaatcagcagtttaggacttgagttataacgtgataaaaatttgaaagtatcacaacttttttctgagatgtcaaattgcttagcattcgcttagaaaaagattctccttttcaaaaactttttttaaataccaaatttgttcagtttagttgggaatgaagcgagttatggcagatcaaaataaaaaatacaaaaaagacattttccagtgtaaattttgaattaacgcgcaaaaatttacgccaaatacgctatttggcgttatgagcaattttgtctaacactgggcttgacccatagtgacatacaatacttaaaattaaaaaaaacctttcaatataatttaaatatataacaaatacttttagaataccgtagtaacataaatttgaacgttctgctgatttttaggagcttccaattaatgaatggatctaatttttccaaattagggtagaatttttcaaatcattaaaaaacctttaaaatggctgaatatatttttaaaaatagtttcagcaaaaatgcaaatttgtattattcataattttaagcgaaaaaaggaggtaaaataattttcaacttttttgcttatttttggcataaatttaccaatgctaattaaattttttgtcacttggaatcatttttcatattgtctttgcctccggcagatttttaaattcaaaattgatgaaaactgcactttttgccatgaaaccatccacgagcaaagggattcgattgcgtgagagaattaattaatgaattaattatcatcggtcggcttttgtctctttttccgttcggttggacatttgtcgcagcagttgctgagccaaacacaaaaaaaaaaaatgcatttatcactttgtttttcattgtggttaattgactcgaacatatgatatccctcggggggggggggggacggaatttggaacattttcgaaggggggggggggagagaagaagcagatcgatgatatccatcaccacaagtagagggggaagcaagcaatgaaaaaaaggacatctgctgacggatccaatttcacccctaaaacgccggagggaatggcggccaaacgaatgcatttttatgtaaatccttccaaaagggagacaaaagcgtgtgatttccaattatttatgtaaatttgcaagtgccatcttccaacagctgccttttttccattttttgccatggcatttccttccgtcgagtggggggggggggagggcactcggagaagggcactctttcgctcttttctcagttcattttccttcgttcttcgacttgcctttttgcacctcataacgagttttcccgctgacaatttccactcataaaatgttttgttatggcactttcccacaacaaatgcttgccaaattcgttttcttacaaattcgaaattttccataaaataattgtttttgaatttcctctcacaccaaaaaaatggaagaggaggagaggaaaagcgggggaagtcgctggagacggaggcgaaggcgcggacgcattttcagaataagtgccgggggaatcgacctccgcttggccattttctc

SEQ ID NO: 432 - DNA, 3253 bp, Heterodera glycines
  misc_feature (64)..(64): n is a, c, g, or t
  misc_feature (71)..(71): n is a, c, g, or t
  genomic virtual cDNA Sequence=SeqID_714; coordinates=2221..2351 ,2398..2620,3195..3253
  coding sequence=SeqID_882; coordinates=2254..2351,2398..2620
  peptide sequence=SeqID_1112
gacttaaattgccctattggaatgattttctaattggccaaccagtgcaatattgttggactcncaagtangtatttgagctgatcttctccgagtgcattcggtttgtcaattttgttacccaggatgagcagtggagcattggcaaccttaaaaaacccataaaatagcctaatgcattcgttcggacttgttcgtcttgtaaaaggctccacagttcttctcgtgcctcctgaatgcgttccaaatcggcagcgtccaccaaaaaaacgatggcgtccaatgcgggaaagtaactcttccatacacgacgcgcttgcacatgaccacccaaatcgaaagtggtgaagcgaataccaccgagtgaaagttcctcggacgttgggtgaagagtgggtacatgctgagcaatacggtcgtctttgagcatgtggagaagcgtcgtctttcccgcattgtcaaggccgagaaacacctataaattgtccattttaatgttttaatgatcctcattctattagaaatacaagtagaatttaaactttaatattgcataccaatttgccgctttttttggttagtcccaaatagttgagcacgccagaaaaccagtcgaggatccacgacattttaatgccttgaacttcatgtaagataaaattttcaattttgagagataattaggaatgaaccagacaatgatgttaaaaacaaaacgatttatcagtttatatgaagataaatgcttttcaaaaactataacatacaattcaaataaacgaaacttaaaaaaataaaaagaaaaatttgtaggcattaattaggggaatgatgaaagaataaaaacaatgagacaaactgctaaccagcggaattctctatattatttggataatcgagtctattgcgcttcttataaattgtgtctagaaaatgagctgctgtttcggctaaatccacggggattgattcaaaatgatcgttgataccctctaggagctgcaatcgtttataaaggcatttaggtcatgaaatattaattacctgtgctttcgagttggcacccgaccgattaggcaaattgaaaaatttcttatagcgacgaagtgttgtcgcagaaagctcatcaaatcttatctgaatggttcgtttcaatgaaaaaaaattgaattaaatttgtctcaccttaacggttttattgaaaccattccataagtttgaccaattttcctcacaatccgttgtgtgttcatatcggtcctaatttatggtaacggtagaaaattaaaaaataaagcacctgaaaggttcggtagcgctcatagagattttcatattgggtagagaaaagatgatcgaatgctttctcacgcaacgtttcattcgcctctgtttgctcatcttcgctggcccgtaaaaaagcatccacaaattcctgaatgtccttgcgctcatccacttgataattcgttatgtttagcttatatgtctgttcgttaaatttcggtgcgttcataataaatttctgatgcgtttgacaaatcattccatcactttttctcttaaaaggaattaaaatattatttagattatcttttgaaaaatgaaaaactgacttcttcgtaaatgtaaaaggggtaatttttgcgttttgcaacagtgacatgccatttgttcagagggatataggccagcctgcggcattcttcaaacgttccatcggcaagtttggtgacaattacacactttctaattctttcagacacagccattaatacactccatccatttaatgaccagatccaattcacatgcgaaatataaaaaaatgattaattgaaaatttaaaacaaaattaagaataaaaatgaatcaactctatcaaattaatttttttatctctttgtgttacctatttcagcttctttttccatatttctctaattaatttttcttctcgtctcacagttcacgtgtaaattttataatttaaagaaatttacaggcaaatcgtttcgtaaataaatcaattaggatctttgttatctgcagatttgcaattctaaaaaccaataaaacagactactaaaaaaaattcttagaaaagcttaaatacgcataaaattcctaaaaagtatgtttttcttgagttgacagacaatgatacaatacgatttactttcataattggcagttcaaaaataggcaaccgttttttaggtgttattgaaaaattattattacaaaggaaaaatggctgacgcagctgctcaagaacaaaaaaagaaacgcacttttcgtaaatttgtctatcgcggagttgacttagaacagcttctggaaatgaacgagtgagtctgagtcgtgcttccttttcaaggattaatgaccttttaggaagcaattcaaccaaatgattcccgcccgtcaacgtcggaagatgaaccgcggattgaaccgaaagcacaaatctttgctcgttcgtctgcgtaaggcaaaactcaattgtcccgagctgatgaaaccggagtgcgtgaagactcatttgcgtgatatgatcgtgctgccggagatggtcggctgtgtggttggcattcacagtgggaaggcatacaatcaggttctctcttagtgggtctgcatgatttgttttattctgattatcttaacagccaaagagcatatagttaatagttcattcattctgactcatttttctttggggcagtataaacatggaaaataacattttttggcattctcaccataccagaaatagtttttcactaaaaaggaccaattacgattttgagccaaaatttaaattatacaacaaaatgtacgcaataaaacggagaacacgattttgaaggcaagaccggggtaaaaaataagctgctcacgaatattaactcatttaaaaatcattgatgtctatgacttttcgtcaatcacttggtttttttcaagtttttaattttctgtaaaagttctttccgataaattttcggtttcataccccttttttgcctttttatgggaccagtaaaaccgatgatctcttccgtctccgacttttctctacatcgcttcacatttttgtccaaacctaaataaaatttcatcccccccccctctttttctgctcctcatatgggtaatagtaaagatggttgcccccctttttgtcccggacccaaattcaaacaaaaaagtcgaaactcaaatttttcgaattccatttagtctaaaa

SEQ ID NO: 433 - DNA, 4172 bp, Heterodera glycines
  genomic virtual cDNA Sequence=SeqID_715; coordinates=4172..4016 ,3982..3825,3786..3670,3625..3538,3481..3417,3364..3226,3171..3073 ,3027..2954,2910..2676,2626..2342,2292..2121,2067..1886,1843..1512 ,1464..1347,1297..1119,...
  genomic virtual cDNA coordinates=1066..922,865..727,671..522
  coding sequence=SeqID_934; coordinates=4172..4016,3982..3825 ,3786..3670,3625..3538,3481..3417,3364..3226,3171..3073,3027..2954 ,2910..2676,2626..2342,2292..2121,2067..1886,1843..1512,1464..1347 ,1297..1119,1066..922,865..727,671..631
  peptide sequence=SeqID_1157
atagtatttaagaaaggaaaatggactaaattagccttctaaggaaagggagaagaaaaaccctttttggaattggtcagttgcaaacgaagttaaaaagggagggaaaaaagcgaaagacaaacgaaacgcccgagggggaaagggggggaggacaaatgaatgctttttggtccaacgacgggagggggtgcatttgtgggtggcaggtgacgagagccaatctcgggtgagggtgggcccaatcggacgacggcccgggtaaaaaaaaaccagacggggaggggaccaccgcttccgatcagtgaaaacgcctcaggcaactgggcggcccattgatcggtttgtcaataatacgcacggaaggccaccgtcaaacaaacaaacagccaacactcatacgacagcttaaactaattcattccaaacgccactttcataaaatcactccttcttatgacccatcgcttcaggttaaatgatgagtcattagcatttggcggactctctctctctcccactaattgattccatttattataaataaatatgcaaataattatttgcacgataacaatcaacaacaattatttgtgtaaaatgcaaattataataaaaatatcaatctcttcacagtccgtcggtgtattttgctgtctttagccgtggcactaaaagcacaaatctcaccaattgaaaatgcttttgttcccattaaattctgaccaatgttcatcccttgcaactcttgaaacagcaatttgcacgcgtaagggattttaatctttgccatggcggcggatgacttgcaattttggcaccatcccaagtagccgatcaaaccgcactcggcacaaacatccatctgacaaaagatgaggcgaaaatggagtcatttgcgaatggaattactgtactcacactgaattgatcggaggagatcattagccgttccatcagcagcatcgacgcgccatacgctatcagacagtccctttccatttcgccaagtcgaagtccgccgtccctggccctcccttcggtgggctgtcgagtcagaacagcgctgaaaaatgcaccccataaaccaattgcagtcattgtaataaaatgccaaccggggccccttcgctcgcgcgtgcattttgtccatgaccatgtgcttcagtttctggtagtaaattgggccaaaatagacataggcggccatttgctgtcccgtgctgcccgacgtgagcatgtccttgccaaggaagttgtacccgtgggcggctaattgtttgctgacagtttccacctgttggaaatgggcacatttttgcaaaagccagaaaagcgctcattacttggtcccctccgaaggctgtgccgtaatgcaaccgccacttttggcacgggcccatcagcgcatttttgccactcaacaattccatcagttttcccactgtcattctgctcggataactaaaaagaaaaaaactatcattcaaacaattcaaaatttggtcgacccgtgtgggttcatgatcaaatcgggcacagtgccgttgtgatcaaatggcatgtcctcctggggcgagatcagtccgcaaacgcctttctggccgtgtcgactgctgaatttgtcacccaactcgggtcttcggcattgcgctatcaacactttggccaagtattgctcctcgtcgttgcaggtcaatagcacgcgctccgccacggcattcattgagccgcggtagggaattgacacgtcctttgtctcaaaattgtggttgaacccggcgacattgccagcgggaagcatttcggattgcattatgggcatggatttgttgatgagcacctggaaagaaggcagaaagtaaattccaaaagtacaatttacatgtctcggcataatcttcgccccaacaaaaacaatgccgtcctggtccaaaacggcatgtttcgcaatcggcttgcgcgtcgtcgcgtccagcgacggtcccatgattttgtcgtacgtttgattggcgtactttcgcgcggtgcccttggcaaatcggtagaccaaacagcgtccaaaaccttgatttattattctcggaattaaaatgttggaagccaaacatacgactgaccccggtccaacgacgctttgttcagtaccaatgcgtcttcgatgtcgtagccgctgaaagacatcaccgccacaatcgcattttgaccagcggggagcttttcgaagtttgacaattcaattgttttggttttcaccaaaggcttttgagggtaaacgagcagatacatcagctaaaccatttccaaaccgttaaaacatttgccatcgctaaagatggaccgaatcaattcgcttctgctgattgtatccgatggtgcccatcgcctgtttgcccattgcgcattggtaagtgttgcggggactctgattgtggtgtgggtaagggatcagtcccgagacgacgccgagcaacgaaaagggttcgatctccaagtgggtggtctgcggcaaaatttggtgctcatagacagcgatgcgcgtactgttcaactcgttcacgtccaaaaactcgatgcatccctccgccaaaagatggtcaaaggttttctgaccgtctcggacttcctgcaaccgaaataattgtagatgaacaaaaagtgacacccatttttacctgaatttgggactgcgtgagacatggacgaccattttcaacgatgacatacggacgacagagtcggcccccgtcgctggccaaatacagcgcatttgtggacgtgttgaaactgaccgagacaaaggcacccaaatgccctcttcggcgcatcagtcgcaccgtgccaatgattttttcaacgtcatcagtaattccgacaatggaaccattgaggaaaacgatgtgataacgtctttaatcaattcccttttaaaggcattaacaatcaaatttacctttcatgaacgacgctaaatttcaacggacgaacgtcttggacaccgaaattgtagagaagttgcaaaatgggctaaaaatgatattggttccaaaaagtcatttaaaaacaatggaccgcttcgtcgctgtccgtggttatgtgactgagcaacgataaattcttgaccaaaccgcaagattcgccctcgggcgtatcggcgggacaaatcattccctaaaaggagtagaaagggactatttacaaaaatgggcaaggcatgaaacagacccattgcgaagactgcagggaacgtggccctgacactttgcgtgtcttttcgaacgtcgaattgatcctcgtcatcattcccaacacactgatgtaagacaaccgtgacaaaacttgcgtgacgccatgccgttccattctgaacaacaaaacggttaatttttcagtaatttccggcattcatcgctcacttaaaacgcctaattgtccaattcccagtggcaagagcattgacaagaccatttgttatcaaatccttaaaaccaaggacacaaaatttgttttttttgtcgggatttattgctttcccacttggcgcatgtgtcgtacgatgtccagcggagcggccatatttcggttgaggtgactgtcggcaattcgtttcaattcggagttgaacctaacaatgaaacatatagaaacaagctggaaagtgttgggaaccttttgaaaaggtcctcgaataacagagaaagcaaagatccagccaactcaatgcgtttgtttccgtaaaaatcgcgatcgtccgcctcgcaaacgcccttctccgcttcgattagccttaatttggttttaaattgccggtatatgaaaaataccgtctgatcatcaagcccaggaagaccgccttcattttcatatttccaccggacgattgaatgtgacaaatcatcgaattggcgaggaaatcgaggacgtcatgctcttgtgaagttcggacagttgcggaagcaccgccaaaggttttccgtctcacctaatcacagcaaatgtttctccatgcattaaccgtttgttcaattcgaacctttgcggtcatataccttagcgcatccgctcttgagattattcccaaaacagaacattcgtcaagggaggggcccaacgcagcaacaaagtcctcttcactgcccaccgaagaagcgatcagaaagtccgactcaaat

SEQ ID NO: 434 - DNA, 4363 bp, Heterodera glycines
  genomic virtual cDNA Sequence=SeqID_716; coordinates=1..12,59..318 ,387..650,707..812,866..966
  coding sequence=SeqID_956; coordinates=1..12,59..318,387..650 ,707..812,866..966
  peptide sequence=SeqID_1175
gggagccaaaaggtacagcgaatttcaagtgctacgcaattctaaaatgcaatttcaggcaacaaattttgcgttttggtggctgtagggcaaaaggttacgcctctaatctatcgactcgaccacggaaaaccaacgccacaactcattggcaagatcgaaccggccaacggactgaacacggcgatgtgggccccgcagggcggttgggtggtggtgatgggggtgaacacgtccagcggaattgtgagcttcatcgacgcgacgggggcagaggcgaacaaagctaaaacgattgagcatacttcactcagtcaggtgggccactgtcaagaaatacaaatgatctttcaagaatatttttgcaatttgtttcccattttcagggttcttgggacccgaccgggcgatactttgccacgtgcactttcgcgggaaagagtcgctatgagacgggctatcgcattcactcgttccaaggacgtgagctgcgacgtaaggcggtagacgccctgctgcgattcaaatggcgtccgcggccacccgtttcattgtccgagcaaaaagtgcgggagactcgcaaatcgttgaagcaattgtcagcgaagtttgaggaggaggacaaaagggaaatgctcaaagtgtcgaaggtaaacacaaaaaaatatattggggaccgattgatggcggaaaattccctttttaggaaataattgaacagcgcaaaaaggcattggaactcttctcgaacattcgcgtcgctgctgctaaaacatacgaagaagaacgggaaaaacggactgagctcagaggcaattcatttaaattctaaataaaataaaaagcaattaaaacaattgtttaggtggcattgaccaggaaattggcgagaaggacctcgttgaagaaacaataacagtggcactaaacacggagaaggagaaaatcagagacgagagcaaatagaggagagaggtgtttttcatgcactttaaattatgttttctgttaattcattgttaaatatgatatgtactcgagtttattataaggtcggcaatttcggttaaaatttattccgaatttcgggactagcagtacgtatgtgggtctaccacaacacaggtacaatcaatagacgtatttaatatgcagcgtaagtgggtcagaacagcaaaattgaaccaatggcgctgctattcgttcggattgtattaatccattttttgtcaactgtttctgacccacagtttccgtaattattatgtgtacaatttggggatattatggatggggtgggccaaatttacaaggtaataaatatcttccggttgtttcgttttcactgtccttcttcgtccctggagagtccggtcagctctttcaccggacattccgtctcccaaatcagcaaatgcgccaaatccctcgctcgaatttgctctgtcattgcgcttctttcgttgctctccttcttgtcatgagggattacatcttcgtcacctattgtgtttttgacatttttaaaacccaacgatcttttgccccccccccttaaataatttctttcaacgtataaaacaaacccaatcgaaaatcaatatatccatcgccgccggacaccatcaatgcttttttcgtctcgacactttgtgtaaggtcggaaaatccctctgtaaattttggtcgtttaaattgtttatctgtgtgtgtaaaaatggtcaccagcaatcaatggtagcagaaaacggacagcatctttgtggccatggaagctgagctgagcgtttgtaatgtcacagaatggggtggaatttgccgtggattcatcgcccgacgaatggacacgaatcacttggcctggcgtccgtccccggtcgaggtcagccacaacagtcgcactgctcctttctgacgcaacaaaatccaaatatttgacacaaatcgcttgacctaccttttaaagggattgagacgattatccctgatccggtgcccacccaaatccttctgttcagctcactcagagaggtgattcgcaaatggctgtcaagctgattagcccctgaattgacgaaaggatttagaaatgagagagcaaagcggaagacgaccaagcattttggagatgtaaggttccacgtcaacgtcctgaagatgttggaaagtttcgctgtggaagagacggatgcacgagtcgagtcggatggaaagccaaacgccttttccacagcaaatcatttgtcgaacttgggagtctttcctcgggtgggcagtgaaaacatgctgaaatacgggtttctctgattgtgagtaattgttccgctgtttttcatcaacctttattttgagggttgtcgggtcgagtaccatcacacaattcctacaggcagcccatacatttccgccaacagtgcacaaatggcacaccgaactggtggcagaacccaatttgaccacaaagtaaccactggcggaccattccccgactaaaacgcaaagatggcacacaaaataacacgaattaggtattatcaattaatggaactgtaagtacagtactgacttgtattccggtgaaaaacagcgactgaaccattggccaatgcggcaaacatccgcccgtttaaatgtctaattgaaaatttaaatttgccacaaatgatgacgtacaaaattgagagaacggcatccggcattttcacacgccgcaaacatttgctccaatttcgcacagccgaatggatgtgaatgctgaatgtatgaaaataaaacacaatattatggagaataactcccacaaaaagttctccagcccaatccacatggttgggaggctcagcaattcactctcagcgccattggcacaccattcgtacgagttcaaagcgtcacgaacatgcaaaggcaaattggcaatggccgaaagggaccctaaaagtgaccaaaatagcattccaaggcaaaagggcttgtatttatagtgtcattagtaaaagtgttaagaacagcggagcaaataaacaggaaaaattgaaaaagtaaattcagaaagcgtgattattaattaaaatggatggaaccgaaaagcgtggacagagaaaaaaaaggatggcacacctccaccttttattttgtttgtttgtcctcaccatccgtcaattttttcatgacaattgtcgcattttctcggtccattttttctgacgaattttcttcgccgaattcaaagggaattgcttctgttctatgcagtgagggcttattgctgctgagaacatcttgaaccgattttggggctcaaaattcataatgggagaattttaggcacatttttgcgaatgaattcgaaaacacttacttttcgtttcaccgttcgctccgatggattgattaacactgactaaaaaacaatttcaaatgaagacaatttcaaagcacttacgttttctttttggcgacaatttctcattgggtggtgaaaatgttggaatttggtcctcctcttcacatttttggagtgcaacgaattcaatggatcccaaagatttgacttcctccacgagctccgccgggacattcactgtcgacaaatattccccggaggtgcacagttccgagtcgacggacattccctcgtcggacagtcgcgaatccctctcacgaattcctaaaaagcagcgaattaacgcaccagcaaaatacgaggcaaggcaatggacagtgaaacacctgctgcactcgcgacacacaaaacgttgacattttcgatagaaaagccggcaaggatattgccgggctgattggcctccaaaatggagacgaaggagcgctgctcgtccgagccacaaacccacaaaagactcgaagcctcgaggagtgtggagtcccttctccgtctccgtttcgtgtgattcttcgactatatgcaaaaatgcggataaatccccaactttctaatgggtaccgtctgttgttgattctctctcaagagcacctcggggtcacagctcaacattgggtctcccacaatgtattcgccgtccctaagccccccgtgcagtgccgacggagcggcacaccaaaccttttccgaataaatgaaacaatcagaaaaaagaaaataatcacttttaaagacggcatttgttccaacaagggcctaaaattgagttatgaaaaaaagaaaatgattagtaaaattgcgacctgcaattgaccggaacaggaattgagatactttctgtggctttgttggaagtcattgaccatcctttttagggaaccaatgaatattcgaggcatttggccaattcccgtcatagcgtaggcattcggaaattcctcctgcttcatgtactga

SEQ ID NO: 435 - DNA, 4855 bp, Heterodera glycines
  genomic virtual cDNA Sequence=SeqID_718; coordinates=1537..1348 ,1297..1141,1098..836
  coding sequence=SeqID_903; coordinates=1528..1348,1297..1141,1098..927
  peptide sequence=SeqID_1130
cacaaagtacatcagcaaagtgcggagcacttctctcttatagtaaatgttgtcactcactttaccataagaaaggaaacatacggctcgtagttctcttcgtccagtccggtatacgaccagcggtcgtaacggtaccgcgtgaattggcgtgggaccgaaaattgaacaaatgaacagaaacaaaaagtgaaacttacgggttcattccaattgcgacgatgcattgtgtgcgagtaattgtcgtaagggtctctctgttcgtacgtgacaacgccaatttcgggatagtctccaatctttaaaaattttaaacgacataaaggccaataaatgaacacaaacgtggttgacgaagtcgagtgggtgatggggccttaacaaagcaatgggatttgttacgtccgtttttcaacttctcccaacggtcacttgtaatcctcgggtcgtagtccgtattttatggcagccgcccttcgttcttcttcgttacgcgggtaaggcccaggcatatgatctctgaattcaaatgcaaatggaaggcaacggaggggcaactcaaagacatggggtgcactcacctcgggtaccatccgggttgagaaacggctccacggcctaaaattgtattaaaaggtaaagtgcgaaatgagaatgggaacaccacttacataacggggccgaagtatgcaaggagcgacgaattggaatttttgagagaaccatcgagcgaagaaagtacaacacttgtaatgaacaaaacatagaaaaacaaaataaaaaacaaacagacaataagagaacagggagaaacgaagggaaattgctaacgaaattagctaatcattgtttatcaaagggagaataaaacagagaaaaataaggcgtcaatcgtctgctttggtccatcgtctgctaatctttttttacttcttccctttttcaaatgcctgacgaattttttcagcgtagaaaaagtcgaagagaattctcgcgtcgattggcggaggaggccatagttccgtctctttggaattggcaatcgctgctttctcattcccaccgaattttgtcaattttttgtcaaaattgcgtagcctaaatgcaatagaaatatttgttgtcttaaattttttttacctttcttcaatttttgcatctgttttgtaagagacgtatggcttcagctcgaaatttgctaggtccggcacgaccaattcgggcaccatttcgggaacatgaacaaaatcgtcagttttggggtcattaaatcctgtgggcgccactccggtgtatcctaaagataatctccactcataggttagcttccaattccggttcgcttactccatagctgtttaaagtttgctcctagaaattttggcgagagctcggggaattccttttgttgaccgggccatttgtgcgattcaataacaaccggcccattcttccgccatccagttgagccctttttttcaaaaggccatggcgcacgaaagcaggaggcagtcacatgacgaaccatcaaggaatgctgtgaaaacaaatatgtaagaaaaaatgtagaataatttgataaatcagagaacaaaaacgttaaacaaaaacttattttacgtttaaaacatgcaaagaaattatttttacatttaaaatatttatttataaataaatgatgtttaaatacatacaaaagagatctaaacatatgtccacgttaattagctctttacaattaaccattcataaatcaatcagaggggctgaggtgaaccgggtggaagaaaattgtcgaggaaccattgctcgtttggcacgaaaaggagcggaacacaaagcaaaagaacgacgaaggcggcgacgaaggcgtacagctccaagcggaggtcggcttttaggtacagttcgaatttggcctcatgggtccaatccgaggcgacccacgtagaatactgaccactggtgaagttgtagtctgaacagtccctcaattcaataaaacattatgaattgcattacctccaatttcgaatgcgggtgacctggccacggtttggtaagtgctcgtccggtagcaactcccattcccatttcggtcgttcatccacacaaaattgtacacctttttccaaattttaaacacttccagcaattgaaatcgctcacattttcttggtagcccctgtcacggcattggctttgtgtccgaacattttgtgccggttctttgctaccagttgaatgagtgagcaaaaagaataacaaatgccgaattattgggcgcctgtttctgccagtggcatcaccaattgaaaaggaatttgctaaattaaggaaaagcggtcaaaaacgtttaaagagtgatgcctgtgtcgttgagataggcatcgatttgtcggtcattagtggcatttgttagcgtgcggaaaagcggacatgaccaattggcaacgaaaaaacactcgcccaattctttcgcctgtaacgtaccaaaagataaccgaaaaataataaatctgtacataattctcgtcgattttgaattggtccacttcagttgcattattattagcaaataaataagaaagtgctgccctcaaagcaatgtttgatgcgtcaataatcttgcggagaaactcgtccaactgtttggggtgagtacgaatttggtcatccaagaatgagttcaaatacctcaaacaatggttatgctgataaaaagatcaagatagaaaatacggatattcgtagtcggcggatccaaatgagctcagaattagaccggggactttatcagatgccttcataatggagtggtaactggacggaggagcggcaccaaaaggcactgaggaaggatcgacgaaatggaaatgttcaccgcttccttttgcattatgaagaaccgtatcaatctgaacagtgtgataagaaatgctaaaatcgtcttttaattaagttaacaaaccaggcttttgttttgcttgtagatttgtgcgtcggtgtgtgcgtaaagtttgggggacgcgccgatttgttgaagttccatgaaaaaggacagttcgtccacgccaatctgtcggacattcttcgactcttcggagaagttctttgccacggcagggaaatgccctcgtcccatgtcccacacccatcgactgctgccaatgtaaccgagcgactcgccgtgcaaaaaggcgaacaacaactgacgacgggacagactggcgagccgattgaatatgtccattttttggccaacagaatgggcaacgagcagaagggaaacgagcgaactgagcactgacaaatcgccacctttggcaccacggaaggtggagaaagagtccatctaacaaaatgacagaaaacattgctatatttgaaaaaattaacgacaattttgataattaatttgaaaaggaaattgagtcgccataattaagtgtgaaaaagggaactgacccgggcagctaacacaaattggtcggcactgtgattctgcttactcagtggaggcaacatcagaaaaacattcatatcttcaagtacttcacataaagaacttaagagcaaaattgaagaaattaaatttaaaaaccccacctttcgccaaagtcagccgtccgttccaaacaaattttggtattcccagcagcggacataaattgtgtcatgcgccccacacaacgcaatccctcggccatcagttttttgttaaatggctcaatgcactgaagcaaaagattagtaaatgcaaattgtgctggtaaaaccttatcaaagattaagtcgatctcttcgttgctggtgacaagacgaagaggtttgttgaagtcgataaacttaagcccatccgagtgaatcgcgttcttttggttccatccatggcaactttcgatagttttctcattggaataaaatgctaaaaaactcagcttattgagatgtgattgttagcggtcacaacttcaaaactcactgaactgacgatttggacatgagccatcctcagaaaactctttaggcttatctttcccacgatgtatcaacagaatcccaacaacttgcgcgtgtgaacgaaggattccgattaaagcactaaaatttattatttacctttcgttaattcagaactttatcttttcgtcacttactcattaatatttgtgagttgaataacagcgattatgttggatagccccaatggtaaaatgccaatcgcattttgtacgtcttttgcatggacaatttcagtcaggacgccaacattcccattgcgactcgcttaatatgtaatcgagaattctaataaatccaaattaagttaaaaagtgtgaatacttacactgacatccaattgaatgtgtaccattcaacattcgaacacattggacatcggtgttattgagtctgataaaaatttgatcttctacgccatcataagcaaagactaaaacgcaattataatagcaaattattgccactggatgaataatgatctttcttatttacttacctcttaacacaaaacaattgaagagcaataaaatgagaaattgtgatttttttaaagagagcattattttaccggtcacctaaaaacccttaaaggtaattgtttcaagaacaacggaatttcttgtacatgtaaaaatttagacaccctgtacctaggtacatatataggtaataatagttcagtttgtcccaccccctttttcgaaatttttttatgttttcaaaagtcataaaaacactttttatggggttttcgggatcgctgatcacgaatccggcgcccatttagaccaattcttaatcccggacccgaattcgaacaaaaagtcgg

SEQ ID NO: 436 - DNA, 3578 bp, Heterodera glycines
  genomic virtual cDNA Sequence=SeqID_719; coordinates=2104..1953 ,1914..1708,1478..1191,1143..1035,990..823,764..271
  coding sequence=SeqID_854; coordinates=2104..1953,1914..1708 ,1478..1191,1143..1035,990..823,764..528
  peptide sequence=SeqID_1092
ccaacgataacaacacgccaagcagcacagtgttcagaaaggggacagagaaaaggagtagcagtgcaggagcacagacacaaaacaataaaaggtacaacacagcagtgtgaagagacggacgaacagcagagaaagaggggaacgaacggcacagcgaaaaaggaactaattgactaattagcaacaatgtgcgagccaaagcccaagcaaaataacacacgattagagcatataatttacaatgcgctaatgtaaggcaacttaatttgtaaagcataaaatattttttaaaatggcaacaattcgaagagtaaaactgctagtaaaaaattgttcgaattcatccgggttgcttaattaaattcgacttgtccgatcactgaagaaccaacccaatccgatcagaaggaatgtcggggcatttccaattgtataggtaatattgcaaattgccatctccgatgccaaatttgagatcctccagaattcccttgttttccatcaaatccaaagcattgaatacgtcaaagccaagctgattgtgaaacaaatttggatatacccaaacgaacggaaacaaaaagaaaaaaacgaacatttcttgccaaaatcaacgcatcgttcaaaaggtggctgagcggaacactcccggcgacattgtagaaagaataagccgcctttatgcttttgtggtgggaatggtgcatcactgtggagggaaggctgtagaagctgaccaagtcggtgacctctccgttgttctgcaaaaatgcctttttattgtcccccgtctcgcgacttatcagtcggttttcccacctgaatcatataagtgtaaatgacatcatcgcggggcaggaagaaatgttcgaactcttcgatggtgaagatggggaccaagtcgaatttggtcaaatatccgctgagcaattcgaaggcgcttttggcagaatctctgttgagtagcgtcaattgagactcggtgttctgaaaatgcaatttacaaaggctgaaaatgttcgaagactcacttcgggcagtttatacaattttatcatacgaggaagcgtcatatttttgccaatatgcgaaaaacttgactcgacgagctttttcgggttcaatgaccggtgccaatacctaaaaaagtaatatgtatgactattatgattcaaaaaaattgctaccggcaaatgcccactggcttaggaatgaaaatcccagcggtgaaagtcgcttgaaaaatcccaaacaaattgactcgtcgggtgatttctttgattagcactggcgccagtcttttggttcgcagctttttgtgcacacaaaggaaatttatttcgacagatttgacggttttgtcataaattcgaattgtggcaggaacagcagcgataaatgccaccaattttccggaagtaacggcccttaccccacaatgccattgttgctgccaaccgtgtggcatcagtgccctgaagacaaaattgagcaaatttgagaaatgcgggattatctctgctggcagtcatttatttattccgactgaatccgtacaaaaattggaaattagtcttttctaaattaccatatgctaaaacctatcgattttgaatttgcagaaatattattatattttcatgatgtaaaaaacgttgaaaaagatgccctaccatcgaatattaccaattttggttgtcctaccatttcagaaaatttttcccataatcgaagcgaaacatattcgcgtcgtcctcaacataattctcggtcaaaagaatgtacagctcatccaattgttcatccgcgttgagatcaatgtcagaccaaataaacttttccaacaatgaatacggatctttttttatggtcgaaacatcaagcggaggatcaatgtaattgttttcggttgttgttgtatcttaattaagtgcaatgaaaaaaggcacaatgcaatccgcctacttaattttgggacgggttgtgtgttccaaaattggtatttgtgatgctttgcttcgaatggatctcttacagccgatgaactggtcgatgccgcctggatgagctgaagcttacgagcaaattccgctgctgccatgtcggaattaatttgtatgggttcgacgtcgttcttaacattttttcgctttggtttgccttttgctgctaaacttttcgcaatttgttgtttttcatcatcattcatttggggcttttcatctgataaatcattttgagtctcatcctctttttgttccaatgttttgtcgtcgtctgccatttagaataaaaatgaaagaaaattttacagaatactcatgttgctgaaaatgggtaatttgataatggtcgaacattaagatggaaatttcctaagttcctttctaaaccttaatttttgcagcacatacatacctacacatccgcattccggatccgaggattccggataatccacaatatgtagcattaattagtaatttagattatagaataaaaattggcataatgtttgtaaattaattatttttaatagagaccggcgtgggatcctgcgcgggattttgcgggtcccagtcgggatttgcgggattaatcccgcgggatcccatcccgcaaagaattttgagttccaatccctcagcggaatccgcaaatttgaaatttccggtctctaatttttaagcttaagctttagcagataagcttggacacggcgattcaattttgggctccaagtataattaagttggttttttcgtaggtggtctgtgagttagtcaccaaaaggggggtctcaggttcaaatcctcctcatgttgtgtgttaatttcaatttcttcgtttaaagaagaaaggaaaaattattttccattaataaaagttttcgtgtcaataaaaatcatattcaaaaagcgttgtttaggtacatcatcgataattttatgaaattttccagacttataactcgggcaataataggccaaatataataattttatattcattttaaagagaaaattctggagaatattgtaagttttatttgatttggctttaaatagcgcacttggctaaaaaagagttaaatttattgaaatttttactagggtcaaaaaaattttcctcgggtcagattttcttaaaattttgcataggcccatattttgaccccctctatcgaatcacagtttattttttagctgtctagtttttaactcgagatcggctcttgtgtttttacaagggaaaatcccctaaaaaatttaagtatcgcaaagttttggcgttctgattacaaaataaataataaacttatttgcactgggagcccaaaattgaatttatagagtcggataaaacacttttccttaggttttcggagtcgctaatcacgaattcggcatttattttaaccatttctagccccgaattcgaattgaatcgctttgtgcaaaaaaaaaaaaattgaattagttgaaaattgagtttttgactttttgttcgaactcgggttcggagttcgaaatgggtcgaaatggatgccgtattcatgattagcgaccctgaaa

SEQ ID NO: 437 - DNA, 2957 bp, Heterodera glycines
  misc_feature (38)..(38): n is a, c, g, or t
  genomic virtual cDNA Sequence=SeqID_720; coordinates=739..901 ,953..1088,1477..1633,1679..1764,2216..2512
  coding sequence=SeqID_912; coordinates=770..901,953..1088,1477..1633 ,1679..1764,2216..2409
  peptide sequence=SeqID_1139
cagggctcgcagatgaaaattttcaaaagcctcatttntgggtcaaaaagcctcattttacaaatttattcaaaacacgtttaaaatgttcaaatgttgtatttttgactgtccatgatcaatttgagcaattttttatttgaaataagcattttgtgaaaatctgagtatgaaaaatcgaaattgattttttttttcagcgctttttccaaaaacttggggacgggaaaaattttgtaatttttaatgcgatttgttaacagatttgtccacaaaaatgaccaaattttgtgattttgagcaaaggaaaaattaagaattttgaccctattttcattaaaaaaattctttattttgcggtttttctcaaaaaaccgcaaaaagcctcaaagcctcattttgaaaagttagcctcattgacctatcaaaaaaccacaaaatgaggctaaagcctcagatctgcgagccctgatgaaaatcccgctcaaaaaaccaaatttgcggatctcgcttccccccccccctttatcgaaattttttttttgttttcataagtcatgaaaacatgtttcagtgggttttcggggtcgctgatcagtgatcacgaaccggcatccatttcgaacaagagccgtttttagacgaaaaatgcgaaattcgaaaatttgtactttcgactttttgttcgaattatatttcttttgtgtgctatgctgctatgtacaaacaaatttctgtttttagtgaaaattttacagcaattataaatatggacacaaccatggaacaaccggctgaagatgttgaggacgtacagttggatttggggaagaaaaagaagaagaaaaaggcgaagaccacagaactcaaattgtcagaagatgagcatgaggaggaaaaggtggcgaaaagccgttaaatattgaaagtgatagtgaaatccaaattttaggaagtcactgcactcgccgaaggcgttggccgtacaaatttgctcgacgcaaaaaaccccgacgcgtggacggactacaactacgacgagatgctggacatggtcttcaacatcatgcgggagaagaacccagaaagtgtgattttgcttaagacaatttcgtttttagagttaaaatttgattttacatgatgtgcccctttttctttgaaattctaaaaatagttgtcaaacatatattttggtgggttttggggtccttgattaggtctattcggctcagattttcctgattggttaacatctgtatcatattctgatcagcaggctttaaaattactggaaacttgtattattttataaggtattctgtgtaaattccaaacaattctgaggcaatcgaatccaaaaagcccaataattcttccgctttttaaatttttaaatggactctggtggctcaaacatcggtttgcatactcacaattttcgtagcgattttatatttattaaattttcagtggtttccggcaagaaaaagacatttgtgatgaaaccgccggaggtgcaaagggcgggcagcaaaaagacggcgttcacaaatttcactgaaatttgtcggctgctgaagcgtgacccgaagcatgtgctgcaatttcttatggccgagctgggaacgacgttggaccattttcatttggcaatttacaattttttatattttaggggctcaattgacggcaatcagtgtttaattgtcaagggcaagttccaacagaaacactttgagaatgtgctgcgcggttacatcagtgagccaatttctagtcatttatctcatgatcattgaaatttttgatatgaaaaattcgggtgtccttaattacactttcaccggcgatgggaggagtcgcaaaatgaacagaccctacctaaagcgccaaatttaattaccgatacgtttttaaactgtggcaaacaataatatttgtttttttgacactgagagggcttggttgtgtttgtatgttccggaaatggcgggcgtcaatttacaaaattttgtaccacctcggattctatgtatttttttgagcttggctcgactccgttccttgccataccattcgggcctaaatctaaatctcgggctgtccaacaaatatccattattgggacagaaggacataacccgttttgatcgtgttctcaaaaatttgccatttttagaattatttgataaccctcttcccctgctttcagatgaatacgtccgctgtcacacgtgccgctcctcggacaccgagttgaccaaggatgtgtcccgcctgttcttcatccaatgcaaacggtgcgggagtcgtttcgcggtgtcctccataaagtcaggctacacggcaatggtgggcaaacgggcggcactccgtcgggcggccgaagcgacggcgggcaaatgaatggcaaaaagcgaatgtggatgggaaaggaaagagacttcttccttttgttgtttccttttttgtcatgtaatttaacgcatcaaaatccgtaatattacctatatatcaaaaaaaagtcaattttcatggaaaaaaacattggtgccatggaatttatattttgttttatattctatttatttgttatccgaaaatggtgcactgacaactcgaacttaattttcatcatttctcataatgaagaggcggcagtggtaaagaattgtggtcccggatttattttttaaaaattttattttgtattttgggctcgaaaccaactttaaggggttttcgagggtgctgattacgaatctcaactcagatttacccaattccgaactcgaacaaaaagttgaaaattttttccagtgattacatttttcgtggataaaagcttcaaattcatttaacactatttattttgatgtaaaacaatgcttaaattgtttaattaagtaaagtgcacaatttgcgccaaaatttgaccggttttaaattttttt

SEQ ID NO: 438 - DNA, 2800 bp, Heterodera glycines
  genomic virtual cDNA Sequence=SeqID_721; coordinates=723..798 ,858..970,1061..1138,1519..1653,1729..1853,1956..2133,2259..2408 ,2455..2505
  coding sequence=SeqID_946; coordinates=723..798,858..970,1061..1138 ,1519..1653,1729..1853,1956..2133,2259..2408,2455..2505
  peptide sequence=SeqID_1169
gcatcgacggaaatctgtgcaaagttcggagggaagtgtcctcgttggactgcgacttttcacctgctcccattcaaggacatttgctcaattacaaaacggaacccgcgctggcaatcgaaaatgtgtgccaactgtcaacaaacactcagcttaggaaataaacgaaatttcaatgttatagtcaattttgttgttattttaattttctttttcataaagtaattactgtatacgcttgttatttatttattttttgaaagaaaataccctattaaatttccatgaagccattcgaccatcgacttttctttgaattcaattttggcgacaaacaaacccgatcatttctagagcctcaaaatctgatcaaattgaccaaattttaaaaccgctttctgtgcatacctatattttagagctgataaacacaattaacagttctgcacttctaattttttactcttttacaaaagagacatttgcattgcagttttcctttttgcgtcaccaaatttttgaattagcgctaaatttttggcgtgttgatttcgagtttaagccaaaaaatataacgaatcgatggaccgaattcctcgaagtttcactggcatttttttactgtccacattagaatcctatccactttttcctaatattatactagttaaattgcaattgcttatttttcctttttcagatagtccgacttaaaaacaaagatgggttttgttaaagtggtgaaaaatcgcgcttatttcaaacgttttcaacccaaatttaaacggcgtcgtcaaggttgggtttttttttcttttttatgctataaatattattttaccatgtcatttcgttaggcaaaacggattactacgcacgtaagcgcttgacagtgcaagacaagaacaagtacaacacgccgaagtatcgtctcattgtgcgcttcacaaacaaggacatcattgcacaggttaactttcttgacaaaattgcagtatatatgtaatagttcaatatcaaaaaagcatcaattgtaaattgtacacgtatttgttttaagattgccttttcgcgcatcgttggcgacatggttgtctgttctgcgtacgggcacgagttgcccaaatatgggataaaggtttcattttttaataatcaatatgcggtaatactggaaaaaataaattaaaattgtttcttttccaaaagtcgttaaaatatatttatgagggttttcggttcgctgatcacgaatctgacattaattttgaccaatttcgaatctctgatccagactcgaacaatagtcgaaattcaaaattctcacacataaaaacaagtttgaattttcgactttttgtcttagttcgggtcctggattcggaattggccaaaactaaggtcatattcgtgatcagcgatagaaaactcgaaaagaaaaattttaaatttatttttcgcaggggcaccaattctccagtattacctaatatgcttcacctaaaaacaaaaccacaggttggactgacaaactatgccgcagcttacgctaccggacttttgttggcacgtcgccacctgaacaaattgaaattggacagcgtttataaaggcaaagaaaatgtggacggagaggactttgacgttgagcaggtttgttaacacagcaaacttttcaacactgctttttattgaaactttgattttcctcaatgtcttttcatttaggaaggggacaatccgaacccgttcacatgtgtgctggacactgggctcgcccgcacaaccaccggcgcaaaactgttcggagtcatgaaaggagttgcggacggtggcattcacgtgcctcataggtgagcaatgggaagaaacgtggaccgactgttgccgaaattttggcttcttttctttaaatccagcctgagttcacttatttgttcccttttccattcaagtgagactcgtttctttggctatgacccggaagagaaaaagtacagcgcagaagcccacagagaccgcatttttgggaaacacgtggctgactacatggcccacctgaaggaagaggacgaggaagcgtacaagcgtcagttctcccagttcatcaagaatggcatcgagtcgggaacggtcagttttatttgggacagagggaataatattatcatacacagacagccattaaatggtgggtcatttatgaacacccaaaattgaatgatcggtgttaaatgattatttgatgctctttttagttggaagaaatgtataagaaagcgcacgaggccatccgcgcggatccgtccttcacgaaaaaggaaccaaagaagccaaaggagcaaaaacattggaacaaaaagaagtacacactgaccgagcgcaaacaccgtgtggccaaccgaaaggtgcagctttcagtatttttatttttgtctaattttcatcttttaggcgtatctgttgcatctgaaaaaccagcaggaggcagcgttggaaggctgaaaaaagcgattgacctatttgagagtgattgctctttctcaatttttatttgttgttttgtggtgagagagaaaaatttgttgtttgcttttttggcaattttttccaattcaaatgccttgatctggcgctaaattttgttggtttatttgacctcgtttatttggcaattgtgaagattattggtcccacaaaaaaaagaataaaaattaaaaaaaaccatttttaggggttatttgatgcgctgagcacgaatatgacatccatttcggccaatttcgaaccggaacccgaa

SEQ ID NO: 439 - DNA, 1443 bp, Heterodera glycines
  genomic virtual cDNA Sequence=SeqID_722; coordinates=1276..1129 ,782..725,571..433,232..21
  coding sequence=SeqID_925; coordinates=1276..1129,782..725,571..433 ,232..104
  peptide sequence=SeqID_1250
tttaaattttgaaatggaagtaaggttcaacaaattttatcgccaccaaataacaaaacaagccgcacaaagagagtgtggttcggggatgtcctcgggtcactcagaattcgccacgtgccaattgccgtcgctgcttcttcttcgactctttcttcactttgaccaatgcgccggccggcttcgcaacgacgtcctttttctcggtcagaatcacttcgatgtgacacggctaaatgaatgggaatgttaatggtaatgggatagtgcacaatcagtcagaaattaggaatgctttgaacaaaatttggcgaattttgaaatttcaagccgcaaaagttaaagtaatccaagacaatttggacatggatgatgggtttggaaaatccgctaaattgtgaaaaaatgtttccaactctgaagaaaacgcaccgaactcatgtacggattgatgcgcccgtgcgcgcggtaagtgcgccgacgcattttggcggccgcttgcacgacgatgtggtcaatgaccaaatggtcgacgtccaggcccttcacctcggcattactctccgcatttctgtgcaaaaatgacgatacaaaatgcaaacacttaacatttggtcaagtttgtttattatgaattttcttgtgggtaggctaggatatacggaaaccaaaatggaattccaaataaaatgtttttagggtcccaaacagaacggccttttacctgagaagttggagaaggaactcggcggactttttcggccaacgtccctgtgttgtgcctaacaataaacaaaagtgtaaaggaacatcattagtctaaagagctatgtcaaaacccatcccatcccggatttttaccactttaggcgtccaatcaatgaccatcctcagtttcattgactataattttttcttaattggtcaaagcatacattcttggtatcaaacaaaagcttagtctcgggaatttacaaacacaaagaaaaacagcaaatactgatttcacatattctaccggtaccgagaatgtaaagtttgaccctagttagaaagaagttatggcctaaggatagtcattgatcggacgcctaacgcgcaatacacccccccccccctacggtttaccccacgcttgcgcctgcgctttgcgtcccacgccgccgttgaagtggcggaacggcacaatctccttcttctcccgtacattctccagaaagcggatggcacgcttcaacggcatatgtttgatggcacgcgccgtctcatgtgtgttctaaaaacaatgaaaatgggcataaaagaaaacgaaactatacttgtctctacgctcattgtaaatataagaaccaaactccttgttccgtttatcataaatctcaattcgtggccatattctccaatggccaaaattttggctgctaatacaggagctacttaaaa

SEQ ID NO: 440 - DNA, 3219 bp, Heterodera glycines
  misc_feature (3137)..(3137): n is a, c, g, or t
  genomic virtual cDNA Sequence=SeqID_723; coordinates=1692..1545 ,1490..1374,1333..1200,1157..929,879..775,731..679,637..577,432..227
  coding sequence=SeqID_990; coordinates=1661..1545,1490..1374 ,1333..1200,1157..929,879..775,731..679,637..577,432..280
  peptide sequence=SeqID_1205
ggaggtattgtagcatttttatcgtcaccaaaactaaagtccacttttccagggtgactttggtggtaagaagttcaaccagggaaaaatcttcaagtgattctgatcatgtcgtaatcacagttttgttgcctacaactgttattttttgttgacgaatttttatactttattcaagtgattaaaggtggatcatttataatcttaaacataataacagggtcgaccaataggatgagtatcggtgagaagttacaatatcaaattaatttaaaacactcaaaaatcagcgtcaagacggaattcacgctgctcttctgttgaaataactcccatcttttggtactccgacactcgcttctcaaaaaaattggtcttgccctgtatcgacagattctccatgaagtcgaacggattgaggacattgtatttctaaaaatggggaccaattgtaagtgattatatatacaggtaaaggctaatcctgtattttattggtcccataaaaaagagattaaaaatcttttatttatgggaccaataaactacaggattacccagtaaagtaaggaatgccttgtcatagcctagttcaaccagcaaatggtcagcgacgaactcaatgtattgacacatccttaacaataaaaaatattccaaattaaaacgtttaattacaaatcggaattcatgccgatcatatagacaggaagtgcgtcggttaggtattcctgcaaaaaacggcgatttattgtctagcaaaggcccaattacctgttcaatttttaccgcgtccgagatgatttcgtagatgcgttctttgggtggcgtgtttttgaggtgggtgtagagaagacaggcaaagtcacggtgtaagcccttggaaatgcggtttttgatatttaaaaaaaaccaaagcaagtcaaacttcgtcacgcgaaattaattcgttgctgtgcgtcagaccgggcaaaaggcctcgttttttaagccaaaaaattgcagcaaaactccccgagaagaaaatcccctcaaccgcagcaaatgcaacgagtctctccgcaaaagaagcgtcggaacttgcgatccaacgaagggcccagtcggccttctttttgataaattcgaactcgaaaatggcattaaaaagcttagcactaaaaggacaaataggagggattaatgtatgaaaataataccgttcatccgaatccttaacgtaagagttaatcaacagcgaatacatttcagaatgaatgttttcaatggctatttggaaaccataaaaacagcgagcctctggaacttgaacttcttgagcaaagcgctccacctagcaaaattaaaattctaaataaacaaacgaattttactaaattttcgttgacaatcccatcagaagctgcgaagaatgcaagtactcgagaaataaaaaatcgttcattatcagttaagcttttccaatcggaaatatcctttgacaaatcaacctaaaagcaaaattaaaatttcattcgttttattcaaacatttcacgcaaatacctcctcaactgtccaaaatgaagcaactgccttcttgtaaaattgccatatgtcatggtatttgatggggaaaatgacaaaacgatttgggttttcctgcagaagcggctcgtccattcttttcaattggaattgggcagtgacaatctgtgataatgttttgctggttattcttttttcctaaaagcgatgctattttgaattcgtttctgggcgcgctattttaactaagttttcagtttctttagtaaacgaattgaataacgaatggaggttaatcctgccgatttgaatttccctaaagcagtgatcgctcgtataatcaaagaagcgttgccagatggagttacagtttcgaaggtattttttacacactttcatgtaataaggaggttattttttaaattttgttttggatgctggacgtaattagctgattagattaaaattttgagattaatttcaggaagcaaaaaatgcgattgctagaagtgctgctatatttattcttcacgcaacttcactagctaatgacaatgcacaatcaaaaaagagaaaaaatctgatcgccgatgacgttttatatgcaattaatcaattggaatgcgatgagcttgagaacccggtcagttttgtgcaaatcgaattgtaagaatgaattatcgcacttgcatagtgtcaatttggaaaattagtaaaaatacaaaaagggaactttatccttggtttccaacgccataaattttctttcttggtcaatgcctgcatttttgtattcaaacgaaagctcagtttctcaataatttataaatgcaaaaagaaaacacgaaatttagcttttttcgggtggtaaaaataattttttgtctattatattatcccataatatagttaaaccaaaaatgctgtagacttaaaaatagacaattaccaagtaagataaaagttatggcctaagaaactgacaaatgagatggtcattgatttggacgcataaactgaattagaaccaattgggcttcaaactgactctgttttaccaaataaaacccctgacaggtaaaggaagcactcactctttacacgcaaaagaagaatcagcgacaacaacaccgaagagagagaagggcaaaacaaagagaggaaaaacggtttgaaaccaaaggaaaaggggagacagaagaaaaaggacagcaagaggatggacaaagcgactgcgaacagggaatggagaacggtgacgacgatggagaggaggaggaggagatggaagacgaagtggggcaatagtgcgcatttatttagactttaaactgcatttttgcataaattctttttactacctattttaaacggccgttttccgttcaaaaggctttattatacttctaattgtaaaaaggaatctgttttttgaatggtattagcttgtatggcgacgcatgattctgaaagttgttcagcagaacaggtggataaacacggatcaaagcactaaagttttggaataaataattatttcctccctataaaaggcttctactgccgatgaggttgagtcgtccagtaggaggtccagcacagataacttgngaggtgattccgactacggcgatgactcggtgtctgacacagattcggatgacgaaatgaaaagagcaaaagttcgacgctg

SEQ ID NO: 441 - DNA, 3239 bp, Heterodera glycines
  genomic virtual cDNA Sequence=SeqID_724; coordinates=1462..1300 ,1036..882,785..760,522..384
  coding sequence=SeqID_1023; coordinates=1462..1300,1036..882,785..760, 522..384
  peptide sequence=SeqID_1230
tgaatttcaaaaattatttttttttaaaaaaaggggggggggacaaaccctactattaccgaataatgaagagcaattttaaatttaacaaaaaaaaacattgttggtttgtaggtttattcgtcgtgtacacatgaattacacattaatagttacggtacatgaaaacagtacacttatacaaattatcatcatcaaatcatcatattacataattgccatcatacataggtgtttatttaatcgtcattagctgtttgtgtgtcaaagtgtggtgtcgtgtaaaaacgtgaaaattgtgtgatgatcggtcaaaaaatttctccctcgaggccttccaatgtttcattttcattccctcccatttttctcatccatttttcctagcgttgctgctgctgctgctgctgctgttgttgatgttgctgctgttgcttgttggccccggtgttcggatgttccgtctccaaatgccgttccaacttttggtaggaggtgcaacggtatgagcacacatcacagcttcaaaaaaaaccacaggaatgattagagtgtcgttttatttttatttttatcaacgaatgatgcatttaatttgcttgcccattcgtcgagcgccacccctcggtttttccaaaaaaaataaataatattttttttttggaaattccgtttctaacattcaaaaaaaaaaaattttttgttatttatgtgaattaattttcaaccattttgtttgaacaacacacgccaaccaacctgtacattatttctgctgagcaaagcttaaaaaaggaagaaaatgtatttggaaagccaatttactaaaagcaattaaataaattaaattatttgcaattataaacatgtaattagcatactttaatctggtgatcggagaccaaatgttgcaaaatgttgaaggcgtactgcttgctgcacagcttacaccgtcccgagtccgccttgcgctgcgcttttgccaacaaatcggcagtgacgagcccatggaccatgaccaaatgccgttccaaacctaataatgtgtagatgatgtacaattgtaatcaagggagtaggacatgatggacaattatagatttaaatcgcggagcaagtcgtttaccgccctattttttttaaatttttaaaacagaaaattgaaagaaaaggatttttttaaaatttccagcatttttccaaaaaaaatttttctaaagcgctaaattttttattattttttaatttttggggagaagcgacagggagaaaaagaagttcatccttcagcagcagcaccttcgtatgtccagaaacggtctctgcagcgtgagcacgccaacggtgcaccgctggccatttccgcgttgttcttccccaacagttgacgatgtgcggactgcaaatgcacccggtactgctcgcggtcggtcaactgtgccaagtcgcaaatttcgcacacataatggtgttggtgttggtgcgggtggctggtcggagcagcagcaccaccaccaacggcggtggcggccgagtgcgcagcggcggcggcggcggatgttgcctttagctaaaatgaattacaattttttaatggcattaattacattcagaaataattgtaattggttggatgcaaaagacatatcctccccccccccccggtggcgttcggaaaatttgatggccaagttactatcgattttttgttttgtttgtttgctgtttttgtaaaatgctgagatttctctctttttgattaaaaaaattgccaggcttatcgtaaaatgtaaattttttttgttgccgttgtcatatagcatatactatattttaccatttgctgttgttgttgctgttgctggtggtgttgctggtgctgctgcctggccccgttgttgatcagtgccctctgttggttggccattgtcgccgccggtggcaattttgcggccgcagcagccaaaatttgatgcgatttcagcttttgttgctgttgcaacagttgcgtttgcatggctaaaattttttgttttgtttgtttttggctctgttcaattcaaagaattggcacacacacacacacacacccgcttggatcatctgtggcgttatgttttggcccttgtcacgtgccatcctcaaaatttggccaaccgatgggcccacctgaaaattattttgatattttaatagtgccatttgaaaacttccaaacttttaaaattaatggggcaatgtgctgcatttccaatgaaaatcaaccaaaaaaaaaaaaaattttttttaaacagaaattcaaggactgtactggaaaatgaaaggaaggcatttttgaaagcgttttttcaaaaaaaaaaagtcgtcgacttgcaaaaaaatcgcaaaatttggcagtttttgggtcaaaatctgttaacaaaccgcactcaaattttcaaaattttttcccgacggcgcctaccggcaccgtcggcccccccggttcaccaaaaatttttggaaaaagtgcgccgcaaaaaaatgggggtttgaaaagcaaaaaaaaaaggtcgtcgatttacatggccgggaccatttcgcaaaattggccgctgaccccccccccccccctccagaccatttcgcaaaaattttggttgacctccccccctttttaatgtatgaattggcataagatagccatacggggagctataagtcaatttctcgccaaaaactttcttgatttatcaaaaataaaaacaattcacttgtgccgattgtgcggacgggaaccggttggcattgtgcacagtgccggcaccaattagtcgagtgtgtgccaccgttgccaacgctgccgcaggcgttgtgccgccgctgaggagccgttggttgcgcaacagttgttgctgttgctgtttgagctgtggcgttttggtaatgggggaacattgtaagacagggttcccaaatgccacaagaaatctacatatattatcgaaggttggacaattttttgggttccctggtgcggtcagaccatcaaaaatgtatcaaatttatgaagggtcccaaaatccattaaaaatataattatttcgtgtattttcagttatttcgaagaaataactgacaataagtcgtgacttttgaatgtgccccaaaatggtcaaatttaagtgttttcaactccaaattttttttccataggtgatatcaggatgtgatttcaccccggtaacttcaatgctatt

SEQ ID NO: 442 - DNA, 4564 bp, Heterodera glycines
  misc_feature (1767)..(1768): n is a, c, g, or t
  genomic virtual cDNA Sequence=SeqID_725; coordinates=4284..4234 ,4181..4137,4090..4056,3997..3938,3883..3833,3747..3711,3663..3572 ,3517..3466,3418..3192,3130..3028,2980..2942,2821..2694,2591..2375 ,2324..2183,2130..1930
  coding sequence=SeqID_868; coordinates=4261..4234,4181..4137 ,4090..4056,3997..3938,3883..3833,3747..3711,3663..3572,3517..3466 ,3418..3192,3130..3028,2980..2942,2821..2694,2591..2375,2324..2183 ,2130..2076
  peptide sequence=SeqID_1100
gggagagagagaggagagaaaaagagggacagatagacgagagagagggcggaagaatgcgagagagaaagaaatgaaagaagagaaaactaaatgagaaaagtgattaatagagaccggacgggcccggcgagcttttaccgggcggcccggggcgcctggtaaaacgggctttttttgaacgggcgtcccggaccactgtaaatgtactttttgtaccttgtggttgctcgataaataaatatattcaaactcactttgcttttcccattttccttttctctcctcaggtggcactcgcctttcagctgaccctctcccagtcgggcgtcaacattttcgccaaaatgccgcgcgaagagttcacccaaatgcgtcaggcgatcatcgacatggttttggccacggacatgagccgtcactttgagcacttggccaagttccaacagctgatggccataatgccggacaacacggaggaggagcgggacgccaattcgttgatcatttgccgaatggtcggcggagggattgggcacgcataaacagggccaaggaaaagacggcatttcttcagatggtcaaatgcgcggacattgccaatccgacgagggagtggcgcttgtgccacgagtgggccatgcgaattgtgcaggaatactttgaccagacggcggaggaaacggagcgcaagttgcccgtcacaatgaagggctttgaccgcgagacgtgcaatgtgccgttgacgcaggtcattcattcattcatttaatcgacgtgcttttggcatttcgttttggttttgatcacccaattttgctcccatatgatcagccaatcatttggccaattgtgcctttgtccgatcattcattcgtccatttcccctttcagtgcactttcgtcgacatgttcgcccgcgaggcgttcacactttggtgcgaatttgccgacctgccccatctgccggttcagttggaggagaactacgcccagtggaagacgagatccgccgaatgggacccgaaaaaggacaacgacaatttgttgaagcggacggaacggtgagagcggacaaagcacagaaaggaggggaagcggcgccgtttgtgccgtggcaatggacccaccacccaattggacggcactttggctgtcgcggcgactcgtccaattcctttcccaaaattaaattctcaacaccaataattattatttatctgctgttcttctgtcttcgttttcatgtgcaattgtctttttgttgctttttgcctctttttcgtcccaattttcaatttgtttttccttttcctttctttagcgtcgctcattttgaatcttttaagttatatttcgcatttttctgtcatttaaataaaggttatacataaaacccgttacttttccatttgtttgcttaggtaattaattaattatgcatcctttggcaaaatgagcgcattggttgtggtaattaatgttttatttcccctcccttttcccttctgtcaatccttccgccgatatcatttttattcttctacattcgctttaccaccttttgtttgatttcgttatactattttgtcccatatttccactcaaatattccaattaaaagagaaaataatgcataaatttttctcattgttgggcaaagcttaggtattttaaaaagggacaaatttaagccgctgaaaatttgacattcatttttagaaacaattttcgcttttgcggaaaatcccttcaaatggaatcctnntaatcccgagctgtcggaaggaataatttagacaaaattctcaaattatttgcgaatttaatccggctaaagggatggatggtacatagatcacgccgattgatttattttatgccaatggataggcaagagttaaaaagacaacgatttattctaagtaataacaaaaccgatttacgaacccacaacggcaaaccaacaaaatgtcgtgtcaacatgccaatgattacaaaaaaaaaattgcaaaaagtgaaattgacaaatagaaaggtcttctttccgcttttctccttccatccgctgcttttcaataacggtaatggcctggtttgaatggtccctcttggggaatgcccaaatatctgagagaagcaatgccaatcagtattcgttcaacccccaacccctcctcactcggcttggtccttgctcaatttggtcagcttggcgcccaacttgtccaggtgcagccgtgccacctcctcgtccaactgtttcggcaaaaggtacagtcccgttttgtaagcgtccggagtgccgtatttcgtgtacaattctaaacgaggaaaagcagaaaatgagaaaaagggagataaacgggcagaccgagctgggcgatcacttggttggtgaaactagcggacatgacgaaggacgaatgtccggtggcacagcccaaattgaccagtcggccctcggccaacagaatgacgtgccgaccgctgcgcatcaaatagcggtccacctggggcttcacctgctccatggacacgcaattctcgttcatataggtaacgttaatttcgcagtcgaaatgcccaacctcaaaaaagggggcaatgaaatggaagaataaatggtggcaattaggagtaattagcaaatatgagagccctaaagtgccattccaaccaccaccgctcacattgcaaacgatggcatcctccggaagccgttcgatgtgttcacccctcacaatgttcttgcagccggtggtggtgaccacgagttgagcaatgtcagcaacttcgtccagcgtactcacttggtaacctgaaaagcggcgtggagggacaagtgacaaatgagtgccgacggaacataaacggacgatacctacccgaattattaaaatatccaaaaatttcatttttttcaaatattttgccttaccctccatggccgcctgaagggcgttgattgggtcgatttctgaaacgtttggcgttttgtacatcggtgtcaaggacagagcgcacctgtgacgatcactcgcgcgccaaaattgcgcagccccgcggccgaaccttttcccacgtcgccgtagccgcagacgacggcgactttgcccgccaacatcacctgaggggaaaggcaatttgagaaacgatcaaccggaattaaaggggggggaatgactcacatcggtcgcccttttgattccgtccggcaacgattcgcggatgccgtacatattgtcaaacttggacttggtcaccgagtcattcacgttgatggccgccgttttcagcagtccggccgccaacattttggccaaattgtgcacccccgtcgtggtctcctcggacagtccgatgatgccgggcagaagttcggcgtgttggtggtgcacaaggttggtcaggtcgcctggggagggggtgcttttccagtccaatgcagcagaagtgactcacctccgtcgtccaaaatcatattcagcggctttccgtccgggaaaatcagcgtctgtttgggggtgaattcggatttaccgcaattttggtgtcccatttctggcacctgctcaatgcaccattcgtactcctcgtccgtctcgcccttccacgcgtagacgggcacgccacgcttggcaatcgcagcggcggcgtggtctttttttgagaggggaatggaaggggacggagggcaaattattcaccttgggtggagaaaatgttgcaggacgaccattggacctgaagcagtcaatcgtcgaaacagttttccgagcagtacaacaaacaaacacaaaaaggccaacccaacaaaaaaaaaactgacttcggcgccgagttccaacagcgtttcgataagcaccgccgtttggacagtctgagaaaggcaattaagtgaacgatttggccaaaactcgggggaaaacggtaccatgtgcaaacagccggcaatccgcgcacctttcaatggcttttgcgcaccgaactttgcctaaatgaattctaattaaattaaaatggatggattaataaacaaaagaaacactcgcccgcatggccatcagtccgggcatttcattctccgctaaatttcattttaaattttaataaatgaatttgtgccctctgaccaattgtaatttccctccgcccaaagtcggccaaagaaatgtcagctgaaaaagaaattgggtttttaattattttaaaaatgagtcaaaaactgaccaactttgtatgccggcttagaagacatttggaccagaaaataaaaaggaataaataaaaagaaattaacaaataatctattaaactgaacaaaacgaatttacagttaattaattggtaaaaattcgctgcccctctgtctcttatcattttcagattcccgaacaaaattaattgcttttttctttatgaaagatgaacattcttttagtttatgactttttaatacatttacccaaatgggttttttcccttcggatttttttgtcgcattgtcagctaaaattcataaaaaaaatatggtaaaaatagtctgaattttgtgatcaat

SEQ ID NO: 443 - DNA, 4958 bp, Heterodera glycines
  misc_feature (4826)..(4826): n is a, c, g, or t
  misc_feature (4879)..(4879): n is a, c, g, or t
  misc_feature (4922)..(4922): n is a, c, g, or t
  genomic virtual cDNA Sequence=SeqID_727; coordinates=1891..1883 ,1833..1623,1571..1321,1266..984,931..802
  coding sequence=SeqID_906; coordinates=1887..1883,1833..1623 ,1571..1321,1266..984,931..893
  peptide sequence=SeqID_1133
aaaaaatgggaaaattatttttggtcaccgaactgaaaagtgaattgttcgaacgaatccactcgggaagtaataaggaaatcataccgtataagtcgctcgagtcacatcctatgtcttagtacaggtatcagtgagtggagcactcaagagcatagatgagatagggtaggcacaagactcagagatcagcagagcggtggaattgacaggtaggaggcatagcgtgggagagggagtcgttggagacagagaagcaatgatagaggaagggaaagggacgagagaggtgcataagggcagtgttgcaggttaaaggaattgtggtaagatgttttaaagaaagcaattcaggagcaggacaatgagactaatcggacagaacaatgacaaaaggaaacccaataacgatggacttttcatttttgtaattacaataaaatattgccaagacacaatgaacttacaataatcttaattgtttatttgtcgcaaatataagttaaattagtttgctgttagtcattaatatttttaagatttaacccaaccaatttcggaacccagactacatagtgcatattattccactaacacatcctaccacgatacctttctcaaaataaagaccaggtccgtcaaagtccacactgtttacgacaaacgatggaggaagacgccaaagcggtccgatccgagtgaaaactgttgtataccttaagaaccgcctaattaaaagacgttgaaacataaaatgtaacaaaataaaaaagcagcaaaacatttaaatcaaaaaaccaatttgaataataacaattcttcaacaaatatgatgtggcaaaacaatgaatgcgatcgattgtctcaaatccgatcgtccgcttgttgtcatttacttgcctcctttctttttcttgggaccaacagtttcctttaagcaattaaacccattagacctcaattaagcttacaccgactaatacccttttgcccacagtttccgtttttgacttcggctgctccttctctgcagtttttaccgcggcaggttgtgtcttgggctgttccttatcagcggtccgtgcagcgacaggttgtggcttcggttgctctttctcggctggctttgtcactaggggctgaggtgtcttctctttctcgctctccgaaattttgtgcaaaagttcctttcgcttctgaaccaaacgctcctcgcgacgtttgcgggtttccttgttcttgttgcgacgtgcctcggcctgttctctgaaacacaatataacgggttgagccgaattcagttggacccaaaaaccatacgcaagctgtttagaacgttggttttcggtttttttcttaaagatgtattccatgaggttgcgcttgttcttgaacgcatttccttttgctttgaggtagagctcatggtaaaggtgtttgtcgatttttttagcatcacgataacgcttcaataaatgacgaagcacacgcattcgacgcatccaaatcactttctctggcatacgcgcattgcgagtaccatgacgcttgccgaaccccatgtgacggccctaaatgattcagagtaaatatccggtcgaaaatagtgtaaacccattaacctttctgcgtgcttccaaacgttcacgagcgcgataacgtgaatggactttccccggcttgcggataatgagaccgtctttgacaagacgtcgaacattttgacgagaattagcattcgaaatctcgttgacttcatttgggtcgagccaaatctttcctttaccacatttcaacaccgaagcagccaagcgcttttgcagacgaagattgctataaattaagagatgcgcaataaaaaaaaatatataatggctataacctcattatcaaatgcttattttagggatgtcaaatctgaaaagttaaataaaattgccttttaacaaattttttttttaatatgaacgaaaacatattcgattgttttctgtcaccaatatgacatcagtttttaccagggtagccagattaaaattttcaaaagcctcatttggcatgtaaaaaaacctcattttggatcaaaaagcctcatttttacaaatttattcaaaacacatttaaaatgttcaaatgttatatttttgattgtccatgaccactttgagtaattttttgctagaaataagcttttttgtgaattctgagcacgaaaatcgaaattgattttttttttttttttttgcggcgctttttccaaaaaacttttggggaataaaggggtcggcggtgccgataggcgccgccgagaaaaatgttgtcatttttaatgcgatttgttaacagatttgtccacaaaaatgaccaaattttgcgattttgagcaaatttttaagaagataaaggatttttatggtccggccgtgctgacaggcgccgccgggggaaaaattaagaattttgaccatattttagcatattttcattaaaaaaattctttattttgcggtttttctcaaaaaaaccacaaaaagcctcaaaatttctcaaacaaccacaaaaagcttcaaagcctcattttgaaaatttagcctcattgacctatcaaaaaaccacaaaatgaggctaaagcctcagatttggctaccctggtttttaccaataacaaaagaaacaaaaaggaaaaattttttttttgagatttaggtaagtgaaaattgatcaaattattactagggctgggatttttatgtttttacatattttttctgcggcttagttatggcgagagaagcccaaaaataacattttctccgaacaattttcgaattagagcgacttataaaaacataaaaacacatattttggcgttttcgcacataaaaacatatcgcacatatttcggagtttcgaacatattttgcacatattttggcatttttgaaaaaaatctaagaaaaacacaaaaaattcaaaaatgcacccctaaaaatcaactttcttgccatttttataggctctttcaaaattttctttatttatttcgtgtaccgaaaatcggattctccattaattcgttactggatatcgaagtttcttgctggaacttactcaactgatggaaaaataatctttaaaacaatttatcaaaaaaggactaattttacccccaaacacctccaaatgttttttatttgcaattgtgcgggcgaaaatgaaaagaatgagttttttggaatttttatgcaaaaataccattggtttttccaatttttagcacatattttcgcacatattttggcatttttttggcttatagcacatatttcagcattttttagcacatattttattacatatttcaggatttttagcacataaaaatcccagccctaataatgacgggttggttggtgaaggagtggaaagaaatggagaagcgattatcttatataattaatttatgcgtaaatctgaaccttaaaatgcgattattaagggattggcagcggttgatttgtatttcgttggatggatgttggaggagcaacaaaacgacaacaattagagttaattaattaagattaataaaactgaaactgttcgagggcaacgcaaaatggcaaagggaaaagcagcagaaacaatgacggaaacatagaaaacgtttatggagtattttgattaagtgaaaatgctgtatattcccaattaaaataaaactgcaattagcagaaaatttaaaaataattaatcgcggacatatttttaagagaatattagccaaatgatttgttgagtataaacaaactgaaaatatgtacaattccaattgcggaccccaaaaacacacagtttcactattaatgaattttaaataattatcaattcttcaaataaaagaattattatttttttcgtaacattaaagttatttatgcatttaaaattgaagacagatttgtaaatggattaaataaatgtaaaattttatattttcttttattcgatataaagtgtttttaggcaatttttaaatttatttcctgtaccataatatttttaattttggtaattaaggaacatcgattttttaaatcactcacctttttattaattactttggccaaaaaatttgatggaaaggcacaatctcggcggataaaaaaatgatttaattaattacaaaattgctttatttaatgacattaaaatccgattgaattctctctctccttctctgctcccccctctctctccttctctgctctccctctctctatcgctctctctctctctccttctcagcttcctctctctccttctctgctcccccctctctctctctctgcatgtctctttttgttgtatctgtcgtctctgttttttttgatcactctctttttcggcgccatttataatttcactgttgattctaaatgttaatgcattgtttgttgatacctaaattttgattattgtatgtaccaacaaagtgccgacaaaggcatcggggaagcaaaaaaaatggtcagacgggaaaaacatatcagccattgccattgtttcaagcagttcagaagcaacagtctgcaaaaacgcacagtttggaatattaaatttgtatttaattcagggctcccaagttttttcttcaaaaaaaggacaaacgatgctaaaactaagattttgactacaaaaataagattttttgaaaaaaaacaaatgattaaaaatcgccgcttttttgagtttttgaaaataagcacaaaacaaagaggtgttgccaaaaaaaaaggaaaaatcttagaaaaaaggacacttgngagccctgatttaattacatttaaattaaactaattgattgatttttcaccanagtgtccaacaaaagattcatcaataagccgaatctgatgccnaatctcgcagccattttgccattgtttgtgcggcgg

SEQ ID NO: 444 - DNA, 4061 bp, Heterodera glycines
  genomic virtual cDNA Sequence=SeqID_729; coordinates=3903..3822 ,3763..3605,3427..3071,3025..2944,2900..2715,2668..2562,2510..2365 ,2320..2239,2193..2134,2080..2039
  coding sequence=SeqID_986; coordinates=3887..3822,3763..3605 ,3427..3071,3025..2944,2900..2715,2668..2562,2510..2365,2320..2239 ,2193..2134,2080..2039
  peptide sequence=SeqID_1201
cggatttaattcctcttaaaacgcaactgaatgagttaccatctatagattaatattttattaccgtaataaattaagtgacattaaatttatttatttttttgaagagagtaaaggcaatgtcgtctcctccaccttttccctccttttgttcacatggtttgtgtcaattgtttgtccataaagcgtcgttttgcgaaacaaagccaccacttacaattagtgaaggttgattttttttaatgctactactcactttcgaaggtggcatttccgggtcggggaatacgcggtcgacaagtcgaacgcccaactcatggcgcaactgttgaagataggcacgcattgtatctgaacaaaagacggaaaattaaaaaataaaagtgaaatgccatggcatttactatattagtcaatgacaataggtaagtctgtttttcttaccttcttcttgagtatttgcgggcggtttgaaaagtccggggaaaggaaaggacggctcgccggggatgggaaagttccgctgactgtccaatgccaaagtcagcaaatctttgcccgcctgcaatttccttggactcttaataaatgttttgttttatgtttcttttttttttttgcttaaaattggcactttttgcaattttttgaggcattcggtgatgtacaaaaacaaataaatcaaagtcctatcggccgggcctttgatttcaaagtttctggaaaaacacattcgccttgaagagagtcaatgcttcatctgtagaacagagggacaattcaataaaatttaaacaaagtttttaaaaaagtgccttccccttaccgtaccgattacgtcctcctcggaagtgtcatctgtaaacaatgaactgcaactcattcaaacaaaaccaaccaatccgcggcgccggccctctgacgcccgttttgatcggaagaacggccatgttgccgacgagcgaaacaccgctggtgaatttcgaatggtacggctgaaagagaaaattgcgactaatggcacttctataggaaaagaacgaaccggcataacgaatgaagggacgaaaatgacaaagcaaaaagcaattgaaaacgaaaaaaaacaattacaataaaatgtcggtaaaaattaccagctttggttaagtatttgcaatttaactttttctttgtgcaaatttatacaacacgtaaagaaattaggaaaaaattacaatttaattttaagcacagatgtgccaatgttgtgatcagtcatttttctctgtcccgcccttttccgtgctctcttcgctcttctccccttccttttcttctttttccgtacccttttcctctacactctctagcgactgtcgtgtcgcctccataaactcaaatgagcacgaagtcaaaacagaaatccaattctgcaaagcgtcataatcggtggccgccattatgtaattgtggccggtgctgaaaaaaatgagaatttaaaagaggaaattccaatgattatttgtgccccttctccaaattacgtgttgaatttgatggagaacgaattttgccttcccatcgtattgtcatcggccaattcgaccacaaagtcttccattacaattaacagcacggggatttcaaggcgttcggacgactcaaataaaaataacaaattggccttcaaaacggcgtataatctgcgccatcgctcgtcctaattaaaaagggaataaaatttaatggtaaaccgaccacaaaacgcacctgaagaacactgacatagccgtggattctccgctcataatttttatccgaaattaatgagacaagcgaactgctgttcaaaagcattgcttacaaaatgcagacaaaaactaacggacgaatacaaaaggccagttccaaaatcttcttatgttttttaaaaagcaaatatttgtgtataattttctgtttgtaaaataattaaacgctttatcaaattcattttcgccaaatcacaaaaaaaaacaattatatttcgccatttagggcaggttcggacaaaggatcaggcataataattcagactcgttttcttcttggcttgcacctaaattttttctggtaccaatcaaaatttaagcggcaattaacctcaaggatagcgtccataaaatcttcgtgcagaatgatgtgagattcacgacgaagcgcgatcataccctgataatcgaagcagtaaaaggtcttaaaaaaaattggtcccaccgcctccacacaaacagctttgcattgagcaccattaaaatcgtcggtacaacgtgccaactcatcgaaattaacatccttactgcaaaaatggcattcgattggttccgagtcgtaacaacttactcaacgttcatattccgggagtgaatgcggacgatgtgcgcccgggccttctcgtttggcgctggcagttcaattttgcggtccaatctgccggaacggagcagagccgggtcgagcacatcgacacggtttgtcgcagcaataacctgaaaaatcaaatcgaaatcgacaaattctcctcattattcgccacccacttttatgtcgtcatttggctggaagccgtcgagttggttaagcaattccaacatcgttcgctgcacttccctatcgccggccttctccgaactgaatcgttttgtccctgaatagaaaaatgcccaagttagataattgtcaaaatgcactaccaattgcgtccaattcgtcaatgaaaataatggacggtgctttctctttggccagtgcaaaagcatctcgaaccaatttggcgccgtctccgatgaacatttggacaagttgcggaccagccagcttcagaaaagtggacttggtttgagcggcaacggcacgtgccaacatcgttttacccgtaccttggaaattggctttaaatttcgaacaacaaatagacaacacctggtggtccatacataagaacgcccttaggcggctgaatgccaatgtttatgaagagatcttttttagtcatcggaagaaccttaaaaagtaattgtgttgatacggcatgtgaaattcggcttacaattgcttcaaccaattctctgatttgactatcgcatccgccaatgtctgagtacgtttctttcggacgctcgtccacttccatggccttcacgcgtgagtcgtactcgggtggcagtttttccaggatgagataagagtccttgttaacgccaaccaaatcggacggtttcatttcttccgggtccacaagaccaacaacgggcagaaagtaagtggcacgcgtggatgttttgatgacggcacactttgttttgtgggcatcaaggtcaatgtttgctccttcctcttcctgttgctcttcaagatccaaaagttcaatgacatttgagaccaaatagggaagagttttgttgatcttaacaattttatggaaaaatgcagaaaaaaattgatttgccctgaaaagtaacatatccattaatagtaattcttagttcggttttaatcggattataagcgcagagctataataaggtacaccctttttctggattgataactcaattattcgaatatttcgaatgaaactaactttgatcctttcgttgttttcctttgtcttctctttgagtgtttgcatactgtgactaatgcgctgaatttcactgcgcattatgcgaatttcgttgtcgagcaacagcgaccgctcccgaatttggtccgtagacatttgcaaaatttcagcatcgatctaaatttaagaaaaattaaatataataaagtaacggtctctgcataatcttgtgcacctcatcttcggcggtttccatcttctcgtcttcctttttagcaggttgttccgctgtctcaaccattcaaattccacaccttaattaaaacattagcactgataaaataaatgtacggaaatgaaaatatatttgaagaacagaaaaataagcgattgttaaagcataggcttaagctaaagagaaaaattaagtcagcaaaagagacaaaacgccaatttaaaaaaaaaccgacacaga

SEQ ID NO: 445 - DNA, 4493 bp, Heterodera glycines
  misc_feature (4438)..(4438): n is a, c, g, or t
  misc_feature (4457)..(4457): n is a, c, g, or t
  genomic virtual cDNA Sequence=SeqID_730; coordinates=507..653 ,706..984,1059..1391,1776..1940,1985..2287,2530..2750,2803..3011 ,3072..3229,3276..3351,3401..3510,3556..3659,3712..3814
  coding sequence=SeqID_842; coordinates=507..653,706..984,1059..1391 ,1776..1940,1985..2287,2530..2750,2803..3011,3072..3229,3276..3351 ,3401..3510,3556..3659,3712..3814
  peptide sequence=SeqID_1081
tatgttcaacacttaaaatttatgagttttaacaacattaggtgggttttttgttagtttcggtcccacctaacgcggtcttcagggtataagtccaaccagaaactagcacacgtttaattatacgtctaaacaaccgtaagaattgattaaataataagattgccaggttcccatacataaattttttgattttcaagaacatataaattttaagaaaaaagggttgctaaaatttactaaattttaatgatttatataacattttatttatttattttgttttatttttttgaaatcccccctctggtgcccaaacttcccggtgcccaaatttctggtgcccaaacttcctggtgcccaaacttcatgtcgccgtctgggtctgcttcctaccgattttcgttcattttccgttctcgtaaaggataatgatatagattaacaaagacatatacataaaaatgaaaaacaagcaattcagatagacaaccaaatcattgaatatgatggaagttgacgaccctcctaatattcaaactccaagttccaaaccgatggaaattgaacgtgaaattgagcatctccctcaagcccaagcgaccaaagatgaaactgagcaactcccccaagtccaagggaccaaaggaattgtttttgtaagtctaatctaaaaaacaactgttaattttaatgggattgcaggaatccgatgatattgcatacgaggaggacatcatacgaaaccctggccttctccgaccctgggaacgttacattgagcacaaagtgaagaccaaggctgaccctaagcaagtgcggctagtgtttgaaagagcgctgaaactgttcaatcggagctacaaactctggtacaattacctgaagtaccgccgcaaaacgattgcgcacaaaccgccgacagacattgcttatgcgcatttgagtgacgcttacgaacgatgcctcgtttttctcaacaaggtaaacaacattgtcattatttgaatagaattcttgttcaacacattgccaattttgtttttccccattgtcagatgcctcgcatttggatcgactattgcatgttgatgattcgtcgtggccaaataacggaaacgcgtcgcgtgttcgaccgtgccattcgtgcacttccaataacccaacatatgcgcatttggcccctgtatattgactttgccacacgacacaacgttcccgagacagccattcgcgtgtaccgtcgctttctgaaggtataccccggcgggcgagaagactttgtggagtatttgaaaagtatcgacaaattggacgaagcggcacaacagttggtcatcttggtgaacgaagacagaccgatcagcgagaagggcaagactggccaccaggtcgaataaatttttatatttaggcccgtatccaggggagatgaggggcgcgcactcccattcctaaaatgaaaatatttttttttagaagaaaatgcagttttgaaattttcagccattttcttaataaatatctcgttaaacatgactaattcctttaaaatggtaagaattttaaactaaaaagatagccatttagtcgttctgtaaaaaatggtgctacttttaattttggacaaattacgctgaaaaaaaaattgtgagactgaagagcgaaaacaaaacaaacttttcgtccgttggtgcctcctcaaaaattattttctgaatacgggcgacacgtttataaaatatcgatactttacaatgtgcagttacttttagctttggactgagctgtgtgatttgatctccaaaaacccaaataaaattttcacgcttcgcgtcgagccgatcattcgccaagggatcggccgttacactgaccaagtgggcggactttggctggcactcgctgagtattatattcgaatgccgaactttgagaaggtcatcatcaatttggccaacaaataataattggtttcatttaggctcgtgacatcttcgaagaagcattgggtgtggtgaagacagtccgcgacttcacccaattgtttgacgcctattcaaaattcatggaacgactgacctcactgaaaatggacgcgttgtcctccgcccggccaacccaagttgatgagcgcgagttggagttggaattggttatgacacgctttgagcatctgatgaaccgacggccattgcttctgaacagtgtgttgctgcgccaaaacccgcataatgtgcacgaatgggtgaaccgagtgcaaatttacgagggcgaccccgaaaatgtaagaaattggcgtatgggaaaattgaaaaacatcgaaggaaatggcatcaaaaacaaaaaaaaaagaagttattattttatttgactcttgcgccaaattccaaagctctcaaaatttggtctgttttagtcattattttaattcatttttacaatcattatattttaaaaacatttcgttgtattttttttctcttgctgctgaatttgtgttaaataatcctagcggaattattttagcaaattgcaactttcgaaaaagcggtggctaccgtggacccgaagcaacaagtcggccgactcggtcagctgtggattgagtttggcaagctgtacgaaaagttagacaaattggacgaggcacggaaggtgttcgacagagcggtgcaggcaaattttgttcgtgtggacgaattggcccaagtatggtgtgaatatgccgagatggagcttcggcacaggtttggcattttttttatttcgataaaaaataaattgctttccattgttcagcaattacgaattggcaactgctttgcttcgtcgtgccactacgcctccaccagtgcgtcgtgacagttactttgatgattcggccaaagtgcagaaccgcgtgttccgatccctgaagttgtggtcgttgtacgccgacattgaagagtcgatgggctcactggaaagttgcaaggcaatttatgagcggatgttggagttgcgaattggttagaccaaactgggaatcttgaaaagcatccaatgggatttacccggagtaatttcagcaacaccacaaatcgtgataaattatgcactgtttttggaggacaaccaatactttgaggatgctttcaaggcgttcgagaagggaattgggcttttccggtggccgctcgtatttgacatttggaacgtttatctgaccaaattcatccaacgatatgtgctgtgtttttggtctatttaaactataaattttcaatttatagggtggcaaaaagctggaaagagctcgcgatttgtttgagcaatgcttggacaaatgcccacccaaatatgccaaaagtaaatgttgttacttaatactacattgattgtaaatttccaattttagatatttatctgctttacgcaaaactggaggaagagcatggattggcacggcactcaatggatatttacaatcgggcaaccggagcagtcgaaaaggaagaaatgcatctggtaaaatttccatttatagaaaattaattaatccaattaccaaagatctacaatgtgtatgtcaaaaaagcgatgcaattttacggcatcaccaaaacgcggccaatttttgagtcggccattgaacgtttgcctgaggagcgttctcggttggcgaagcacccaacttttaaaaacattctaattttactccctttttagggagataagtgtacgctatgctcaaatggagcggaatttgggtgaaatcgatcgcgcccgagccatttatgcgcattgtgccgaaatttgtgacccccgggtcggttaaggaggggatcatacatatacaaggggtgtctcagaccaagggctatacgacggacgattgggacttgggccagagggggtgtctcgggaccgatttttcatacgaaggtccaaacttttctttctccgacttttttttgctattcagccacacttttttttgcggcgtgttttccaaaaaacttttggggaaggggtgacgggtggtccggcggtgccgatagacgccgccgggaaaattgcaacaacaccaacgcgtacttcggtgggtcggaattcgacgcgccagccaatgtttgggtcgtccggagggggcggtttgaagcgcatgttcatccagttggaggactggatggtctcgaagtgttccgtggacttttggtcgtcctgctcaatgcgttcctcgaacacctgcaacgggtcgcggatgaacatgtgcgcaatgtgactgaacagaacagtggggcaaaatgaatgtaagagagagacaaaagtggtggcaatgcgccaaaaaagaaaaatcaaattcaaaaaatgtggcggttagcatagtgaaccccaaaacgttgccgggacattacgtcgccgcaaaatttttttatttccttgaattttttanatatattttttttgaattntttttaaatttttttattatgctaattgtaagtact

SEQ ID NO: 446 - DNA, 3720 bp, Heterodera glycines
  genomic virtual cDNA Sequence=SeqID_731; coordinates=3720..3692 ,3615..3410,2299..2214,2171..2079,2000..1834,1780..1688,1642..1502 ,1444..1288
  coding sequence=SeqID_944; coordinates=3720..3692,3615..3410 ,2299..2214,2171..2079,2000..1834,1780..1688,1642..1502,1444..1355
  peptide sequence=SeqID_1167
tgatgagcggcaccacacctttatttggtggatgatcagctcgttcacttggtggtctttgaggctcgtgatcagtgacaccgtcggcggagtgcctttgtggtgggcgaagcgtttctcattctcaggcgcaattgcgaatccctccaatcggctctcgaaacacacttggcaccaacgcatccaatcattctgaaagaaagggacaatgaccaaagagggcattaccattcaccatggggggcaattggacgtctttgagggggtcatcatcaggcactttgacgcactcaaactcggatctgctctgagagaattcgttgctctgaaaaaaggccaaccgataattactaattaagcatgaaatatttttagaaaaatgcaaatggttaaaatcaaccaacagtttgccacaatacttttcgaaaaagatacgatgttccgggatgggtgccaatttaatatgttcactttaatgtgtccaatttaatgtatccccgggctgtgagttttcacgcacccccaccattgttgaagcattctgagccattcaaacgcaccttcgctacacaccactccttgttcggcccgaacctggaggtgaaggttcgtgagtcatcgcaaatgcccggaagatttgtgagagactttcttaagggagtggcgctgaaccgtttgagcacttcgggagaagcgacggcgacgtcgggcaaaagctcacggccaacgacaacctttgggaaggaataaaaacattataaaaagccaacaaacaagctgacaatgatcgcatttgctaccgacaaataaatttccatgccgcaaaagccgaacaaaaataatacaaaaacggaaacaataataaattcggcaaacctatatcagcaaaaattatagtagttgcaaatcagcaactttttcagcttgttcttgccaaaaaggcctttttgatattttttagaaaaggcggacgctatgagagacaaaacggtacaccgtttgcccaactccgttcctctctctttattcagtgttatacaattcgtacaaaagtcaactcctaatccctccgcccacctgttgcatgtattcttcgacagtcatcgccggcttgttaaggtcaattttgcttctgtcgaactcccccaccgtgtaaaatgcctcttgttccattcgatttttttgatcctttctttgtattttatatttcggtcattaaataatgagaaattcaaggtaataaaagtatccaaaacaaaagaaaaagatgacaaaatccaaacaaaataatgacgttttttattgtcggaacaaatcaaataaatttaaattaaaatgtttttgacgttcggcgctaaacaaataaatcctcctttatcatgtgcagctcaagcagtttccaagctgttgccgggttgaactcctccatgtctcggcatattacctaaacaatcactgcttcgtctccctcttccgttcgccccacccattaattactcacccaaatgtgtctcactcgaaccgctttttcagggtcaccttggacaattttcccctcgctgttcttcaccacatttgtcatgaatacttggaattggatgaccaaagtcggcccttggtcggtcatattccccgtgaccaactaaaactcgacgaaaaggttgaagaagacatccctaaaaagtacctccactttgctaacatcgataatgcgagaatccctcgtgttgaagccaatcttttcgtattctttgatagaatttgcgattaaattgaacgccttttgaagcatgaataaattacaaattgattatgattcaacgaatcactcactttctcgtaacaccaatcacgaaggatttcgaagttcatttggtaagttgattcaagaatgttcgggatcatttctttttcgcaaaaacggagccattccgacttgtcgaattcggggtcgattttggatatttgcgttagcacttccgacacattgtctttggattctgaagtttttaatcattcagcaaataaatataaataccgcatgaaaaatgggaaaattcagttgaagaccgactgaccaaatgcgagttggacacgttcgaaggtaccacgaacagttcggacgaaaatattctcgctttcgtcaatgcgtgttttccagtcaataatttctaaatgaatgggatttgacatgcccacaacaattggtgtactgttgtaataggagttggactctgtgaatgtcttccatcccgcgtaccaacgcgactctttgtgaagttcaattcccgttgcatccctgaaactcacaaacaataagtacatgggttgcacgggaccgtgactgagccgggaattcccggtccttccaggttccgatcctgttttatatatctttccatacttttttcattcatttttataaaaataaactataatcgactaaagctactttttttggtttaaaaatgtttagaattcagtcaaaaatccataaaacgctttttaatgttcaatatctgttaccaaatcatgcaaaattttcgaatttccccggcgcatcctttatttcaaatttgaccaaaaaaattaccattgtgaaatatgttaaattcaaaattatctccggaggtgcctttcggcaattgtcgccctccatccatcagattttttggaaacaaaaacaaagtgcgcaagcgcaagaagaaagcctttttgaatttttttagcagatttcactgaagttacaaattttaaaaacattaaagttaacagtaaactaaatttctcactttttatgcaccgagaaaatcttagggaatttgaaaaaattcaatcccgaaacgtccaaattacgatgttccaattgttttcttatttttttaaattaaagactaatgattttattaatttgaaaaataattaataaatactttttttgatggccctggtttattgtcccggtttttcctaaaattcgatcccttgcatctctactcaatagatttttttggaataattgtcttcaaaaatttaaaacaaataattaaggaaaaattgaatttaaatacgaatttagaaatgctacattttccaattctcacgtgtttgcttcgacacttctgctggcgaatgttgaataaaaagggctcgtccgaagtttgagttcatctaaagtgaacaattaatgttccctataaaaaccaaaaataaaaaataatttttttttattcttggaaaaggctcaaaaaaattaatcagtgtaaattaataattttatttattttcaattgtgttttattttttctcccattaaattcagttcggcacttcctaaaaatttttgttatttcaaattaaaaaaaaaggatccaaattgaacaccacgacgggctactttcaagtgtaccgttgacatttaaatattaacaaacctggccttttatacattcgaacatcggccaatcggtcgatttccttggccatataagacacttgcttatacgcctgcatttcgccaacttgttgagcaactctttcggcagtttctgttgccacctttagctgctgaatcgcatctttgcccaatttggagtcttttacatttgatacaatctgaaaaagtaatttttaaataaaaaaagtggtaattgtgagacaatgcaaaaaacaaaacatcataataactgacccgcgtcatgtgatctgtgaattcttcaa

SEQ ID NO: 447 - DNA, 3020 bp, Heterodera glycines
  genomic virtual cDNA Sequence=SeqID_732; coordinates=1..153,391..577 ,620..750,793..1071,1569..1782,1826..1923,1977..2150,2198..2677
  coding sequence=SeqID_887; coordinates=1..153,391..577,620..750 ,793..1071,1569..1782,1826..1923,1977..2150,2198..2545
  peptide sequence=SeqID_1117
tttttgcgcgtttctgtgtcatcaaaagaaggacaaaagcaatgggaaaagccatctaaatcggcgatgaaaaaggcaatttcgcgtttggaagaagaacgacgtaaacgggaaaaagcaacaaattccgcggcagcgaaattaacggaagaggtgcagaaagaatactcaacaaaatatttttgttttatttaaaaaatattaaaacctagtatctatacgtgattttaatatgtaaaacactccaaagtttttttttgtccggcgcgccgctgagaaatgagaaaaacttatctaaaccagttcattttaagttttaggattaggtgcctcgaaatcagtccaattcttcgaattaagtaaactttgaataaataattgtttgttaaggcaaagtcagtcgcagaacagcaacaagaaatggcacgagaaaaacgtttggaagaagcaaagaaaatgcaagttaaattggacgaatccttgcccgaagcgaagcgaaccaaaattcgcgaatgtccggcactgtgtggccagcgggtgaaagtgttcgcattcgtccatcggatgagacagcaaagtgcgtagcctcacgctcaaaacggaaatggcccatttttagggaaaaacttgatgttcctcgtccttcgcgatggctccggcttcctccagtgcgttctcaacggcactctctgtcaaaccttcgaagcgttgacactgactactgaaagttctgtttgcgtgtttggccaagtcagtcggttgtctttcttttgagtatttatcccttcgaagatcaacaaattgcccattggaaaagttgcgcccggcggcatcgaattgacggccgatttttgggaacttatccacggatcaccgcccggaggggttgacaatgtgctgaacgtggaggccaacgtggacgtgaagttggacaaccgccatttggtggtgcgtggagagaattgctcagccattctacgaattcgcgccgctgtgacacgcgcaatgcgtgaacatttccatgaagctaaatacatggaagtgtgtccaccaactttggtgcagacacaggtcgaattttcaaaattgtgtctacaattgctcagaattagaggtcggcacggacgggaacccgcgtattaggttttacgggcttatccctcacggaattccgtcttgcgttttcaataaaaagaccggtactaaggcgtccattggaaagcaggtccttagtttgcatatttaagcaagggcgtggctaccccccccccccccccccccccctctgaaaccgaaaattcttttttttaaagtatacaaaactttgttaaaatcctctatcccaacagtggctgacggcattgcggattttataaacagcgtcacggaatttttcattgaaattagcagagggttaattttgaaaaacttgataaaaggtatactttatggacacatcttgcttcctttttcttcacgttttctttaaccagaaaaacatttaaaacataagaaactcgaaaactaaaattaaagtttttggcatcattctaaacggatgttttaaggtcgaaggtggctctacccttttctccctgaatttcttcggcgagtccgctttcctcactcagtcttctcagctttacctcgaaacgtgcattgcctcgttgggcgattgttattgcatttcgcagtcttaccgcgctgaaaagtcgcgcacgcggcgccatttggccgaatattcgcacgtggaggctgagtttccatttatcaccttcgaaggtcattttcaaagtgtagagaaccagcgaagctgtgtgttcagatttgatggtgcgcattgaggaaatgacatgtgacacagtcaacagagtgatggccgacccggaaatacgcgaacttatccagcagcagtggcaaaaggttagtgaccacagccaagggcagagatagataaagcgatccctttgggacaggattcccaatatgagttcgtcgctcccaaacggccttttcttcggatgacttatgcggaggcaattgaatggcttcaaaagaatgaagtgatgaacgaagaggggaaacccttccaattcggcgaggatattcccgaaggccctgagcgatttatgaccgacacaattggacaggtctttgaatccctcgtttttctttcacaatcgcccgttcccttcagccaattcttctcaatcgctttccgcatggaattaaggctttttatatgtcacgttgtgcagatcaaccggaattgaccgaatctgtggatttgctaatgccgggcgttggcgagatagtcggaggatcgatgaggatttggaaggaggacgaactgcttggggccttccaaaaagccgacatcgatcccaagccatactactggtacgtggaccagcggaaatacggaggttgcccccacggaggttttggacttggtctggagcggttcgtatgctggttggccaatcagcatcatatccgtgatgtgtgtctcttccctcggtacatcgggcggtgtgcgccgtagcttttttccgtctttgaaaaggaccaaaaacgaacccatacgaatatgggtattgttcatttttggcgttaaaacaaatgtatcttctaaattgtgcattttttttgttgttattgcataaagggataaaacacatgaatgttcacaataaatatgttatggtacaaatatgaaaagaatttgggacttagaaatttcataagttttctgaaggcgttaaaacaattgaaatatgcaaggaaagagcaatgcctaagtacactattaacatggcgaggaaaatcagttgctttactgtcatttgacttgtacccaacccttataaaaaggattgaatcagaagaatttcccataaggggatgaattcgcgtttggtgggggatgtcgttgaaaaattggagccttctgagcttgggccaatggaggcataatactgccaccgatcgcttgcacaacggttggagcacagcggaag

SEQ ID NO: 448 - DNA, 4392 bp, Heterodera glycines
  genomic virtual cDNA Sequence=SeqID_733; coordinates=2646..2596 ,2526..2427,2374..2215,2167..2041,1989..1754,1707..1584,1512..1343 ,1283..1120,1057..921,691..445,385..214,92..1
  coding sequence=SeqID_866; coordinates=2646..2596,2526..2427 ,2374..2215,2167..2041,1989..1754,1707..1584,1512..1343,1283..1120 ,1057..921,691..445,385..214,92..8
  peptide sequence=SeqID_1242
cgactgatcagtccgtatttggtcggctggaggagacttctaccacgtcggattccaattggtcgagctgctcaagcatcgaactcagatcccttaattggcataaaaagtgcgttggttaattagctaattgcccgttcttcttccgtttattggttttttccgctctcttctaaattggcactgtttcggctttctctccgtccgcctcacttttcttctttgcccggttcggtgcgcagttcgatgtaatatttcactttcggctccgttccgctcgcccgcagtgtcaccgcacttccgtcgaccaaagtgaacgtcaccatttcggaggaggtgctcagcggcagaatggccctgtcatccggttgagcgttgtcataacctgcaaaaatgccgttccgtggttttgttttggcaattccttctcctcaaatggcccacccgtcgtcaagtcgcgcacaaatttcacatcgaaattctgcccaatcgtttcgggataatcggagcgaaggtccgcaaataatttcttcgtcacttccgtcgatttgaccccccaatacgaattgcgttggaggtgaaagccgtagatggagaagaggcggaagagctgttcacgcagcgaaacgcccttttgggtgcgcagccaattggccatttcagcaaagaccgcggcggaagaaacgccgtcctatgggaagaaagcggacgaatggtcagcagtcaaaaacagacaattggccgctaacagacaaaataggattaaaactcaaattctttggcctttatggttcactgcctttcccagcgggtcattttcccttgaaattttaagttcaaaattccgaaatttttagtaaaaaatgcctggaaatctttagaatttttttggttgactaaattctgccgcccgtgcccactttgtccagcgttgtgccgggagtaaacccaatggactcctcccaggcggcaataacggtgttgccttccgaccgcaatttgtgtgccaaattgcctatgtatttgaagcccgtcaacgaatgcgccgctttgaagcctttaattggaacgaaaatagccaattcatttgtttaattaataattaattgagggacagaccctcctttttggccattgtggcgaccatttgggaagagacggccgaatggaggacgaacacccgcgaagagtccgccgttgggttggcggcacgccaattggtccacgcccaccacgtcagcagaatgcccatctcattgccactgaacacgcgccactctccgctgaaagcaaaatcgaaatcagtcaaatgccaattcaaatttggtcccgttttacggactttgcctctttctccgccaattggagtcggtcggcgtccgggtcattgacgaggagcaaagtcgagtcattggcatttgcagtctcaatgcacagtttgaggacccggtgcccttcctcggggttggggaatggaacagtgccaaagtcggcgtcgggctcgtcttgttcctgaaaatttgaatggaaatgagtcaacaggacacactgcgcaactgttataaaaaatacacacaaaataccttaacgtacgaaatgttctccgagggaaagccaaactcagcgaacattcggcggacgaatttggagccgacgccatggaaagcggaataagtgagacggagggacgaagtttggttgagcgaccgaaaatggaaagggaagggagaaccaaaagtgtgccgcatggaacttgtgatggcagcaaatggcactctccccggcaaaatatttctccaaaaccgagtcggccgagtggagaaaggcacttgtgccgagttggaccgtgtcccaataggcttcttcgggctttgactcctccgcgacaattcgacaaatttccgtgtcgtgtgggctcagaatttgagcaccgttggcccaataagccttgaagccgttgtcctccttcggattgtgagaagcggtgatcggaaaatggaaaatattaacaggggaaatacaaatggcaaacaaaccaaccatgatgcccgcagcacaacccaaagaaacgacggcaaacgaaacgacaggggtggggacgacggcggaaaagagaaaggcggacagtccgttcagcacgaaaacattggcagccaattcggcaaaactaagcgtggaatggaaatgccaacgcatactttacaggccttttaccgtttgctctgatgtcggccatcgaagccaatcacaacgcctttctttttgccatcttcgcccatttcacttgtcaaatgccgtgccattccatgggacagttggatgatggtcaattcgttcagtctggcaaagcccgcctccatgtgcgttcgaactcctacagaaaaactcgggatcataactcacaaccgagaaacccatcaaggcacctgccgtcccaaaagacaatttcccaaccatccgaagtcgcaattcgtgcacattattctcttttacgagtcgttcaatttctgttcgagtcgtttcattctgaaaattttacacaaattaaatacccacaatttgtgatgatttgattaattaattagatgacaataccttgtcccagcataaccatttgtttattaattcttgaaggtaggggtccattacagattggtaacaatttgtttgctaatgaaattatttagttggatttaaaaaattgtagtaatggatagtttgaaatatcatttttaattagcgttgtcttacaaaaactttaattattcatcaactttaattaaaacatttctccgtttttacaataatgattaggtatttagttgagtatcgatactgattgattatcaacataaaaccattgttaggtataagtacacacaacgaatgacgtcacatactgactgtgagagactgacaaagtgactttctgaaggaaacgagtgtttggaggccaaaacagacaaaattgatcatacatataatatgaaaagtgaaatagcagtgggagaggaatttctgctgaatacaaaaaataaatggacatcgaatggaggacttaaatttaaaacattaaaaccgaaacccaacgtcctccatttattaaagcttttgtttgaacaagcaaaagtgaatggaatttgaatgccttcgttcggttggtggtcgacattcctcttaaacttgcgtctgcagcgtcccatcctcaaaaacgatattgctgccgccggaagtggcgaatagtcgttcgacacgcttccttttccttcaaatatttgtataatattgtaatattatgttacatcgaaaatgctgataaaactcactccatttcggtgctgggcccaatgtgtgttgttttggaatagtacgaacgacgttcgctggtgccccgttgtgaaagcggaccgccaatttgttgttggtactgaagggtaaccgcgtccaccgccgcttcctccgccttatgttgctgctcttcgtgctccgatattcgcgacctttgctggtgttgtcgcatcggagtttgtttcatggctaaattaaatggaaaatttattgaagtttaattatttaagctgaaaacattaaacaaacaacaattaatttaaataaaagaatcgcgagggtttgagttttaaacgaacgtgtcaaaaatcaataagcacaaaacacaagcactgtaagcacacatttaaatgcaaagcccaaattgaaaacgactcaaaaattgctatattttaaaatttggaccgtttaattttctaaaaatggacgcggtatgaaacagtgcatgcctttgtacctaccgatgtaggaatggacaaaggagcgaaactttgaggatggatgcctaactgacggaatgttgtccactgaaatgcaattagaaagcaggtcattgaacaaagaatttgggaaaggcttttaagagtgcactgacccacgcaaaatgctctgagtttgttgttgaccaaaacttattcccggtctctcacacatagtttttgtaattcttttccttaataaattcctctctcttaaaatttgaaatggcttaaagccttaaacccggggacacaacaaagagcatgggacggggctaagtttgatgaaagggaaatggcagttctttgtcagttggacgccaaactgtccgatttgttaaaaatcacagacttgtcgattgtgaaattcgccggaacacaatggttgagacaaaagtttggaaacgcaacgcatagaagcccgggtttgtaacggaaatactttcctaaaattttggaaagataatctctggatttataataatattaaaaaacaaaccccgtcgtgcagtacgctcttccatgtagtgcaatctttttaaaaagcccggtagctctgcagaat

SEQ ID NO: 449 - DNA, 5468 bp, Heterodera glycines
  genomic virtual cDNA Sequence=SeqID_734; coordinates=3144..3037 ,2991..2792,2250..2073,2027..1878,1835..1744,1692..1456,1407..1261 ,1219..1185,1042..943,894..694,645..519,472..357
  coding sequence=SeqID_932; coordinates=3144..3037,2991..2792 ,2250..2073,2027..1878,1835..1744,1692..1456,1407..1261,1219..1185 ,1042..943,894..694,645..519,472..357
  peptide sequence=SeqID_1251
agttggacacattctcattgtcaaagagagccattaaagccccccggggggggggcaccactgatttggacggaggtgggaaaatgaatgagcaaaagggaccctttgcgttttaaagaagtcgacgaacagaagacaaagcaaccatttttctgggaggggggctctgtgacataaattacggtagtaatgccaaacaataagcgaaaggaaattccaaatttgcaaatgtgtcacgcactgatcactaattggagcagcgccgtaattaagaacggaattgggtcctaagcccagacacatttggtgacgctttcattcacaattaattttggactcggatttaaactggctaccggattattgacgagcaaagctcgaagttcgtcttgaaccgtttggttgacgagttgctcaggcgtcggcgaaccccaaccaaaccaacgtgaccatcccgaaggaccgcgagattctgtacgagcagagaatggcaatgccaaacggatttcccgacacaccttccaatgtctttttaagttcacgaattcggtcagaggccgcgttggcaaggaaagcgcacgattggtcccacgcccttcggtcgggcaccacttggtcagcgacggcattcaattggataacacgctgaacacccaccagaattatttgtaaagacaaacgatgaccaatcaccaaataatccaacgcttttgaatcccatctgtgctgctccaacacggcactgaccaccgcagccttcagtgctttcaacaaatttccaccatccggcgatttttggctgccgtgcgtccgattggacttcagcgtctgtccgcccctttcctcgccgctcacttgacgccgaaagatttgtgaaagtgtttcccatccgacctttaaattttggtactgattaggtaattgagattataattgtcggacctgcactgatcggttggccaattccttttccgcccaatgtttcagtttaatgtccaccacagtgttgaaagaacttgtactttcaaccttaaaatagggtcatttaacgtaaacaccaccataattcgtccatttttaccgttgacgcgggcatcagaatttggtcgaacacttggggacagatggcattccacaaatgcgcacgaagaagcacttcccattcgtcggcagagacaagcgacaaattgaccacttcgtcgagcacttcgccacgggcctaaaaatgaaaaaaccgtgggggagggaaaccgacggaactttgtcgaagagttcgtccctggtcaagtcgcgttggtgcgcaaaagtgtttttccattccgtctccaaattgaagcgattggcgcggaaagcgtccgcctgcgcttcgatggattcgcgaaccatccgccaaaaacagtccgaaacctaaacaaatggacgggaaacgtttcattagcttaaaaaagtttttaccgccaatgacatattccgcgtcgtcatttgggtggccttcaaaacgccatccctaaagagtttggaactctcgaagaagtcctcctcgtatttgcggatctccgcaatgctcgcgtcccgcttgtccatgccggtgacaacgccgaaatagccgagcgctttcatcggaaatagtttcccgtcgaggatcttctttatccgatgcgggttgctcaagtttttctccgccaaatcaacctacagaattgcaaaatgactgcaaatgccgtcctgcggttgaaggacaacctttgtcagcaccaaaatcgtgcgctgaccgtccgggtcgacgttggtcaccaaatcggtcacattgcttcgttctgcgtccactgaaccatctgaaagaaacggaaaagaatgagacaaatttgctgcgatgccttggatgcaaagaattatggcgtttggattctccatgtgctgcttgcacatcttcgcgatgtcctccttcgtctccctggccatgtctgtggtaacagtcgaaatcactccgggcaaatcgacaagaaccattcggggcaaagacggacctaaaatagaaacaatgacggaaattggcgttggaatgaagtcaccttttacagtcaaagaaatgacttcgttggacaccgtttttccatcccgcaccgaattgcgcattcttagttcaatttcattgcgcaactgctccaattcggacgcatttgtcaggtcaaattcgcgattgctgtcccgaaattgggccatgtgataagggccttcgctgagagtcaccggaaatgttaacaattatgtcaagggtctgaagtgatccgattgtggcactgacatttgtgccccaacagaaccaacatttctataactttaaagcttcagtgatagagttttaccatacgataactttccgtatcactttttgcggcgttaatttatgcgttagtttttaaaattaagtaaaattttaatggcccggcggtggcaatttgataatggtgttcgataaagaactttcccgaggcttgagacattgaccattcgctgttggttttcataaaagaaggatataactatgaaaaacgcaacatcatcaccaaaatttcgaaaaaaggcttaaaaattctaaaaaggcttaaaaattctaagatttttccctaaaacaaagtttgaaaaatctcttgagccgagatctcgaacatcactaaaattgagtccccgtaaagttggaattttactgaaatttgtatataaaaaaaactcagtctcaggaatttgccccccccccaaatggatatccaatctttcccaagtgaccgactttgaccggtgctcgtgtcatcatttctccgctgccccgtgggaatatcctcgcttgggcaatcatttcgagcactgacgttttgccggccgattggtcaccgacaacgacgacacgcggcaattgtccgcagttccgtaggaggagtcgaattcgatgagaatgtcgagcatttcggagtacaattcgatcaacgaacgctgaacaaaatggcagatattaaaaatgatttcgttggttttcactttgattttcttctgtcgcttcaattcgcccgcgtcttttagcaaaaggcgttgtttgaggtttttgttttctttctccagcagttccaattcccgttgatattgcagcttaaatattttaatgttaaattacaaataatttaacgtcataaagtgtggcagttggttaccccaacttttgacactaagggaatagcgaaaggaaaaaacaaaatgtcaaataatgcaaaaagaaaaactcgcaaaatccccggtgaacaaaaccaacaaattcgatttagccattgtaagaaattcggcggaataaaactttaaaaatgcctgtgttctgagtaggtcttcctgcagtttttgaatccgttcgcctccgttgagctaaaaaggcttaaaagtaaaataaaactgtttaagctacctctgctaaattgtccttggctccgtctccgctgtccgttgcgcttttgccaggaaatttctcacttatataagaaaagagcgacggtttttgagcgtcatccgatttctgcgattctgagatgtttcggatgtccgccgtttctttgctttgcccacctttgcgcatttggtgaaggtcgatgttcatgacggggaaggaccctttgaattggtcaagccactgcaaatcaccaacagatggctgaaggcataagaagcttacatttacgggcgtggccaaagactctttgaatttgtcgatccattccaaattgggcatggattctttgactctgtcaagccacttcaaattgaaaattattaaaagctatatgaaaattttatttttacatttccggctgttattccaccgccaatggcaccaccaagaacccaatagcgaatttttaatatgtgtcgtaatagggaagccatcgagtgacgcctttttactgattgaccaaatgcgaaactgaaacacaaaccgataagcaaatttaaattaagagaagccaaagggacgaactaattataattagtagggctgcaaaaaatatgtacaaaaaccccaaatatgtaaataaaatttttttaatggtattttttgggaaagaaaatccccgtaaaatatgaaatagccacaaaatgacataaaaattacttttttttggtatttttaggcaacattttcaaacttattttttctttataaattttcaaaatatgtaaaaaaaatgaaaatatgtagaaaaatatttgccgaaatttatcgcgaagcagaccgccgaattctcacgatggttcaaaattatttaccacttaacaacgtagacactaacattttcccaattcatcagccttttaatcatcattttattattgcttttttgattggaatttctcgaaattatgaaatgagaccgtgatttgaaacagataaaatgttattttttcttggatttttaatttcaatgtcttttaaacttttggtatggaaatggtctaaataccttggtatggaaacggctggtatggaaacggcggtatggaaatggcggtatgtaaatggcagtatggaactgaccccaacccgaaaaaatccaaaatatgtacaaatatgtaagaaaatcccgaaatatgtataaaaaccctgaaatatgtaaataaaagtcccgatttttgttcgcaaacacaaaaaagaaagtgtttttcctgctatttagagcaaggagaagccaggaaaaaaatatgtaggtatttacataaaattggcagccctaataattagtaaacgcaatccaatgctttttaggacggacgattcgattcacaatttttaaggttttaatcaaagtgtgaattaggtatgtataaaaaaattcctaacatttcaaaaattcatcataatttttttgaaaacaataaaagaattgggttttatttatcaagaattttacaatgattattttattattcgtttttttgtaaatcttttcagcaactgaaaaacgaaattttataccgaagcttctgtatacaaccttaaaatttaggtgttgtctgattctgtttattatgaattttgcttgttgctgtcatttttcaagagttgcacaacgttatttttcgagcagtcgtaaacaaacggaacaatatttggaacgacaggccaacgaccaatactcgaggcgggccagagaacactcataccgtgcaaggagtgcctttaaactcatgcaaatcaatgacaaaatgcacttcatcaggccgggtaccaataataattgtgagtcagcaaatgctcggctcaaacactcattgcaggactcgttgcgattgacgcgggtgcaggttcatttctgttactcttttctgttgaaactcgctctttgcccagcgcccggctcgtggtgccaagtgctcagcgagttattttcactgacaatttcgcaccaaaaaaaagaaccaaagcggat

SEQ ID NO: 450 - DNA, 1373 bp, Heterodera glycines
  misc_feature (28)..(28): n is a, c, g, or t
  misc_feature (65)..(65): n is a, c, g, or t
  misc_feature (90)..(90): n is a, c, g, or t
  genomic virtual cDNA Sequence=SeqID_735; coordinates=1373..1321 ,1236..1051,837..591
  coding sequence=SeqID_860; coordinates=1373..1321,1236..1051,837..670
  peptide sequence=SeqID_1240
cacagtcgcaaacaagctttgccccatncgatcttatcacaacaacaaccagactgtcgtcgtcncaacaacgagctccacaccaacaanccactggtggtgtgttgctacagatgtccatcatcatgttgctgctgaaggtcatcattattcacattcgcatcccatgggcattttgcgtcgatttgaccagctcgaacttggtgggcacagaatgtgatgaaacacgcccaataaattgtgcacatccgttttgtctattcattcgttttattgttttgtattgtatcctcaagcgcaaccagtcatttctcttctcttttttccttggcaattctctgatttggtccattaattgttttgttttaaatcccgcaattatgtattgtattcttaaaacgcctctcacttaaaccccatcaaaatggttccaaaaaaccaaaacattttgttgtttctcctttcaattcaattgctttctctcgtcacggttcattcactgctgcttaacgggatttattgaaataaatgcatttttctttttatatttctccttcgactcgaagtaaaatattcaaacacaacaaacaaaaaaagtttatctgtaaaataacaacaacaaaagcgtgccgtccgctgcacatcaactcatcgcaattgtttccgaaattagatcattttttcaagcaatttgttgatttggtcctcgcggtttccgtagtcgcctccctccacaaaatggttggacttcttcttgaacccgcccacggggttgctgagtttgaagggccacaaaaagttggtcacttgcttgaagtggggcccgactgtccaaatctgaaccgagacaaaacatttgaactaaaagacacgagacatgcatcaaacagtgtttcacaattgatacacaaccgcccgggctattaaagaaatttcaaatttggtatattggtgcgattcattccccgccccgctccccatgaaattttttataaaaaactttttcaaacaaaaaaaaacagtgaaaaaaacccatagttgtttgttcacctggtgaatcatgtcctccacacagatcacgtccgatttgcccatgtttcgctcaacaatggcattgtccgtgatcggaatgcgctgcccactctccttggcataaccacgcttgtacaccaactggcgaatgatcttctgactcgggtagccccacgcaatgtacgggtcagcaatgcgcaacatctgaagaagaagaagcaattgcataaattaattttacacgacccaattggagctaaaaattgataaattcatccaatttctaacctggattgtcgctttgttcaacttgacgaatacgccgttgttgatctgacgca

SEQ ID NO: 451 - DNA, 2451 bp, Heterodera glycines
  genomic virtual cDNA Sequence=SeqID_736; coordinates=1440..1283 ,1242..1140,1051..923,878..787,743..560,518..274
  coding sequence=SeqID_928; coordinates=1390..1283,1242..1140 ,1051..923,878..787,743..560,518..274
  peptide sequence=SeqID_1152
gatcatctgatcctttttctccccacactcaattgtgaagcacaacgtccgtctctctctctttgagttagaatagccatttgaggcacccatttcgccgagcaatcgcacgatttctagaaataacaataaaggaaacaagagaaaaataacaaaacctcgtaacaattactccgcttctatcatcagcaccattcaaaccggacagattggtatgctgatggttcgagagactcaaattgacgttgagctccctccccgtgtcgtcagttttcatggctcattgaatagacaacgaacgggcaattgttgagaagaatttatgcaaaaacaaggcctatccgaacaccgccgattcgaagaggctaaccgcagcaaagaaggaaccgaactactcacttcctgcatgaacttcttgcagacaacgcgcagctcccgaggcaaagttgcactgaacatcataacttgcttctcctgcggcgtcattttgaagatttcttgtacgtcgtgacgcatgtcttaaattgcaggataggaaagaaagttggaaaagtcgtaccagcatccccaatcattttgtcacactcatccagcacgaagaatttgactcctttaagcttcagatgtccagtgcgtcccagtgctaaaaggcgacccggcgtcccaacaacaatgtgcggagtgtttttggccaggacctcctcatctttcttaatcggcataccaccaaaaaacacagaaaccttaacccggggcatgaaggctgtaacataatttagtaaaaaccttcactcctggcatgtacttgctgaaccgctcatattctttcgaaatttgaaaggcgagttcacgagtgtgacacatgacgagaacagagactaaaatgtgctgcttaaaaggagcttaaattgaaatgtcctacccgtgccatcagtcggtgtcagttgttgcaaagtggcaagcacaaacactgcagttttacccattcccgatttcgcctgacagacaatgtccattccaagaatagcttgtggaatacactcatgctgcactggaattcgattaacaattattaatgctccttcgtgtgttccctctgggcccgttccagacaaaaagctttttcttatgtaatcaaccttcagaagggtgctcaaatccacaatcaattatcgcacgaagtaactccggacggagcatcaaatctcggaatccgctgctgtgaatgctcgcataattaccctaaaaggtttgatgaatttttgagtcagttactttttactttaattttctttgttgcatctccgtttgttgctgcatcattttttgattgttgttcctgagtctcttcttgttcttcctcataatccaaaagttgttcctcgtccattatgcggaaatagtaagctcaaacaaagaaagcgaaattattgaccttaaaacatcatgtgcattgttaattaaaaaataaaaagtttttgcattgaaacagctttaaattgtaatgcatatttacaaaattcataaaagtatatttgatactaatacaggctaaattgttcagaaatcgataacataaatatatgattaaaaatgaatactatgtagtccataaaaaatgaaaaagctcaattttgcactttattcagccttcttgtaataaagaatactttgggctatcgaatgataccatgagtgtctaatttggcaaaaaatttccaagtgattggttatgagcaccggtcaattattttcatgcaaaacaagctcgtcgtcatctcaaatttgaagggcaaaatcgttaaaatcgggctttttcttttttttatggaaccaataatctacaatcattgccaaattttcaccaccatttcccaactgctggatcgatcagcttttttacataaatgtatttgcatgtaaaaaatctcaaatgaaaatcgaattttgttatttggcatttgtattgcatatactcctacaatttctttagtgcgtatgggtacatctttttattcggtgcgccaatccttcgtttggtcgatgggttaaactcctcactcgttccaaaaaagtgaacaaaaaatatgaagatgataatgataaagaagaggagaaagacgaatgcgatcagatcaggggaccagctggaagagggcggacgaagcaattggagacctgggggaggggggggggttgggtggaaggttggctctagtgaactttaggcgtccaatgaacttttaggcgtccattgtccagtttctttggccataacttttttattatttcgtttgataccaagaatgtagggattgaccaagtaataaaaaagttatggtcaaagaaactaaactttacgcctaaaagtttatttcatgcctttgttctgctttaccggttcgttcaacaacagccgtaaggagtgaatcgcgcacccattccaaatag

SEQ ID NO: 452 - DNA, 2889 bp, Heterodera glycines
  misc_feature (10)..(11): n is a, c, g, or t
  misc_feature (62)..(62): n is a, c, g, or t
  misc_feature (1707)..(1707): n is a, c, g, or t
  misc_feature (1749)..(1750): n is a, c, g, or t
  genomic virtual cDNA Sequence=SeqID_737; coordinates=644..855 ,1035..1275
  coding sequence=SeqID_888; coordinates=644..855,1035..1161
  peptide sequence=SeqID_1118
gtcgtcatcnnccattaaatcaatgcccacaacgtggccattattcttaataaattaagttntctgccttcgaaatacgtcggatggcggcggattacattcagcaaaatcccgaggatttccttccctttttggctaacgaaaacggagaaatgttcaaagatgaacagtttgacgactactgctccaaagtggcgcgaatgtgcgcaagcggcggaacttggggcggggagccagaagtgagcttttcttctgccaattgactttgaattcctaccattttcagcttcgtgcattgagttgcgttttgcgctgtcctattgaagtgcttcacgcggacggagcaacaatcaaatttggcgaagtgttttctggccatcctctcattgtgacctaccacaaatttgcctacactctcggggaacattataatagcactaaaccgaccggagaatgatttgaattttgtaattgttacttttttgtttgattttttgtttggttttggcgcatacatttccatgaacgtcacaatattctcgctgattttgcttatgttttattcattttctattttaatatgtttaaaaattgtatggatttgtctttaaattggtcttttatttaagatttaatttccaaaatggttgaagtgttcgactctctcagcaaactttacgcggattatcaacgcacaacggcaaagaagttgaagatcatcgatgcttacatggtctacattttcttaaccggtgtcttccaatttgtctattgtttgctcgtcggcactttcccttttaacgcgttccttgccggattcatctccaccgtggcctgttttgtgcttgccggttggttaacgtgaaaatatggtgactgatttaagaacttttatgctgctcattttcctcctttttcaaaattgtagtttagaatttctttggattttttcatgatttcccttttaaattagactattttccaaacctaaaataaaaactggaaatttatgtttgtcattcatttttagctaatttgcgcatccaagtgaacccggaaaacaaggtcgaattccccaacatttctcccgagagggcctttgccgatttcatcttcgcccatgtaattctccatttggtggtcgtcaactttatcggataaaccaatgtgaaaggatgggaatataaaagtcattctaaatttaactgaccgtttattcgtttttctgttaatttattttcgtttaataatgttttgcataaatgggtttcgttggctcttttcttctctgtttttctgttttctttcagtttattttttacccatttctctgcataattctatttttattttatttttttgccatgtgtttgtcacttatttattcattttttcgctcagtttggcgctttttctgcactttaatcaaccgaattttcgccaaccaaaaattggaagacattgtgagttggacaaactttcattttttgaccatactaattttaagttgactgaaaagaagccttccaaggcatctcgcaatcagaaaattgaacaaattctgcgcacttatccgaacgaactcgtccaatcgtttagttgggacaccggtgggtgcattagcaaagggacaggggtttgctcaggcaagtgtacgaggagttgtatcccatcctccaaatgagacaaaccaagaaaaattggatngaagactttcacagcgggtgccccgcaaccacaaatcttaanngcagcaatggaatgaaaggcaaataatattacaacagacaaaggcactccctttttagtgtctattgaacgtgttcatttgttcaggggatgaaactgaggcggcggaggccattttggaggaatcggtcgccgaggacgacaaacgttgggactatcgaagacattggcccattccttgccgcagatcaaaggctatcaaaagctttgtgtgaaggtggaggagcgacggctggagagttactgcgccaactgttcggaacacgagtgggagctgctgagactgtggaagttgctgaagccggaagaggcgctggagggccgaataacggaccaatggcaacagatcggcttccagggggacgacccggcggtaaaagcgcaattccctcactttaaatggtcttcaaaatccattatttatgaaaaccctcgtttttggttcaattttgggacattgccttcaaaatttgaaaattttaatccataaaattcctttttgaggacgatttatacatataattccgaaatgctttatttatttgtgttgttgagaaagacggacttccgtggcatgggtatgctcggccttgaccaattggtattcttcgcccagttcgatttggacaattgtcagcgcgtcctttcgttgtccaaccacccgatcattgggttggttgttcggctgttactcaagtaatgaaaataaattcaaattttaattaatagatttccatttgcaatttgtggcattaccatcacagcgttgtgcaaggtgaaagaagaagaaaaagcaaatattatgagttaaaacatatgtgataaataagcttttacttaggaattacttttcgacgatttgctcaaaaaccatttttacaatgccttggaccaaccgtccctaagtgaggaccatttccatcaagtctactgtaagtgaatggcgaaagccccctcaccctacttaattttggtttagaatatatagtttactcgggtgcactacaattcccccctcccccgcctgaaattaaaacaaatttcaagcataatttttttccttgaaaaatttcctttttattttatttttttgcggcgaaacaatgaaacggggggggggactgctcccaatttagtcac

SEQ ID NO: 453 - DNA, 3415 bp, Heterodera glycines
  genomic virtual cDNA Sequence=SeqID_738; coordinates=3011..2829 ,2676..2497,1735..1603,1327..1160
  coding sequence=SeqID_933; coordinates=2981..2829,2676..2497 ,1735..1603,1327..1227
  peptide sequence=SeqID_1156
cactatgggtcaactccactgtgcagagaaaagcctagtactatctcgtcgtttctctttttctttgtaatttctcttactttggcgtactatctcttcattttaattatgtaaaaaacaacatttacttcgtgacgtttaacttttttcctgcacgttaaatccacacaaaattttgcaaatcgatagagaaaaaaattctgcatcgattaatgcaaaaagtttttttgtttatgcgctagatcaaaatttgcatactcaaacaaaattaataatttcttttcctctccttttggcgtactattttcatgtctctaacacattaaaaatcatgaaattcgcaaattctaataattttggttataagggtacaaaatcactttgaacatttagaatcaatagaaaaaagaataaatttagcattttggttagaaagagctggctaggacttgagttataacatgataaaagtttgaaattccgacaacttttttctgagatgacaaattacttaacattcgcttagaaaaagattctccttttcaaaaacttttttttgataccaaatttgttcagtttagttgggaatgaagcgagttatggcagatcaaaataaaaaatacaaaaggcattttccagtgtcaattttgaaatagcgcgcaaaaatttacgccaaatgcgctatttggcgttatgagcaattttgtctgacactgggcttgacccatagtgagagaaaaatctcaaaagggtggaggaatgggtacaaccggcacggttaccgaaaaaaactccgaatgacaattttagtcgaacgggttcggatgggactcgaagttagcctaaatgttggttaatttgtttgaccggcgcttcgaaaaccgcagaactcttttcacgatctcacccaattcttccaaatggagaactgacaccgaaccagcagttcgcatggcccatcatttttcaggctaataaaaaaaatagtttaaattcgaaaattaattttaaatgtccaattaaaaaatgttaatttatgcacctccgggttatataaaagattatttgtttgtgtactctttttgcttgccgcctttgaactcacaaatattttttcctcgattattttaaaataaatttgcagaaaccacccgccgaataacaacatttctttatccatttgaccaacaaaaaaggggtaacaatgggtttttatctttgtgtgctcattcatcggcaatggccaccttctccgacacataaatgccgtccaggaatttccgaatgtccttgtttttgacggtcgtcgactgttggatgcgagcagctgaatttggggagaaaaagttattaaacaaatattttttatttatggggttgtatcggtcggtcgaaaaccattcgcttggaactctttggtagaacaaaaacgaacacagacttttaacattggaatgcaatgcctgcccaaattgtaatgcaagatttcatgatcaagagtccaatttgaaaatggcagttttcccgaaaagggattattccatggaaccgaccccggtaaataaaaccagtcaaattgggtcgacatttatcggcactcaccggcctgggacactttttggatgtcggtaccgtcaatgatcaactcgtccttctgtttggtcgacattacagcgctaacgccttgcggtagtccgacacggcgcacaaatttctcgcccaagaagtttcgaatctaaaaatgtcacttttccggttttgccaaaggtaacgaaatttttggattttcgtgatgcaggacgcggcccctgacctttctcaggatatttagtgtaccagtacttaacaatgaatgttttatccgaacccgacccttaaactaaactcgggtaatttttgttggtaacacttcagtttatccctcccgcacattctgaatggtcatttcttacattgcttcgattttgtgcaattaatgtgaaaacatgaaacaaattcgaaattgctcaaaatgtgtatcaattcgtaaccagtgactctgaaaatcctatcttttggtgatcgtcatattaatatttaaacaaaaaaaatcggaacttcgcatttcaacgaatttcgaatttttcgtctaaaaaaggcttatgtgatcttttattacaggaatgatgactttcagtttgttttcatgcatttaagtcgttttcgagacattaacccaaatttaaatttaacttcgattctttgttcgaaatcaggtccggttttaggaattggtcgaaatggatgtcatatttgtgatcagcggcccaagtaacccccgtgtgacaaagaatcgtaaaaaccgccttatttattctttttttatgggaccagtaaaagtaaccattacccgccccccccccctgcaccaaaaaagtcgctagtaactaatccaattcaaaatcccgggactttactggattgcatataatgcaaagaagacaaaacaaaacaaacctcgacgacggtgttgttctcctgaagcgtgatgttaatcggaaaatgcgcgtagactgagcgcattttgtaccgaaatccaacagtcacacctttgatcatgttttcaatgtgtgagcacactgtgcgaatggctgccaactctttgcggatgccaaaccatttccgcacacggagcagctaaaaacccacattttagcattttgaaagttggaaaaataaaagtttaaatttgagactattttaaacgaaagcgcaatcatttcaacaacaattagaaatgaaaagagcactataaatttcagattttgtttgtttgttactcagaataccttcgggttttctcgcataatttcaatgtttaagtggcgaaagtcgcgcttgagcgtaccgcgcggtcccttcacagtcacaacacggttgttgagcgcgaatgtgacattgtctgggaatttgacgatgtcgctggattcaatcagcttcatttttcgttatgtttaaacagaaaattgatctgtaattgaaacttacaaaatctcttttttttactcctagaaaaatatatagcaaacaatactattatcataggagacttttaacattggcagcaaagatataacttgggtcaacaatcttccagtacctcataccagtctaggaataacttttcttgatttttttaataaattttcactaaacactaatattataggtccaagaagaggaaattcaattcttgatctttgtctttttacaacccttgatttagtctcttcaattgaactaaaggatagtattgttttttcagaccattcagcattgtattttaatattgatattccttgccaaagacaaaaacccctaaaaattacggtcagaaatttcacccagtctaaaattaaagcattcaatacctatt

SEQ ID NO: 454 - DNA, 4255 bp, Heterodera glycines
  genomic virtual cDNA Sequence=SeqID_739; coordinates=4123..4020 ,3352..3279,3114..2966,2438..2292,2055..1992,1787..1635,1390..1262 ,790..600
  coding sequence=SeqID_972; coordinates=4110..4020,3352..3279 ,3114..2966,2438..2292,2055..1992,1787..1635,1390..1262,790..641
  peptide sequence=SeqID_1189
ttttttagaaaacgacctgaaattcaattgtatattccccttaatttgatcataaacattgaaatcccaattaatacaaatctttattgctttgtttcagtgaacaacaacacaaatgatggtggcgaggagaaaacgctcaaagaaaaattgttggctgcccgcagcagtggcggtggcaattctctgtcatcgtcgtcaaatggtgagagttttaatgacttcgggtacattaggttttgcccgcatcgtttcccccactgaaattttttttgtttttccagcgaatgttagtaaaaaaaattttagaaaaacttagtaacttatcataaattttaaaaaaatcgcgaaaaaattttgagaaatttcatggttaaagaaaaagaattttttcttctaaatttcaacaggtgccaaagcagtgggtcaacagatgaagcgttcttcgttaggcatttgtctcacaaagaaaacgggcgccgctttgaaaaacaatagtaatggcagggcgtgagaaaaaattccatttttaaatgtatattaatacttttaaattaataaaaaaaacaaatatcattttctattaaatacttagtttttttttgtgaaaacgaaacaaggaaacaaataaccaccacaatcaacaaaaatgaatgtccgccttgttaaatgttaacattagtgccaaaaagtcttcaattgacattgtccgggcacgccgcttggcaaattgtgcttcttccaacacccgttcaatgtgtgaggtcatgcaaaaatcagttggcacttcctggaaatacaagtattttgcatgatctcgatttaatggtccgatcaaatgtggatgaaaaccgcactaggtttctttggttggttagctgacattgaattgtgcgtttttcatttaataaccttttcaaccccggtaagtttatgaaaatttcgtgcatttatttttgctctagggttataaaatttcgagtaatttcaacaacaaaaaaaaatggtgatggtggcctaattgtaagaaaccgagggatttccagttgattaggcacaaaaaatgcattgaaaactgaagaccccagatcttccctttctggatgttggagaatgagtgtcaaaaatggaaatttactcggtcaacttttttgaaaaaaaaaaaaatttcagaaccagaaattaatgaccatgaaatttttaatatttttacaaagtgcctagcgccaacaacattttttttgttgttgttgccccttacctttcccctcgtgccgcaaacgactgcgtaatttttgcgcaacacatcgaccacctgcttctgcttgaacagcgccgacagtgttttgtttttgcgcataaacgcaatgcgcaacattccatcccattcctaattgggaacaaaaacaaataaatacaattaaaaattataaacgaaggtgggcggaggaggtcgtctccccccccccccccgaaaaaaatgtctatgctagaaatttttcataaaaaagccccggggccaggatctagggacaatccctgcgggatcccgatcccgtccaggctctaaaaattagagatttaaattagaaacaaaaattttaaaaaaaaatccattttttgttttcgtttgccttgtaattgatggccggcggcggattgcgcggctgaatgcgaatgacggccgagtccacctttggaggtggcacaaattcggaacgcttcacacgcatcagatgctcaacggtggccaataattgaacagaaacggacagccgacaatacacctgtttgggacaaaattttttgttttgataattaaaaaattgtgtgattttttaattatttgagcattcctgaaaattgagggtctactaattggtgcgctccgaaaggcgttgtttacaatcttttttttttttttttgagaaatttcatccatttttgagacaatttcatttcggattaattaatattttatttgtgtataccttactgcccggcttggccaacagtcgatcggcgaattccttctgcagcatcagcacggcgtacctgcaacatgatgaatgacgatggagcggggggggggggggtatgtgatttttttgtcaaaggtgaaacgaagtttttgcgaaaaagttgtgcaatgtaaatggacaatttttttcaacacgacggaggaggaggaggagggatgacttgatccgggtgccaatataatatacgtgccgtggaaatttttttaagaatttttgaattaaaaaaaattgttcaaattttaaacacacctgggcaatggccgttggagcaatagtcgaaaaataaacggtgatgaaatttggtagggcaaattggagacgcacacatcaaacggaggccactcggctgctttgatcacatcgccagcaatgatacgcaatttgtattggacgggtctttaaaaaagcaaaaatattaatcttaaatcatttttcttgatttctcaagataaacacttggcatcaacgacacctaaactcgaaaatcaaactcaaaaatccggagatttttcgaaactgaaatttcgcgcctttaattggcaccaatttagtctttcagtttaagtagccgcccaaaaaactcatcaaattcggggtgcaccccaaaatttcgccgggacataatttcgccaaagaaactttgttttttaattttcaaatttcaaaatttttttttgtataaaaattccaacgaaaaattttttgaaaattttttagcgattttttggaaaatttttcgaaaaacttactaattcatatgaattttgagaaaaatcgctgattttgcagcgaaattttgtcccgtcccccaaattcggagtcctttttaggccaaaaacctattgatttaccaagccaatggtcagtcagcatgaatgtgcaaaaaaaaaaataataatttatatttaaaaatctatgcatacgttccgaccacacgtttctgcagctctgccaccattttagggtccaattcgtaggcaatcagacggccggcacggtccaacaatttcatggacaaattgccggtgcctgggccaacctcgagcacagtgtcagtgcccttgacagcggactgtaaaatttttgattaataaaattgtcaataaaaaataatcggaaaatttacaatttgtgtcaatttaaatgatttttatgaaaatttatgtgaaaaaactcgcggaattgtgaaagaatacagcctcaaatttcatggttagtggtttataaaaaaccaaccttctcaacgatggcatggaccacgccgggattcttcagaatgtgttggcccttttccgtgttgaatttgatccctaaattttgtaaataattatatttatttattgtttatattgcatgacaaaatgtaatgctaaggttggtacttttgctttttgaggtcgcgctgatcacgaatacagcaaccatttttgccaatttcgaacccctgacccgaactcgaacaaaaataaaattagaaaatttgtattgatgatatcctcattggcatcttgtctatgagggtaaccttggtacaggaatcctatcaattctttgtccctgtacagctcaggtaatgatcggtagcgctgatctgagccctcgtgatcagcgacctcaaaaaccccttaaaacttattttcattaatttcaaaaacacatttataggcatttgaaaatgtatgttaaaagtatttcgtaaactgcataagtaccctaaggttagctgcagaaactataaaaaatttggtgccaatttcactaaccaacagattttgtaaaccataaaggacaaacttaaaatactagaggacggtattttgaagagaacagtgtttgtttaggtttcacgtttgcactaggtctggattttctgtgaaaagctgagcagggaaaatccagtcattcggaaactttttgagattacaggaaaatgcctagcacttcgtgtgcactcatttgtcagcagtgttcacccacctttctgcttgaatttgcctccatccttttggggtccagcagttgtagtagcaacagcatttttcttctttttcttcattttgttagccattttttaaaaaaagcttaaaaaaaacattatcatcgattatggaaacattaggcacgaccaaacgaaaaatataaacgacaaatattggcaaatgctatcaacaaaaaatgggtacttttcgttttgggtccacgtttgatttttt

SEQ ID NO: 455 - DNA, 3091 bp, Heterodera glycines
  genomic virtual cDNA Sequence=SeqID_741; coordinates=1739..1594 ,1545..1370,1233..894,805..591,544..390
  coding sequence=SeqID_965; coordinates=1739..1594,1545..1370 ,1233..894,805..591,544..390
  peptide sequence=SeqID_1183
ttgacgctggccatcaagttgtgtcttaaaacaggaacggacacgaccgacctgttgttgtagtagtaatcgatgagaagtcagctccatctcggcggtatcgccaggcggaggcccgttgagatggtgctgatgaattgttgttgccagcgctccgattaattccgttccttccgagtgcccatccgattggagagtcccaattggagcaccattctcaaaagaggccgtgtcttcacgtccaatcgaagaactggacgcattttcaggccgatctgtaacaagaaggggattcagacgattgaacagaggaagaggaatcaaagtgctaattgtaagggattccccgacaaaccctccccgtgactgtcactgctgtccacaaatccgctgggcccaggcgctcttttgtggctgtacttcttcagatgcatcttcagactatggcaatatttggtctgataagtgcagtcctggcagcggaactggtagacaggagtgtgcgacttcatgtgggaattcagcattgacttgttgacacaagctgaacgacagaagcggtgtttaattgtagtccgtccttttcttactgtaatcacaaatggagcacttaaaaggtttctgtccgttgtggttacggtagtggtactccaagtggtgcttgtattctgtcacaaagtcacaaagttcgcaagtcaactgcttttgcttgggtatatgcaggcgtgcgtgtgcccattgctcctctttactgcggctgatgttctgacatgtcttgcatttgtactgcttcggcttccccgatcttcgtggcgtgtcctgcttctcatcgctgccgttctgtgctgcgttttgttggtgaatggcatcacttccgataagcgactgaaatggcgcttttgcgtgtctctttttcggtttgctttgcgctgcttaccgcttctggcccaatctgtaactctgcgatgttcagtgtgcctgctgtcgatgtattcagcagggcggtgtgcctttccgtcagggccctcagctgttcaagcggaatgtggccgaagtcccccacctgcggcgacgaattgagcatttttttgttgggaccattgttcgcaataacatcagtgcatatcttaaggagggcgtcggtggagttggagaaggcaacagaattggtattggtgagcatagactgaatggactctaaggcgagtgtcccgttggaattgtctcccgccgacaacatgctaaatcagaaaacttcgttttttgccattctcattatcatccaattgccacctgtttaatatgcttatgccatccgggggcattccttgactggcaagtattttctgactcaaacatttatcgccacttaaatcgccgttagaaggtggcgaattctgcttgagtgtcgttggtgtcgggggcggcgattggatgttaatgcctgcagcaagcctttgctctcgcttgtgcgactgcaacatgtgcttctttagacgcccttccgtgcgagtctcaaacttgcaaattgggcattggtgcgtgctgaaaatcatttgttcagttttgtcattgctcgcccaacggggccacctgtgcgtgttgcggtgtgagttgtaatggaatttcgaagaacaactgaagccacaatcaggacagaccaacgcatttgtggggaagtcgccactgttctcatccggcgcttccaagcccggcgcgcggaagaatgttctgccggtattccgttggtggagctgcggcaaaggctcaattcttccgttgttgacgatggtttctccagttgcaatgtgctcggtggtgttttgctgcagaatattgtcgtcattgctcgatgtagcagcacacactgtgacatttacgctggcacttggagagagaacgacggatgactttgttccgttatttgtacagctcgttatgttttgtgttgttggagaagagcttattgtttctattttgatagaagaattcgggacagaagtttctgtgaactgttgatgttgttgggaattcggtgtgacattatcactgactgagagagacgcgggtgcaggggccgacatgttggagatcatgcttggacaggaaaaagttcgagttttttgttaataccaatggaacatacttgagcaccgtctccatgtctttgaaggttcttcaaccccttttttcgactttcaatgtttgccattcccgtgacaacttcctttttttgccttcaacattttcttccacaaaaatagctaaacaatgagtaaaagtaagtgataaataattaaaaatatagcaattaatcatgtattaggtttcttcacctcccccttcaggccattcatacacagttggccagagttcattatgcatttagcaagaaagacaactgtaatggaagacgagacgagaaagacagcaagtcataagactgacaaaaataactgataaagagcgaaaagtagagtaatataaaagagagagtcaaacgaacgaagagagcatagaaaatgcagacggaagaggaaagagtgaaaaaaggacatctttttcactcacctatttcttataggcaaaaaattccttttttaagttcttttcattgaattttactttctctcttcccgttctccctttcttttctttcttctcttatttccttttccatcgctctttcgcactctttcatttctcttactctctctctctttccattgcttttctcattctttcccttctcacttcccctctctttcttctgtcccttttgttgcctgttcgtttccaaccctttgattatctttcttcgattcttcgcaatgaaaaatacctggagaaagattagcagaagagcgacaaagagaaagagagaatgaatattgaagaaaaagaatggcagagaaagaaagtgaaagaaacataaagggagaaacgacggctgaagaaatagaggaaattagtggcaggcaactggtttttctttttgagcgaatgcaccacaagaaatggaaaaacactcattgcctctcccccgccgcatgtcctttcttttgctcatttttgttttggtagggaattt

SEQ ID NO: 456 - DNA, 1698 bp, Heterodera glycines
  genomic virtual cDNA Sequence=SeqID_743; coordinates=30..146,202..341, 546..726,780..947
  coding sequence=SeqID_836; coordinates=30..146,202..341,546..726 ,780..947
  peptide sequence=SeqID_1076
ggtttattaaacttaagtttttaagaaaaatgaaggttttcggccttatggtattgtcgaaggattcatcgacggcgaaagttcgtttgttgaaaggggcttttgagttgaacagcttcagttttttcacaaggaaaaatgtgcaggtatttaaattctacacgagtaaaagattgcattttcacttacacttaaattaaggaatttatgcaatttactgccaaattaattgcggagagatcggcgacaccaagccgaagttcagtgaaagagggcgaatatttcatccactgtatggtgcgacaagacaatttagtcggtgtttgtataacggacgaacagtgcgtgaattggtttttaattgaaaatttaccattaattatattcattcaactttataccaacctaaaaacaagataatgagatagaaaatggttacaatcggagtcgaattttgcaaactgaaatttgccctggggcgggaaaggtgtcccaatcggaggggttatatcatttatattaagcctcaatctgtacaactccaggtatcaatctcgggtcgctttcactctgctcaacaaagtgttgtctgactttgccgaacgaattctcgaattggaatggaaacggatgagcggcgagtccgactgttcttatagcgaattgcctggatttctcacccggtggcagaacccacgtgaggcggacgcactcacccgagttcaggtgaaaacatttaaatagaggcggggcaaataattaaatcgaacgtataacaggacgaagtggaggagacgaaggcggtgctgcacacgacgatgcaagcggtgctggagagaggcgagaagttggacgatctgatcaaagccagcgaaaatctgtcggatcagagcaaaatgttctacacgcaagcgaggaaaatgaacaaatgttgcagctacacctagccaagacagagcattccgtgattttatacctatattcaggcctgtatagtgaacacaattgttggttgaggttgggcgccatcataattttttaaaatttgtaaaaaaaacggtgggcatttttaaaggcatcgaagtgtttattttgaagtcctcatttctccccggatatgggcctgtcaaaattcgaaccaacacaaatgtttccatgagattcctttccattatgtctcttctatttgctatttatattttctacctttggtcacattcccgggatttcttcaaattgaataagggcaaaacgtgtgaccctttcatatttatagaaatctccttgtaatttagtgacacatttttcccaattatcaataaagtagaaatatctttttgacttaaaatattattttaaaatttttcaacgaattttaggaaaatttttgaggaaaaaaacttaattccgagggaaacgatttaggggtaactgatccgtggggggggggggcacttgctccccttttgttctgtgtaaaaaaatatttcgggaaaaacattgtaccatatttgtattaaacgttaaacccttgccacttccctcctctaaattaacaaagagtctcttattcatcaacaaattctagcatagaaaattcatttgtcaacaagaaatatcagattcgcagtgttatttctgcagagaatattttaaatgtgctcgtcgtttgcatatcggaaattggaattgtacgat

SEQ ID NO: 457 - DNA, 2531 bp, Heterodera glycines
  genomic virtual cDNA Sequence=SeqID_744; coordinates=1123..1289 ,1336..1563,1610..1837,1884..1977
  coding sequence=SeqID_872; coordinates=1151..1289,1336..1563 ,1610..1837,1884..1977
  peptide sequence=SeqID_1103
accatggcttcattggattgggccgcccattaatatttttaatttttggggaaaaatcatttgggaaaaataagaaagaaaggcaaaagaaatggtttggaggaaatttctccgccatcaaaaacatagttgggtttaacattctttcaggtattggtcatttagggttaatccataaattatgcaaaaacaataatgcaaaaaacccaaatatttattattcatggtaaataaagtgatccgcggatcaggtcgatttagaggaaaggaaaatagcgttggatttgatgagaactactgaggaaaagaaaaggaatacaatccacggatcgagatccatgggatacccaatccgatctttatgcatacggattttgatccacggatttttcgatcctcgaatcagtgattcgtggatcacgatccggggatccgatcctgatctttatgcatacgggtactgaagcatatattttttttgctccacaaatatgtatacagtatacttatcctcctcctgtaatgaagttgcgttttctttttttttgttttcatgataatcgcatgtacgacgtacatgtacacgtttactgtcatattcagtttctctcacaaacgaatgaatgttttagtaccaggcaacacttcccacttctcatccctcttccactgctgattgtgaattaccccttccttccatttaccaatgttttcctcccctcaccacttctctcctcctccttccactgccttccaccattcttcgattaccgctccacccccccccccccgccataattttgcttccttttctttccacatacagctagctctttacatctctgcatttctctgttcttttattttcgctctgtctctctcttttcacaatcatcatccacacatactacattcggcttgttccccgtgacatttaattatttccacttctgggtctttccatttcatcatttattctttccatttcatcatttattcttttctaatttgtacattccgtcatttggtcatatgacagctaattgaatttaactcaacgcatttatatttgtcccattttttatttaactcaatcatttatctattttgttccttctaattttttagcgaatactctttattcattataatgcaaatctttgtcaagaccctcaccggcaagacgatcaccctcgaagttgaggcgagcgacaccatcgagaatgtgaaggcgaagatccaggacaaggagggcatcccaccggaccaacagcgtctcatcttcgctggtaaaactccctttgctagacattctcgtaaacaattactgttcaggaaagcagctggaggatggccgaaccctcgcggactacaacatccagaaggagtctactctccatcttgtcctgcgtcttcgtggaggaatgcagatctttgtgaagactctcaccggcaagacgatcaccctcgaagttgaggcgagcgacaccatcgagaatgtgaaggcgaagatccaggacaaggagggcatcccaccggaccaacagcgtctcatcttcgctggtaaaactccctttgctagacattctcgtaaacaattactgttcaggaaagcagctggaggacggtcgaaccctcgcggactacaacatccagaaggagtctactctccatcttgtcctgcgtcttcgtggaggaatgcagatctttgtgaagactctcaccggcaagacgatcactctcgaagttgaggcgagcgacaccatcgagaatgtgaaggcgaagatccaggacaaggagggcatcccaccggaccaacagcgtctcatcttcgctggtaaaattccctttgctagacattctcgtaaacaattactgttcaggaaagcagctggaggacggtcgaaccctcgcggactacaacatccagaaggagtctactctccatcttgtcctgcgtcttcgtggaggaaagaactgtattgatgaatgacacgatggacatatattgttttgtgcttaagcactggacgctcctgtcaccattatgttccgttttataatcttcatcatgaatgtatttcagtgatcacggaacgataaatcttttccctcagtttcagacttggtaaattgttagaattatatgcattggggtgctatgtaactgaaattatttcttatattttgtatcgattagaagtggtccttggcagaaatcttaacgctcattttttgacaagatttcttaacccgactatttgttgctgaataccttcgtttagctcatcataatcacctcataatattatattgaatgcttatattgcaagaattggatccgccgacagaggcggtaatcgaaacggagggtcaagtggtcgctcattgggaaaatcattgccttggccagggaactttatatttgatagagaggtatgacaagattctgcccattttgtcatatcataaacaaatacaaacgaaatcacaatttagcgctttggtttggataagccacggcactaaaa

SEQ ID NO: 458 - DNA, 4042 bp, Heterodera glycines
  genomic virtual cDNA Sequence=SeqID_745; coordinates=954..1065 ,1111..1235,1286..1443,1821..1892,2083..2273,2434..2550,2619..2844 ,2896..2996,3061..3168,3229..3414
  coding sequence=SeqID_945; coordinates=954..1065,1111..1235 ,1286..1443,1821..1892,2083..2273,2434..2550,2619..2844,2896..2996 ,3061..3168,3229..3414
  peptide sequence=SeqID_1168
cacaccgtccgaaaaaatgagatatgtaccaataaatagagagtgcagagaaaaaaacatctcattttggcgtactatttatttatctctgttaatagagaaaaaccgaatttgcttcatcctgtttaattttttttttctacttgttaaattcgtttcaaattttgcataacgatagagaaaaatattacgaacaaaatctaagggtttttaagagcaaaaaaagggtcagctaaaaagtaattcaaaaaactaatctttaaacgcctatattttttcgaaaccatcaaattgcttaggatttgcttagaaaaagattcagctaatgaaaagctttcgaatgataccaaaattgtccaatttggttggcaaaaacctcttaaaacaattctcaaaaacggcattttttagttttttggacaaaaataaataaaaatattcatgttgcacaacggactcgaaccttcttcctttgtcccttcactatcttacaaaaaccactgagccacacgcaaaactttttcggtacagtagctcagttttggacgctgtgttcactaattgtctgtgattgaatccctaaccaaaaataaagcatctatctaaatccatttcaaagcacttaaatatattttttagcgtttatttgttagtatcagtggaaaatgggaagcaacggcaatccggaggaggatttaattaacttaacagacaaattaaagaaaaaactcgcaaagcatggagaagacgaagaagaagaagccaaactgaaacgaagaaaatcgaaaaaagggattttcgatagaacaattcaaaaaggtataaagcaattcttctaacttcaccaattgaaaatcataattttttgagtctgatttaatacatacataataacaataaattgtcaagctcattatctgcatcattcgtttttaagaaagcaaaagaaaaatgaagataaacgatcaggaaagtatttgcggtgaaattgtggctcaagaaagtggcgaaaacactgcaaatcaacagaatcagactcaacagaatacaaccttcgaggaattggtattttgctcaactttgtcaacttttttttgttaaaatttttagggggtcaatgatgaactttgcaatgcatgtgagagcctcggatggactaagccaatgcctattcagcaaaaagtgatccctttggctctaaaaggccgcgacataattggattagcagaaacagggtaattgtggcgtgtgtttgttcgttttctttgactcaaacaatattaagttcggggaagactggtgcgtttgctctgccaattcttcaagctttgatggattctccgcagcatctttttgcacttatattggctccaaccagagaactcgcttttcaaattagtgaacaatttgaagcccttggggccacaattggacttaatgtttgtaagttgattttgtccgtttctaaaatggggagggcggggaaagaaaaagagaaatgataggctgaagaaaattggtaatttatgactcgagcaccattttggcttcgctaatttttttttaattgaccattttattggtttcggaacttgaacttctttttttctaattattttaataaaagtttacggctcaatctatctttctgagattttttgatttttaaaaattttaatcgattttttctgttattttaaaaaagtttatggttcaatcttaatccaccatgctaacaggataaaaaggttctaatgtgatacacatttcaatacgtttctttgtaagtttgttatattcttcaaatctcttgctttgaggtacaattgttggcggcatcgatatgacatcacagacactttctttggcaaaacgtcctcacattatcgttggtaagtattttacttgataattctgtcggtggtgaaagcagttcccctcccccccctccctaaaaaaatttccggcgtggggggcgtagtacacccgtcagtggtggtcctcatcatttttttggtgtaggagtaacccatcgactgcattatctttttcttttaattttaattaatcgtctattttaagcaactcccggccgtctcgtcgatcatttggaaaataccaaagggttcgatctgcgcactgtcaaatttcttgtattggatgaagctgatcgaatcttaaacatggattttgaagtggaacttgacaaaattttgaaagtattgccaaaggctcgtaaaacttatcttttctcggcgacaatgacccaaaaggtgttggattttgtttgactgctattataagtcataaatcaaaatggaaaattgaatctattgaaacaaaggggtgaatttttagaatctaatttcggcaagatgtttttcctcttactcacttgtgtacctctataaaaattgtttttggcatttataggtgtccaaattagaaagagcgcatctcaaaaaaccagagagaattgaactttcgacgaagtaccaaacggtgagcactctcatccaaaatatgctgttcatcccgttcaagtacaaggtgggatttcaattaatactctaatggcaatgagattcaaattatgtgcttactttttccaactttaggaggcttatttggtttatttactcaacgaaaaggcgggcaatactgccattgtgttcgtcagtacgtgcgcaagtgcggtcaaattgtcgttgctgctgcgacatttgggctttggtgcgatttcccttcacggacagatgtcacagccgaagcgtttgggggctttgcataagtttaagaaaaaggacagaccaatcctcgtttgtacggacgtggcatcacgaggtgttttacttacaattagaagtgggcaattagtggaaaatttgcttgcagggcttgacataccaaatgttgacatggtcatcaattacgacgttcctcaaagctcgaaagactacgttcacagagtcggacgaactgcgagagcgggaaaggtaccgcaagaaataaatgagtggaaactgcccggacttcgtaaattattctgcatctcttaagtccggaattgcgctcactatagtaactcagtacgacgtggaggtgtaccaaaaggttgaaaattcgattgggaaacgacttgatgttttcgagataacccacgaagatgtgatgcaactggcaagaaacgagaaacattaatcaactaattttaaaagttgtttttaggtggaaagagtctccgaagctggcagaattgctgcaaatgtgagagtatttaaatttaaatattcatcgtatttgagtttgtttagcggtataaagaaatgtttgaaagaaaagggtataaaagaggaattggggacgaaggagacgaattggaaccagcgcgaaagcatcaaaaagcgacagtgaaaacggacagacgcagaagaaaagacaattgaaatggacaggctatttgtacttgttattgttgtttaagctaaacgcttccagaaaaataaaaataaaaccaacagcgtgtaaatgcacatcatattctgctactatccatcttcgtcaaaataatactttctttttcctccctgcatttcttcttcaaggtcgtctgccagttcgtcgtacaaatcatccttaactttttaaaattattttgttccgtattaaaaagattgaagcggcaaggatagaattgtcttcccgatgaggaaaaatagtaacatttccaaaagcagcatttagcgcaattaggcttacttcctcgtcctgtaattccgatgtgtcgcgtgtcgtgtcttcatcgccataatcagtgaattctctgctaaattcctgaaatagcattttttcaactaaaatttctttgatcttttgcctcgtcttggtgatcactttcattttcttcgaatataatttgtcgctccgtttcgttacttggactttgccttaacgaaaggataaattcatctgtttattgttattcattttacctcgctagggagagaaatattccggcgctggtcgatggcaaaggttcaca

SEQ ID NO: 459 - DNA, 4759 bp, Heterodera glycines
  misc_feature (4129)..(4129): n is a, c, g, or t
  misc_feature (4152)..(4152): n is a, c, g, or t
  misc_feature (4179)..(4179): n is a, c, g, or t
  misc_feature (4187)..(4187): n is a, c, g, or t
  misc_feature (4194)..(4194): n is a, c, g, or t
  misc_feature (4203)..(4204): n is a, c, g, or t
  misc_feature (4253)..(4253): n is a, c, g, or t
  misc_feature (4307)..(4307): n is a, c, g, or t
  genomic virtual cDNA Sequence=SeqID_746; coordinates=436..519 ,592..663,714..836,907..1039,1354..1700,2194..2305,2355..2407
  coding sequence=SeqID_951; coordinates=436..519,592..663,714..836 ,907..1039,1354..1700,2194..2305,2355..2407
  peptide sequence=SeqID_1173
tctgaaaaaacgaagtcaaaggaaggatggataattcttctaaaaatatatgtaaaataagtgaaaaaaattttcaaacgtaccacttatacagtagcgccaaaaaatttttttcaaaaaaggggggaatacaaacgccaaacagtatgttaaaataattttttcaaattttttgtttctaaaaataaaaacctaaaaaataggttctaaaaactcgaaaagtagcttaacaaccaccaaaaaatatttgttcgtgcgttccaaaccatatggagctaaggaaaaaaataggtaacaacttagaattaagccctattaacaacaaatgatctaaaaatttcaaattgccacagcctatcagcaccgtcgaactataaatttcataaaaattttcaaaattactcttttaagttaaattttcattatattaaagaaatggaagttgttgactcaatgtcagttcaaattccaaagtccagtggcgccaaaatcgaagtaataaatgacccgcaatgtattctttgaatgaatacaaacttttctttgcttgtggattaatccttaattcagaacaaatcatttgtcaagaaggcacgcgtagcggcgcacagtcacgtcaaagggttggggcttaacgtagaaaccggcgaagctctgcaaaaagtctgtcaaatagacagactaattacagtaattacacaatgcctttttaggcttgcggatttataggccaatgcgaagcgagagaagcagccggcattgtgatggagctggtcagacagaagaaaatggccggcagagcggttttactcgcaggccctccggggacaggaaaggtacgccagccataataccttttatacagttttttaaatgaataaatttttccaattattttttttctagacagcaattgcaatggcacttgcgcaggaacttggcgacaaagtgccgtttgtgccggtggttgggtcggaagtgttttccagcgaagtgaagaaaacggaggtgctaatggaacacttcagaagggccatcggtaagcaaaaacggcaaactaactgaacaaaggttgtccattactcaaattgtttaaaatctaaatttttaaatctcaaataacacaaattaataaactcattttttgataacttgaaaaaacaacggtcacttgaaataattaattctaaaacttgtccaggaaatttaggtttttttcgtgtttagcctggacctggatttcctagacaaaactccaggaagacccagattgccgaaaaatggtctggacctggaaccaggaaaaaccctggtttgaagacgattttgtttaccctcccccgtccctcttaggtgtacgcatcaaagaagtgaaggaagtgtttgagggcgaagtggtcgatttggcgccggtggaggccgaccatccgatcggaggctttgggaagacgatttcgcatgttaattgcgttctgaaaacgacaaaagggtcgcgcgaattacgtttggatccgaccatttacgactcactgctgaagcaaaaagtgacaccgggagacatcatttacatcgaggcgggctcggggactgtcaaaaggatgggccggtcggacattttcgccaacgaattcgacttagacgctgacgaatttgtgccaatgccgaagggagacgtgcacaaacagaaggaaattgtccaagtaaaacttaatcatttgttaattaaatattaattgggatttcttgaactgccgcaaacccaaaattgaacattggttatggaaaattattttatgagaaaagcaggaaaacaaaaaaagaaggcagggatggtcacaggatttcgcccggggtgggtgtcccgtcccgcccggacgaccacttttttttgttgcttttcgtactttttggtctcaccgccggaaaaatcttgtttatcaaaatgtcctttgctgtcgaaaattcttaaagccccccaccaaagtgaatcaaataaaatctatgcgaatccatttttctgaaattgaaacggcctaaacttaactaaaaacaagttaaaccatgggtgcaccccaaaatcacgccggccgaaatcacgccgctagaaatttttaaaaatttctagcggcgtgattttgtcctgttccctaaaccattgtgacagtgtaaattcaaaactgcccattcttacagtatgtgagtttgcacgacttcgacaacgcaaatgcgtcgcctcagggcaaaacgggcgattttatctcaatgctttcaaaatttatgaagccgaaaaaaacagaaatatcaggtgggcgaggaggggaggggaagcctatctgacaatgaatttaattcagagaaactccgaagcgaagtgaacaaagtcgtaaaccaactcattgaatcggtgggtcaattgcattattcccatttcaaatagagaccggacaatgggctccatcgttttgtcgatacaatatcagaaaaagacccccgagaaagactgacaatttttcttcgacttttcgatctaaaacacatgtgttattgtgtgtttcaagaaatcggggaattattttgactgggaataaaccagaattttttccaagaaagttcaaaatttttaaatctaacaaggggaaccacccgaactgtaagtcggaaatgcatatatgttatataccattggatagagcaggatcgacttctattgtgaatttttaatattacgttcccataggaagaaatcaaaaagttagtgcttcaaaaatcgaaattttggctgtattttcgattaaaattggtggctcagttgtttaaattcccatttttggagttcggtttcaaatccaacagaaaaataaataaattttaattaatgtataatataactaattaatacagaaaacattttttaggactaaaaaaatgtattatagtctttctttagtgaaaataagcaaaaatcagtcaattttaaaggttagggaattaattgaaagttaacaaagctggaaatgggaactttggccaaaatttcgatttttgaagcactataactttttgatttcttcctatgggaacgtaatattaaaaattcacaatagaagtcgatcctgctctatccaatggtatataacacatatgcattttccgacttacagttcgggtggttcccttgtaagaatacaaaaacgaatcattggcgatcgaatgtcgtctacatttttttttttgcactacgatttcttcacccatttcattttttgccagatttgtcgactggttcagctaccatttgtcaaactttgagtatcgttggtcatggagtgattggattgaatgtgtcgaggttcgtttttttttttgaaaaatctgttccattatttcgatttttaattttcttaaacctccctcccaaaaatgtttttttaaattttcacagttggattcattgcatccaaagcgcatttttgtacgtgaagtcattgaaaagtgtttgcgcttttcctaccacaaaaaattggtcgaatttttgccctccgaattggcaccgatcattccggacgagccgaacatcatttacattcttgacgaccgtcagtttttgcatattacccattttagaaaccttggtgtagtaccaatcaaccagtcatgccaatttccaatggaaatttgtttttccaatacaaaaaagggttccagtttttttttcggtctacttttggcacacgattgtcagttttggctcaaaaattagggttcgattaaacgactgctcgcgccctaagtaaaatttttgcccattttcagcccaacatccggcatttaccaaggccgaacaattccggggcctcatcatgaacaaggctgacgatcaggaaattttgagcgcccttcgaatgccaagcgatgaacctggcggtggtggtggtggtgaattttccaccgatttttccatcgatgcggtcgccatttttttctccgttttgttgaagctgtcttcgcggacaatgacacattcatttgcggcactgacaaggtatgtagggaaatggaggaattcaaaaaaaatccttggaacttttttcataagaaaaaattcaagaaaaattttttggcaattttncaattttatgatgaactgctaancataagttttttcaaaaaattttccanaaaatcgnctggttngaaagatannaaaaaaattttttggagaaaataaagtgcatgcacccccgcacgaattncactcatttgtattttatttttttacagatacataaacattgcactgatgacgntgacaatgaggaaatgcatcgacattctcagacattgtgagaaaattgaaaatttttatggtcggttaatccaatttccaggaatgaataatggatttgctaacagtctcattatttgatttttgagtgcagccggggggggggggggggggggggggggggggggggggggggttttttttttttataaaaaaaaaaaaaaaaaaaaatttttttttttatttattttttaataaaaaaaaaaaaaaaccctccttttttttttttgtttttttaaaaaaaaaaaaaaaaaaaaaaaagaggcggcggtggcgggtgtgttgaaaaaaaaaaaaaaaatatcttcccccccccccaaaaaaaaaaaaaaaaaaaaaaaaaaaaaaaagaagggggggggggggggtttttgttttttttttttgtttttttttgttttttttttttttttt

SEQ ID NO: 460 - DNA, 4865 bp, Heterodera glycines
  misc_feature (44)..(44): n is a, c, g, or t
  genomic virtual cDNA Sequence=SeqID_748; coordinates=4844..4810 ,4751..4628,4569..4435,3821..3633,3230..2951,2657..2554,2487..2067 ,2025..1788,1520..1381,1150..801
  coding sequence=SeqID_955; coordinates=4844..4810,4751..4628 ,4569..4435,3821..3633,3230..2951,2657..2554,2487..2067,2025..1788 ,1520..1381,1150..801
  peptide sequence=SeqID_1254
tctacattttcaagttttttgcgtgagtcttaatatgtatttantggggaaggtatgcaaaaaatgaaagcattttaatttaccttattaatatttttggcaataattgctttaatgaatttaaactttcgaataacaccatatgtacataaaatgcttggttggggatggtttacacttactttccgaaaaaggggcacacaaaacattgtttaaccggttccaattgaccatttgagaatacaggttaaaaaagtaagtctgtcatcggaactaattccattgacagtcccatgctgaaactgatgggcggaagagaagaaaagcacaggcgaaacggcgccaggggacaccagcagcagcagacaaagcaatgacaaagaaaggggcgggggaggagggcgacgactccaaccgaacgaacgatcggcgattgatcaaccgaatgatttgttcatgcgatcgaacctctacaaaactgagggggcgaggaatgccactcattattaaaaatatagaatttgaaagtgcgatttttggtatgcccctcagtttggcacgtaaatatcattttttatgaattgagccacccctccaattgagatgtcggaaatagaacttctgggggctttaattcaacaaatacgatataaaattctaactttgtgatatgattttaacaacgaatgaatgtaataaaaattgttcaaataattaaaaatttattcgccttcaatgaatttggacaaaagcggtgggggagagatcatagcaaaataaatcaacaacgtaagtccatgtcagcttcctcttggatgacgtcctctttgcaaaaaatatgaaatgcctaaaacaacaaaatgacatctattctttccctctttggcacaccttcccatccgaaagtaagcagtgccgaaggcgccacacgtcctcctcctcgtcccaatactcctcgaattgttcatggcaaacttggcattcctgtgaaatgagaatgcaatgttagcatcaaattggcaaatgcgcttctggcctaccttcgattcgacaatttccgaaggcgcgtcccgattggtccccgccgtatgttgatgcgaaactgcggcggtgcccttttcgtcttcgacggcagatttgtcagcaccaccttggcataatttaaatgattcttggcgttatttgccatttccccctttgctcacccattccctgcgttctgttgaccagttccgtctccgaaaaatcaaaccaatcctaaattccaataatattttgtcgtttatcgccattttcgagttgcattcccgacctccaccatataccatggctgtgagcttgtacccttcaccacttttggtcctttgttaagtttttggtcctcgatccgaattgttttttgcaggtgccaatccgcgtgccgttgatacgcctcattatataatttttggaacgcaattccacaatactgacacacaacgcgtggacgatgaatggcgtcgattacggaatcgtagcgactgaaatcggggatgaacattcaatcaatgccaaaagtaaccggaaaaatcagagtggagcaaaattattaattctaaacatgctaattaatattcctctttccttcgtctcataatcgtaagattggaataattaacattgtgttatttgttaaataggctgcttgtcattttatatgaataaaatatccttaaatatcgaaaactgaattgtgactggtccacaaatgtcgcacaaaacagataccccttggttaaaggactgaccacaccccaaacaccgacatgatcagtgatctcatgctgaactgctccaggccggacatcggcgttgccctgcgctcgatattgtctaggcgatggttggaaggaattggtgccgcattcgcctctatctccacttgttttttacgttggttccgctctgcttcgttgggcggttgtgtaagcagtccggtctccttcagacgctttaacaatcgtgaaacgtcgatgggcggcgattctgaaacaataattcctgttttgttagcctcctgtctctacctctcttcctcttgcggtcgccctctgtcccatcagtcttcgtcggttgcaccatcgtcggctgttgttgtcgcactgccggcatgtaccgcatcagttcgtagctcggctccgggtcaatgcgcacttcgggcggcggtccacaaaggcgaatttcgtgccttcgttgattgatcgttgcaatgattggcggacctccgaaggcgcctttgaacggaaaattgcccataaacagctcgcgagaaggtgcgccaaaacgtaatgtatgcaggtcgccatcgatgagaacttgtttgtgctgcccaaatgccattcgataagccgtcccgtcgattaccacgtcgcggtccggaccggcgaaggacacccggtggggcaatccattgcgctcaatggccgccacgtcgtctaagtaaaaaacctttaaagggaaaaaatggaattaaaaatgatatttattcaatgtgatttattaaagcaaacacacctcatacgccttcccatccacaaaaatgcgattattctccggtacaccgggcaatttcggcgtcacattttgaatatgatgctgttgttgctgttggattggtcctataattttgaagatgatttcaaatatcactttggagttactttaataatctacaagccgcaaaaaaatatattaagttgatgccattcgttctctcatggtccgtatagtatttttcctaagcattttgggatggttccacccaaaaacatcgctgggacctaacttggccgcaaataattttatcaagaaaatttttagatttgcctttgttttgaaaatcaaggtattatcgaaaccaaatttttttgcggatgttagacaataacagcagtcgttttaataaattaacctcgtggaaaaaatagaggaggtggcttttgttcaaccaacaatggtcctccattttgaaccattggcggaggattggcgacgggcggtggaagtgaaacaggcggaggcacggaagtgacgacgggcggtggaagtgaaacaggcggaggcacggaagtgacgacgggcggtggaagtgaaacaggcggaggcacggaagtgacgacgggcggtggaagtgaaacaggcggaggcacggaagtgacgacgggtggtggaagtgaaacaggctgagatggctaaatcaatcacttattggatgtacaatgaacaattagaacaaattttcggcaatccattattgtagatgggaggtaatattttttatagtaaaaatgtatgccaattgtaagtccaaaattgtttttttaattatttgattatttactcatacattaattaatttatttttatgttggatttgaacccgagctcaaaaaatgcgaatttaaccaactgagccaccaatttaaagtgagagtaaagcctttcttttttgaggccgaataatttttttggcccgtatttaagaattcacaatagaagtcgaccctccaatggtatataaacatatgcatgacacccgtaaaaaatgtaaacatataatctgttcccagctcattacacatctatgcacatacaacctgctgttgtggctttccgttcaaaaacaatggattcacatgaacaactcctcgtggagtgaggatcggccaggctttgtcgatcctattaagcctcatgtcgattgcgtaaaggcaagattgacgaaaaatttcggaccaagttgagcgaagacgatagacggaggctcgcgtcttctcatcaccctgaaaagaattcagttgttgttaacgaatggatgtcaaatcgtccgaaaaattgtgtgattttatacgttctccatgttcaaattagaatttttaccgttgattgccggctattaactcgatacaaatgctgtcaattactaaaaattgagtgacacgaatatcattcacttaatatgttttttgggctggtattcggagcacggacttttggatggtctgttacttgattgtgtgaatttggttacaccaattcaccccttaatcaagacactgttttgttgatgaaggccaacagttcacaacataatgtaaagaagctccgtcgtcagtaaagacgaatcaaatttccccaactccttttccccccaatagtctttagctgaagcactccaatttaagaaagcaactaagattgcttatgttttcatcttttaactaaaattgagcggcagagcaaagtgtatttggcaaaggtgagaaagagatcagcgcacataaaaatgattatgaaagacaacaatcttaagactagaggttgtggtggaaattttagggacttctggctttttgggcggattggaatgctttgaatgcgaattgacgagaccacctccttgaacacatggacaatcatgtcaacaatccttttcgcaaataagtcacggtaggcgccgcttgtcgcgggaatgttcttgacgatcgagtcgagcacatagagcatgacgattttcatcggtgatggacactgaacgggcaatgctattcagtaaagaaatgcaaaaataaagtcccattcaaaaaaccttgaagagacgttcctcaatcacagcaacaattgcgctggcatatgacgcataatcctcggccaaaattgtgagcagattgatctgagtcttgtcattgcgtgtcagctccgacagcgctgccctgaattagtatttgtttttcaagaaaaccgaacgaattggtcaatttaaatacgaacctatactcttcagcaacttcgtctggagaaaccatgacgtatagtaagaacaataa

SEQ ID NO: 461 - DNA, 3426 bp, Heterodera glycines
  genomic virtual cDNA Sequence=SeqID_750; coordinates=1..84,235..338 ,425..492,601..744,1187..1567,1919..2173,2501..2749,2967..3064
  coding sequence=SeqID_953; coordinates=1..84,235..338,425..492 ,601..744,1187..1567,1919..2173,2501..2749,2967..3064
  peptide sequence=SeqID_1253
tcattatgagcgggatacgtccaaccgagcgtgtacagtgatcgacgagtgccaattcccgcagctgaacgactgccatccgaggtgtgttaacggcaccgtgaaggtgctttatcccgagccatggcttgaaaattctcgaccactcatccatccattatggcattaattacattaattttggagccctttcctaaatgacatgagcaatggactaattatgtcccatttaagtgccgagtgcacggaccttgcccagggctacacctgcaagtgccgaagcggcttccgcgacgtgtccccgtccaaggaaaagccgggtcgtgtctgccgggcaagtaagtgccgcccactatcgttttgggcctttataccgtattcaatctcccccaaaataccgtaatgccattttcctcattttcagtggtcaatgagtgccaatttgcgcatctcaacgactgccatcagaatgcgcaatgtttggacttggaggtaaatttgtgaaaacacaatcacttgatataatcctttttagaaatttaaaaattaaatttacgcccggtaaatttggaaaaaaaactaaaaacccatttttgccaggacggctatcagtgtaagtgtgaaaacggcttcaaagacgttcgaccggaaaggccgggccgactgtgccaacagatggtcaatgaatgcgcacgtgcggacacaaattcatgcgacaaaaatgctaaatgcgtggacgaagaggcaagttcagaagagaggcacacaaaactggcatttgtcattaaaaaattgtgtgtgtctaaagttagggtattacagtaccatgaacttttgggatttactgttttttggatattacagtattcagaacaattccttgactttaccgtatttattttatttccggtgataaatttccatgctgtacttttcttttaaattcagccagccatggaaacggcctaacacagtaaaaccctggttataaccaatgcataccgtatctctcaaccgcatgacgattagttacagtcttcccgacttgaatatacagtatcaattatccatgaaaattcatagcgcataattaattgttcatggcacggttttcatttctcccccatctccctgcttcgtcccctctgtgtgttactgtattaaaatggcatactgtcctctacagaatggctaccgttgcgagtgcaagtcgggcttcgcggatgtgtcgccaactccgacgctgcccggccgcgcgtgccggcccatcgtcaacgaatgtgcggagtcgaagctgaacgactgcgaccggttggccaaatgtgtggacatggaggacggctaccggtgcgaatgtccggccaactcgcgcgatatttcgccatcgcccgccttcccgggccgcgtgtgccacatattcgagaacgagtgcctgaccgggaagcacgactgcgacccgcaggcacagtgccacgacaacgagcaggcattcacgtgcgagtgcccggagggcttcaccgaccgatcgcccaacaaacagcaccggccgggccgcgtttgtgtgaaggttagcaaacagttaatcagtgttacggtggtagctcccgcatttatgtacggtattactcctcgaattgatactgtggcgatctgctgctgctcttggattttttacttatttagcaacaaaatgaaattttccaatggctccgatcatttacacccaaataactttaaatagctttagaaatatctacatattttttcgataatcgagactaaaaattgctgagaccgaaatcgggggcagaaaaccgggaccaacaagcctcaaaaactcgagaaatttcattgaaccgaaactgtgaactgagcttctcgcactcgcttattcataccccaaagcttttttctttagctggtcgacgagtgtaaggaagaccatgacacgtgctctccgaatgccgagtgtcgtgacctggaggagggctacacgtgcgagtgccgtgacggctacgtggaccggtcacccaatttggccgtgcaaccgggccgcgtctgcggagcgccggagacatgccccgcaaaccatgactgcagtgcggccgcggtgtgcgaaccgcagggcggcaacaaatacacatgcacgtgcatccagggatacgttgatcaggtgggacgaatatattctcgtcgggatcgctagggattactgatcgatggcctgatttcaactgatcagcaataataaatccaaagcaaatcatttagtgatcggtagaggtggttcttgaggcacaaaaaaagtcccagatctcataggccctttaaaatatcaaatttcctggtttttcggatcggaatcagaccctttgccctttcgctttaaccgatcagattgattagaaccggtacagagagagagagagagagattgcgctgctcctctctaaaaacctttaaatttttaagccgatctaattaatttccgtttttttagtcccccgatggattgcaaggccgaatttgtgtgcgcaactcattttgccgtgacccgaagctgaacaattgttcccggaaagctgtatgttatgaggaaggccaaggctaccgatgcgaatgtgcccgaggctatgtggacaagtcgccggacggcacgccaaaaggccgagtttgcgaattgccgccggcgccggcacagccccagcgacacccgtgccaagacgggagccacgactgtcacaccaaggtggataggacattttgtgtataactcagaaacaaaatgcaattgtgtacatatttggtgctattcgttgtagaataacgagatgaatccattgaagctattgtaattgtttgtcgaattttacagcacatcagttaggaaaagcagcggaagtcatttaaaaatatcctggaaaatcagagttctgctacccaaattgaaattgacttttctctaggcatcctgccgagctgtcggcgccactgggttcgtctgcgaatgtttgcccggctatgaggacaaatcgccggatccgaagaacaaaggcggaagagtgtaagtggataaggccaataaaaaaagctttggattaagccaattaattgatcagttttatagcgaaaatgataaaatttccttaatgaaattctgcacctaaaaagagcaaaagccaaaaaccaaaatcccagaatgatcgcttcactttcaactgatcagaaataactcgcgacttaaattgaccgaataccggagaatttgaatcttaaaaaatacttaaaattggctcaaaacaaatcttcttaaaatttcatcgctcttttcagctgtttgctccctgaacccgatctgcctggataacacccgaaatgattccgatgctttttttgatcgatcaatcacaattccttgattcactc

SEQ ID NO: 462 - DNA, 4386 bp, Heterodera glycines
  genomic virtual cDNA Sequence=SeqID_751; coordinates=2780..2964 ,3014..3107,3149..3265,3312..3389,3433..3573,3626..3808,3860..3946 ,4018..4082,4134..4341
  coding sequence=SeqID_970; coordinates=2780..2964,3014..3107 ,3149..3265,3312..3389,3433..3573,3626..3808,3860..3946,4018..4082 ,4134..4341
  peptide sequence=SeqID_1187
ttcccggtgagagttttgacgaagatttgcatgatagccaaattgaaggggtattgaattcaatcgctaaattataatattaaaaggatgatattacaattacattgggaaagaaaaagtgatgaaattggaaagaaacagaaaaattagaaatgaatgtcagaggaggaataagagctgaatatatgtgatgtgtgcggagttattgcaaaggcagagatgcaacgatgaattaaaacaaacatgtggaaagcagagaaagcaaaatgtgggttaatcgttaatcgaagaatggtgggaggagaggcattgggaatgggaagagaagaaaggaaaactgagtgggagaagaaaaaaaagccgtgatgagtgtgggtgagaacagtgagtgtgcggacattaacgacccggacatttgagtccgaacatttgagccgaaaacaattaggcataattgtttagggcgcaaatgttcgaggcgcaaaagtccaaggagcaaacgtcactttgtgacttagttaattaaacaatgatttgcttgggagagaaaataaaacttagaatgaatggatgagttgagcggaggaggtaattaggacgagaatcgttgagaagttggagacaaaataaatgagaaaatgaaaagtgtgctggaattttgccatatttatacacaatcaactcggtctgtaaaagacagaattttttgcggcagtcactcttctgtaatgtagacaaatgcattgtaaaaagtgtataaaaggagcgatttttggccgtccatcgccatcaggaatatgagaaaatcagaaaaataactttccaaaatggaagaggaaaatattttttttttcacgtaaatgaaatgaaaataaaaattttaaaaccggaaatgtttccgagaaaaaatcgtaaaacattgcttaaacgcaaccaaattaaatcaaggtaacttcatactatgtatatctccaatgaaaagaaaattttttgttggacgaaaaggaaacaaaaaaaataacacaaaataaatgttttcgtacgaaatgaaacgaaaatctcaattgactaacgggaagtaggtgcatgacaaaatttcttgattcataaacgaattgctttccccactttgccgctatttttaagctcggaatttgggtttttgagatcgctactctaacaacttattgtcgataatatcttccaaaacataatttatgcttcgtccgcatcatgaactcgcaatatctctaagtggttgtggctttctttgttcttaccatattggggcgatgatttgttttcaaaagcatgccaatgtacaaatatacagtatacaaatacgatacatataatacaatagattttttcaatattttacatttggaatgctccatttacagaaaaatcattataccaattgtttaaaaatgtaaaactgcttctttttggtttagtctctcctctctcgtgttaacttttattgtggtgcgtccgctggtgccctaatcgcctctttgctcgttttatcgcctcattcactggaagtactatattatttggtttacattattaatctaattatttttatagactggattaaaccaattgtacagacttgcagaagaggtgcaaaaccaacgcccttttggtgctcttactcctgggtttaatatggcgcaacggcttgcaaaaattgttgatgattttttacccgaagacattgatcgggcgaatggacggctaatcatttcagtgacgaaacagagagtgagtggatttggtcccttttcggcctcggatttgttatctccaatgatttaattagtatagccaacattttaggactggtcaaatcgtctgatttcagaatatccgagcagggaataccttctgcagtgcctcaatgccacctgttatgtccccttatattcgagcagtactcctcccgcaatcgatggcgaagtattgttaattaattacgctcataattcaattcaacttttgcaagcgctacattgacggggtttattccaacaatttgcctgtccccgatattccaaatgttcacaccattacgatcagtccgttcagcggaggagcaatgatcgcgccacgtgaccaaagcgctttcgactggcagatgataatgggacagcagagaataaatgtgaatttgaggcttttaattgtaattgattttaaagttaacgggtccgggcttttatgttacgcaattggctctattgcagtttacccgaccctaaacttaaaatataatataaaaaaatttatatttataattttggatatggttagtaatttattgtgctttttcaatggtcatgaaatttcccaggtaaacatcagaaatgtcatgcgcggtgcacagtcacttttcccacaatcattggaaagactcggccggctttaccgagcggggtattacgacgcaatgctttaccttctccgcaagggctgtttcgaaagagaagttggaagtgaaatttgattctattttttgtattttctggtgtttaattgagagaacattgttagctcaaatgttacatatttttcaactattgttcattcaaatggttatttattaatttctcgacaataatggatgtttgtttgtctcttatagtaccaacatttcaataacattactcactccgtttcttcgaaattctttcctaaggacgccttttgcttcggtaagttttcatctgtcgaatggctaatgttttgttgagttcagattgttattttgaccatgggcatcaaggatttgtcaaaggtcattgcggatcattcgccgttcgccattaaaaccaacgaaatgaaagcgtatttcggacggcgcatcgcaatcgacgcgtcgatgagtctttaccagtttttgatagcaattcggcaggatggtgctcaattgacaacggaggagggagaaactacgaggttttacggaaaaatgccattgttagtgccacaattacatcgactttagtcatctcaatggcattttttaccgcaccatacgaatgatggacaacggaattcggcccatttatgtcttcgatgggaaaccaccggagcttaaggtcaaccattgagcaaacgttttgccatttcgtgttttcagtcaatcgaattggacaagcgaatggaacggagggcggaggcggagaagcagcacttggaggccacagagaggggcgacaaggcggacattgaccggtttggacgtcggctggtcaaagtacaacaataaattgcgcacggcatggtaacatttcccttaaaaggtgaccaaggagcaaagcgacgaatgcaaacatttgctttctctgatgggcgtgccggtggtggaggcgccttgcgaggtgaattaatgattataggttcaaaacttaatggaattgccaggccgaggcacaatgtgccgaactcgtacgagcgggaaaagcgtacgccactgccaccgaagacatggacgcattgacttttggttcgaaaattctggtccgccacatgacattcagcgaagcgaagaaaatgccaataaaggcaagtaaagttgatttggtgagttagttataataagacgcttttctttgaggagttctctttggaacgcgctctgaaggactgggagataagccacgacgaattcgtggatttgtgcattttgctgggctgcgattattgcgcgacaatcaaaggaattggcccgaaaaaggcgttcgaactcatcaaaaagtacaaaagtattgagacaattctcgagagcattgaccaaaaggtgtgatgacacaacgcgttaagggggatggtaaaccggtaacaatttcagaagtacgcaccacccgacaattggttgtacaaagaagcgcgacaactttttttgcggccggacactacgccaggagaacaattcgaagtatgaacaattgcaatatagccaataattaatggaaattcttccgaattggtttctttttatccgttaagttcacttgggctgagcctaaagtgccggaattggtggactatttgtgtggtcagaagggatttaagtgcgttttttggctccctttctttcactttcaatgaatttccctttttagcgaggatcgcatccgatcggcgcttgaccgactacaaaaaagtcgaaaaatggcacttcaagggcgaattgattccttctttaaaccgcaagggacagcaaataaagcgatcacagaagagacaaaaaagaaacggaaggcggaggaggaagagaagacgacgacgaataagaagaagagcacagtgaagaagacaaagaaaaaatgaagggacattctgaagaaaggggggggggaggagagaggggttggc

SEQ ID NO: 463 - DNA, 3027 bp, Heterodera glycines
  genomic virtual cDNA Sequence=SeqID_752; coordinates=1..112,211..318 ,1056..1155,1210..1353,1486..1647,1690..1847,1958..2111,2153..2289 ,2383..2578
  coding sequence=SeqID_870; coordinates=1..112,211..318,1056..1155 ,1210..1353,1486..1647,1690..1847,1958..2111,2153..2289,2383..2578
  peptide sequence=SeqID_1243
cctttgcccacctgccgcgaagagtttccccaggagcccatcagcctttgcccgtctgtcgggaggagttttccatcttccgcgacccggccaaatccatggtccatctcctcataatgttgccctttcatcggctccccagtgttcagatttgttgcgaccttgacgacgtcactctcgctggtgcgcatggaaaatttgctcccacagttttcacttcgacgcctcgtcgttcagtggctttttgcgccttcgaaccgccaatgatggaaatggacaacgatgggctgatggggcctgcaccgtccgaagacagagaggaacgggttggcggattgtttgcaccggtacccgagacgggcgtgtccaaattgcagcgtcggcttagtctggttgggtggatgttccaattgtttaatgcgtttttccctttcgtccaggtgggcgattttccgacacacgcagaaaagggctcacaatcggcgaagaaaaataccggagtcagttcaatggggttactgtaaatccgatggtcgttggctgtttttctgatttgaatagagcataaataaatatatagcgtatcactttttctgcctatttatcccttaattatggggtgggcggtggtccgtcagcataggcttatttccgtattaattatttcctatgccatttcaggggaagaaaatgactacgaatgacattgtgaaggcgttgccgaatttgaagatcggctcgaccattatggaggagacggaagaagacgaaaaggaaaattctttcgcttcgccccaccggaaaaaggcgcgccagggaacgaatgcttcgcatccgccttcacttgttcactcatcaaaacagacatcgcaactgaatgacgtttctcacaaccagccaaaggccgtttcggcagaaacgccgacagaagagggacagcccgaccccgacaccacccatttgggcattgtgtgagacataccttttcatactattgtttgatttttggaattggaaaagataaatttgaaccaattgtgtaaattaccatttagcgaacaaatcaaaactgggactgagaacccatgggacgaagaaaagcgcaatcagattctccaaaccgcacatgtgatggtcgaaagtcacgcatttatggtaactcaaatggtccccatttaaagctttatttttcttcgattttattagacggaaaagtgtcctcgtttcgagttgaaccgaacaatccatttgggaggtgaatcattctcgattgaagacctgttgggccaaggcggatttgcgcgtgtttacagggccaattcacgtgaagatggttgcacttatgccatcaaggtgaattggatttttagtgtatataggatggacataaggacaaatataattttaaatccgtacggaaataccggtcttaaaaaaaattcaaattcgttttaatttctcatgcaaattactcctccatttcagtacgaatccccggcttgcccatgggaagtgtacatttgtagcgcactcaaaagacgcattccatcccaattcgctgcttatctaatggaagtgagagacgcgtacattttcaaaaatgccagtgccattgtttacgaatatttcccaaaagggacacttttggtagggtgaaaggcattcggatgacctgatgagaattttcaggatcttaccaatgtctacaaaaagaacggaacggtggtgggcggtcttcttgctacttttttcggcattcatttggcacgtgcgctgcgccaagtccacgagacggccaacataattcacgcggatgtcaagccggacaacgtcatgctgttgacggcgtatgtttcggattgaaaattgtgattcatttctctcttggccccattaaatgtcccattttggcacatttattcgattttagtcaaatacagtgcacctatttttacagtgccttgaatgcacatgattcgctggacaatttgctcaaaacccccgtgctgaagctaatcgactgggggcgatccatcgacatgaaccatttccaaggagtcgaatttcacggaaaagcgggcaccgaaaatttcgattgtgtcgaaatgaaggtggttaacatcatgaatttaaaaaaccgccttacttatagacgggcatgccatggactttccagactgatttctacggtttctgtgccacaatgtacgtgatgatgaatggcgaatatctggtgaccttcaaatactcacaaacggacaaagttgttcccgtgaagcagctgaagaggtgaggttgccattttacaacttgattttcggtgcttttctttaatcaattgttccttccgattctttttccccctaatttttccactttgaggcgcatggctctgtacgacgtgtggacgcagttgttcgatcagttcctgaacattcccaactgcaaacagctgccaaaatggttaaatacattggaccaaatggaaagccgactggccgaggctgtgaaaacggagcctttggagtggaaaagagcgatcgaacggttcaacgaattcgtcaaacaacgggggtgaaagaaaagggacaagacattggatcggacttttgtgcaaatgatataacctatcccaaaatgcttttctgcttcatttataaaaataactgtccaccccacatcaataaatgaaatcctgtatagccatcaaatggataaaacaatgactcctggaacgtgtatcactatttaaaataattacactaactatgttttaaagaagagatttattgctctttaagtatgtgtacaacaattcaaatgactaattaagttgggcaattcaacggacgatcgaatggaattgactagacaataaatgaaaatgcttaagtaggaaaaataataatgctatggcctataataaaagatggacaaatgaaaaggaatatctgtgcgaaaatgttgatcattctgttgttttttcaattttgacctaactcaatcggccgagccagtgaaatgggt

SEQ ID NO: 464 - DNA, 4382 bp, Heterodera glycines
  misc_feature (15)..(15): n is a, c, g, or t
  genomic virtual cDNA Sequence=SeqID_753; coordinates=2559..2485 ,2434..2372,2318..2238,1615..1551,1517..1468,1056..938,448..398 ,317..201
  coding sequence=SeqID_834; coordinates=2559..2485,2434..2372 ,2318..2238,1615..1551,1517..1468,1056..938,448..398,317..201
  peptide sequence=SeqID_1074
gcattctgaactctntggaccaaaggtactgtaaaattatcttgttacggtatgctttcaaatgccaaattacggtatggcatagtttcactactataccgtataacgctacagtatgaacagacaccgtaataaattttgtagaaacattttctcatggattattgttgcccattccttctttcccattgaaaagtctgtgcctggaattggatgattttgtcctggctcaaacacaggtagaacagctccgccccgttgctggccacgtcaaccatttggaaggcgcatttgtgcagctgactgaccggctcgcccttgaggggaaaatttttcataattttagctaaaattttcgtcaaaaaataaatttttttttttgtttttttggtcctacctgtccagcagggtccaacaacacgtgctgtttgtccaccttgcgaattcgctgaaatttgcattaaaaataaaatgtttggattaaaaatgctcacactctttagcatagaattacgggatgcaagaaaaaatattcgatttcagcaggtattcataaattttgactcattttttttttgttttaaaatacaggggtcttgcaaaatgtttgaccagcgaaaaacccgactttttttcacaaggatccttcccgttattcctttcctaaatctccttcatgttttttgagaaccgagaaacccaaagaaaacagattttggcacacattttcacaggaaatttaggcattttgtgtttgatctgattcagctccatgatcaaggaaggctctgatcggcgggttgagtttttgggtggatattttttgatcaattttggatcaatcagcagattacagaccaagcctttcacaagcaagatctgatcagatcaaaatcggtgtgttggactgcttgaaactgatgactgactgactgaccatcaacggaagtcgcatttccgtttggctgtccaccaactgaatgaccgacccgtaggtgaccgtgtgctgctgctgctgctgctgggactgttggccaccaaattcgggctggtcaactgaacggaaaaaaaacacatacaattttaaagaaatttatacaaaaaatagagatgggtaattaatttccttaaaaatttattaaaaatttaaaatttttccaagacggcgccaaaaggcaccgacacggaacccccctaattgccctaaattttcaaaatttgactcaaaaattggtaaatttttgctgaaaatttgttagaaacagtgtcattttttccctgccggtatcgcctggcgctgttttgatttttgtcacaaatttcaggcaacggaataacggtttttcaattttttaaaaattcgctatggatggcttccgcaaaaaatttcaggaaaccaattaattacacccacccattaggccccaaatagcctcattttcgctgatcaatcaatcaatcactgaccaacattgatgtgaaatgcgccccattttgttgagctggccacaaacgcaggcggttcatgcatcttttggttggtgctgattttctcatcaacatgcagataacgggtggacactgtttgggaacgcaaacggttgaacagggcaatctgagggggaaaaagaaataataaagttggcaaaaatggggacaaaatgccacttggcccaaaaaaaagtgattaaatgggacaaagtgcctaattaattgggcagtaaaatggcgacaaaattccaactgtgaatgggcaaaaacaggggcaaagttggaaacacatttaaactggccaaaatgggaaaatgccgacttggtcaaaatggggacaaaatgtcaacttgctccaaaatgcggacaaagtgacaaattggcaaaaaaaaaacagggaaaaagctggcaaaaattgttaaagctggccaaaatggggacaaagtgccaacttggtcaaaaaaaaaagaagattaaatgcggacaaagtgcctaattggcaaaaattatttaaactgggcctaattggccaaaaaccgacaaaaggtgtacgtacaaaatgcttaattgaccaaaaatggggaaaagtaccaatgtcggcttacaaaatgccaatttagtagaaaaaaaccaataaaatgccgttgtctaaccaaatggcacaaatcataatgactcatgttgcccccattaattaatgaataaatcaattaatgtgtcaattaataatttgcgctttttcatgccttgcttttgttcccgacacataaatatttacaatcggagcttttcattgactgtttcttcttggatggttttgaaataatctaaaaaataatgtaaatatttattttattattttaaaaattcatttttttactttaattcgctgagacgcaaaagtgcccaactccaaagcgccgcaggcgtacccaaaatgtgcctaattaggaggggaaataatttaaattaaaatttttcagattttctcacattgagatgaaaatatttgcgtttatccgtgtcactgatgtgcaaggctttggccgctgaataatccttaacatttttttaatataaaagtgataaatattttaaaattaaatagttaaattaaaatattttaaatatatattttttttttgattcaaataagatttacaggaattttctattttcctgtaaatttagaagttagtcatcgtaatttatgtatgtatgtatgtatgtatgtatgtatgtatgtgtaaagtttaaactataccctttttaaacttatttttaaagatcggaccggaccggatccggtaccggatttttctggatccggcaatccggtccggcaattcgaaaatctggattgactggattaccggattgaccggattatgagagaggatccggaatccggtcatttttgaaaatactagtccggtccggtccggcatttttgagaattccgatctctacttatttttaaaaaattgcccctttcacatttaaaatttccaatttttaaatttaaaaatatttttggctttctgttacgagccaaatcaaaaagcaacccaaaactcgaaaacccagaggcaataaaaattatgtgtgtaaaaaatcaagtaaaatggtatggagggacgggggtaaaatttcaacaaatggtataataatttgctattcctattaattaattaattagcacactaattagcactaattacctttccattggaaaagtccaacaggtggtgttgttttgtctgctcattttgctttttgtcatcagctgcagttgttgctgactctgctccaaccacaattgacgcgcacagttcgacgaacttttcgcgctcgtcgatatttgccaacgacgaatcgccagaggcatttggagaactgtgaaaaaatactaattagtagagatcctcgacctgggtgagagcccagggcaagggtggcattccgaggcgccgaaaatttcggaaatcggaatccgtgcccataaaaatttcggaaatcggaatccgtgcccataaaaatttcggaaatcggaattccgtgcccctaaaactttttgaaaccgaaattccgagccgtgaatattagaggtcgaaattccgagccaaaatccattgcaaggtccattattgttttcaggccgctttggttttctgggttttttacagaaaatccaggcccagcaggcctggatttttcaaaaaatcgaactatattaattagtgcccaattagtgaaagtctccgatcactttcagttaagtaacattactagccgagtaaatttgttctggaaaatgaaaaacccgtaagctttttaaatttttatgacattttaaatggcaaaatgccaaaattaacccaaaaaaatgccaaaagctaaaatgctcaatttgtgccaccttttatagttgttttggtggtgatgatgatgccggtacagttgttcaagcaatttgcgccgcgttcgccagccttcgcccatcaaataaatgcacggaggggggcagaaaaacctgcaaaaattttaacaatttttctccattttccacctacctattttggaaatattttttcatctatttaggttcctattttattgaattaagtccctgaaaatctaagcctaacaaaattttttaaatttttttagcaaaatcagtgttaaaccaatcgtcaaaaaaaattttttttgttgttttaattacaaataaatttacaacggcgccggcaaaaaaatatttttaaataaaaaagaatttaataaattacactcaaaatttacagcggacggcaaaaaaaaatatatttttaatagaccaaaaaaaaattttaaaatatactaaacagtttctctagggctcacaaagttaa

SEQ ID NO: 465 - DNA, 3797 bp, Heterodera glycines
  misc_feature (56)..(56): n is a, c, g, or t
  genomic virtual cDNA Sequence=SeqID_754; coordinates=482..698 ,951..1021,1070..1150,1302..1366,1410..1514,1568..1691,1737..1844 ,1908..2116,2236..2422,2476..2788,2846..3205
  coding sequence=SeqID_992; coordinates=482..698,951..1021,1070..1150 ,1302..1366,1410..1514,1568..1691,1737..1844,1908..2116,2236..2422 ,2476..2788,2846..2925
  peptide sequence=SeqID_1206
tgcaaaaaaaaaaaattcttcccatactctcttatttttctatagaagtatcattntaaattaaattattataattaattgattattatttgttaattagcagctaattattaaataaaattagtcacaatttcaagtctatctgtcgtcaatccccaatcgttcattcatttttagaattattattattttttggcctatatacgtcattgaatgcatactgatcaactgcaaagagaacatcatcaataatttgctgattggaaagggaaaaagtgtcaaattaattgctcttctatcaacgcaattcttgtccatttgtaacaatttttgaggtaatagaaaccatttcattgattgcctttagtcttttttgacaattgcaatttttttcgcttttagtaccgaacatttcctcgcccccatcttcgcatcattcgttcattcttcgaatttttttactgagtgaatgacagttgcgatggaccatcaggcgttgattgacgagctgccggaggtggagaaaatgccagcccaacagcgcatcgctttggcccgtgaacgacgtgaacaacaattgcggttgtgtcagcagcgcgaaggacatttgccgcagcccgccccgcgtcggccgcggctgcggttcagttccgacatcgctctgctggagacaaccgtccgtggcgacgcgcaggaaggtgctttgtcgtacaatatttcaatagtgttgtacaataattggcgagattctccctttatagctcatttcctttccgcttttactattgtatttaagttctttgagcgatttttcgaatccgttcataccttttttgaggggctgggaatcggggttcgtagcgaagggaaaaatgaggaaaatctcaaaaactggctattcttcttaaatggctgattttacgaaacgatccagcacaattccaatttagttgagctgatgctgatggatggtgtcaacccaaactcacacaatgaagatggcctgactccccttcaccaggttcgtctaaaaaatgatcaaattttaattgtaaattttattttttagtgtgctattgacaataatgaaagaattgtgcgacttttgcttaggttcggcgccgatgtaaacgccaaagacacggagaatgtataattgtttttttttattcaaaaattgcgattcagaaaattttgcgatttttgatttttgagtttatttataatatagtataacaaatatgcctgaaaaattggttttttctatatattgacaaatttaatttttgtcaactttttagtggacacctttgcatgccgccgcttgttgtggttacattgaaattgtcagacttttaatcaaacagtaagaatcgtttaaacattaccgtactaatagtattattcagcagtgccgatctgttggcggtcaatgcagacggaaacatgccttatgacatatgtgacgacgaacagactttggatcttattgaatccgaaatggcgggtcaggggtaattaattgaatcctcaattttctttataaaattcgaattttctttttaagcatcacccaggaaatgatcgacgaacgacgtcagttgccggagcgggaaatgctcagcgacatgaaactgctccaccagcaaggcattccactggaccaacggatgccggacgaatccacttacgtgagttcagtgtcacatcgctttttgattgctgacaccgtttagctccatattgccgctgccaacggcttttacgacgtcgccgccttcctcttgcgctgcggtgtgtcgcccgcctcgcgggacaaagactcgtggatgccaatccacgcggttggtcatatattagccggataattatttagatttttctatttatatattggaatcttctaggcagcctcttggaatcagcctgatttgatcgaattgctctgtgaatatggggctgacatcagtgcgaagacgcgcaacggggagacgccgctggacctaacggaggacccgcaaacgcaattagtcattcggaccattgcacagacggaggcacgaaggaagcgaatcggacactttggagtgcgagatagtcgacgacagtcgagaaagttggtcattttagatagtcaaattaggcccttatctaagactttttaatggtaaggtatttgaggcatttattattgtgagaacattcgctaattattttataattgggtaattaaaggcgaaagaaattcgaatcaccgcaagccgtaccgcctgccgcgaacaccgacttcattcagacagcccggggcgcaattcggcgtcagtcattacgcgatcggagtgggatgacacttgcacggcttgattcacaacgtgaagggtccgacttgattaggagttggagcaaggaggatgtgtccaatgtaggaggctttagtttttattaaattaccatatattgacatatttaatttaggaggaaatgtctgcgcatcatttcggcaacgggggaccgtccacctctcaccagccgacagcaaatcagcaaagacgcgactcgccgcctaaaagaatgcagaaacaatcgcagcaaaagcagaagcaaatgtcgccagacgagtggttgaagaagttggaggccgaatcgggcggccttcgagacgaagaggaggagcaggcggagaaagacgtgctgaaagggagcgccggggagagcatgcggaagggagcgaaagcacagaaaggcaacggggtgattaggagagatcagcaacagcagcagcaacacggtgaggacgaacactgccatcggcgcactcaccgctcatgtcctttcttggtttcagatatgaacggaatgaatctgaagggatcactcggtggacagaatcggaggcggaagaagagctgttgctgcattatttgatcacgccttcgccttctccccaatcgcttgttgcccctttttcgcattttggtcatcctttgattcgtgattaaatatatacgtaaattgtatcgcctctttctctatttctatccccaaatggtcattcgttcattcagctcacaattcctaccaaatctgcacatttaaagagtatttctatctgggaaatctgttcattgttacttctttgtttgttttatttagacagcgtacattcttttggaatcgttcgtcgacaaattattaacaatttatatatccttttctacttttcgccttcacttttccatttttattacaacaacagatatttaattaattatttcttttgtaaaatgtattataaaaaaggaaaaataaagttaactcgcagattttaattgggaagttagataaattaaacacaaaattattttttattttaattcttggtgcagtaatttatagaaagagagagggagaggaaaaagaggagagagaaaagaaagagagaagaaaagaaaaaggagagagattgggcaagagagaggagctcagaagtgcaaaaaattgtacaaaaatttccaaatttttttggagcgccctgtacccggaaattttttggaaaaagcgcgccgctgtcccggcgagattttgtaacctaacttaatgatcagcgcattttttttaccctaaactcattggaaagaaaatactttaaaaaaataaaaatttgaaaaaatttagtacttgatgaaaagtcatagacaaaatcaatgattttttcaaaatcatagttcagattcgtgatccgcacattttttaccctagaaaaaatgctttttgaaattttactttttttccgtcgg

SEQ ID NO: 466 - DNA, 1277 bp, Heterodera glycines
  misc_feature (16)..(16): n is a, c, g, or t
  genomic virtual cDNA Sequence=SeqID_755; coordinates=1266..1221 ,1176..997,760..467,418..319
  coding sequence=SeqID_905; coordinates=1247..1221,1176..997,760..467 ,418..374
  peptide sequence=SeqID_1132
ccgttgagagttggcncagtcttcgtagcagtcgaatcaatcaccttaacaaaccaattgacatacagtaacaaaccacatcgctattatacaattcacttacatggcattgcaagcaccgttgcttgaaaatcttctttcctctctcgtaatcgccttccggaattgcctctggcatatttgaccttcgaaagattgatgaagcgtgtataccctgtttcaagttggttaagctgattgaaaaaacaatacgctattaaaaaagctgtcgccgtggtttgtgaaaccgaatataaacattttcaaagaaaacccgggtaacacaacaactttaatcaacaaatcggaaatacaagtcgtctcatttctttctctacacaaaatgagttctcggacgctgtgtcgtgaaaggagtcatctaaatgagaaataaaagtaaaaaataggtgtaatggcattggctaacattgcgtcgcttggaattcacacggtgaggaagcggaaatttgatcttggagttctgaaattgcttcaccccggcacgcttgcagtccgccacactgatggtttgcactttgatgatctgaatgcgatccgcttgagcgcggtgacgagcgcccatgtcgcgatagcactgcgtaacagcacccgcttcacaaacatcgcgatactcgcggtacatgttgtggtgtccagtacgagaatcgtagcggagccaaatgccaaagttcttcacggagccaggctttttctcgaagaccttaattttcgcatttggtttatgttaaacgtaagtgattgcgcggatcaatcattacaacattttcagttatttttaaatatttttcagtcttaaaacggacgacgcccaactcgttttggacgctctctttttttacaattacatcgagaagttagatatctcatacacattaacaagttaaaacaaaaacgaattgacaaacgaattgagtttttatcccttttccttcatacctcttgacatgaaataatttctccgtgtgtttttttaacacgacgcaacatgctagtgaagtaccagaagcgggacttagcaacgacgtggttgctggcaaaaataaccatttcatgcagtgtcggatttgagtcatttgcagttgggagtttacgtccaacaacgatgtactttcttaactgaaaagacaggatttccacaaagaccaaattttaaaaattacagtttctccggatgctttgattggcattgtttaaaacttggctaaattagaaaattg

SEQ ID NO: 467 - DNA, 1486 bp, Heterodera glycines
  genomic virtual cDNA Sequence=SeqID_756; coordinates=367..411 ,453..587,723..938,1104..1228
  coding sequence=SeqID_1015; coordinates=409..411,453..587,723..938 ,1104..1160
  peptide sequence=SeqID_1222
ccatttattaaaaattgctttatgccaaagccatttattaattgaaaccaaataaaaattaaacccaaaaacatttcccattttcaaaaccattttttaacaccaaaaacaataaaaacaaaacataacgccacacaaattcaaacagtggcagaaacatacatacagacactcaactttattatataggatattttaaatatattaacattttgttttacgccaagctttttttttaacctttttaccgtcaatgaaggaaactcaacattttttaaattacctactcggtttttttcgtttcttccatgatcaattttgtcaattgatgatgtatgaaaattcctttagatagtaaagttttcgttattgactctgaacattattgtttgtcatcgaaaaagacaaatggtatgccgttttcctatttttttatctgataatttttttaggcgattagcaagggcactaaaattacgccaaaaggtggtaagggcggcaaaggaaagaagaagaagcttacgctaaagtttgtgatcgaatgcaaaaacccagtggaggatggcatcatgaagactgccacatttgtgagtttggtttttgggcgcatctgctttatgttgatagatttcaatatttatgtaatttttattttgccatagttaacggttctcgcgagcgtaggggcccattccctagtcagcctcgtcaacactttttaggaaacctttcttaacgaacggatcaaagtcggcggaaaaaccaatcaactggcggctaatggtgtcaaagttgaagccacgaagacaaaactggtcgttacatcggagcagccattctccaagcgttacttgaaatatctgacgaagaaatttctgaagcgcaatgctctccgggattggttgcgcgtggtagccagtgccaaggacacttatgaggtttggttttcttatcaccaaaaaagggtggatgtctttttcaggggtgttaaaatgcagttcggtccccctcacatttgtattaaattgaggagagggtcggagtgtggttaggctatatataacacagcaaactagactcattaatccatttttaatttttagcttcggtacttccaaatcaatcaggaagatgaagatgaaagcgacaatgaagcatgagcgatttgccatttcttttgttgggtcgtattatttgttgcactttttaccagcgataaaaacttgttaaaggaattgtttatgactaaaaaatacatgataattgggtaagctcaatgagtcttatttgatcaaaaaggattttctcagctcctgcaatcgctttcttgcgtcgagtactcgccgttcctgggctaatatgtcttgttccgtgatggttggaatctgaattagaatttgtctaacataaacagaatttaatttcattcttcccatattaaaagctatccatcttctgttagtggtaccctttgctgttaaacctg

SEQ ID NO: 468 - DNA, 3023 bp, Heterodera glycines
  misc_feature (454)..(454): n is a, c, g, or t
  genomic virtual cDNA Sequence=SeqID_758; coordinates=2733..2580 ,2516..2357,2312..2191,1910..1825,1376..1254,1028..749
  coding sequence=SeqID_929; coordinates=2709..2580,2516..2357 ,2312..2191,1910..1825,1376..1254,1028..795
  peptide sequence=SeqID_1153
aggatttttcacatgtattcaagctgacgaagatgtctgctgtttattccggtgagacttatatggacactaatcgggagtgattaaaatgatgaggtaaactcggcatcgaataatgtgagttattttttacttattgttgaataaaaaatagtcataatgagtgcagttttgtcggtatttctaggccccttcaaataacagcagttcgtcctcgtcgacggtgtccgacgtatcgtcctcgtccgtttcctcctcctcacatgtccgtctagtccagcagcatcatgtcctctcggtcctcgtcccccaaagggccactttattcttccgcagtgcagccttgcgcgctcattggtccgccaacatcatcatggaattcgtcatcgcccattcttgcacgaacttatctgaacgtccttctaagtcattggggggggggggcacggcttanatcgccagccaaagatcgccggaatttgttcaaaaagcccttcttcgctttaatagtatgcaaaggaccttaattgttaaccattctccaacaatttgtaaaagtataatatcaaccaaacacttaagaataagtattctaaagctgaaatccgcatgtttctaatccgacaacgaaatactggcaatgagcagaatagtcggtgattaccagcggaagaccaaatttcagctagtagcctgactttttagcgttgattaaaatcgcatatattatgacaaaatttaggattaatttaatatttataatcaaatttttgatgattgaataaataaacaatttaacgctccaatggtgccaatcccaatttctttctcagtgcgttattctcctcaatttctctttcggtgtctttcgcggcacttcgtcctccccgacggtctaaatccaactggcaatttgtccttagggttgatttgataccatccgtggaaagtgatcggcgtctccgttctctcgatttgctccgacttcggccacggctgcgcgagcgacttcggcgccgagaaacgatctgtcatttagttacaattattagggatgcgatttttaggtaaaaaaatcccagaataggtacttaaataggtaaaaaaaaatctcaacgtagacacccaaaaccaagtggaaaatgcttttttcgtgcttatctgtgcgtattaaatgcgcaaaattttaggtatttaactaaaaatcgcatccctaacaattatcgtcccaaaaaaaggctctcgattctcacatttggccgtgctttccgcgtctcctgctcatcttcggagtcggtggaaagacgctctaagtcttcgtccaaggcggaagcgtacaactcgagttggtccttttcttcgagtgcttgccgtttcttaaaattgtgattatgcaaaattgctttgttttattcatttcgtgaaaattcaaacggaaagaaatatttctaggaaaatttgcagccaatccattccccccagcactgctcatttttggcaaagataaaaagaaattttccatggtttataatgatctcaaacatttttgcgctatttgtcaatttttttaaatttagttttgggtgtaatttttgataacagattttcaccaaaatggccaattttgagaatttaagccataagaaaaagtatgaaccccgaaattcggattaattgtccataaaaaagacaaaaatagaaatcagacaaattcaaaacaggatacttctcaccccttccaaagttgtagacttatgtaaagtttgaagaaaatcccccaaagaacggtgccgaaagacacaatcggcaaaaaatttttaaaacctgtagacgaggcagctgtatatcacaataatggtcttctcttaacaaattgtcgacaaattcatccatgtatagcaactcgaattctaaattgaagtgattaaaaaaacattcggatggggaataaacggcgagggggggggggggggtaaattaatgaactctttaccgattactaatttgaaaattatgttttttttcaaaataagtttatgcagtagaagaacttgaaacccatttcttttggagctcataaatatttgtatagaatgcaaaatagggttattaaaaacttagtcgtaaatttaatgaaattcaatagagcggtctttgtaagtagtgccaataaacaattgttttactcacttcccattctgttcatgtaacgcagttttcggtaatcgttgtacagcggttccaagtatttgaagacttcgacggaattaaataccaaacggatatacatggcacccaaagcacggacatacctaattaaaaaaggattttgaagaaaaatgacgaacgatttaacttgaagtcgtcttgtcttataaattcaattattatgtctttgtcgggttgcaattggagcaatttgagtgtaagacagagaaactgagccggctttatgttcccagcatatattccaccaatgtaacgcaattcagtggcacggtcgacgactgtttcagctgaaaaagttaaaaaaataagagaattatcagttgtaaagttttttaatgtgattgagtaacctgagagtccaaaacactgttccttccagtaaagagaatcgtagatgcgagtccggatgatcttttcaattaaatattgaggatttgtgccttttatggtatgtgcgtctcgagctgtgcgatttgccatgacaagatgaactaaactttgcctaaattctcatcttgattaaaattttaaggacatctgttgggtagagttcgacctggacctggatccaggcctggatttttcctggatcctggtccaggtccaggtcattttttgacaacctggatttttcctggacctggatttttgtccaggaaatccaggtccaggtccaacatggaatccaggtccaggtccaggcatttttcaaaatgtcgatctctactgttgaggttagagattcttttggtatttgcatggcaatggttggttggtacaaaaacaaaaatttt

SEQ ID NO: 469 - DNA, 1960 bp, Heterodera glycines
  genomic virtual cDNA Sequence=SeqID_760; coordinates=1629..1533 ,1213..1106,1060..874
  coding sequence=SeqID_886; coordinates=1629..1533,1213..1106,1060..963
  peptide sequence=SeqID_1116
tgttgttgggacgcgtaaaatgtgatgggacgcgtccttcaagtgggacgcgtaaagtgtcatgggacgcgtaaaaccctctagaacccatttaagtatatttaaaccgattttgaaccaatggaaaattcaaaattttggattttcgaacttttgttcgaattcgggtccggaattggccgaaatgtatgccgtattcgtaatcaccgacccagaaaaccattggaaatatgttttgatttttgaaaacaaaaaatatttttttccaaaaagggggggggtaccatctaaagtattaccctagatgctatcaaaatttgacatagcctgaagaggaagtaaagcatacatccagacagtctcgaattgtacagatgaacagaatgagaacccaaaggctatttttgtgtgtccgcggagtttcaaaagcaaatttaattactggataaagcacattttgtccttactaaattgggtagtactgccaatggtaggaacatggtttaaatgattttttattgaagcactaatgattcatggaccaaaaatatgaaattcgaaatttgagtgacttttgttcaaattcgggtccgggattcggaattggtcgaaatgggtgccggattcgtgatcaacgaccccgaaaaccctttaaacatgttttaatgaatcttgaaacaaaaaaatttctaatgggggaggggttaaactttactgttatccatattttctgtgatttttaagtttaattttttcaagagaggttctaccaacatgcaatattgtctgtaatgcttttctttttcgaaacgagcaggtttattgggaaaaggccgttgcgcatgaattcgattttttaggcccaagtgaaggtaaaataaatcaaatttaacggaaaagtccaaaacacaacaacaaatttgattctttctccaaactttctcagcgtatcaacggtccgttcattcttctggcacttcaatctctcccgccctgatcatgtccacaatgtcgtgagggtgttgtccatcgacggtacagccaaccgattgagcggtgcctataaaaattcgttaaatttgttgcaatggattaggaaacaaacccaaaatttccttgacggtgccttgcaattttcgtgcgattgaacgggggcgcatctgacgagcgatgttgatcacttgttcaatggtcaggttgccgctgtgcttcactaaaagcgttttataatagtgaccagtccatacctactggtattccttggtctattcctgatattattcagcaataagatttcgacgctactttaaaattggcaagttttgaattttactaaaaaccaatgggggggggggaccttttgttcccaaaagttgacacttttaaaattgcgccacatttctaacgagttatgttacgtttgtttcatttgctctctgtgaatctaataaactaaccattcgtgttttggtaccaatagtttgttgattttgaatcgtttaataaaagttgattttactaattgttcataccgttcttgactttcttgcggtcccttggcggttcacgcagttctttgatgatcagagaagcggccgatggaaccacgtctattttggcgacacgattctaaattgtaaaaaaaatattttggtaatactaccgattgtacaccctccgcccactttttgaaaaaaagttttatttttttacaaaaatttgttttataggttttcagcgaaggaaatatgattttcacatttatctctgatttttcattatcattaaaaaagaaaccgcagccaagcggagactcaaaccaaaacccctgtcttatatgacccttggagattaataattaaaaacttttcttcgaaatacattcaatagcttattcaaggcgatttttaagctcttaaatatcggtgtatgagtttttgcgcccgactaatttccctta

SEQ ID NO: 470 - DNA, 1485 bp, Heterodera glycines
  genomic virtual cDNA Sequence=SeqID_761; coordinates=379..453 ,571..735,789..1039
  coding sequence=SeqID_964; coordinates=379..453,571..735,789..1022
  peptide sequence=SeqID_1182
atgagccggagccgaagaagtcacggctggaagaaggaggagaacagcaggagcaagaaacggagcagcgaccagcttcgaccggcgcagaaaaagactccatcccaatggagcagtcatgactctgatcgtattacactaaccattcacattgaccaactgtctgtcaatgggtggcgggtgtaatttacgttccattccctcgctaattatttaatggtctcttttcgttgtgtttgtccgtttttccacttttttttattttttgtataagtaaaatgttttcattaatattattttttatgtcgattatcaattttcatacctttgtcaatttttgttaattctaaaaccttcaaaaagatttaaacagcaaaaatgacgacaacaaaagaagggagcatcaaacgcgagcagttttatgtgcgctattatgttggccacaaaggaaaggtgagaattgtgacgagtgttaattcgaagttggtcttttgggtcggagtcattttgagtttttggtaatatggtgcggatttgttcaccgggaaagcaaaataattttatttttagttcggtcatgaatttctcgagttcgaatttcgcccggacggcaagttgcgctacgcgaacaattccaattacaaaaacgacactttgatccgaaaggaatgctatgtgggcaagtcggttatggacgaattgaagcgtatcattgaagattctgagattatgaatgtgagttgttggcaaacatggtcataagaggattatgtgtcgaatggttgcaggaggatgatgccaattggcccgaacctgaccgagttggacgtcaggaactcgaaatattgagcgggaatgaccacgtgtcattcactaccagcaaaatcggttgtctcgtcgaagtgaacgacagcaaagatccggtgggactgcgctcgttttactatttggtccaggacttgaagtgtttggtgttctcactcatcggactgcacttcaaaatacgaccaattgcgcaatgatggactaattggtgacgttcttttaaacgacgaattccttttttgataagcgactttttggcataccaaaatggaaaacaaaaaaagaagacttttggtggtttcataacaagaaattttgcccattgtatgccaatttattttggacttttgatctttatttaacacgttatctcttcaattggtttgttgtttcaccaatttttaaaaatactggaaaaaacattatcatattcagtccaaattgcagggaaagatttggctttttagtgttttcctccaaaacagatcagcaaaaagttatatactataaagacgattgccgatgagacaaaaatccattaatattaaactattaataattttactagtagggtgagtaaattcaaaaggtcccgtgaaggacaattaaagcggcaaaaatcttggcgtaaaatttatatggcaattcattcatacaaaa

SEQ ID NO: 471 - DNA, 3262 bp, Heterodera glycines
  genomic virtual cDNA Sequence=SeqID_762; coordinates=1647..2018 ,2081..2202
  coding sequence=SeqID_902; coordinates=1647..2018,2081..2202
  peptide sequence=SeqID_1247
tgtcatgttaaaaagggtgaaaaataatgcagaaagtgaacaaattggagaaaagacgaacaaattgcgattggacataatggagctgaatgaccgaatagaagaagtgaccaagcgaatcgcggggccatgccaaaagcggataaaggacgccgaaaaagtcaagaccgatgcagaagctggcattaaaaccgagaatttgacacttgcgtcaaccgaaaggaatgtgaaaaaggttaacgaaaagttgcgcaacttggaacaggatataacggcaagtttattttaacatcaagtaaaagggaataccattaactttaaaggaaacgggacgacaattggactccattacgacacatttcaccgcggcagaagagagacttgaaaagctggaagaagtatttattttagaagaaaaagacatgatgttaatgttttttagattttaattcaacgaaagaacgaagctgaatcatcaaatacagccttaacagaattcatagactcaatcagtggccgaaatgaggaggaaatgacactacaaaagaaggtggacgagctgaagcgtgagttgaagggaattgacaatgaattggcagtgttgggcgcaaaattgaaagccggcgaaacaaaagtaattgattagaataataattgtttcttttattaatttataaaaagacaaatgtttttacaagaaaatttcaaaagaaaaaatatttaaaaattttcagcgttttttgtggtattttatgatgaatactaacaataaggttttcggaaaattttacaaaaaattttttaatttctgctgcgagatttcgtgcggcattttggagttcacccaaaaatatacgtctagagcatatgtttttttcagttagcatcgctcaaatgtttccgtacgaaatggcttgccaatgcgttgtccaaagaatcgggagcgattgttgagcgtccaccgaagaaaaaacgcttacaattaataactgaagacgaggaagcagcagaagatgacgaagaagaggaggatgaaggagaagaagacggagagggcgacgaattgcacgaacaaatggaatttgaggaggacggaattgaggatggacaacgacaattggaggaagcggaaaacgaagagtctgtggacgacctcgaccagtttctacacgactgtgtggcgattgacgatagcgatgttaattttgatgagacagatgcaagagatgcggaagaccaaatggaaattgacgaagaggacgacgatgaggagggagagagagaaacgaacaaccaattggacaatggccaaagagcgacgaaatcgaccgctaaagtcgttgctaacccggacaacctcaacaaactctttatgccgttgcccaaacttaacgaacagcttttacgtgatgaagttgacgtggaccaattggaacatcaattgacggagttggaaaagcggaagcggaaacaatctgttgccaacctgacattggtgctcgacttcttcgctaaggttgacggactgacacgtaaatgtgtaagactcattttagttgaaaaaataccaaactgagttcaaagaactcgccgccatcactgagcaacgcgatttacaccgggcctttcatgatcggctgaagaagcaacgcttgcacgaatttatggaaggattccgagagattgcgacagaattgcggatcacttatcagatgatcaccatccaaggagatgtatcacttggtaacgttcctccttttatttatttttttactgtttttcatccagaattggttgattcgcttgatccattcgccgaaggcattgccttcaatgttcgtccccccaaaaagtcatggaagcagatcaccaacctttcgggtggtgagaagaccctcgcctctctttcactggtgttcggtttgcacaagtataaaccgactccattatacgtaatggacgaaattgacgcggctttggacttccgaaacgtttccatcatcgccaattatcttctggtaaatcttcccactgtagcacattttttaaaattaaatttaatccgccgtcatttattaaggagcgtactcggaatgcccagtttattgtgatttcattgcgcaatcaaatgtacgaaaaggccaaccgactgatcggcatttacaaagtgcgtgactgcactaagaatgtggtcgtcaatccgtctgccatgagcaaggcttttgaacaggacaagaaacggaaaagcaacccttaaccgataaaaccattttccgatctcacttatttaactctttggttctctctttgcaaataaataatttttgactttttatctttataaattattcaatcgtttgttacttaccatttttactcgacattttttcccttttatgtattttaaatgttttttaagtaacatggttaacacaagcgctttcttcaatgctgtccagaatttaacgtgcgaaggtaggcaaaattgaaattgatgggatgcattttataatcggagtacaatgttttatgtagcgagttcgaaagaattggcgcaattctgtcgccgatggttggatgaaaatgcggagaaagtcaatgcaacggaggctgatcgcttggtgggaatgatcaatcttcagtctcacaccctcggcgccatttgcgcactctatgtgaaagtgagcaataaatttatgatttcaataattttttcgatttcagttaattaaaatccgaagcgacgccgaattgcgtgattttctgaccaatttgtacgaacaactgccttttttcgaccttaagcagatccattgggcacttgatatttgtcggttttttatttggaagtttatttggggacgggacataatttcgccgccgaaatttcggcgtcgaaattttggggtgcacccgtttatttatgaattaataataaacacctttcagataatcgtttcttcgaaaatatcactgatattctgttgaagcgcaaggtgcccttgtggggcattttgctgttggaacgtgccattttgatctgttcccaaggccatcccaatcggttgaccaacttgcacgcctcgttcttctgcctttgtttgaaagcacgccatttcgacagggcggtgccctttctgcgcatcgatgttgttgaactattcaaacgagctgacggggcggcaaccggagcttcggttgaacccggcggagatggctcagccgcagctgtgggcggttccgtttcggatggtggtgataa

SEQ ID NO: 472 - DNA, 2808 bp, Heterodera glycines
  genomic virtual cDNA Sequence=SeqID_765; coordinates=1..26,183..371 ,427..608,1093..1197,1252..1373
  coding sequence=SeqID_1024; coordinates=1..26,183..371,427..608 ,1093..1197,1252..1373
  peptide sequence=SeqID_1231
ttcgcaatcaacgtcacttgcccaaggttattttattgtaaaatgcaattaccaaatcttttatttgttttttttgaaagtgtctcaaaaggaaagaaaaaacgcggaaaggggggaaatgtgtcgcaaaaggagggccagcagcaaattgggtcgggcagtgacagcgaagagggcgccgtaggggcaaaggcgagcggcggatgcatcagagagaggggcggcagcggaaattgggtggtttacacaagcgcattcggatggaagccgagtggcgagcagcggacgcaaattgcgaaggatccgccgcgactcgtccacggagacatcattttggccaaactcaggccgggccaggagatcgaggcgaggtgggtcggcaaaggggatggactcacccctttacgatgactttgccattttcagttgtcattgtgtcaaaggaattggcagagaccacgccaaattttcacccgtcgccaccgcaacgtacagactgctgcctcagatcaaactgaaaaaggacaactttgatgaggagcaggcggcacgactccagtcaagtttttccactggcgtaattggaagggacgaacagacggggagaggtgagagagaagggactgatgtgaacgtacaaagggaagagacgtaaaagaggtgcacgtcccccccccataaaaaatttaaaaagaaattcacgttacaagtgggtgggacgaattgtcgagtttgagggggcaggggacgcatgtcttggagaatacgacgctagttacaaagaggggtcttttgaattttatcaaaaacaaaaggggggccttttgttttgcaaaatttttttatgataaaaaaacccatgaaaatttgttatccggggttttagagggtcgctgatcacgaatctgacatctaattcgaggtcatttaccccaataaccccattaaataaattttcatgactatatattaaaaaattttgtaaaccaaaagggtccccccttttgtttttactttttgataaattcaaaagactcctctttgtaactagcgccgagaatactcaaacaatgaattgtctttgtttcccagtttatgtgcgggatgctcgcgctgacacttcgagtcgcaacgtgttcatacacgacgacctgaaagatgcggtggaaatgggcaaaaagaaaacacatttcatttgtaaggcgaacaccaaactatttgcactcaaatgctcataatcactttctttagttagcgttgaatcggtcggcgcattgccttctcacaaattggtcattgaagcgtgcaaagtgatgagggaaaaggtggaccatctgagagagcaaatcagctcaagattagaaatgctatgaaaacagtcgagaattcgttgttgatttattgtcttgataataaaagaaattttcagtgctttcatacaaacagagtaagggcatggttttaagggaataaaactagtccattttgaattcactttctggtattagaaaataactaaaaacacatgccccaacaacagtatcaataataaattacaatatgcttgttgagcaattacgatgaagtttcggtggcatttgcaagcctattcaatgcttccgtccttgagattgatttggtcatgtcttttttctgttctttcggctgactgtcggtcatcaccacacttggcatcattgggttaacgacggcgctttcacgcaacgcacttttgccttccccagaccatgggaaagtccaatttcggtcctgaaaatgatgattagctttgttacaaatggtcgatggttgcccaccctccgcggcattcgcatttcgtcctgcaattccgtaaccagcacattcagtcgcattatctcctggctcgtctttttgctcagctctctcaattcctcggcgcttgccaattccttctcctctttgtgtgtgaaataggaataagcgtaaaacaccacgacagtgtagccgaaaatggccacttgatggatcacttctgaagcctgaactgaacggatgctggaaattatctttttaatttaaccatattagctaattggtggcagaaatcacccccccccccaaaaaaaaaaatcagattatacgttaatttcaaaatggaggagcccatggtgacccaaaggtgtcatttaaatgtggacctgttcaagcgctgtctcttccgatacatttaccactgaagttggtgagccgaggtccaaatttttcattcgcaattttgtggaccaatttgtgatagctgaaattgacgacgattattctttggaactttctccggtgcacacacttttccctattggtattaacactctgttccgaaatgccgggtgttctttccccaatcccataaaatatccagtgatgggctttgacaactgtctggcgacgatcatataaatttggataattggaagacccatcgctgttaacaggtcgctaaaaaattgaaaattaagcaacaaagaaatgatttttactaggtcgttgcataaaaaagggcgcttttttagaaaaaaaattttataaataaaatatcaaaaataataatcataacaactgtaaatacaatatcactcaacaaaatagtttccctggaccctaacaacctttctccaacgagaaggaagtttcctaatgccgcgacggaaaaaatctgtgccgatctttgaggtcaggtactgccccaccgcctcctcgacctcggcgtcttcagtgaagcgcctacccagaagaaagttttgagagaaagaaaaaggtggtaatccgagg

SEQ ID NO: 473 - DNA, 2757 bp, Heterodera glycines
  genomic virtual cDNA Sequence=SeqID_766; coordinates=869..1050 ,1135..1293,1345..1438,1480..1554,1784..1960,2010..2186,2679..2729
  coding sequence=SeqID_867; coordinates=869..1050,1135..1293 ,1345..1438,1480..1554,1784..1960,2010..2186,2679..2729
  peptide sequence=SeqID_1099
accccccccccccccattattcaacaccgactttctccaattctttgattgcgtctcgtgccgtgccttccttttccgtgtccaatttggcacgtcggtccgcctccgcttttgcgtgtttcaccttgaaaagggtaccatttaaaatcccttttttcccatttcgcttttccatcacttcgttcgatttggccaaatcgccgcctccttcgccccttttttgcttcacgtctctgtccaacgcttccttcatcagtttggtgtgcagttggagcgcctgaaaaaattctcaagcaattttgaaagaaattttatttcctcccgctgaacttttattgtccacctgacccacatagacattggtaatactggagaattggtgtcccggcgaaaataaattaattatcacgaatctgacattaattttgagtaattttatcccggacccaaactcgaacaaagtcgaaattgaaaatgctcatacataaaaatcaatttttcgatattttgtccgagttcgggccgagattcggaattggccaaaactaaggtcatattcgtgatcagcgactccaaaaaccacagatacatgtttttcttacataaaaatttattaaaaaaatcaagttcttgatgaaaaatcatagacaaatcaatgatttttcgaattctgagctcagatccgtaatcagcatatttttttacaccggaaaactcgaaaagaaaaattttaaatttatttttcgccgtgacaccaattctccagtattacctccaaaaattttctcatgccgccgcatttcgctttgtattctcacaatcaagcaatctccgtttaataaatatatcaaaatatttttttagagagcgaatttggcgcaataccaaaatccgaagtgactttcgacacgtaatgaatgcggtcgaagaggcgaagaagcgaaaggcggcggaagtgcttcgattaccgaaaagcaacagagaagcaattgcagcagtcgtaagcaatgaaagtgaggaaagcaaaatatcagaaaaagctgcattattgtccacggcatttttttcttttttttattttaaaaaatgtccacataatctccaataatattccttgtcagatgcccctttggctatcacagctggcgatggtgctgattttaccggcaatttaatggtcgccactgttccttcaaagcctcaacaagacaatgcgaatttgcgcgctttacttccttcccgtgccaatttgataaccaagccaaaatggcatgcgccgtggaagctgtacaggtcgttcattggctgtcttcccttaaaaagcaaagttctgtatcggtttagagtcatctctgggcacacgggatgggtgcgggcggtggacgtggagccgaacaacgaatggttcgccagcggaggagccgatcgcatcatcaaggcatgttagtcacatgtatatgtaaaacaaaaatattttagatttgggacttggcaagcggacatttgaaattgtcgttgaccggacacattagtgccgtgagggcagtcaaagtggtaagagacatttaaaaatgaatgaattttttatttcctttgccgttgaagcgacggcgcctattggcaccgccagcacccctttttcagattctttttaaaaaataaaaatgccgaaaaaaaagtaatttgaataacaaaaaaagatcgacacatcaaaatgtgaataaaaggtcgattgaaagcaaatcagagacgccgaaaattattcattgcatttttgcttaagtcaccacgtcatccgtatctgttcagtgcgggcgaggataaacaggtcaaatgttgggacttggagtacaacaaagtgatacgccattaccacgggcatctgagcgcagtgcaagacttggcacttcacccgacgctggacattttggtaacgtgcgcacgcgactcgacggcgagggtaaaaaagaaagtgaaaaacggacttggtttgatgaaattatcttaaggtatgggacatgcgaacgaaggctcaaattttctgtttgtccggccactcggacactgttgcgtcggtgatttgccaaggtgtgaatccgcaagtggtcactggaagtcatgactcgaccattcgcctgtgggacttggccaccgggcgcagcatgtgcacgttgaccaaccacaaagtgagtgctttgactggcattgtttatataagggggaggagttgacctccccgaggtgggaggttgtcaaaactttcatttaaaaactccattccactgcacgcaatcatcttcaaattttcaaaaattccttcaaagctttaagccttggtcattttatgttgtaacaggatttttttgaataaaaataattctaaatgaaaataaaaatcgtaacgaattaacgccgtcgaacttctttcatgaaaaattttaactacaaaagaaaaatattttcatgagctttaacaaatacactaaattttaagtttttttcctgccatacctttggcagcgttgatttttcttttttttattcattttttcgaaattcttaaaaatcaaataatgaaacttttctggctttagtttagtttagtttatgcgtccaatcaatgaccatcctcacaatcagttttttttgccataacttatttttacgagggaagggagcaaactgtcagcggccgggaaatacatatgagttataatacctttagatagagcagagtcgacttctattatgaatttt

SEQ ID NO: 474 - DNA, 2295 bp, Heterodera glycines
  genomic virtual cDNA Sequence=SeqID_767; coordinates=934..1524 ,1569..1743,1795..1894
  coding sequence=SeqID_1017; coordinates=1382..1524,1569..1743 ,1795..1824
  peptide sequence=SeqID_1224
gacgacagcagcgacgacgaagtgccgacggggccgggcggggcacagcacgtgcagtgtcagcagcagtgatctgagagagcgaagagacgggacaaaagaacacatcgaacgatgttgacacggcaaaccggcgattattatctatgttctttttgacaatataaattgatgatagactatctgtatcatgcgttgatttttttaaatttggattgttcaatctcatcagtatcattaatttggttataaattcaaaaaacaaacaaacaaaatgtagaaagttcgtcgacaatgaatattcctccgaaatcgttcaatttggctccgattgctgagcaggaagggtgtgatctcgaccagtccgtgtcctcgtcgtctttcactaatcatcaacagattgggcaagcgcgaagaccccatcccaggggtatgccaaggatgattcggctgagacggaagcggcgggatgatcctttcggcacgctaattcaatcgaccaagaaaatgcgacttaacgaccagtggaattcttcggaggggcaagcctctggcgtagaagggactacgacaattgcgaaaaactttgcaatgattggggagagagcgccgagtggaagccataacattagcaaaatggatggtgtgctgttcacggaagacgaggaagacgaattgttgttttattatggcggacaggacgaggaggacgactcagacgcggacggatacgacgacgaatcggactcaaacgcggaagaatactacaaaaatgactacccggacgaagagaacggcaaatttatcagtttcgcggacggagtgcgcaccaacgaatatgaaaacgactcgacaagtggggacgacaatttcggtgagtttaatattcaaatagtagagagatgaatgatttacaaacagatcattacggtgacgaagcaacaaaatatggccatttttgttacgaggacgacaaagaggaagacgaagacccgttcagtttcggcaaaatgatttcggcacaaaagaagggcagcgaggacgacagtgattgacggttgaatatttttgctattgtgctaaaatccatttttgtcagtgcttttacatggtttggtgtttgtttaattaatgcaaatttaaattcgaggcaaaatttcataaatcacattttaattgtttcactgtcttgtccaaaaatttttttgttttgtcttttctgaaaaacaatcacttactctccgccatttcattttcgcaaaacgaacgaataaatcacacatttaacaaaacgtgctcattattttgtttgtaacaatttgtattttcatttgctgattattcaataaaattccatttcattttttcggccttcttgaatatgaatactcctgctgcctatgagccgtttctgttggctgatggagagaaaaaggtggtcattgagaaggacacaaaagtgccgaatgcggcggtgtttacttttaacaaggaggaccacaccctcggaaacctcctcaaacagtgagttaagttcttgttcggctttccattttatatactttcagtcagctcctcaaagatccgaaagtgctttttgccggctaccgaaacccccaccccttggaacacaaaattttgctccgtgtccaaacaaatcccgaaacaacgccaatggaagcattgaacaatgccattgaggatttggtggcggagttttcattattggaagagcgatttcgagtaaataaatcccatttagctaaccgagacaaaataattgaccatttttaggacgcgataagggaaaaacgagaagaatgagaaattgttcttgtttacggaactgattattttattttatttttcaataaataaataaaagtaaaacaaatgaacttattgtagtttcattaggttattttccttttcattttacttttgtttactgtgttttttttttgtttaatgagtgttttttccctcaattggtcgtttgatgtcatttagcagccggcaaaatttcggtgaaaggcatccgctgattggcgcggatcggtacttcaacgaccgactgacgaatagggcatttgagccggcaagtgccagtttgggtatgcgaaaataacaatttttaagctaacaataatggactattggaataacgttggcaattttactcatttgttttgtcttccctttcagcctcttctcatccgtcttcgcctcctcgggatgcttcgcatagtctgccgtctctttttgacgacatgaacatcaacagcagcggctctt

SEQ ID NO: 475 - DNA, 3077 bp, Heterodera glycines
  genomic virtual cDNA Sequence=SeqID_770; coordinates=361..615 ,661..723,778..930,978..1106,1151..1375,1800..2045,2125..2255 ,2310..2430
  coding sequence=SeqID_878; coordinates=361..615,661..723,778..930 ,978..1106,1151..1375,1800..2045,2125..2255,2310..2430
  peptide sequence=SeqID_1109
gggtggggggggggggagagggggtaccaactaaacctagcaattaagaaatctcttattttggtgatagatttctagacaaataaaaatcaaatgaacaaatgttgttgttgttaacaaaagcatctgcggtacagtacgatcctaacaaattgtcgtgtcctcgtgtcggaaaagcctatttttaaaaaaacaaaacgccaaaaaatttattttaattctttcgtcatcttcccatcaattttaattaagaaaatgaaaacaaaagtacaatgaaaagctgaatttatcctttttcattaaagaatagcaaattttatgaattccttttaaagatctgttgatactatttcaatttttatgtccaatttgcccgtttcttctctgattcgtcaacagcacggcggtggtttaggagaggaagatggtatagaaagtgggaaaagaaagtccaaggatgagtacagacgacaaaaggacttggaggagcagcgaaaagccggcacggcgccggcgatggtcgacgtggagacggggagagacataaatccgcacattcccgagttcatcgagaaaacgccctggtatgtgccatcttcaggacccacgctcaaggtaagtggacgaataacaaacaatgcgacaacgaatccattttagcaccagcggccacatcctgaacgccaaaaacagatgtcatcggttgctgaatggtaccctaaggttcattttggttacaaaacaaagggacattgtgactcattggcttattgtcagggcactaccgaacgcgtggcattcaaataccgtgacggggcttgtcaaaattgcggtgctttgggacataacagaaaaaattgctttgagaagcctcgattagtcggtgctaaatttacgaactcaaacattgctccggatgaccatgttctggtgggtgaccactttgttaaaatgttagcaaaatgaccccaattcagccatccctcgaaatgggatacgacgcgaaaagggaccgatggaacgggtacaacgcggaggattattcattggtggcagctgagtttgaaaaaatggaggaaacgcggaaattgatcagagcggaacaggtaaagccaggaggcgtaatgcaatggcaatattcaaaactcagctcaaagaggccggtgaggaggacaaaaaggcggaggaggacgaggacatttacgcggaagacgcgtcggcccccggacagtccgtggacatggactcgcggacgcgaataacagtgcgaaacctgcgcattcgggaggacaccgccaaatatttgtacagtttggacccgaatggagcatattacgaccctaagagcagatcaatgcgagaaaacccttataaggtaagcgaagattgaaggggaaagtgtggaaggaactgctggcaaaaaataaccattcgttaaaagggagtagcacaacaattttgtcatttaattgcgatgtttttgaaagtaaaattgtgggtacttttctagtttacaggtacttttaacatacatttttaaatgcctataaatgtactcatcttataatgatttttcaagtatggaattttataaactttaatattcatgaattgtttacttttctgcaaaaacctgacgctgaataaaacaaaaaattttttgttaaagatgtatgttgaaagtatactgtgaactagaaaagtaccaaattatgaaaaaaatgtccttcccgcgaattccttttagatgggtacatttaaaaaattattgattaatcgcctcaatttttctttttcagaatgttcctgggaaagaggaggaagcggccaaattttctggagaaaatttcgttcgtttcactggcgaagtggcggatgccaatgacgcgcaagtgttcgcatggcaggcgaggtgcaaaggcatcgacgtacactctttggcggaaccgacgcggttggaggcattgaaacgcgaatttgagaagcaaaagggtgcgagaaaggaatcagtgaaaaatgaattgttggagaaatacggcggagaagtgagtcgaaattgagggaagctgaagagacggggagggggaattggataaacgaattgaagagaaattgaaattttaggaacatttggacattttgccacgggaattgttattggcacagaccgaaaaatatgtggagtacaaccgaaaaggaaaagtggtgagaggggacgacagaccgacgatgaaaagccgatacgaagaggacaagtaatgggtgggaggaattgattgtgttgttcaatttgcatgcttccaatttagttatataaacaatcatttgactgtttggggctcttactggcgcgaggggcggtgggggtacgcgtgctgccaccaatttttgaaaaattcgtattgcatcggggaaagcggaattatcgcggagagaaatgaatggggaacaaagatggagcaaggggagaaaggcgagtgatgtttcggcagtgattaaagcgaatttggcattttgttttatggacaataaattcagacaaagtcacacaaaaggccgccgtcttagaattaaaaccatctgaagaacacctaagaacggaaaaaggcgaagaaagtacgaaaaatgaggatgaaatacacaccgaagaagcggaagaaaatgaggaaaagggaagcgaagcctcggaaagagagggaccaaaatcggaggaatgttcggtggatgagaaagactccgacgaagaggagaaagagcggttatacgaagaacaaatggaaaaggaaaagcaaaagagtaagacatttgctttggaaggaaattagggctctaatgcactttatgagtccaatcgacttttatgagtccgatttaacttttatgagtccaatcgattgacaatcccgggtttttacacaataactttgttcatgttcgaacaaatcctatctttttggtatcattcgaaagcacaaagtctaaataatgtaataatacgagaaaccaagagaattctaacatttcaagaaagttacaaacgaaaataatcagcaattacttaattaatcaaatctttt

SEQ ID NO: 476 - DNA, 2176 bp, Heterodera glycines
  misc_feature (1960)..(1960): n is a, c, g, or t
  misc_feature (2001)..(2001): n is a, c, g, or t
  misc_feature (2048)..(2048): n is a, c, g, or t
  misc_feature (2110)..(2111): n is a, c, g, or t
  genomic virtual cDNA Sequence=SeqID_771; coordinates=1263..1219 ,1170..1100,1051..877,809..615,567..442,384..91
  coding sequence=SeqID_848; coordinates=1263..1219,1170..1100 ,1051..877,809..615,567..442,384..91
  peptide sequence=SeqID_1086
aaaaaaaaggtcatcaaaaaaaatcggcggccgacccccttcacaaaaattttggccgacccacccccctttttaatgtatgatcttgttctaacctgctttggaaacaagacgcgcaccgatcaattctccaagcaaaactgtgagatttggcgcaagtgcattcattcggttcttcaaataatcgtgtaattgtgcgcgatattgtgccaattctacgatctggtcacacagctcgacaatgtgtatcaaatccagctcggaaatgtccgttcccatgctgatttcggcctcctgtcgcactttttcggccaattcttcgggcaaaatggcgcttaaatcggcgttttgcgcattcgctttcattccaattgctttcacgcactgaagaaacaatgtttaatgaacttaattttaaacaatgtattaattccccattaccttcgcatacgcttgagcatccgcaattagctttcccagctccggaaaatgccacccataccattcacgacaacgcatcacataattgttcaattctttgtccaaatcatccaaaagagaaacagccttaaaaaagaaattataaaaccacaaagtgcgccgcctctcttcacctggacgatcatcgtgtcaattttctcggggttaaatttcactttgtaacggccgatggaatgggcgacacccaatcgcatcgcattcatttcatgtgctgtttcttcgcccaagaaactgctgacatttgcacggattgagcgcatcaattcggaaactgcgctattgtgtaagcatttgatatccaacgaattctaaagggaaagcacattttaatgaccacgggtttgtgtcatttaaatgttaaaaacattgccataccttaatgattttgccaatttgtgtgtcgtccaccgccaatttctcagtttgatcgatgatgctttttttcaggaagcgtttcaatgttttgtccaactttccttcatttaaggccgttgcatttgacacagcttcagcgaccgttttgtactttttgaaggaaaccaattgaagcctttaaagaacggagggcaaacggagtaaaaaaacaaataaacattacgctttattatcgccacttgaaaattccttccaaatgtcgtccactttttgaagaatgctttcatcatcgagctgaattaaattaagaaatgttacagcaattaattgccaagtgaatacccggaaaagagcgtaaccggcagaagtttcaaataacactaacattctgaaaagcaaagagaaataaaacaaactctcgtaatgaataaaatatgaaaacaaagttaaaataaaatgaaatagaaaaagcagggaatcattcaaaattttatccattgaacaaaaaataaatacgtatatgtaggtatattctgctgggttagctagttgacaaaaaaaggacaagttgacctgcttaggtactttgtacagcaaaattttcgtaaaaataaaataaacccgtttaggtaataccttttagaatgttaaaataataaataaatctaaattttttttaaacaatcagcctttctaaagctacaattatttgtccttgtcttcgctcggatgaccaaccccaatgaaataatataattttgtacatctaacaaattatatgacattccaaccatcacaatcagaatatcgtttttgtttgtttaatgctttcaattgagtcatttcttcctcactaagattaacgttgaggaaatcaatatttgaagaaatccgtctcgggtcctaaatttgttcttcaaactttctaatcagacttataatcaaattggattcagttgcttgaacgaagtatacatttttttgatatcagaaagtgcgaaatattgatttttggctctattgcagttcacacgaccataaatttttttacaactttagtgcatcataacttttcaatattttngagtttttgttttcagaagattcgttgtctgcgaccactanacctggtaggcattagaagcaagccccatctctcattaaaaccactncacttttgattttggaataaattccattccttgctgataagaaaagccaacagaattgctannatatttgttaaatttcactgcactcgaatttttttctctgtacttgaatttgtgcattgtgcttt

SEQ ID NO: 477 - DNA, 2167 bp, Heterodera glycines
  genomic virtual cDNA Sequence=SeqID_774; coordinates=1919..1809 ,1759..1584,1519..1368,1323..997,954..707,651..567,480..333,231..1
  coding sequence=SeqID_833; coordinates=1894..1809,1759..1584 ,1519..1368,1323..997,954..707,651..567,480..333,231..149
  peptide sequence=SeqID_1073
aaagggatggaaaaaccaatgaattacatacgacaatcgttttcgtttcttcgagactcttaaacgagcaacgaataacaaagtaatgaagcacaatccgaccgaacgcttcgcaccgacaatgatcaacaaacaacccattctcacatcagtactcgctgaggtcgatctcgtctactccgttctcgagctcatccaactgcggaatgtccaccgaataacgaaggacaccttggacaaagaaaagagtaatttaaataatttcaattcattaagtgataatcgtcgttgtttttgctggccataatttgcagtttcaagtttcaactaacctccaagtcctccaaaaccgcgtacaaactgcgctccttcctgcgatttgtcggtgacaatttcaagtgccgcaccgaatcgtttgtaattgttagcgagccattccaataatggcgtgctggactcaatctcgtagtcagttccagtctgaaacaggtgacattcaacagtaacaatagattgttttttatttttctgctaaatgagaatataaatttggatgggtgaattacctccgggtccacaaagttcgaccggtccttctcgtcgggcttcagattaacgactttttcaccattggttgttcggaatgcgtatctgtttatgggtttgttacgctattctacttgcacttctcattgacagaacctaccttatcagatccaaattctcccaacaaatcagagtttcgatggcgcccatttccaatgctgtcagtgtttcttttaccccgtaaattgccttgttagtgtcttgggaaatctcgtcgaaaaaggcgctgatcagtttcttctccttgatgaatttaacatccgccaaagcatcggctgccaaatctatcgcttggttgaacccgttttcaccgccgtatgatatgtcgacagttttgattatttttgcctgtaattaaacaaattggaaacaaattatcccaaattttacctgtaatcgttggtcaaacatgtcggactgggcgagttcattcttaaaatcagcacttccggccaggacgaggcccaccaccgcgactttgtcgtttttgatgaacatttcaacggccgtctccgccacttttctgacgtaattgtgtcgcttttccatgcgcaaccttgcaaatcgcagtgcagattgccctccccttccatgcttcttaggtaattcgacagagaatttgtgtagcacctccctggcatttccttgcaaagtcccaaaaagtgatccgtttccgtccatcacaataaacccgaatttgttgtcgtcagcgagtagtgctaaacttttatattaatattggtttaggaggaatttgaattgccattcaatgcttcagtgtggaatttgttgtcgcatagataaagtgatgtgttcactgctttgaagggttcaaaatcgatgttcactttcttttcctttccgtcctctgtgacaatcgttccacaataaacaaccaatccattctcgggcacttaacgaatttgttaaacaaaacaaaaaaaaaatccagagaattcttcctaatccaaagttacctcttgtataaagctttaacctcgcctggactgaagtgattgcccccaaaacagagagtctgttgactcgcgactttatgttggacgctgttccaaattcgtctccaagcattttctggatacgagcaatttggtctcttggcggaatgatcagggaaatcatcgaagtaccatttctgtaagataaaataaaattagtaaggcctaaatggtattaggtaataccctttggccatttcaagtgactttataagacgcttgattttccagagctcaacattgtgatcggcttcaccttcggaagaagccattcaaataaaaagttggaagaactaatatcaaatttgtgaggttttaacagaaatacttgttccttaaaattaaattaaaactttcaaaagaaaacagagaaatcaataaaaaaaattctttatcaggggttggggtcaattccctcgtgtccggtaatcccgacactgggtaatttcgacactgagtaatttcgacactgaactattttcaaaactttcactgttttacttcattttcgacactgagttggacactgagtaatttcgacacta

SEQ ID NO: 478 - DNA, 2666 bp, Heterodera glycines
  genomic virtual cDNA Sequence=SeqID_775; coordinates=2583..2513 ,2313..2215,2170..1894,1785..1633
  coding sequence=SeqID_918; coordinates=2583..2513,2313..2215 ,2170..1894,1785..1633
  peptide sequence=SeqID_1144
tggtcgaactcgttgtgaaagccgaattaagtcattcccttcttccccaatgaattttataaatctgatttttgcggactgtccaattgcaaccacctcttccttgagctgcttctccttgttcttagaacgtatttcccttttgcaccgttcggtgagttcgttgcatcgtctgatgagctcttcccgggaaagttcctccaattcgatgctcgattccccgatggaaatgttgtgaagtgcaatggttgagctggagagcagcgaagacgtggacaacgcacttgacaaggagttcgtcgcggagcccaccggcgcgagtcccatggcgccatgggaatgttttcggaactgcagcacttcgttttgcaactgtcgtacggtcgcgttcaattccgattcacgctgcgatgactaaacaaaaacgaaaataaaaatgagaaaaataaataaatttggcacttcggccattgcggcgagcatcgcttcgtgcttctgcccgtgtctgtgaagcgtctccaccaattcgtcttgcaaatgactcttctctcgctgcaaatttaagaaagattcttccaacaatgaatgcgacttccgttcgcgttccaaagtctgtcgaagttcgtcgagttgacgcctgaataattaattgcctattgggttcaagattcggaagggagggcccgaattcccgacaattttgttaaagtcggcgtattttcgaatgtattttaaaacgggtagcgctctcgtggcatcactgccgtggaaagtactcgagttttggaagattctgcagacgttggtctttgtgtgccatttcctccttcctttgctgcagctcccttttgaacgcctcggccaattcgcgcgcgttgtcgagcagttcgttcagctgtcccacgcgcgtctccgccactctcttctcgaactttatttgttcaaactcgggcgatattgaatatttccttggggcggtgttgccgaaggtcatctgctctttcagttttgacacgtataattcgagtgatttcttttcctccctcagtcgttccgcctaattgagaatggaaattaaataaaaacaaacgacaaagacagtctcacttcttgttcagttggcacaatgctgtccaagcgttccctgagctcgtccacccgaatttccagtccaattttgtctgttttgagctgttccacctgaacttgtcccaccatttctccgtttgccttcccttttccccgtctcacttcgtttttcgttcgttccaattgctccttcagttccgttgcgctttcttccaaaatgtttttgtccctttgcaatgtttcaatctgatcaaatcatttatcgtccgatcagttccattttctctgtttgcccacctcttgtctcgatgtcgaactgactgtgtccaattggtcctgaaggtcgccaaatcgaacttccaaaagtctcttctcttcttttaattgttcaatttcggcacaatttgtgatttgatttgtcccattaattaatggcacatctgagggagaagagatttgtcttcgaattgcatccaatgggctaaaaatattgaaaatcttattttcatttaagggagttttataaaatttacccttgttcactggagtaagtgaatccgatgaatggcaattggttaccggtaaaagccttcgggatttgaaagttgtcgggattgactgcctcggcctgctcaacatcctcaaagtgagaagtgtcgtcgtcacttttgagttcgggcacaaagggcggagttgctaaagaaacggagaaaaccctgcgaatttagaataaaaattaaaacaaaaaaacaatggcaattgctttgaatgccaatctcttctcttccacttcttatcaccgaccgtgttggatggtgtcgaaagtccaattcgaattgccaaaaaacgggtgctttttgatcggatcaatgccacttttgcccagcctttcgtttggttcagaaagaaacttccgaataatgtctttggcatgtgcggaaatcctcacatcggcggggaattgcaattgtcggtcgtggtccataatttttgagtaagtgttgaccaaagagtcggagtagaacggagtctcgccgaccagcatttcgtatagaaaaatgccaacagaccaccaatcgacctgaaatattggcatatggcaaagtcatttgccggacagacaacctctctcccgtagacgccctccccgccctgtgaacgcagcacctcgggactgatgtagtcgggagtgccaacggcactcgaacatcggacgaggccatcctaagggaaggaaagaatgttgtcagtgagagacgggaaagcattgaattggttggaaggaggaacagcttggctttttgtaaggaaaatgaccattctgtatcataatctgagtgtttttatttatttttttgaaaattaagttataaaacggtcattgtcagtggggtttttggttccgtctctgcttttgaccaaccgtgttcatcttcacacacgtgccaaagtccgccaatttgatatgtccattttttgcgatcaacatgttatctgaagatgatttgaccgattagactttttgcttgtaatgctacaatgttgctttaccgcataggtggacaaggggggggggg

SEQ ID NO: 479 - DNA, 2611 bp, Heterodera glycines
  misc_feature (77)..(77): n is a, c, g, or t
  genomic virtual cDNA Sequence=SeqID_776; coordinates=1750..1652 ,1603..1537,1456..1385,1321..1260,1213..1079,1030..1008,942..783 ,733..602,499..140
  coding sequence=SeqID_958; coordinates=1750..1652,1603..1537 ,1456..1385,1321..1260,1213..1079,1030..1008,942..783,733..602 ,499..242
  peptide sequence=SeqID_1176
atccccccccccccccaatgggcctggctgaaataacatctctccacaggacacagggaaacaatgacatttctagncgtaacttttgattacaaaaacgctaaaattggtaggtgtctgaaaatgagagagacgcgagtaaaagaggcaaaatttactcaagaaaatgcgggaaattccgcagcaaaaaatgtggagatttttcaacaaaaaatggtttggtcgcgcaaccagcagctgatcacttttgcgcttcactttcttccgttgaatgttcttcgccatttgtttctgtaatttgcgcctcctccgtttgtcccttctcatcacttggcacatcattttctcttatttccaaattcgccaacttttccgttggcattgcgtcggttgtgccgtcgttcgctgtctcagcagctctctcttgtgccactcgttcacacattggcttatacacttcccaatattccaaccgacacttttcaattaactccaaaacctaaaaattaacattttccttctagagtaaaaattttagggaaaagcatcatccagtgggaaaatgaaaaccctgaaaatttagtaacaaaattaaattcaccttatcaaagccctgacccgtctttgccgatacggacacccaatttaaattttcgtagaacgaatcgagcacaagggacaaagagcgggtcaagtcgttcatgaaactggacgaactttggtcaagcgcagtctgaaaacaaaggcaaaaagagcataattttccaaaaattgttggtcacttgaaactgctcaaaatctctcatccattcgacggcaaaagcagggtccaccacgtcggacttgttcaaaacgacgaaaaatggcaatttggtccggtaaagaatggagcaggcgtagagcatgttggacatgaaagtcgtcgggttggtcgaacgggcactcgaattataacaattttgtatattaaaaaagtaatgaatgggcggcacaacgcctccaattacctatccatcacataagcgacaacctgcaaaaagccttttgcatttgtgttgaaaaactcaaaaaaacgaacggtcggaaaagaggcggccaatgaatcggtgatgacagtgccgctggcggaccacgtgaacacctcaatttggcccggggtgtcgaaaatggcgtatggtatggacccctttcgtctgtccaacaagtccaacacctgaaaagacggggtaaaccatcggaaaatggacgagaggcaacacttggttgaagcgagtgcaaaacaaattcagactggtcagaatggcaccgtttggaccgaggcctaaaagtacggggacaaaaagggtttttaaaaagcaattggaggtgcaaatgcttgggttaccgtattcctgcatgacctttttgtaatttacagtgtctctgatgtcaatgtttgctgggaatggaacggttgctgtacaaaaaacgaattgaaaaacgcgcgacattttccacaaacaattataataattttaagctcccgcgcccattaacctgccgccgggtcgagattgaccaagtaggggaacaccttcttggagtggagatgactcgccaacctctaaacgggaggttctcgagaatccaattaatttgggttaaatcccacttggacaaatgagctttttccagaaccggccattccaagcacaattaaacacggaggcaacgcagaagaagcaccgtcacagcttttgtcatcagccatttctgtgttttacttgcattaaaaatgacattttccattttcaaaaataaataagtccataaaaactatgacagaagatgaaaacaaaaaagaaaatcattaagtcatttatcacaatttaagacgacaagacaatgagcaatgggaatttgggaagggactcggccaaagtgcataatataattatgtttaatgagtgattagtgtggtaatgtgtagtggtgttgttctacaagtgatgtatttggccgggcaaaagtcgtgccgtctccgggtcaggcggagcagccgacgaatccgatcgctggtcgttttctttggtttgcatttgtagtttctgcactgagccgggtgcaatgccgcggggccttttctcctccgtcgatgaactgctcgccgagttcgactgacatgggagggaatgtcggaaggcaatgccatcattttgttgttgctgttgtggcggcaagcgtatgccgaacagttcagcgatcagactgagtttgaaggcacgcgaacttttcttcccacggcttagccgctgtttggcggccatcaatcgaatgtggtcatcgaagatgagttttgcatcaaaggacggtttggctgatggttgggaacgcattttaacgtcctaaaaatgaagggaagggaactgagaaaaagaaacaaagaaaatggcaaatacaatgaaaactaattaaaccctattaaaattacatttatcaaaaaacaaatggtggaactttcactgaatcactcacttccacgacaacgcgaagtgttcggctatcgaatgaagacacttgaacgtcctagaaggcctttaaaatttgtaaggattataaaattcgtagtgga

SEQ ID NO: 480 - DNA, 3839 bp, Heterodera glycines
  genomic virtual cDNA Sequence=SeqID_777; coordinates=3537..3413 ,3271..3107,3022..2941,2861..2742,2555..2334,1389..1082,842..684 ,631..506,352..25
  coding sequence=SeqID_1009; coordinates=3537..3413,3271..3107 ,3022..2941,2861..2742,2555..2334,1389..1082,842..684,631..506,352..25
  peptide sequence=SeqID_1261
aaaaaattgaaaaaaaatcgtttttcaagttttttttaattggtttggaaattcaaaagaataattcggcggaaagggcgagcggcttgctctctgcagcttatattggtgaggaataaaaatgaaattattgcaccgcaccttccttaaaacggcggttgcccgtcgcaccgtgcctgcgacaatgaccaccatccgagccacccaaaagaacgaaatgtcgtgtccggtctccagccaaagagccggggaaaaaagtggcgcctgtccgccgttctgtttcgggcccaacccatccacactgaaagggccacgatgccggcggagaaccacgtgtccagcacgtcctcgtctggcgaaaatggatggggtggatattattccatttttaaaccggttaaaattcaaataccccgcttcgagtgtgacggactgttcagaaacgttgaaccgcttggccgcctttgtcttcgcctccgcctccgttcttccggacacccaatacgattcttcgtcgtcaacgctcttcattgtttcccggcggtgtcgaagaatgattgccgtcaatggtgataaaagaggccgggatttggtgaccccaccgaagctgacgagaagatgcaccgaatcccttagatgatcgatttagtaacttcttatgtgattatgtttctgttccgaaccgaatgtcgttcagccacgcattccacgtgttcacgtggtattccgggatgagtcgaagtcgtccgtcgaccaccgccgctttggcccgcttcgccatctctgaagagcgcacgtaccactgcgattttatgatgggctcaatgatgtccttggaacgactgaaaaaaatgaaaaatagtaattggtgttggaaaatatcatgaaaaaaacagcttggaaagtgcagaatactcgccccacaaatatttcgtgtgcataaaattacgacatattccttgggtgttaaacggaccattaaataatttttcaaatttgtataattgctaatgagccgggttcgctttcgtgaatatcttgtgaccaaaaccatgcttttttgccacagtctctccctcacctgcaaatgcgcaattgcatcgggttttccttggtgtcccggtacagtcccatcgccttcagccgcccacgcaccgccagccgcgcgctaaagcgatgcattcccgcgaaagggccgcagcaaggcgcgcaagaaccgtggtccgtgaagatgttgatcagcggaaggccgtggcgttggccaatgtcgaagtcggtctggtcatgggccggagtgattttcaccgcaccggtgccaaagtcgggcagcacggccgagtcggcaattatgggcagccgacggtcggggaaaaacgggtgaacacagtgctgaaatgagacagaaataataaaggggtgggggtcgacgccaaattttactaacaataagggggtcaaaccatgtaaatcgatgacccttttctttttttgtttttcaaaccatacctgcgcaagagggtggtcagtgacagggtcttacgttcgactttgacccacccatggggggtcagagccccatttttctacgttcgaccattttttgcatatttttcccaatgcagaccttttttctgctattcagagcattaatgtaaggaaagagtgttgaacgtagctgagtttgaaaattttagcgaaatctaatggaaattagttaattttcaaggctccattttttacgttcgacaaatcccactcctcagggttggtcgaacgtaattagcggcactttccttgatttcgacgctgccttttctcccttttcccctttttccttcctcttttttcttcttttttcctcttttgacccccccccccccgatttcttacgttcgacacccgctgaccccttacattcaacgtcatgacctccccccccccttgactaccccttgcgcaggtatgtttctaacaacctttttttacggcaagcttttttcaaaaaaaaaaaacttttgtggaatagggggtccgaaacggtgccaacaggcagcgtagtggaaaaaatttgtaatttgaatgcaatttaacatattttgtcaaaaaatggttatagtgtacaaattttcgtaattttcagatgccgacaaaagttcgtcagttaaaagtttttgaatgatgatgataacaataagtttgttagatttgcaaaaattggaaagttatataatcttgaacagcctatttcttacccctgttttaaaaaccaatttgaaagtacatttcaccgattaatgccaattgtttttcgattaatctcccacaaaacacactttgccaatgattcgtttgtaccgcgcgtcctccggatggactgcaatggccacgtcgccgagcattgtctccagccgcgtggtagccacaacaatttcacgggttttgctgccgtcctcctccaccacttcctcctccagtgggtaggcgaacaacaccaacacgccgacctcgaccttttcggcatggcccggcacggagagcaaagtgcgaccggtaatctcacgcttttccacctgaaataaaacaaaacgttcttttaggagaatggaatcaaaatgcgatgctttgaaaatcaaaactttctcacaaatgattcgttttttaaaaaaaagttcaaatttgaattttttgatcactttttatatcttcgtcactgtgctattagaaaagtcagtttattgtacctcaatttccgaaatggctgaacttaatgcgcatgaccaattgacgagccgtttgcttcggtaaatgacacccttctcgtgcattcgcacaaatgcttcagtaacagcgcgcatgattttctaggaaaagacgatcaaatggggtttattcgatgccaaaaaatttcttaaaattttcattcgaatttattgggtttaccgggtccatcatgaacaccactcggtcccaatcgacgccggcgcccatttttttcagttggtcataaattatgtgcccttttctgaacgaataaaaaaaacgatcaaaatgaaaaaacagcgcaagtttcccattgaaaaatgaatccgatgcccgcagcactcactcgttcttccacttccacacttccttcacaaagtcggcccggccgaggtcgtgccgactgagtccccgctcgcgcttcagcttcttctccaccaccacttgggtggcaattcccgcatggtcacagccgggcacaaacagcacagtccgaccgcacattcgatgccaaaaacggaggaaaaatttttatttcaattaaatttcctactcctaattaattggagtaatagggtcaaaattcgaagggagagaagagccgtctaccgtttttacctatactagtaattgtgcgtatttttttgctgaccatcttgcgatggtgtcctcaacagcggtggacagtgcgtggcccaagtgcaaagtgccggtcacattcggtggcggaatgacaatggtaaattggccatttgggttcggagcactgaaaaacattgttcgcattattcaaacatcgcacaataatgcagcacttaggtcacttttggccaagcgaaaaagtttgaacccgttaaaaaaacaaaaaagcaaactcgagattccgtccgccgtattcgggccgaaagaaaccgcggcgctcccaccattcgtaccacgcggcctccacgtaccgaggcgaataggctgaaggcattccgtcagaaatatctgaaaattaaaagaagtggaattttgcatagcttcctttctatagtattgcctaaattcagtgtttccaggaccgcaggcagcaagct

SEQ ID NO: 481 - DNA, 2614 bp, Heterodera glycines
  genomic virtual cDNA Sequence=SeqID_778; coordinates=135..302 ,427..513,560..756,882..1110,1408..1672,1960..2188
  coding sequence=SeqID_967; coordinates=135..302,427..513,560..756 ,882..1110,1408..1672,1960..2188
  peptide sequence=SeqID_1256
gtcgtcaattaacttgtttatttatttcagacatttctgccaatttgaatttaaaaaatgtttgtcttcctaaaattacctagaaattttcgaaattgtttttaagaaaaatactttaatgctatgctattttttcacttaaatcttatatttatcaccaattggtcaaggttgaatacacgggtgccgtcgacgacattttctatgctggcacggggctgttgctgttgaagaacgcggactctgtgcaaatgtacgacttgcagcagaagcgtgtgctggccagtgtcaaggcaacaaaggtgttgaacacaaaactgggtgttcaaaattactgaaaatttgaaaaaaagtgtttgaaattgaagttttatccaacgataaacctaaatcgtcactctgtttccgcaatgtttttgctttcaggtaaagtacgtcatctggtccaagaacatggaatgcgccgctttgctcagcaaacacaccgttaccctcgtcaccaagagattggaggtggcgttgtactctttggtctcgtcttacaatcttttttctccaggtgctcggcactgtgcaggagtcgactcgggtgaaaagcggcgcttgggacgcgggcaatgaggcctttctgtacaccacctccaaccacatcaagtacgcgttgaccaccggaggtgaccatggcatcatccgcaccatggatattccgctgtacattttggcggtgcgcggcagccgactgtactgcttgagcaggttggagttgtaaattccttttttaagacatttcggaatgatctttttgcatttattagaaatttttaacttaactttttacctggctcaattttttcatcctttttatgtgatttgttacacagagaggcgtcgcccgtggaattgtccatcgatctgaccgaattccgcttcaagctggcgttgacccatcgtcgttatgatgaggtgttgaacatggtccgcaatgccaatctgctcggccagtccatcatcgcatttctgcaaaagaagggctacccggaggtggcactgcactttgtgaaggacgagaagacgcggttcggactggcgctggagtgtggcaatttgcaagtcggtttacgagtagaaaactcaactttagatgggttttgacataaactgatttcaaccaattatttttaatgacaagtttcaaactccaaggacttgaaattcttcattgaaaagcactctcatttttaattttttggtatgtgatggaatgaaatgcattaatttttgacaaaatctcattttgtattaaatgcttcttaagtgtggttaattgtaagtcgaaaataggtattgtaataagccgggttcagaagacccgttgaattttcttttattgttgttgtttttgttcaggttgcactcgaggcggccaaagtgttggacgacaagaccatttgggtggcgttgggcgaggccgcgctgctgcagggtaaccaccaaatcgtggagatggcctatcagcgaaccaaggactttgagcggctggccttcctctacctgatcacggggaaccgggaaaaattgcagaaaatgttgaaaatcgctcaaatacgcaaggatgtgcacggacagttccaatgcgctttgatgctcggcgacgcgcaagagcgcaccaaaggtactgctcgaacactatgtggttgtatttatgagtataggtgaaatgtagggggatgttggcccgactgcataccaacgaagatcaggagggttcgaaagacctccatttcatcccagtcattacaaagttactccattttcgccccccccccctcatttttatttcactcctattttggaaaaaccgtcccaggggtataactagtcacaaatacaaaaaataatttaatctcgctgaaaatttttctttacggaagtctgtaattgactgtaaaaaatttgcagtgctcaaagaacttggccaacttccgctcgcctatttgtcctccgtgactcattcgcttgacgaggatgcggaacagttgcgtgccgagttggaacagcgtcaaattgcggtgccggaaacgaacacaagcgcaactccactgctgccgatgacacctctcaatccgctggtggacaattggccccagctgaccgtctccaccgggccctttgatgcacagcaactgttggccgcgacggcggcctccagcggtggcggcactctgtccaccgcaattggaaaatcgagtgagcgaattttaaagcgtaaaaaattgcttttcttaagaaaacgaatcagaataaaatataaccgggttaaaagggcattaggtcaacattaaatttgaacaaatgctctggcgctatttaaaaagagtaaccttttgaattctatcaaaaacaaaaggggggacccttttgttttgcaaaatttttttgagataaaaatccatgaaaatttgttatccgagggttttagaggtcgctgatcacgaatctgacatctaattctaggtcttggacccaaagaaccccagggaataatttttcatgactaaatattaaaaaattttgcaaacaaaatggtcccccccttttgttttttgctttttga

SEQ ID NO: 482 - DNA, 3592 bp, Heterodera glycines
  genomic virtual cDNA Sequence=SeqID_779; coordinates=799..940 ,1111..1230,1352..1479,1851..2064,2417..2480,2747..2814,2865..2959 ,3054..3093
  coding sequence=SeqID_910; coordinates=799..940,1111..1230,1352..1479, 1851..2064,2417..2480,2747..2814,2865..2959,3054..3093
  peptide sequence=SeqID_1137
aacgtacagaaaaaaaaagttaaaaattggtgcagaacgttgagagtggtaaagaaatcagacagaagcgaaacagtgcctcagcagagaagacatagaaaaggaaaacgcaacatttgtatcttcctcattttctttcctatcaaaaaacttgcaaaaatttgtactctttagtgatcagcgacctcaaaaaccccgggtgcttggctttaggactttttaacttgaaaaaaaattagaacaaaaaaagtgcatagcgacaaaacactacgccaaaggtttatctcaatttattctctctctcgcttccaatcctttttatgtttggtcgggaatggccaaggccaagaaagaaagtggccaaattccacgcttttgacgcgccataaaaatccataaaattggcactggaagacacaccaacaattttagcgtcagaagccaataaatgacataaaatttctatttcttcataaattaatatttcaaagataagatttaatcttaatttattcctttgagaataaacttttgcttcctatttcactgaaattcgcccaatttagggcattatcttttaaaaaattgatgttccagccaggattttcagatgaaatatgccaattttagacaaattcttatttacatattttcccaaccaaatattaaatttgtattaaataattttgtagacaaattcaccacaatttgtgccttttccatcgtttaagcatttcttcttcctctgtttcagcaaatttgccgcccaatttctgacaataaaatgactgatccaagcgaaaagaaggcccagtcgatgctggccgaggcggagaagaaactgcagaaaagcagcggtgtgttaagtttcctcttcagcggttccagcactccctccgatgcggccgaactgttcatcaaagcggccaatcatttcaaggttttcaagagtggaaatgagttctttttgctctttgtctgtcctgaattcttagcaaaactaggaaaaaataagctatttttataacgaaaaattttgcaaaccaactattgcctgtaaaacggggaaaatatcaaaattaaatttgttaggcgttccaaattgtttagttagcaaagaattggaacggtgcagccggcgcatttttgaaggctgctcaactgtacgaccgggacgcaaaacatgacgcggcgatcaactttggcgaggcgggcaactgttttaggaaggtgagtgactaattattttttagataggtaaatctgaataaattttaaaaaaaaaaaagttaaattccgacaaaaattggctaacccgtcatgtttttcaattttttttttttgaattaaggttgacctccaaaaagcggtcgagtgctatcagaagggggcggacatttacctggacatgggacgcttcaacatggcggccaaaatgcacacgaccatggccgagctgtacgagtcaacgctgggcgaaaacgaagcggcgaggagcacgacggtgctcagcatccaagtggcaagtgttttacagaaatagggcgtttgtcatttatttggtacccctaactattcacggaaaatgttaagattttgcccgttatagaatccgttgtaacaggacagtctcgtacaatattttctcaggatatcctggtctggatcttgcatattttatcccggatattctcgtcctgtcctggcgggttgttttttttaattcgattcaaatcatcgcctcgattatcaataagtccatttttttagtgggtaaaatttgtttgtttcttataggaaatgtgacataaaaatattaatttttacaaaaattttcccctgtttcagtgtaaggacaaatgcattgagcagtaccaaaaggcggccgacatgtacaaaggggaggagcagcgcagttcggcggccaaatgtctgctcaaagtggcgcactacgcggccgagttggaccagtaccagaaggcgcagctcacttttgaggaggtggccatctacgaggcggacaatccgatgctgaaatacgctgccaaaacccactttttccaggtgcagttttttaataatatttttctcggcagtccaccatcaagaaaaattttgttgtttgtaaacgggtctggaaaaggaccggattttgacatttttgggccaaacttggtaatccaatccagggttgtcgaaagcgaatgcagattaatttttgttcaatttaacgaaattaacatgttacatcaattaaacaatttttatgccaaaaagttgtactagtgctaccagcagtgaaatttggaatttatattatgtttttataaacaatttttttagaccaattgattctgtcgtttgggtcctattcgggagaaatagggacggaattaattgttgttgtccaattcaggcccttctctgctccttgtgcatcgatttgctggacagtcagcgggcactgaaacgatacgaaggttggttggtcatttgatgaatgaatggtggggttcacatcaaaatcttgccaccggaatctcgccgcagaaattaaaaaaaaattttgaacatagaaacaaagtttgaaaatttttaagcattcctgcgccgagattttgtcccgcccccgtcaagtggtggttggacagggaaactcccgagggatgacggcgcgacaacatttataatttcattttcgctcataccacaaaatataaactttgaatttgtatgattttttcagaattgagcaattatttcgctgacgcgcgcgagtgccaactggggaagcagataattgaagcgatggaggtgagtgaattttatattggcacaatattcggaattttcattgtttgaagaacggggacccggacggattcaccgaggctgttcaacagttcgacaaaatcagccgtttggaccaatggcacgtcgcaatgttggtgaaggtaaggtgcaatgatcactatcgattgatcagtcagtgatcaattgattggttttttaattttccaggtaaagcgacgctgtggcgacggcggagacgtgaagaatgaggcgggggaggaggaggacgatttgcgataaaagggggacaccaaagacaaaaatattttaccaccaatatatttgacatgacacacacattcaattggacgacatgctgattgactctgtattatatgtaatgattctgggattcgaaaaagaaagtctaggcccacgaaaagaaaattttttttgaataaaaccaggaaattggagtgggccaagacttggatttatggaaaacgtccgaaaatcaattccggtaaatgttggaacttattttctctctttctttcattttcttacaattagcataaaagagtgtataccctgaataaagagaaaataaaaaccatttaattgccgttgcttggtaattgaaaaaaagtttgattaaatggtccggtaaacccaaatgttggcttactaaaagaattttaagtccatttttgaatggtcattcccccccccccccccaccgctgtcaaaagcggtggccgactccgttttctgccagcagcagacagacggaagggaa

SEQ ID NO: 483 - DNA, 3510 bp, Heterodera glycines
  genomic virtual cDNA Sequence=SeqID_780; coordinates=1901..1753 ,1698..1618,1543..1334,1210..1115,1062..940,891..727,529..338
  coding sequence=SeqID_978; coordinates=1901..1753,1698..1618 ,1543..1334,1210..1115,1062..940,891..727,529..338
  peptide sequence=SeqID_1194
tcaattaaaatcacagcttcaacgaatgaagtgaaaatgtgcaagaaaagggaaaaagtgaaaataaataaataaaaaagaataattgttaataaaaagggaagaaagaaaagattagcaaaaaaaagtaaagcaatgaaaggaattggcacaatttccgttgcaaatcgcacaaaaggcgaaaatgccaaacgaaaagaggataaatttgcaaaaatgaattaattacacgtaatgccaccacaaacaaccacagcgctaatcagaaaattaaaaaaatgccaaattcaaattttgcaggcgccgcttttcctcatcaaaaatcggtgaatttttcggcgtgtgcgtccggcgcgtcgccctgcgagtcgccgtgcgactgcaaaagttcgtccgcttcgtcgatttgctccacaaaatggcgcgtgtcgtcgggcccactaactttggggtaaagcgcctcgaaaacgcgcggcatttccgccgggtatttggcgctgaaggacgcgttgaaattgggcggagtgatctgtaagagagagacagcacgggaaaagtggagaaaggaaaaaaggcagagaaaaaggggcgaaaaaaaagtcagcaaatggccaaaagaacggccaaaagtgaaaaacagataaacatcagcagcggagtgcagacaataaggccaccacatcaaacaaaacgcaaattcaaaaatccgccaaacgtccgactgacctttcgctgatagacggaaatccaatcgaccgacgcgaaccatttgtggtttttgatgtcggcgacgccgttcttcaaattgccgtaccttttggtcaggtcgacctgcagcaggttcttcagcaggtccttcagctcgttggagaaatgtgacgggaatttgacctggaaatgatggcacaatgccaaaatctgaaaaagcaatggtccgacctttccagacacaattttctcgtaaatttggatgggctgatccgcaaagaatggcgggtagccggcggccatttcgtaaatgagcactcccaacgcccaccagtccaccgctttgttgtacccctgcaaaaagttgccgacaaattcagtaaatttgctcatccaaaaaacacgccttgctaagaatgatttcgggcgccaaatattctggcgtaccgcaaagtgtccatgtccgacctttgacccgttttgcgaatccgaagtcggtaatctgcggaaaaagtgatgccaatttcggaatgtcatatgcaaattgagagtccaattttaatggcatggcattcttgcaaaaagagtgccaaactccatcttcccccctcgggcttttgcatgccttcaaatatccgttgctatcgatcagcaaattctccggcttcaagtcccggtagatgaggtccaatgagtgcaaatactcaaacgccagcacaatttgtgccgcataaaagcgcgagtgtggctcagagaaacgaccaatgcgtcgcaaatgggagaacatttcgccaccgctgatgaactccaaaaccatgtacaaattgctgttgtcctaaagagaaggggagaaatagaaatttgaaattaaaattaaatttaaaacgaaaaacaccgaaaaagacacactttaaaggaatattgcatattgacgaggaagggaaagtcgatggcctgcaaaatccgcttttcgttcagtgtgtgttcgacctaaaggcaattgaaacgaaacaatcggtcatttgctggtcataataaaccgacctgcttcagtttgaccactttttgtttgtccaaaattttcatggcaaagtaaatgccggattgtttgtgcttgaccagcatcactcggccaaatgagcccgtcccgagcgtttttatgcggtcgaagtcgtccaaacatgaggtattctaatgaaacatttatttttaaaatgcacaatgttagaacaaaaaccaaaaagtcattttgcttaaaattatttaacaaattttgcgctgtctgtccttttgctacagtatgctgtgccgtctaactgtctctgctgcacttcgaattgttgccttttctcatttaaatccaattgctacagtaatccccgtctctctctctctctctctctttctgtttcttccttttctattttatgcccttttatgcacctaaaccacaatatccttttttacgctaattctaattctaaatccgtccatgtaacaagtgcatacaaaattttcaccatttgtctggccgagcctttttaaggaaattgaatcttagaccttgggaaagtaaaggggaaggagagaggagaggaggggagacggatagagcggacataccgtccgttagtccaaaaatagcattgcgaatgaatccctttttaaattatgtgagcaaaaataaaaaacaaacaaaaataatctcccccctttttttcactatgtgaccaacaacacaaacatttgttacttaatgtgttcctatttttggctgtctttttgttatttggaagaaaatatccgcacggaaattaatgagaaggataaaaagtaagggagaattgtcacgaataaatgaagtttggaatggcatttctccgagaaaggcatgccgtgctctttgtgcgtcacctcacctgccaattcaaaaggcgacacacggagtgcctaatggccgacttcagccaaaacaattcggcacggagattgaactcgcgtgcgcctccgggcaatgcgacggctgtcgcctgcttgaacaggtcgcatactttctgcacaaagctcttgcgctcaattgccaaaatgacagtgcccttcagaggtggccaagaataggcgtgacgaagttcgggccggaacaatggaccgtcgtcatggtcggcattggttgagaaagacgagtgttgtggaatagcatttgccgaaggggccgcccaaacggtgccgccgttgggaggcagtgacgaggactttctctgctgctgttgatcaaccctcgtggcttttagcaggggctgttgctctcccaccgattgatcaatttcagctgagaggggcggtgtttttccgtcacggtaaccactcgccatagcattctccgaaagcagtttttccgtcgcgttgtgctgaaactccgcttctgcctgtgcgggggcatgtcgtcgcacgggtgtgccggcggtaaggccgccaaattttgtttctgaaccgcacggaaggacgggcaaaccgccgaaatgcagcggcggtggctttatgttcggttgctgctccgacggtgcgttgtttttctgatggtctgacggagacaaatccgacgctgcagcaagagtttcgcattgtgaagacggcgatgtgccgccccaaccgccgtcctcatttggccgcacttcgtcaccacaattcggtgctatttctgatggtgttgttgttgttgttgttggcattgatgaagcggttgagttggcagagaaaaccaaagggaaaggaaagggtccgtcggcagagcccaaaaaagaa

SEQ ID NO: 484 - DNA, 2671 bp, Heterodera glycines
  genomic virtual cDNA Sequence=SeqID_784; coordinates=2475..2352 ,2280..2155,2104..2027,1980..1819,1755..1683,1427..1268,1215..1095 ,663..601,557..480,426..300,258..152,99..1
  coding sequence=SeqID_855; coordinates=2462..2352,2280..2155 ,2104..2027,1980..1819,1755..1683,1427..1268,1215..1095,663..601 ,557..480,426..300,258..152,99..1
  peptide sequence=SeqID_1093
ttggcccatcggaccggcgccgcttgcggccgcaacaccttccaccatcgccgggtccaactcctcctcgttgtaaatgttgtccgccatctgccaaatctgtgaacgagacaaataaaattacaaaaaatttgttttgttccagacccacctgcattatgttgtcctccgacactgaacagatcacccacggctcgttggggttccacgaaaagtcgctgattttggccgtgtgcccgccatggatgaacaacagttctttaaaaagatccattttagtccgttttgcctccactcacccggtggtccgtcctccgcgtcctctggcgactgttcgtcgccaattttgctcagatcccaaatgtgcagacggcgatcggtgcccgagctggccaaaatggtctcattgtggggcgaccattggaccttggaaaaatgtttttttttgtttaaatttattgaaaaatgcacaaattcacttgaaatatttcatctctgtgcgattcaaatgaatgcagcttcaatttcaaattacgaaggtcccacaacgcaacagtcttaaacagatttgcttaaaaatgctagcagatgcgtccaaactttgtctgccgatccggtggccaaaatgaattccgagtacgggttgaaggagagacaattcacctgggaagtaacaaaaattaatgaataattcagagacaaacaaaaaacatcacacattggcatagaataaagaaaatttggtaccgatcgaaggaccgaatcaaaatgcgtttttgtctatttctcaagatttacaattttaattttttctaagtattttgggagggaaacccatacaaattttcattaacttatctttcaaaaaatttttttttaaaatttagtgagatggggagggggcagtttcatccttataccactggttaagtgcctgatttttagcacacacatttatggactgatttttgctgtcccaatttctagcattttcggctacgagtaagatataatttccttttttccaataaaaaaatgttctttctacccttttttaacatcaatctccccccccccccccggtctccgcttgcctcggccgagtgtgcctccacaacatgggttggctttgtggagctgttcgtgcgcgtgtcccacaccatcagtttgtgatcgtcgccgaccgaaccaaagactgtgtcatgtaaaacgtgccttaatttgaaaattattctcaaaattcagttcgtaattccatgtttactaccatgccacgtcctcaacaaccgcagtgtgtgctgtgaaaatggattttgcgtccaaaaagttggcattcgcagtcgccgcttgaatgtcccacaggcacacggtcatgtcgtcggaggcactcaacaaatgaccaggcaaattgttgttccaggataagcctgatttgattaaatttgttatttaatggatgaaaaagatcacattaactaaaaaattttagaaaaattaagaaaattgtggtaatttactatttttgaaatgatctatatttattaataataacagaaccgccaaatttgtttttgcgagcttttactagtgggtgcaacgaacaaatagaatgtcatccaagacagaaacatggaactgtcctcctcccccccccctttggtttgaatgccaaaaaaccggaccgtatccctccttggtgtggccacgcagtcgcaactgcggcttgcactccacgtcagccggcgtggacggatgctaaatggacaaagtgcattaattatgctgataattgtaccgttaattaatcaacagacagaccttcgtgtagtcaaagacgtacacctccgaggagggtgatttggtgccaatcagaaccggattctgtggcatgtatcgggcccggttcacctcgccctcgtggttcattttgatttccacctcaattttgccggtcactgtgccaaagccaccaaattcgccctggaatatgattggattttagggtaaaattaatatggttgggcactcggtcagtgtcgtagcgagacgcgtcaaactgtgcgtcgtcgttgggcagtaacagtttggcgatgaccaaatgattctaaaattactcatttgcgtgcaattgtcacatcaagccaccacctttacctgctcgtccgacgtgtgcgtgcccaaaatgaggcgatggattgtgtagtcggcgccctcctgtcgttgcacgtcgggcagccattggacggtcaaactgggccattccaacgcatgagtcatcacctgaaaacgacagaataaagcaacaagacgtaccaaaaacaggaaatttgatggcttgttttaaaccccaccatgtcgtaaaggaacgggcagtttttcttccagattttgtactcctcgttgatcagccgctcctcggcgtcctcaccctgttgcggaggttgagagccaggcacagacatttgctgcaattcgttgtttatttctgttcaaattatataacagtgaaaaggctgttacaaattaatctcaaaaaatagttgaatggatttttaaaaccatttgaagctaaattcaaagtgcaagtgatcgccatttgttcacacatacaaaaaatgaatgaaaaataataataatcggcacgctttttgctacacatcattcacaacag

SEQ ID NO: 485 - DNA, 2468 bp, Heterodera glycines
  genomic virtual cDNA Sequence=SeqID_623; coordinates=2299..2195 ,2137..2072,1981..1932,1847..1688,1599..1558,1512..1474,1387..1170 ,1079..647
  coding sequence=SeqID_962; coordinates=2299..2195,2137..2072 ,1981..1932,1847..1688,1599..1558,1512..1474,1387..1170,1079..860
  peptide sequence=SeqID_1180
actttttcagaaaccaaaaaatctttttgctttttgtatggctaatagagcatgtaaagagccttcgaattataccaacaatttgggttttgataacaaaaataagtggaaaaaccgttactttttaaatttcagttttgctgaacacgatcaaaattccaattaggaacgtggttaatattttcgtcagtaaacattttcgtcagtgaaagttttcgtctgtgtactatttttatttatttcacagttttccatttttttcgtcagtgttccaattcggcagtgaatattttcgtcagtggattcataaaattaaaatgtgcttcatttttggttaaactatttaatacagtatttatcgcttcttgcgtatggtacttctaagcaaaataaaatgattaattgtgctttaataaatgatttacataaaaagaaattgtactttaaaactgttgaatattattagtaaatttacttctccaacttcttatctcgccatcgttcccatgcgttctcgagtgcctatttgcatatttgcttagtccttatctagtttttgcaatgcatttggcacttggactttcacgcacgaataacagccttgaaggctggcatgcaacgtgttgtttcatatcactatatttaattcataatacagagaatttaatattacaaatcaaatagctttacaaaatttttggtttaaaaatgtgtgattaaatgtatggcaaaactaaaaaaaaatgaaagcaaggccattggctgtgatcggtcatcaatgggggataaagtcaaatcattaattagtaagcgatgggcggaaaacaaagcggaaatgaacatttcccgcgatcagtgatcagacaaagtatttgtgctgcagacattcaaccgcagtcggccgttcgtgcggattaaattgcaaaattgccgtgagcaactcaacaccggaggcgggcaaatattggggcatctgattggcaaacggaggtgttatgtgcggagagttttcggcgtagaaagaatgagggacaattgcatcggcgggccaaacagagacggacggagtgccgagttttctgaggggggggggagaaatattcgactcgacagggcaataaaattgaaaaaaaaaaattttttgcggcagcattttttgaaaaactcactcaaaaatgatgcgcaattgctccgcctccgtatcccctctgaagagcgcgtcgcgcgtgtacagctccgccaaaatgcaaccggcggaccaaagatcgaccgcagtaccgtacttgcactggagcagcagctcagggctacggtaccacagggtgaccacctcggtggtgaaggtggcatgcagaccgtagttccgagacagtccgaaatcggcgatctgaaaacagagaggtaagcgaattaatcatttacaaagcttttccgaattttgagcagaataaaaaaataaataaatttactcacccgcaaagtgtggtctttgttcaccaaaatgttttgaggctaaaaattgggggaaaaaagttgtcataaggacgccattgaaaccttaaggtcacggtgaataatactgttggcatgaaggaaatcctaaacaaaaactgacataaatgaaaatgtcagaaaaggcaattaagtaattgctttcttaattgtcaaaaacaaatcaattcctcacaatgcccgtcattatttgacgtgcaaaatatttgcactgcgcgtcgcacatatttttcggaatttttcgcaaaaagtcgcacaagtcccagtcgcacttttcgcagacgatgttcaaactgatggtgccgccctttcggcgaatgaatgcgtcgtggagccttagaaaagaacacagacttttaattttttacttttaataatttggatgtgtgaataattaaactgcaaaaacagaaatttgcctgagaatatttgggtgtttcatctgtttgagtgcgacgagagaagcgacctgaatttgtttcggtgattttgccatgcaaaagcggtttagtggaaatgccatccgaaagaagcaaaaacggattcactgcctttttacctctctgacgacactctgcggaattccctcctccgtcgctttaacgggaatttttttcatggcgaacttaaacacgttcagttgaacaatcagcagaacgacttctcccccgcccttccccacctgctctctctcattttctttgctggtcaccaaccaaacttcgccgtacgcgccttggccaagtacgcggatcgggcgataatcctcgtcaaccggtggccgcattctgcacaaatttaaaaattttcgcgaacattttccaattcttcaaagaacccgaatatttacatcgattgccattgcattactttgaataaaattttgatgagttcaaaagtgtataaaatcattttgcaattatatcgaacaaaataaaacgcacaaaataatagaa

SEQ ID NO: 486 - DNA, 1399 bp, Heterodera glycines
  genomic virtual cDNA Sequence=SeqID_626; coordinates=1..161,254..445 ,519..649,701..790
  coding sequence=SeqID_989; coordinates=1..161,254..445,519..649 ,701..790
  peptide sequence=SeqID_1204
atttacctttttttgtttcacagaagcgccccttcaaaacacttcgctgtccgtgccaaattcgacttgcgccgccttcgactacttctccctcttcctcccccagcaggacttcttccactcctttggcgatgggtcggcctcttccctggccggcgaaggtccgtccaattcagtcccaagcgggggaggcccttacttctgtgaagggtcggcctcttcctctgcctcgtccgcctcgtccattcctaccttttgttctactggttattcgtcctcttctgccaaaacttccgccgcttcgacttcgtcttcggcggcggcaaaatcgcaagaccgaaaaaggccgtacctgtgcccgacttgcgactcgcgattcggttccaaaatggaattggaagagcatcagaactcgcacaccggattgaaaccgttccaatgcgatgtaattttcaaacatggccaatttcaatttgcattgaatgcccccgccccctcccgcccctccccggctaaaggtctgtcagtcgcggttcaatcgacgctccactctttggaaccataagcgaattcacagcgacgcgaagccgttcaaatgcacagtgtgccaaatgcaattcaaatggaaaaattcgttgaaatgccataagtgggaaaagaaagagaagagaaaagcacacaaccattcccacccaaacagagaaatgcatttgcgaaagaacgaattgagtcaggggacaatgccggacacggactcgcagcttctcacttatgcgacggccgcaaaaaagacaatggttcgcattttgctgctgtggcccattaattatggtagcctagggatcgctctcttctcaaatggatgccatcggtgccgctgcgtcgccctcggccgctgtgctgccccctccggcgatggctgtgcttccctactcggccgccccttcgcgccttttgacatgtgccggaactccccggaagagagcaccgccaaagagcgggggaaacggaaaaggactcaaagttggcaagacgaacgatccaatggagcggagaaaggacggcgaaggggcggacggaaacggcacaacgcaaatcgaaacggtggcggaaggacagctaacgcaattcggcattaatttgttcggaattggggaagtggcggagatgacacagctgaagaaggagtcgaaatacgcgcagcagaccgaagagattgcggcacttcggagggagcaggcacttcaacaacgccaacatcagcagcaaccctccgctgggtgaggggggggggggggggaaatgccgagttagtggggatcaatttgagttcattttattgcgtggtgagccgaagcgaaaaagtatggtggatgtgctggttttggagggaagggcc

SEQ ID NO: 487 - DNA, 2208 bp, Heterodera glycines
  genomic virtual cDNA Sequence=SeqID_630; coordinates=1097..888 ,830..792,720..661,615..364
  coding sequence=SeqID_997; coordinates=1079..888,830..792,720..661 ,615..508
  peptide sequence=SeqID_1209
atcatagacataagaatcacagaaaatgcttgactgctccacacaggacgcgagtccaatctgaaaaaaggttcgtccgcctctttagcattttcgctttacccacgcgcccttttgcggcagaaaaagaaagtaattgagagagaacaccaaaacggaagagcaaatgctggccagcacatagcataacaaagtctgcttgttttcttcataaatttggcgttgtccgcgcgtcgcccgcttcgcacttttctgctggttcatttccttgcaatttgttttgttacggttttaaataattcaaaaaaaaatcattgggagatccaattgcaaaacgaatgaaagaagctcaaaatgaaagcatagaacaccagtttatccgagtcatattgagggcaaaagctgaaacaaaggcgaaacaaatcaaactgcgcaatcaatggaaattgtagaggaaaaagaacaacaacaggttgcaaatgtccacgagagaacggcttcagcacttcaatgcaaaacaagacggaacacttcattcgaaatgaaaaatcccccggaagaatttggtctcagaatgaagcagtggttgaatgaattcactgggtcatcgtcggtctaaagcaaagaacagttgaataaataaaccactgtaaaggacaccttaagctgaccaatcaccgtcaccaaaattgacccatccggaagcggctgactgtcagtctgaagttttattggttaataaatttccaaaccgaaaagaatgaaaggcaaaagactaatttggagaaaacctttgtaatcccatgttgaatcgttcggaaaggtagcgcctaaatataaaaaaaattaacgattaagtaaacataaagcaaaaaacaaacacttactccatatttgtccaaaatggcctgtcgacctttcacttggttcccctcaaaagtcataaaagagtgttcagcatcatacaaatcatgaaggccgacggtgcgagtcggaccatcgggcacatcaaatttggtgtaaaagtgttggacaaaggcctgcccaatggattcatagttgggattgtaagtagccatttgatatggttatatgtaactagaggagcaaacaaatttagagacttagtttttgaaaaaatggaattcttaagaaaaatgcaccaaatttgtggaactcgacaagtatcattaaagcaaaatgcgttttatggaaatcgcaataggtgcctaaatatgtagacaccaaaatgtcaatccctaaacgctatttcggaagccaatttccaatattttttcagccgtcggaatgccgattttcgaaatttttgcaaaaaaaaaagccgaaaatttacaaaatgttcccttgtaagttttgatcaattgtatattggctattaaaatttttgaaaagaaatttttttcgaagcaatgttaaaaaacaaaatgacgcacaagacatggacggtaaaaaacgaaaaaaattgccaaaaaataattggcgtaaaacaaaacgccaacacacgcaaaaacaaagtatatgcacttacactggtaaatgccttttttgtattttttattttgatcagccataacacgcttcattcccaacaaaagtgaacaaatttgatatctaaaaaaagattttgaaaaggagaatctttttctaagtgaatgctaagcaatttgacatctcagaaaaaagttgtgatactttcaaatttttatcacgttataactcaagtcctaaactgctgttttcaccaaaaatgctaaaactattaatttctctattaattctaaatgtcctaagcgattttgtacccttataaccaaaattattagaattttcgaatttatgtttttccatgtgttagagacatgaaaatagtacgccaaaaagagagaaaaagtaatgcattttcatgttttatatatatcttttgaaaaagtgtataaaacataaaatggctgcattacattatgcagaatttttttctcaatcgattgcaaaatttggtgcaacttgtatgcatagaaaaaaagttatatggagagaagtaaatgtagttttttacattattaagaatgaagagatagtacgtaaaagtgagagaaataaagataaaaagtaaatgtgactgaacgccaattttttccataaaaagatttattgtcgctttttttttcttttttaccgtccatgaag

SEQ ID NO: 488 - DNA, 1622 bp, Heterodera glycines
  genomic virtual cDNA Sequence=SeqID_637; coordinates=607..770 ,888..1025,1086..1145
  coding sequence=SeqID_831; coordinates=607..770,888..1025,1086..1145
  peptide sequence=SeqID_1071
ccctatagcctgtactttaattctgcgttggatttttgctctccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccaaaggaatggatttaattaaattctctccttcggggatttttttccattaggtcgtccgttagcgttcaattgctctagtcaatttttaaaaatttttgttgaaatatttgtcgtgctctgaagggcggggggggggggcctcctattccatctattttaccacaaatgcctttaggagacggtgcaatcgtcggcaaagtgcgcgatggacgcgctgattgccaaagtgaggccgtccagctacgggcaacggcgcaactactccagcattgacatttcggcggagaaatggttgatgcactacgacgccgactcgttggccaaactcgagaacccaccgtcactggcggacggaatcaatcgcgaattggagagggtaaaacggggaagaattggggggccaaaaaaacggggaatagggatttagtttcgtagacattttcgaagaattttatcaattttcattgttaaacttccattaccctgtgtttaggacattcgctatttgggctgtgaactgatacaatcgggtgccattctgttacggttgagtcaaacatcagctgccaccgcacaaattctcttccaacgttattactacctcaaatcatttgtgcgctacaatttcgaggttttttttgttgttgttgcaatttcagacaaattcggtgtattttgcatttttttttagcacatggtccaagcttgtctgctgttggcaagtaaaattgaagaagaacctcgaaaaccggtgcgtttttattttgttgatggaatttttaggtataaaaacagttaattccatctttttaaagccctcatttcagtgatggttggtctgaatttggcagttattctgaattcctaggattttttgagcatccaaaattctgtgttcctgaatttttttaggttctgaaaccactccagcccatttggtcctaacaaattaaccttaaatgggggggggggaggaatcaaattttcgttttttttttctttcaataataattcccatttccccccttttaatttttcgggttcagggtgacgtgctcaatgggaaccaaccccttaaagcaaacccataacggaaaaaatgcggccccttcccaccaccccaaagatttggaaaaccggaggaaaaagaaaacaattttttccccttaataaggcagggatttgcgcgcaaatttgttgtcaaaaaaaaaaaccccaaaattttttt

SEQ ID NO: 489 - DNA, 1938 bp, Heterodera glycines
  misc_feature (33)..(33): n is a, c, g, or t
  misc_feature (1915)..(1915): n is a, c, g, or t
  misc_feature (1917)..(1917): n is a, c, g, or t
  genomic virtual cDNA Sequence=SeqID_644; coordinates=778..992 ,1116..1204,1249..1399,1442..1717
  coding sequence=SeqID_922; coordinates=804..992,1116..1204,1249..1399, 1442..1657
  peptide sequence=SeqID_1147
ttggaaatgccaatttgttactcaattagttgncagaaatttcctcatgagattcttgcctgtttgaagttttaacattcttacatatcacatatatacggatttgtgtcaaccataaaataatttttcattgttttgataaaaatattggttaatcgaaaattttttttttgcgaattagagttttaaaatttaacttacctatataccttttagttcaattttatattatgattttgtgtactgtagaattttaaaaaagttatgttattctgtttattgtgaatttatattaaagattttttgcattggttttccaaaaaaatcgttttagcgagtcactcatagtctggatgaaagattgggcgctatatgcaaagtggtcaatttttaattttatcaaaaagtaaagggggaacccttttgttttgtgaaatttttttgtgataaaaaaccatgaaaattgtgttatccggggttttagaggttgctgatcacgaatctgacatctgattcgaggtcatggacccaaaaaaccccagggaataaattttcataactatatattgaaaaacttgcaaaacaatagggtaccccttttgtttttactttttgataaaattcaaaattgaccaaaaccgttttgctcgactccccgtcttacaagaaacatgaacctgtaatgtttctaaaacccgtactcaggtcctcccagcttcagtcatggctttaaaaagcgctaattaccaacgtacatacatattcagtttttaatcactttagaaaatcatattaaactaaaaatgggacgtcgtcccgctcgttgctatcgctacattaagaacaagccttatcccaagtctcgcttttgtcgcggtgtccctgacccgaagattcgcatttttgacttgggtaggaaacgcgcaactgttgacgagtttccatgctgtgtgcacatgatatcgaatgaaagggaacatttgtcgtctgaggttaatgttaacatttgctgtaattttaagaaacgaatgattttctattttgcctcaaaaaggtgctacaaactaatctatcaaatcctatatacaatttgattttgacaatttgatgtttaggctctcgaagctgctcgaatttgtgcgaacaaatacatggtgaagaattgcgggaaggacggcttccacatgcgcgtccgaatccacccgtaaacatctatcggttgcattccaatatcattttgctttccaggttccatgtgattcgcatcaacaaaatgttgtcctgcgctggtgctgaccgtcttcagacgggaatgcgcggcgcctttgggaaaccccaagggttggtggcgcgtgtcggcatcggtgatatgctgatgtcggttcgtgtccgtgaccaggtaaatctcttcccttggctttcagctttattttctttttagcatcaagcccacgctcttgaagcattccgtcgagcaaagttcaaattccccggccgtcaatacatcgtcatttcgcgcaaatggggcttcaccccttttgaccgcgaagtttacgagaagcaccgcaaggaagggcgagtcattccggacggagtcaactgccgattcctcaagcaacacggaccattgacggaatggctcaaaaatccaatctgatcaattgtacgacggatatattcccttttatatgctttgttgattaaattgttggatctatacattcggattgggaatgcgtcaatatacaaaatgggcatgggactgcgtgctttctgtctacgacaacatatatgaaagggggagggtcaaccgaaattcttgcggaggtctgggggggtcagcgctttttctactcagcaaaaacttgttggaatttttagtggatttcctaagaaaatgcgggctctatgcctntntattgagtccaatcaattgac

SEQ ID NO: 490 - DNA, 963 bp, Heterodera glycines
  genomic virtual cDNA Sequence=SeqID_653; coordinates=341..466 ,516..612,694..825
  coding sequence=SeqID_869; coordinates=341..466,516..612,694..825
  peptide sequence=SeqID_1101
aaatatgtacaaaaaaccccaaatatgtaaataaaattttttttaatggtattttttgggaaagaaaatccccgtaaaatatgaaatagccacaaaatgacataaaaattactttttttggtatttttaggcaacattttcaaacttattttttctttataaattttcaaaatatgtaaaaaaatgaaaatatatatgaaaaaaatccaaaatatgtacaaatatgtaagaaaatcccgaaatatgtaaaaatatgtaaatattgtcccaggtcccggtcccgtggcactctattaaattctataactcaatcttttaagcttttttcgtcaattttgacatgagttcagaatcggacgaacagagtgccgatgttaacggactctgttcgcaatcgcttcgatcagatgaaaaagtgtgtcccgacccggacacaattaaaatgtttattggccaaattccgaaggtccgacgaaatttatgaaatgtttaaataataaatgcgttcttttgaggcgtgggacgagttgcaactgaaggaatactttgaggagttcggtccgatttatcagctgagtgtgctgcgggacaaagagacggcctccagccgtggtgactcacccccccccccctaattaattaattataataatcaccccaattaattcattttggagccaatttccaatttaggctgttgcttcgtcacttattatcaccggaaggatgcgatcagtgcccaaaatgagcttcacaatgtgcgcactttccccggactcagtcacccgattcaaatgaaaccggcggatgtcgaaaacaaaaacggtaaggaaaaggcaaacttcacgaaattagtgacaattaatttaccagtgacagttccgtaaccagaaaatttcaaagggggaaatccaaagacttctgttcttcgaaccaaatttttttgtcatttttcaaaactca

SEQ ID NO: 491 - DNA, 1310 bp, Heterodera glycines
  genomic virtual cDNA Sequence=SeqID_670; coordinates=692..651 ,546..451,327..166,86..1
  coding sequence=SeqID_976; coordinates=692..651,546..451,327..166 ,86..1
  peptide sequence=SeqID_1266
ccgcgaagtggcagaatgtgcttggccatgtccgtgtgggcaatgcaaaagtcgtagtcgtccatgttgaactgacccttgagaatctgaagcagtcgcacaatcaacagcaaattagcgattcaccttcggttcaataatacaaaaatgtcccttttggcccacctttttgaccatttccggcccaattgcaatgtccgctccgtttagcatcacttcctgttgcgcttctttggtgccggcaaatgccaaaatggtacgcttttcagagtgttgaaaaggatgcggaaggacaaccaattgacgcgaatctgacacgaatttggtctgaaaattgcaaatattccgaagaaaaacaacaaaaaaaaagtcaaagtcgtgcccatcacgaaaactttctgtttacgagtttttacatagaaagtcatccaacttttggtcgtttctcaccgctttttcggtggtcatgttcagctcaatgcgcagctgcaacagttcatccgatttgccataaacggaaggcgaatggtactgacggatgtacgactaaaggaattgccatgtctaattgtaacaatttgcggatctttcccatgtgatttgtccttccaattccaattgccccctttttctcgccctccgtcttttaccaacgcagtcgcaagcggaaggaattggttgtgcatttgttgtgccgtgtaaatgccaaagatcggctttgtctcttcttgctccgctattttcttcgcttccgtttcgtcgtaacgaccgatcccttgcagagagatggacttcctgcagtttttgggtcacactttgaatttttaagcaaagtaatattacataaatccctcgggggttaccttttcgtggtacaaccatcattcttccttttggttgctgtaaatgccctccttcttctcacagaccaaactcgaggctggcttcccccactttgacaaaatggaacaaatatctcatgagcccttctcaacccgcgacgccctttccacgacagacagtggggcctttgcatatttgacgatgccatcaaatttggaggcgaagttggcaaatggaaaacgaaatccccgccatttaattgggagttttgaccttttcagttgagtatgttctgtcacaatattttcttccaacccatggtccctgctttggccgacaaatatcccgaggtgaaacgaatagccaataacttatcgattttagagatggtgtctttttatgttaagcacgtggccgcttacggttgcggaattacaggactgaacgggggacaggcgagtgccaac

SEQ ID NO: 492 - DNA, 1666 bp, Heterodera glycines
  genomic virtual cDNA Sequence=SeqID_702; coordinates=1502..1363 ,1302..1082
  coding sequence=SeqID_909; coordinates=1502..1363,1302..1082
  peptide sequence=SeqID_1136
aaaaacaagcactggtaagaatggggtctgagtgaaaaattagtgaagaaaattggagtcaaagggaaaaaataaaaaataataataaatatattctttaaaagtaacactgcccaagtgtgcaaatggcctaatggttagtctccttgactttcccttcttctttcccctggttcaatccctctacagaattagattattttcattttttttttgtatactcgtgggtttcctataaagaaaatatgattcctcatagttttttttaaattgatacatattttatcattttttaaatgaaaatcctaccaattgaacttaataatcgcaaaaaccaacctttttttgttgaaaatctgttaacaaatcgcattaaaaattacaaaaattcccccccggcggcgcctatcgcaccgccggaccccttctttcccaaaagttttttgaaaaagcgctccgaaaaaaagtgatgtgaaaatcaaatctgaatttctattaatattcgatgatttagtccaaaaatgattaattgtttgaaataattgaagaaaatttgtttgaaaattttcattaatttaatttattataaaaaaccaaataattttgtattattttcacttgatataaattaaaatttgaattttttttttaatttttaaaatttttttgaatttttaaaatttcccggttggtcccggttcacggtttttcttgcggtcccggtcccggtccccaaaaaaaatcgaggtcccggtcccggcttctcaggtcccggcaagtcccggtcccggttttggcaaaaattcccggtcccgtggcactctagtgtaaaccttttgaaaaagtgtctgtctgtcggcggttcaaatttaaattaacctaattaaattcatttgcaacaatagaaattttcatttgatgaatcactctcgctaattcaaatataatattttttaattatttgaaattgatttttcatcgcaaaaaaataaaaaatttattttttgcttaattcttttctatttgatttttgcattcaaatatataattttttcagctagccgctttacaccaatcaccacacctcaatgtacacgccgactgagcacgcccactgcacatcgaagcgccactgggttccgctttgcacgtccgtgtgccggagggagcgcaacagttggatgtaggcggatgagaagcggtaacgggtcggatttggcttcgaattgttgtgcaacgacgaggatgaggatgatgaagtgctggtagtggttgtggtggttgagtgatcagcagatttttctgtacaatttaaaaattaataagtatgcagccatcccagttttcaaatagcttacgtacttgtcgaaggttctgagcacgactcgcgcaaatggagataaccgtcaggccgaagccattgaagagcattggcaacaaattgtaccgcttcctgatcagccaagtacatcaacaaccaattagtgaaaaccaaatcaacactagcaaaaaaatgaaatgagaattgaaattgaaaatcatttaatgtaaaaaatcatttaatgtaatacgtgtgtatcaatctcaaaattattattattatgtcaaaaatagatttcgagaaaaagtgatcaggtcctagtaaactagaaattaaattaaatgt

SEQ ID NO: 493 - DNA, 871 bp, Heterodera glycines
  genomic virtual cDNA Sequence=SeqID_703; coordinates=531..205,143..1
  coding sequence=SeqID_949; coordinates=531..205,143..1
  peptide sequence=SeqID_1252
tgacctccatcggcttcatgttcagcacttttgtgatgcgtccttgcatgataagaaagtgcgggttgttcacgtttatgccgacttggcgaaacatatcggacacacgttggtttgtggcagaagtgccgttgatttggtagctgtttttcccgttgatgataatcttgcaataaattgacattatttaaaagtttaagttacaatcacctgccgtctcacgacaatttccttatatttgttgtagccagcaggctgtttatcgggcgggacgtcgttgtcaaaagtgatcgtaacagttgctcggctgatgccggcctggccttgcttgtacaccaactcgttgagggaatgcactcggacctgggcgaggtttgtgatgccaagcaggaagcatatggcatccaaaatgttcgatttcccagaaccgttgagtccggtaatggcattaaattcgggatccaaatctctgactgcttcatgctgtgaatatgacttgaagccctcaatctctatttttttgattctcatctatttaaaaaaaatattatagttaaaagacaaaaatttgaacaaacatacaaagtgcaattttaagatgcttgatctccttgtttgtttgggtctgttgttttgcttgaacttcgaagccaaaagaattcaaaaagaaaaaaataatgccaaaaaaatttggctaaatgttttaaattaaaatagaatacgagtccaacaaaaaatcattgcaggacagaatgggaaaacaataaaagtgggttggtttcccgaactgaaatcccagctttatctcgttactaaaatcccatccgcaaaaaaaaacgggtgtttgggcgttttgaactaatttgactaa

SEQ ID NO: 494 - DNA, 1307 bp, Heterodera glycines
  genomic virtual cDNA Sequence=SeqID_705; coordinates=149..366 ,417..516,1027..1102,1162..1307
  coding sequence=SeqID_1003; coordinates=181..366,417..516,1027..1102 ,1162..1201
  peptide sequence=SeqID_1214
tacatttatatgtttttttctaacgtaaacagtttatggcttagggtaatactttttcttttgggtttttctagttgtgtaaacttgtgtatggatgagtggggtttacctcaatagttcttcatcattatcatctccatattatcttgagcaatactccctttttcccaaatcttacaaatgaacatgaatcaacttttggttggccgttcgctgttcccaaaaatcatccgccctttctcgcacaccaaaccccttgccaagtctgaggctgacccggatgattacggctacttcccggacccaattgaacactcgtggggtttggagaggaaaatgctcatcgctcgtctgaagggtgacgacgtgagcaaatttttgatttttactattttttgtaaattttaactttttagcgctatgagccgaaggtatatttccgcgctgaacataccacccgggactatccgaatttggtgccggtccatttgcaggacaaagtcgtcgggtgcctttgtaagacagatttaaggcgtaacttttttattacgcattattagtatttattttattaaaattataattatggcgaaggagatcaaagaaagaaggaaacgaactggaagtcatcaatgcttaaaaaagagcatgtaaaccatttttagactaaaaagtgaaaatcggaaaatttgagcttcagattttgttcgaattcggacccggggttcggaattgttcgaaaaggatgccagatacgtgatcagcaaccccgaaaactccggaaaattttcgtggcttttgaaaacaaaaaaatttttttcgaaaaatgggcgggggaccagccttaaactattaccaaatcttttcatcaattattaaatagagtgaaatacgtaccattattaaaaaagcaatctacttccaaagggttaaaataaaatacaacattaataatttgtaattaaaaaattcaaaaagcactcttttaaagtagcgcccatattttctttattcttgaaaattaaggcgagccggacgcggagtacgtgaactattggcatattaggaaaggccagatgaagcgatgcgagtgcggacattggtgagttggagaagcgcattcgaaattcaaacaacgaaagcccctttcctttcctttaggtttaagggcgtgcaggccgaccctgacagtttcgcctgaatgcgatggatacgaattggctttgaagtgataggagatcatataaaatgatcagttattttaatagtatttctaagttggttggataaatgtaaagcatagtttc

SEQ ID NO: 495 - DNA, 1382 bp, Heterodera glycines
  genomic virtual cDNA Sequence=SeqID_707; coordinates=1270..1220 ,1153..1115,1060..872,826..665,605..441
  coding sequence=SeqID_942; coordinates=1270..1220,1153..1115 ,1060..872,826..665,605..441
  peptide sequence=SeqID_1165
aatgggtgcgttatatcggacgctccggcttatacgcaatgagatgttaagctagcaataaatgtgactcttgtcgaactaattaatgcattcccataatttgaaaattaataattttacagatatgatttgttttttatccttttgtaataaaccaaagaaggaactctaatcaggggtcagtttctccaataggaatttcagaatttgataaacagattttcccaaaaagccattgtagatttttgaacaagttttaaaaatataaatttgggtccgatttgccggtagagcacgtcaagacaaattcagattttgagtcggtttatgaaaaatatatcaagaaaggaatatatccaacccctttaatcaaattgtatagtttggacatattggtcagtggtatttgctcctttcagtcaatatataatatgtgattttcactcgtccatgttactgccatcattgggagtttcgctgctgctttcgttctccaccggtgcattttcattcgttggatttgttcctctacccgtgtccacgacatttgatgtacccgccgcgttcctttcttctgaatttccatccgaaaaagacatccatgactaaatataggatgttttcaaacttcgtgactaaattcccaagttgggccaagacttgcctgctcgacaattgcctgaacccttttttcgtattcacgtcgattctcctgataaagctgcgctgctaatgagtttgcaggactgttcgggttgggttcgtccagcagtgattggatggaggtcaaaattgcagccacatcataagttggtgaccattggttcttaaaaaaataaatttaaaaaattccgttaaagacaagattaacctgtaaaatatccagacaaatacttccatcggcgtaaacatttggatggaacattttcgacacaaatttgacggttggtggcttgttagggtattcttcagtaaattcgagtgtcaatttgaaagttccgtcttcaaatggtgtgtcctgaggtccaaaaatgactgcttcccagcgcatgatcgattcctaaaagttggacgggtcttcctcacttcgggggatggcaaaggcaatggcaacctctgtcggtgctccgcaaactccggcagggggatcatcctggaaagagaacaaacttattaaactcaagttgcatatgagctgtttattacaaaaaaaaatcacctgtaacttcttaaaatcgcgcattaaacggcgtctcgacggagttgtcattgcatttgttattaaatgatctcaaatcagcttaataaaaaaattaaaattaatgtaaaaacacaagaggatgcttttgccgttatttttctttttttaagttcactatccg

SEQ ID NO: 496 - DNA, 1993 bp, Heterodera glycines
  genomic virtual cDNA Sequence=SeqID_666; coordinates=1..112,207..360
  coding sequence=SeqID_1004; coordinates=1..112,207..360
  peptide sequence=SeqID_1215
tacgatttattcacccatttcattttttgccagatttgtcgactggttcagctaccatttgtcaaactttgagtatcgttggtcatggagtgattggattgaatgtgtcgaggttcgttttttttttttgaaaaatctgttccattatttcgatttttaattttcttaaacctccctcccaaaaatgtttttttaaattttcacagttggattcattgcatccaaagcgcatttttgtacgtgaagtcattgaaaagtgtttgcgcttttcataccacaaaaaattggtcgaatttttgccctcagaattggcgccgatcattccgggcgagctgaacatcatttacattcttgacgaccgtcagtttttgcatattacccattttagaaaccttggtgtagtaccaatcaaccagtcatgccaatttccaatggaaatttgtttttccaatacaaaaaagggttccagttttcagttagctatagtttcggtatcagatagtccattgtggctgcatgattcgcgtccgtcaaaaccctggcggtgaaaaacaaaaatgcaaattatttagctgatataaaaaataaattgtgccatttaaagcaatttatattttttgtatatttgtataataaactaaatacataaattaataatattccttttattttaaactttacccaccgcgagagcgagttgagcaagcgacgaaaacttggaactatccaaaacaatgagaacataaagcgtgacatagtcctccgaacaatgtaaaaaaaggaagaaattgcgcggcaacagcaatgaatgattacggcacaaatacgcacagacttttgttggtccaaatttacggtctgagaatgtggactccaaattctggatggaaaaaccataaattatttattaatatttatatttttatatcaattttggagcaattttaccaaatttaagttgaaaatgatagtttaattttaatattaaaaaaggtaattaataaagctaaagccatgtgaagagaacgctttgtcccgcatttaactgcgcataatgcgtgcgctaggcaataagcaaatgaatgataagacagagaataaggagaaatacaatcatcagagatctaagcaagataaagctaacttatttttgaaaaaaagaagtttaaacttgaagaaagcctatttcaattgtttgatctacgattttctcaaccaaatttagttcaaaaagaaaaataagatctcaattgcacaaaagtaaatggacattttccattatatatttttaaaaacactttcacgcattacccaaacatcgtaaggctcatgccaagtaattgcatgtttgccacccgtaagcaaacgacacagaatggcactggttgtaagcatttgccgaacgcgccaaaaatagctgggccggacccataggagcagctcatagatgagctcattaggaagccaaaagtttcgttgttgtcctttagcagtgccattcattggcgttgccagtgccggcatggcctttttgatgagtttgttctttttgggtgccaaaacggaggaatttctgcaaatggcatctccgacccctccttcatagtcttcttctcattctttgtgagcagcagcagatggtcaccatttgtggcataatccgggaagagatggagctgatcagatggcttagtcagcgagtgacctgcatgatggaacatgcaaattttgttcccgattatcctcgctcattgttcaaaggagtgataaataagcaatttgtgcacgatttaattaaagacgaaaagggcatcgtaaggaataagcagaataattttatactatgcataagaaaattcaccataaatgaatgccatattgggactaaaaattacaatgaacaaatgccattggaaatcccgaattaattaaaaaatttaaaaatatgcaaaactaaaaacccccacaattttgttccaaaatgaccaaaaaa

SEQ ID NO: 497 - DNA, 8267 bp, Heterodera glycines
  misc_feature (70)..(70): n is a, c, g, or t
  genomic virtual cDNA Sequence=SeqID_678; coordinates=7357..7203 ,7156..6948,6860..6707
  coding sequence=SeqID_895; coordinates=7357..7203,7156..6948 ,6860..6707
  peptide sequence=SeqID_1123
ggatgaaatgattgcccagccatgttacaaccctctcaatcacaatgtcgacaatccgctttactttccncctgattatgaagaatcggaagaaatggaagaaggcgcggaggacgaaaacattgcgaaaattgaaaggcgttggatcaaaaggaaaaagcgcatggcaattacccattgattgaactgtttgttttgttttgtcagattaaaatgtttgttgctcttctgtactttgtgttaattgcttttcgtttttcgacacattacaatatttttctatgaattcaatcggtattaaatttaaagtttttttcgtcctctgcttctgcttgtcagataatgattgtgaacccaattagaaatatattcgtgaggaattttgcctgtcaattcggaccttctgaactcggttaggagattttaaaaatggctggactcgggagtctacacaaatgagtctttaattatgattttcagctcgttcctatgtcaccgatggcccactgacagtgagcggacgcagtgcgcctgtcaaaaagcgcacaaatgccgcagacgaaattgcgcggacaaagttcgagcttttggaacctatcgctgttactgacttgccacgggcacaacaacgttttgctcgtcaaatccacagatccaatcggactcgggtgcaaaaaatatttgccaagaatatcaaaatgatcaaaaacggcctggccggcattgcattggtggtcgccatttatttgtacacatttttcgtgatgcgaaaggaaacattcttggaagaaattgacgaagaaatggcaattgaacggggcgaaatgaaactcgatgaccaagggagactggtggcagtgaaatgagcacttttgttaatttgattttagcacttcatttgtctaatttgttttgttttattttttgaagagaaattaaattgttttgtttatccaccatctttctgatttttatgtacttacagcgttaggaaaataacttcctataccaaaaaattttttccattagcttttaaataaaccaactttataaaatttgcctatttcgggaaagtttggcccgaaaaatttggcttaaattgaatcatacgaaactccatcgtacgaatcgcctattgtacgaactgcctttgttcgaatagcccattgtacgaaacgccatgatcccattttttaaatccatacttcaagaatcccaactttaaccaaccgaactatccaagctcctttaattttgaatctttgctttcttcgtgtaaacattagattaaacattaaacggcatcttaaaatctatttgcataactattacatacgtacattaagcaggaactcatggaatagaaatctactatctgtcaactaatattcatttttagtcatacaataatatgaattatcgtgactttgctgagtatcagggcatctcaacaagcggtgcagcggcctgggaccggcttggagaccatgcttttctgagcccataccaagatttttcatcgatgtcccgtgttcctggcgaggcctttcgcttggagcgtccctatagtaaaaacaaggcaaaaggtggcggacgctttactggtcagtaagagaaaaagtaaattgccaagtaaaattgagcaatgttttagaaatgcgcagcggtcgtccgaatacgatgaaagcagtgggcattcgccgtcagcagaataattattctgtaaattcacaaataaattctttccttgggtattgaaattaagtttttagtacactccaattcccgactcgattgagcacaaagaatttgccttgtcttcaaatggcgttttcaatttccatggctatcagagtctttttactctccaacatcgcgtaattcattccaccagccattgttctttttagattttgtcatttcagttcgattttattgtcgacggcgtcacttacaaaagtgtcgaccagttctaccaaatgaacaaagtcaaggatttgactgggatcgaatcggccaaattcacggacggatcgacgcggaattacagcgcattggccaaggaattgttgcgacaagcaaacgtgataatttaaatgctcaaaatatataaaataaacaattgttaaggtcaaacggcaggaaattgacaaatggcgcaccgggaggggcgttgaggtcattcaggtgactgacattgggcaaaaatggcaaattgcccattttgtgtcgttttccttttcagaaggctcttctcgagaaggtccgccagtgctacgacttgcgcaattcgatcaccagcacagcggacaaactgattgtgcacagttacaacggcgacgactttttcggggcgggcgttccggcgaaatatgtgaacgattggtgcggggggatggagcagaacaaagtctcgctgaaggtggacttatactgatttgcagtattttatataattattttgatagtacccaatggaatttcccctcactgcggacaatgtgaaatatgtgccgctaattgcgaaggtaacaatcattttcagtatttagtaatgatttaatttgtgcttcaggggaagaatgttctcggtgccatttacatgattttgcgcgaaaaggttttcgttgtgaaataaagcatttcgacttattactccattgcttttcagatcaacaaaggccaattggactctttggacgtgcaattgaagccgattccgatcagcagcagcagcacaagtaccgacacaattatggtcgattccaactcttaaatggcacgcaaattctttttgatctgagaaaagttatggatgatgcctttgtattgtttgggcgctttttctctcgtttcatcattattgttttatcactttttgttgttctcaaactttcaactttttgtgctgacgaatacttttcccaccaattttcacatgattaaagagcttatcgataaaaatgattttcaatttaattgatcgtcaaccttcattgtttattttgatttgtgaattcggtttttcatgttaaaaatggtatttagcaaaagaaaattgcaacggatagattagcaccatttgttaacattgtcaatttgctgtttctgaataaagcggtggacaattggcatttagtgcccatgacagcagcagcatcggagaattttggccctctgtcagcacattacgaggaagacgatgaactgcttacaccgacaaagcgacttcggttatagtgtactttgtaccccccctttttttgaaaaagaaaaaattcaaaaattttttttcgaaataaagttgttttatggattgtctgggtcgtagaattcgatttctttttcataaaaggggggggggggggagtacaaagtaaacgattaccgcgacttcatttaagcgaattgcggctgaattctgacgaaaaatgtgcgatgtccgattcaatcccacgggctgttgagctgtttatggagaagaaacgagcaaggatttcaaaattcctgtacacgtacaacggcaacttgcaattgaatttgccacaattgcacgcatttgcatgctcaacgggcggactgattgatgacgaatttagagaaaggtgggaggaacaaacctcgtaattctcccatagagatctcagtttacaattgccatttttgttctggcttttttaaaaaaatgcactcaaattggttcggcggataagtttttaattatttggccatcatttttctttttactcgaatgaattgtcaagcgcttttaaatagattttttatggcttaaaaatagaagttgtggtcaaaaaattcttacgttgtgttgttcttttgtatttttaaaaccaaaaatcaaaacagaagataaatctaaattgatggaaaatttattgttttagaatttggccaattctcgcaaaaaatctcccacaagcaaaacgatgtaaagatacgcaatgggacgccctccgctcggaggaatacaatgaccaaacaaatcattcgagcgacgaattgcaacaacaacagcaaacccttttcctatcagattccgactttgaatctgcactttccacgttcaccccgtccatttcgggctgtgatgatcaattgatggatgcggaggacgacgccgagggggtcgacgaccaaagaatggccccccaaaacgcaacggtactccgctcatttgggttgataaacacaaaactataaaaattgaaaagaaccgatgacattcgagtgagtcaaggtcttcgacttctctcctgaccagctgcgtgcccacaaggaatggaatcaggtcgaattggacgtggcacggacattggcacggtttccaccgaacattgacgaggacgaaagggcatgtctgcagaacgagttgaccccacttattgtgaggatattgtgcgaaaatgaagacttccgttactatcaaggtgagtgtttgttgtcgatcaactaatccttgaaaaaaccctggcgaaatttgcgttcacaatttaacccatttggcaaaatccgtcctcctttccccaggctttcacgacgtgtgtctgacttttctgttggttctcggcgctgattcggccctccaagttacgcgggacatttgtgcccgaggcgccttccacaattatttgtgctgttcgctcgaagagagtgcaatgcgcgagttgcaggacctgtacgtgttgctgttcctgcatgaccaagaagtggagaagcggctgagaagcgccgagttgggcactctgtttgcgctcagttggcccctcacttggttttcacatgcactccaaaattactcccaggtgaattttatttctgcatttccttttcataattaatttggttctaataactgttgcaggtggtcctgttcttcgaccttttcctctcttctcatccgctgatgccaatttatgtcagtgccgcgttggtcagcgaacgacgggaagaagtgttgggttgtgaagtcgacatgccatcactacaccaactgctgaaccatgtttgtctgttgttgtgtttggctgcgttatttttgacttttaccaaatgccttctccttttaagattccttccaccattaattgccatcgcgttgctgacgctgctcgtgcgctaatggaccgttacccgccgactgtcatttgcgagtttcgagaagagtaccttcgcatctgcgacaggcataagcggctaattgcggtagaacggctgcaaaaacggatggagttatgtgaaactaaaaaatagcattgtttaaaaagcagggacatttttcttgtagcagtccttccttcccccaccaatttttttttgactctaatttattattttctaggaataattatatgaatttttcaaaaggattgcttatagaaattattttcaaaaaaaaaaaaaattttttttttatattctagatcaaaaacctacgattagtagaaaacaaagttttctttttttaatcgatacggggtggatgaacctaatgcacctttttctctgaaatggatgttaaattaattatttaaatttcgttcgaatttaatttatttcaaaacgatccataacaaaagtctgtttagatggaacccatcagaagcggtggtgcccgtcgttcttctgcctttctcctccctttgctccaaagggacaacatttacgctttggctggtgcgggtgccgtcgctttgctcagcgcagcaattgtccattattggacctactgattttgggacggtggagactcaacaacatacaaaacaacacatgcacacatacattccacacagaatatattacccatcacatatatataaatacatatttatttctcattttctcaattggaatgatttatgtaaaattaacaacaccatttaatgtaatatgtgaatgaacaataatgtgctttttccctccattattatctaccatttgccgcccttcttctttttccccttcttcgcctgttgcccggccggccgttgctggcgcggtccttcgggtttgggcgacgggtggggggacggagtgccaccgctggggcccggcttggccgaactgctgctgtagtcccttaacaaaaaatcccaccaatctaaggcaataatgccaaaatgtgctcacatattcgccacggcactggccgaggtgccctgtgtgcctcgtccaatgtctctgtctttgtattttttgtgcagcttctttcggtacgctgttcgttcctgcctgggcagccatcgctcggggtcaagcggcacttgtgggtcgaaatttgccggcaaacggcgctttcgcttgcgcgtctttctgcggctttttgtcactgcgtcggctgctccccctgcctgggaagagaagaggggagggacctttattattttgatatgccatattttaattggtacttttgccctatttccccgcccttttaaatcccccgatcaaattcgaattacgggcgttcgaatggactttcgtcggtcttttccctcgtcctttatttaccccgtcctcctccatcggctcctcctcgtcgccatgtgcacttttcatcggtcgccatttcttcccaaattttacgtaatccgcttccaaattctcgacaatcgccgctttcaatttccaatttaaggctctaaaaacagattttatttattagaatggaatgacaataatttacttggttttcagcacattttgatataattttagtgcctctttcttttggtccaatttttgtaatgtgaacgctttctgtgccaaaattggtgccatttcctgctgaatttcctctttgccaaggccgtccgcgttcaatgaccgttcacattcaactgtatttagtgacacatttttgaatagaaaagcatttttggaagaaattgtaaatgctactacctttaatgattcttttcacttaccggccgtcttttcgagcagtcggagggcgtcgtcaaacttttgacatgcgatcatatggcacgacgtattgtacatagtctcgaaggactccaagttggccaagtccaattcttgcgagtcgccttgggactgaagtcgcgctttgactgcgatgagattcgctcgtcgaatgtcgtcaaattcgtcgctgtgagttcggattaacttcctgaaaaatgaaatacagaaaaagaattcgtaatgtggtggctaacttgaacaattcaagagcttcttggtattgttccattcggtacagaatttgcgccttcaattccatcacacgcggcacggaaccatccaattttctgatcactccaagagcggccgtgtcattctttttacggtaaaaagcataggctttttcaaaagacatttaataaagcggcaatgataaaactaagaaaaagtgcttaaacagattttttattaaaaaatattaaaaagttattttgcagtttttaagaggcattgtgttgagtaaaattcaaatattgactatgtccagagaatctgtttttttcgttattaaaaaaattagttaaatcatttcctttagcctaaatgttttccaatttatcttttttttaatgacggaagcaacaaaaatttacaacagactcagtgcttttcaaaagtttcgcatcaatttgaactgccatttgcgtcgcgtccggtcgaattggttgtatcagctttcgacggcgctggtcttcgttaccgccttaaaccatgccagcatttacctcacttacgggcccgaccacccgcgatgcatgcaacagtaaattgaccaattttttgcatcggaattctgtcttatggcatcgttatgcttttctttgcaaatgatgcttttaagcaactacgatgagattaaaaaatggatgtcctgttaaaattctacaaatttttgaaaaagaatgagcattttaattggtttaattcgaaaatgatttttagagaatcagtttgttcaaacccggtgcatattcatggtaggcccgacaccagaaaaaaagcgggaaactcgatgattttttttaaacttttctggccaacaattccaaaagctttttgttttgctatttcaaaatttgccctgctccagtgccctccctgatcaaatatttcccttcagatggaaggaacggaaacagcgcggattgttaacggacgaattgctttggaaggagcggctgctgtacgcccgcaggtgagacccttttttatgcgcccgtcacgaataaaaatgtcagaggggggcgggggggggggcg

SEQ ID NO: 498 - DNA, 5428 bp, Heterodera glycines
  misc_feature (8)..(8): n is a, c, g, or t
  genomic virtual cDNA Sequence=SeqID_679; coordinates=1332..1436 ,1492..1956
  coding sequence=SeqID_1008; coordinates=1332..1436,1492..1956
  peptide sequence=SeqID_1218
atcatacntgaaagaaaaagaataaaaattgtgagaccgctgtgttttcctcaccaaaaagcagacatctttcggtccaaaaagtggacaaatcttcatcgcgagaggaaaggaaagcacgctaaaataaatgttaattagttttcagaaaggataaatggcaactcatacaataagcaattcgtacaataggcaatttacaataaccaatttaataaaaaggtctaactctaaggctaaagcttcggcctagccctatccctacatatgtacgagttgctttttgtacgcgttgtcatgacaccgtcaaaaggaaagaattaagaaaacaaataggtacatacatatgataaaaataaaacaaattttgaataaagtaaattctgaataatttttctgggttttgaggaatacaaaatttaatggttggtcttcgattgttggttttctttttttcctactacaacagaacagcagatggaagaaatgaaaagagaaaaaaacgcagagagaaagaaaataaagacattttcttgctgattgggtgacaaaaaacaagcgcctaaaaggcaaaacaaaaaatgggcattaaattagcataattttagaattttgaattttaaagtgcttttttgtccgcagaacgaatgtctgcgttaattccatttataattgttacactgttttgggctgtcattggtgcaggaggcccatttttggtaccaagtggtatgaacagaggtaatatatattttcaatatatttcatcgttttcgaatgttaaaatgaataattatttgtttccgattttgtatcattattttttaagggatcattcaaacgatgatcgtactgaccgcagtctgctgttatatgttttggctgatcgtctaccttcaccagttgaaccctttgataggaccacaactgcccgtgaaaacgatttggtggattcacaacacttggggtatataaatattgtacaattgcctatttctcaacacacatagtcgactcaatcttaattttcatttctcaaaactccgaattaatatcttacaatacatttctatttttagggaatgtgaagaattgatgatcgatgattgcagtgattttccacttttggatgtactattagtgaattctctatttctgtgaaaaactggcatgacaaaaagacacatataatttttcaaccttttatttctataaaaattgctttattttttattccattgaattaataattgttttcattatcaataaacccatgttttttttaaattaattttccaatttggttttatttctttacaattagtccatcaatgagtggcaccgataggttgccaagtatttctgcaaatgaatcattttcgattgattctgatgttgccagacgtttttgtcaggaaaacagagaaattgttcaggtgattattttaacactagtctttgaggatttttttcatccggttgttcctttagatttgtgcgttgttggcgtacaacaaaacatatatcgaattgttggatgaattaattgccaaagctgacgaggccgtaagacataacagagatgcgcaaaaggtggtcaaggataagctgcttcgtcctgataacaagccgggaaaacgtcgacggagaaaggatttcggactgcactaccgatacccatacttcagagatgccagtggaatggtaccagcacaaaacatggagtctttggagttgtctcgcgtctgttctttcaacccactgacggaagaagaaaaaaagtgtcagttcattaagaagcttattattgtttttgccgggcccgtccgggctcaacttattgttacacttaaattaattaattttaaagggacagaaaaagagttgagggggttgcgagaagccgtggcgcagtcgctcaatgaacaacaaataataaaattggatgccaagtgatttaatttttatcaaagtctttttcaaatgtttttgtttgatagaaaggaggttctctatcggaaattgcgaaccgctggagttgagacgacagacgaacaaatggagaattggcgtggggaagtggagagaataaaaaaccgcacaaattatattcggtaaactttttgataatcaacccaatgctagtaaatgttcagtggtcgtcccgtggatgaggtgattcaggaggccaaaggcgactttagtctcgtcgattgggcaaaaattgcttcttctgtggtaataatttaaagcgaatttcactcgtttgttatgcattacttaaatgtttagtttcaaggaacgcggtccatcatacaactcaggcaaaagtggttctgtgacatgatgttcaaccaagaaccgtggactctcgaggaggaccaagaccttctctcattggcggccgatttttctgattgggattcgattgcgcaacacttaaagacaggacgaagcgctttccgttgtttccagcggcacgcctatttacaggacctattaaaagaaaaaaagtgcacaattatattgtttttaaagtacatttttatttttcttcttacaattaggccatggactcccgaagaagacgacaaattgctctcatacattcgcctcttcaaagttggcgagcaaattccttggacaaaaagtaattttttcatttttttttttgatttaattcgcttttaacaccagtttctatgtacatggagggtcgtccaaaaaaagcgtgtgaatatcgttacgaacgttgtacaagtgaagcgttacgccacggacgatggaccgaagctgaggatatggtattgtctgatggaattcagttgtaacaaaaaaaaacatttagttgctacttcatgccattaacaaatatggtcctcaaaattgggccagaattgcgagttttgtgccgggaagaactctgttgcaatgccgtgaccgatggtgtttcaatgatttattcctcaaaaacatttgtttcaggattcacgtgttggatcacaaacgccgagacttgccttggggatgggaggagcaccagcgtctcctttacggcgttgagctatttggtcgcagtgaatgtgccaaaatttcaaaattgttgcctggtcgaaacaatatggatgttcggatgcgaattcggttgcttgtcaaatacaaaattgaagtaaatcacaatcaaaaaacatccagtacggttaatttttaaggaaacaatgaaccccaaaaaggacgtcgtctttcgtcattttgccaaaaattacttgtgttgtaaatcacgtcgaacatccgtcgttgacaaattccaacgctatctcgagactgaacagcaaagccaaaaaaatcagctgctctctcgactgggacttggtacttatatggtggattttgcagattatagtaagttgataagacttacaagcagaagcattatacttattttccggatagtttagctatgagttataaccacggtttattttatggaaatttgtattttcttctttaatcgtgtttaagcaaattaaattttgttaaagaaaatgacaaaattcaatctattttaaaaaaataatacatttgacttaaatataaaaaggattctttcagttagcgccttaaaaatgccttttccccgaaataacagattttgacgctgatgcattaagcatacaataccgatatttagttcagtttggaaaacgagaataccaaaaattgcgatttctcaattttagccacggttaagaattaaccgcaagttagggaatgaggcctcagctgttttatttatgcacccaatttagcggacgtgaaaaaggaacgtgctgagaaatttggtcaatggactgtgaaggggtcaggaagatgggttcgagcgttgatgaaaaatccaaacgaatataacagtgaagatctgatggaagagttggacaaactgcccgaagaaaaacgggaagaggtaaaatgagggacaaacaaccattcccgtattacataatggcattatcaggctatcgaatggcttcacaaatcggatgaacgattagagcaagaaagacaaatggaagagacaataccggaagacccagtggaagcgaaagatttttacgagcgaatgtatcccaaagaacgactcaaagaactttcggaatttgttggaaaattactgaaaccgacacaaaagtatggttgtaaatgaacaaaaaatttaaaatatacgtgaactttgttaagtgatattgcctactttgagcggcacagagttcgaccaggacacatgaaattgaggaaggtaaaaggcacacaaaagaggaagggccagaagcggagaagcggagaaagaacgagaggttggcgaggaagctcaatggagaagacatcgaggaaagcgacgtcatcggaatgcgatggtccgatcggatgatcgctgaaatcaacaaaagtctcgaggaccttccgcaggtgttggtttatccaataattccaatacaaactcacaatcagctgatttccatttaggaaaaacgtcgtgaatttgtggtccgcagtctttgcaacgcggtccgacagcgcgtccatcaaacgaatgtcactctgctgaagtccaagcctgactacagagacaaagtaaagacaatggtacacgattacattgaacaggtggtcaatttaagtcgttcttctgtgattttacaagatttaattcaggtggttaacgatccaatagtgccaaagccaataaaaccaaaagtaaacaacgaaaaagttgttatgttgccgcaaaattggcacaatctgagcctgaaggagatgatgaagttgaaactcgcaccgaatatttatccggcccttgtgcagcaggcgacactcgcgaacagtcacttggcaaattttgacgctcggcaagaaaatattgacaatgaattatcactggtaccatggaaaaagcgacgccgattggagaaacgaaaaatgcaggagggctttaggggcggtttcaaggaaaccgtcgtatgtccaatgcccgaagtgcaaacaataggaatggcagacaatcccaaatttaacacacaattggagatgtacaaacaaatcctcagcaaattggtgagattttgcacccaaaatattcacataacatcacttttgtttttaggttccaccatgttctgctactgtcaatgctatggaattattcgatgtattgaacatttgttacttttattcagaaaccattttccaatttcagctgggagtacgagctcgtctcaccaaactttctctgttttctcctccaccgacagacgaaagtgtaatagctgaaactgaagggccaagtacatctaaacagcaacccacacaaaatccacagcggcgtaccgtgccaaataatgtgcgtcaaagcatgaatatgctcagctga

SEQ ID NO: 499 - DNA, 4375 bp, Heterodera glycines
  misc_feature (4356)..(4356): n is a, c, g, or t
  genomic virtual cDNA Sequence=SeqID_711; coordinates=4209..4054 ,3991..3728,3624..3496,3285..3160,2832..2618,2550..2383,2288..2210 ,2054..1998,1931..1821,1677..1601,1501..1396
  coding sequence=SeqID_843; coordinates=4209..4054,3991..3728 ,3624..3496,3285..3160,2832..2618,2550..2383,2288..2210,2054..1998 ,1931..1821,1677..1601,1501..1396
  peptide sequence=SeqID_1082
atgtgttcagctctccgtcaaagaggtgatgttggagatgagtgagctgcaaagcgccgaggggacagcagaagctgaacagtcgacaacctttggcgagctgcactccctcctgcagctgccggagattgacggcacaagcggcacatcgaatggcactcgtttccgacgtcaggcgccgttgccgggccgggcgcaatgcgaaggtgggggggggatttatttaaaataagaatttaaaaattgtattttaaatgttttaggttgttgcatcccgggactgcccggcccgccgggcccaccgggccgcagcggagtgcccggccgtccgggagctcccggggctcccggatttcctggacgccctccagcgtaaaacagccatctgatggcttggaaaagctgcctgctcatttccgccccatttagcatttgcgaagaagtgacccctccgccgtgcattccgtgccctccgggccaacccggccctccggggtcgcccggcgaagtgggcagcccgggcccggttggccatcccggacgacccggcaatgatggaccaccgggtgaacaaataaaatatacccaacaaattttactccatttgcgttcaggcccccagggacccccgggcattcagggcgaacacggcgacatcggccgagagggaacgcggggggagccgggccgaccagcgatttcgacacccgccctccccggcgactcgggcccatccggggaaccggtgagtgtgccaaagaaatgatcccctcccaaccccaaattgcagggccctcccggcttccccggtgaaattggcgagcccggccgtcccggcagcgaagggctgcccggaccgcagggaccgtccggcgccccgggtcctcccggaccgccgggccgacccggcgaagacggcacgacggggcaccaggtggagccaaatgggagacaaatcgggcaaaagtgtgtttagggaccaccgggagaacggggaatatgcccaaaatattgcgcattggacggcggcgtcttcttcgaggatgggacgagacgatgagggaaaacggaggaagaaaaagtttttgaaaaagaaattgcaatttttgggcaatgacccagaatttatttgtaaaaacttgtaatatacagaataaaatttatataaaatataagccagggaatatttagaatcatattcaaaaaagttcgataattaatcgctaaatttaaaatattgttttgttatttttaaaatttcgtcattaaacaaaaacggaacaataacaaaagggaaacaaacaaattgacatcacacatcacaaaaatggtcagagggaagcgtcaaacagtatccactggttactgtaccatcgcattcatttactgtctgttctacccctcttcctcctcccgcatttcgacatcgtccagctccaaatcgtccaacatttccgcgagtgtcggcgctccgtcaatgtgctcctcctccccgccttcgctaagtgctgaatcagccgcggcggatgccattcgctgtcggtggtgccgttgttgggctgctgttcggtttgcactcgtcgccgtctgtttcaccgactgctttccgcctcccttcttgtaaatgttgatccgttcgcgcaatgccggatcctcctcaatgtcgtccatgaattccttaaataatgtaataatttttttaaataaattcctaaaattccattgttccctttaccaataaaatttttgcaaaaattccgggtctatcgttccggctaacaaaacaataagcggttggttcaaattcaaactgtgctcacattgaactccctctccacgctggcagtctcttcctggtcgagcagtctcttcagtcgccactgtctcttgcgcagtcggcgactccgatcgtacgcttttctgatcaaaacctaaacaagcgaaaaacataaatacaaatagaaatgacgaatcagcattaagtaaaactgactgaccacatccggcacattttcctctttcaccgcgtcaaatgtccgattgttcaaattcgtctgacaaacattgtaacccgaaaaaggaaaaacaataagaaaattatttcgttggaaatcaaggaacgagtagactttagagacccatttgaaaataaagccgaaaaaactaaatctaaagccagggaatattttttgcattatgcacccaaaacggtgtcgccggcattgagcagatggccaagatgagaacggcaacaaacggatttggcatcggaatgtccgacttggtcactgtagtaggtagaaatatgcattaaaaagtacaggaaaattaaaaaaattgaatcgaatgagattcaaattggggggggggcgggaggcgcacctgcgcaccacccaaacatcggccagtcggtgctttgtggacacggacccatgaccgtgtgggagaacggcgtaagggtcgtcgacctcctccacgtcgaccacaaaaaactcgacaagcgatttaggatgaaccaaaatgtcgaaagggttcttccaataggtggtactgaaattggaaacaaaaaacggtataaacgaaaaaagggataaattatatttaaaaaaccacttacgcgttgagctcgtacaattgcaatgtttgcgggttgatcagtgagacaacgtcggtgacgcgaagacagaggacgaattggccaatgtttgcgaaggattgggccaaagtgcgcggcagacaaatgagcgcgtccttcgtgatcggcacaatgtccacacagaaagtgtgcttgtaatcgtagaaattgctgcgcacgtcatgcgtaaccaattgctgtaaaattggggggagacaataaaacaaatgcaaaacccaaagccaaacagaacggtgtttgaagttactcaaaaaaccatcaaaataaaaattttgctaaaaaactcgagcatatttttaattattttgacccattcgaagccctaaaaattctctattacctgccaatttaaaaaaaatttccaagaagttcttacaattagggcaacccaattatatcaagaatcaaattttgatttatttagcaacgttaatttttgtcaaaaattcaccattttattgttttttgagtaacgtcctttttagactcagcatcaacagaacctgggactgatggaatttggaaggcaaggccgagctgatgaaatccaccaatttgcgtgcctcttgctgccgggcgaagaaaaagtcgatgccggtgggcaccggctttatgccacttgcctgggcctaaagaaagtttaaagtctaatataaaaaagtgatagcccaattctttcgttcaaattcctaacccaaaaatcctaatggaattttctgcgtaaaattgtgttaaaagagtcggttttaataagcggtcaccttttttatgaaatttatataaattgttttacttttctatgccatccctaacctaataatgttttaaaaatgcgcgacctgcgcattgtgtttgattaacaattgctccaaatagaaaagtgtctttttgtagtcgcatctctgccgcacctgcacacacgcgcgccaatagtctttggcctcgaaacggcggcagtcatcgcacatctcaaattttttttggggggggggggaaattattcatttccctaattagtgcctaatacattattcccactcgtaaaataatgtcgaaaaagcaatgcaaaacctggttgagaagcacaaattcgacgaccatcgactgctgcagcacggcacgggagaacacctccttttggatggtcagcttcactttgacacgttttgagtgcggttcggtccacacaaacgcagcgtccaccagccgcactttggccatcgccggcttcagacgggccaagcaaagagccatcaactccttggactcgggctttgccgcattccatgcgttgggaggcacgaaaaaccgttcgcagttgcggcacgattgaagctgagctaaaaaggggggggggggttggagagcattagatttttaagaaaaagtaaagagaatggacattgcttgggaatcccttcggtgatgtcagccctcgcgcgaacacagcccaagcacatgttggccgggttcggcgctatcggagtgccacagtcacagcaggcaattgtaccctcggagaaagtgccaggttgaatttccagctgctccataatgagaatatgaatttgcagttttgatgcctaaaaaatgctattttgaagatatgattttcagaaaaaattttgttcgttttcccgggcaaccgttacaaaataagcgaaaaatgcagagcgagcggcttatttttttgttcaaanttattcgttggcatagtgt

SEQ ID NO: 500 - DNA, 5369 bp, Heterodera glycines
  genomic virtual cDNA Sequence=SeqID_717; coordinates=1295..1399 ,1522..1659,1734..1848,1926..2083,2579..2776,3210..3353,3685..3768
  coding sequence=SeqID_900; coordinates=1295..1399,1522..1659 ,1734..1848,1926..2083,2579..2776,3210..3353,3685..3768
  peptide sequence=SeqID_1128
gtagagtagagcgggaccgggaattttgggcaaaaccgggaccgggacttgccgggacctgagaagccgggaccaggacctcgatttttcttcgggaccgggaaccgggaccaaccgggaatttttaaaaattcaaaaaaatttaaaaaattaaaaaaaaaatcaaattttaatttatttcaagtgaaaatattaaataattaaatttttatttagttttttatttaataaaacccaaaagttaaagctaataaattaatgaaaattttcaaatcaaattttcttcatttctttcaaacaattaatcatttttggactaagtgatcgaatattattagaaattcagatttacgtttcacataaattttttcggcacgctttttccaaaaaacttagcggaagaaagggggaccggcggtgccgataggcgccgccgggggaaattttgaaaatttgagtgagatttgttaacagattttcaacaaaaaaggctggttttgggattactaggctcaatttgtacggattttctttaaaaatgataaaatacaattaaaaaaaaattaagaatcatattttgtcgataggaaagccatgagtatatataaaaagaaatttcaaaatattttcatttctgtagagggatcgaaccaggggaaagaagaagggaaagtgaaggagactagccactaggccatttgcacagttggtattgctactttatgaatatatttaattattatttctaaattttttcctttaactccaattttctcactaatttttgcactcagacccccattcttaccagtgcttgtttttcccggttgccctaccgggaccgggacctgagcttttcaaaatccgggacctcggatgaccgggaattcccggcccggtcccggtcccgctctactctactttaatgaaaacgaagcataactttttttagatatgtccaattgcatttgcttagaaaaaaacatgaaaatattaatgtaatggaacgcattcgaactcagcctttttccataaaaaccactgagaaaaatgtaagcttttttcatagaaaagatgaaaatcgtgacgctgtgcaactgataggctgaggtcattccgatttcgtgtgtaaactgtaacacttacaaattgtggtaaaaatcgtgttaatggcaccgggggaaatttactgtgcttttaattcgatcattttgtaaggtatttaatttagatagttttggctttccgtttttcaatttaaatttactttccccattcatttaattttttaagtatggagccgaacaaatatgaaaagcaaaagggatttgctgctgaagcacaaaaattggaggaggacattgaccgatttatggaggcattggcggagaggggaaaggtgggcgtggtgttaattttttggatcattgcccacttttaatccgtctttgaagcaaaaaaaaaaaaacggatttggccaagaatttgtgttatttatccacccttttttctttcctttagaatgttcgttcctccaacagtgaaaaaaaatttgactttgaaaaatggtgcgaagaaattgataaacatcctgcatttgcacgcgatttgaaaccgaccgaagacggacaatattcaatggaaatgcaagcaatacaagtgaacaaaaagggaacaattgggggggggagaagaaaatatattatttgagtgaaaaaggaaagcaatttcaggcaatgaaatacgacgaggacaacccaacggaatgtgccaatgcgtacaaagaggagggaaatcggcactttgagaagagaaattatcggtgggcgattgatgcgtacacaaagggtaattaattaaacgatgaattcatcgcccgtcgttccaaacatttgcgcttccttaccatttgcttcctttttcaggtatcaaattgcgttgttccgatgttcgtcttaactctgttcttttcgctaatcgttccgctgcccaccggcggttaggcaatgttcggtcggcgttcaaagattgtttttttgcgcgacgctttgatgcagaaaatttgaaggttctgcccatgggagtggtcaaattagggcttatgttttagttgctaaaaactgccaaaataataagtttcgagtttcaaaaaacctccaaaatagttgctaaaaattggtaaatagttgctaaaaactttcaaatttagggatgtaaaatgacaaattttatccaaaaaagtaacgaaattaaaccaaatcagtattgagataaacaatttttaaaatcaaaaaatctcatcaaataaattcggagatgaatttttgagaaatgttttagttgaaatagtttttttcaaaaattttatagttttttagttactaaaaataaaaaactagaaagttgctaataattcgaaaagtagcttaacaacaaccgaaaaaccatgtttttcgtacgttttaggccacggagagctcaggaaaaaatagtgaaaaaactataaatattagccctggtcataattcataataaaaacaatttagtaatttttaagtttaaacttttattccttaaggcaattcgccgtggcgccgaatgtcttttggaattgggcgaagcggccaaatgcatcgcatggattgagacgaaggcgaacgaaggtggcacaatctcaccgaaagcgcatgtggatgaacagcttgaaaagacgaggaaaaaagcggaggcaatgagggcggaggaggacagagacgcgagaagagagagggcaacggtgggagacggtagagggggaaaagcaaagcggaagagagtgtggaggaaggggggggggaaaagatgggagagagtgtggaggagggggggggggaaagatgggagagagtgtggaggaggggggggggagaaagaaagaaagcgacagagaaggcggggagggtggaagagagagtgggagagaagacggtcatttctctatttcctcatttagtatcatcatttttttgtttctaggaaactctcgaacgaaggcgcaatacaaaattaatagaagaacttagggcgcggggagttcgcctttgtccaccggtggacgagccggacgaattatgccaacatttgcaaatttcgtttggcccactcgaaagggtcgcaattgactaattattcatttgctggttgtacaatttatttggttttcacttcagcattcgatggttcgactggtggacgagggcaccaaaagtgcgcgactgatttggccgcttctgttgcaatacccggaaaagggacagaccgattttgtgtccgaatgtgcggaagacattccgttggccgaggcatttgaggaggtgaaaataagaaaaacagcgcaaacggacggaataaaataaacccaattgcaaagttaaggtgttttcttcgcctgctcattgggactcccaacaccaatttcggttagtgttcttatatttttgtaattctttgtttagtcccgacaatgttcgttttttcgtcgctctctccggcgccgacggaagggagcgaatccgcgagattttccctgaaaaacattcactccgtgtcgtgctgcagtggccagatgtgtgcgtggccatgggattgccggtcatccaagtctctcttttatttcctttttttattcgtcagctttttttacaggtttatacgaggcagcatttggagcaaaatgaactgaaagcgtccggcggagaaaaagacatttatcattttgggaaggggtgagaggtggactgattcaacaataagtcaatcatttgtaattttaaaacaaataaatttttatttatatcactgtatttattcgttgaaaaaataaatgggaaaaacataattgaaaatacgtcactttttcacttgctaggagaacatgtagatttgaattcatacatcagaagaaatccgcagctgatggcctttttcccatattttgctgggtttcttccgtttccgaaacttaaagccattcgaatgtttttctgatttttgttgacattatttaccttttctttgctgcgcttctctttgttctttgtttttgattagtgttgaaggaccaggtgaaggaattctaaataaaatggacccgcttttttgcttcgattgtcgtcattaccctcaggaggtcgtccgtaactgatgaacctgctcgaaagtcggcgtcgctgccgcccgtttgggcgtcgttgcgcccgacttgggctcattcttcactttgatcatctgataaattgccgggctgaagaccgttctcgaagccgaacttaaattcgaggatttaattgtattttacgacatttaaacaacaaatattcaactgaccccctcggacttggagaaactttgatccgatcagtgcccagtcgaatgccaagtttatcgcccaaaagactgcgggcggcaggagacattgtggccaaacgaccgccggaagagcgcacagaattgaattttggcgtctttctacaattcaacggaattaaaggcatctcttccgcctcttacggcgccatttgttggatttggtccattgccctcttccgtttgttatggtaacgagacgcaatttgctcggcaattccttgagcgattttctccctaattggcacttcggggatctgaaaaatgaatggaacaaagtttagggacaaaggaataatcgaatttttgcacaaaatttgggatttttcggttccgaattctgttcgtgtcggttgctgacaattagtcggccactcactcggaatgcgggcgcatcctccagcgacggctgaatgtcgggggcgtcgagtcggaacggagtgccctcaatctctccccaggtcatcagtggtgagtcgtcaattcctcaaagaatgagtgatgctctagtaaaaacaacgaaaacaattccaaacccatgggtcgtgatacaatgcccactcacctggcgccggcgtcggtgtggccaccaatccgaccgttttggcctctattccgatcagcttgccggtgatgtcaatgtggcccgcatttttggcaatgttctgaagggtgacacgtgccatcatttgctgctggggtcgttgtgccatcatcgcctcggtgccgaaacgggtggcctctctgttgatggccatttcgcgctgcttggccctttcgatgtgttcgcccatcgtcagcggggcctccgccaaatggttgaacagcaccacgttcctcgccttgtacgtccaattgtccacgtccaccggtcgttgcgctgaaaccgttcatttgtgttcagttttccctgtctttttcgaccctgtctcattgcgcatcgccaccatttgctcgtccgcttc

SEQ ID NO: 501 - DNA, 12080 bp, Heterodera glycines
  misc_feature (40)..(40): n is a, c, g, or t
  genomic virtual cDNA Sequence=SeqID_757; coordinates=2305..2449 ,2531..2763,2899..3061,3153..3385
  coding sequence=SeqID_1014; coordinates=2305..2449,2531..2763 ,2899..3061,3153..3385
  peptide sequence=SeqID_1221
cagttgcgtcgtgcggccatcgcctcgtcgacgccgtccnccgccgtggacagtgtcgcggacaaccgcctcttcctcaagccgggcaaacgctcctccactgcggtcctccctaaacaaattctgctcaccctttggcgcgacattcattctcatcgctatgcgccagtcttcagttttccggtcagcgaggagctagtccatggctatcacactgcaatcaaaaagtaaatctattcaacaaattatcactttttctcactaattatttagacccatggatttgaaaacattgaagacgaacatcgagtcgggtgaagttaacacgctcggcaaattcagttatgcaattctcaaaatgtttgccaacgcggttatgtacaacagtaccggacattatgtgaacaattacgccaaggaaatggttgcgtacgcattgaaatgcattgaggtgagcagtcaaatccaaatcattcatctcatcaacttcttgtctatgctcaggttgttcagtttcctaccggccaatttcacgctccgccgcccagtcgccagagcaatggcagttcctccgaggggggtgcaattggcggagggggagcagcaaaatttaccattgcttgggcaacaactctgattaagccgaaaggggtggaccaaaagaaggcaaagggtcgcaatgacgaagagttgaccagcagcagcagccaggacaaggagagggaagtgagtcaatcaacctacgcaaaagccaatcgtaaatgcaagcataaaagcgacgttttcaggcagatcaacgcgatgaggaggaaacacgtcgtcttttccaacgacgtcgaatgtataacaaaaagtacacatttacgtctacaatttaatccccttctccaaatttggtgcatttcaactgctctctctccctttattcatttatttgtgctcaaattatcatactgaaatgcgacacttactaccactcattattgatgttagcaatttgtattttccattttcaaataaacttatttacatttttgggattacctttgtaacgttttatatttcaaaatttttacctactttcattaccccaaaacccattaatgcttccgatgtcaaaaacggggctatccgcggcaattgatgatgaattcgaccctgacattgatctttcacagaggtccaggtcggattgggtgagtgaacctcttaatatatcggctctaatgcagttaaccgtccaattaatgaccatcctcggtttctgaagccttaacttttttcttacttggttaatccatatatccttcgtatcaattgaaagctccaagtcccgggaatttataaatactatacaagaaaagaacaaatacttgcattaagaaaaaattgcaatgaaaaaacctgaaattcgtcatttttcgcgaatattcaacaataattttatgtctgttgcctttatcccagaatttttttatgcgtaaacttctgtggactttaagctctcgattgatacaaagaatgtaagttttgagcaagaatgaaatatgacttaagaaacaaaccgaagatagtcattgattgttgcgtaaaagtcgactggactgcattagagccaaatatgtgctttttaaatttccttttctaggttggttcatttgctggtaatccgtccacagctccgacggtttatgcgatgttcaacaacagcgtttggacttttatgcttgtttacggcgtgacaggccgatttatttccgcaaggtcccaccatccgcggaaagagacacatgggtcaccctcggttttggttttcactaatagttgtactggttgcgcgaaattagccgtgcccagttatcgcccaccctcagccgttttgtttttccctactttttttgccccttccagtgttgtaagtttactcacgatgccagccactgctgctctgtgggtttgggaggctgatcgcgactacgaacgctgggaagggtcgcgggtgttacgtgagcgccgagttccaaaatttgtgctcccgcgaacggtgcggattcgctatgttccgcttgcatttataaacttttttagattttcgattggtctgactttgattatgctcaacagatgagaaaggctcctaccggttaaggaaaaagactatttacctaatacatatttgaataaagagcattgtttcaatttctcaatcatattgcttttttgttgtaattttgtctaattttgatacctccaaaaatttgttagcctgaacaactgactgccatttaacatttgaagcagtgaatggccgcgacttctcttcaacaacagctcaagaggcttaaatcggcacccaccggggctttggcggttgagcgtgattattcttcgcttcttttcaccaaaaaagcggcggctgctttagaccgagacgagttttacaaaattggtgattttctattaagacattgttagaggcgtgggtggggatttgttctctgcaatgattattgcgagttgcgttttttaggacttgctgggctctctggcatgaaaaaaattgacaatgcattcgacacttatgcgccagaattgttttggaaggacaagaaacggttcaatagagcgatgctccagaaggatgaggcggagcagttcgaccggcggattgagacatttttgctccgtctcgccgcccatttccatcaccagtgctgtcggcaggtgctcgaatggctcatccataactatcaggttctcgacgttagaatactaacggaagatcccctttaggaatcgtaatcgatcaattagaaaagtcgctttctgtctctgcctgtcacgactaactttctaggcgtttccccatgtatattggtttgatccttccattttcagattcacacatacaatgccgaggcgcttctgctcgcttttctgccttatcacagcgtcaattccttcggtcggctcctccacattctcaaattcaactccactgcttgggattggctgacggaatatcaaagggacgcagcacctattccgatgaatattttatgtatatttacgaactcgcttccgttttatttcaaattaaatttctaaaaagttttcaaatttaataattgaaaggaaaagtcactgttaaggcagagcatgtcaagtcggtcgttcctatggactcgtttccacactgtcgaacttcgtccaaatggcaattgagcagcttgggtccacatatgccaatgacaaaatgcaaaattattttacttttttggtgtctttgttcggcattttgattgaaaactcgacagctgacggaactgttgatgaccaactccttgccagattgatgccgtttttaagcgttgcattgaagtgatgcgcttttatttattttcaatttgatttttctatgcccttaggtccaaattggaagccttcaaatgtgccggcattatgttgctgatttgtttggcggtgaacgttgcgacgcttgacaatgagacggttcaaaatgcactgaaattgttactgtacaaactccgtcccaacacttttccgttggtgcttcgggcggtgtgtgtgctctgtcagcgattgtcgttggacactctgccgaggaagtgggtttgtaaagttaccacaataaatctcactccacagtgcaacattgcgaatcgtctacaatgatgacgaattgaaagcgacgacggagatccaaaaattgatggaactcttcgacttgagtcattttctggtgcctttttggcggattctcgttgacgcatacagaaccggtagtgaaggcgtatagataccacaacagtaacttccaatgtatggaaacttaggagaaaacgaaacatggcgtgacgcctatctgacgatgctcctcaaaacgatggacctggagggaatggacagattccaagcagaaaaagccgcgcactttctttctttgcttctggaggaagagcaatctcagcggagttgtgaaaaacgttttcaaccggaggtgctatttgaacgggcgagcctttgaaaggcacttttccttcacatttgcagttgtccggctccgagctgaagggcgctgttttgcgctatgcgaaagcgatcgaactccgtctcgggggagaaaaagaaaaatcgacgaatgtcattatgatggaaagtgctgtcgcccctttttattcaaactgatcaggaggaccttccctagtaataatgctaggggaacctttgtttttcttttaacgccaataaatttattgaccaatcccaaattctcggatgaacatttttatgtgcgtaatttggccttcgtccgccccctttggagtcgataattcattcatttgaaaatttaaatgtcgaaacataagcaattggtaaatttcagtgcatttacacggcgagtcaattttgggctccaagtagtgaacgacaaaacgacgttttagtcgtttaaaaaaaagaaacgatttaacatcgttttgttaattttaacgatgtgcataacgccaacgatgttttaacgatgtttttttaaattacgaattatagaattgaaaaggatgtaaatgaaatgcaggtgtttgcaaattatgcaatcaatctaattgaggtaatttctctaaatatctaaaaaatcattaaatgattacagatggaaaacaaatgctcgcttaaccgcgttcttattgagatggtcaaaatagaaaatttatggagtgaaaaatcttcatccgacaattattttatacaagcactggcaaaaagtggcttggaagcatttaggcgcaaaatgtgtgaagttttttggcaaaaaaatcctacaattgttcaatgtgcggcatttttggaccctgcggtcaatggattattgagtcaaatttgccattcgaattctaattggggaacccaaacaatagttatgagtcgggatttttgaaattttaaatgtataagaatattaagatatttgatgtaattgtcagcgccgctaaagagcgctttccactatgcacacaaattgccagaaattttgaactttcaccgagtttgtcatgctttcaacagactcctaaaagttgtatcgaagcagaaatgattttttacagaaatctttgcgagtcccttggcgggaaaaagataaatctgcttgatttttggaaagaaaattcaaaaaaacttcactttttgtcttctttggctatggagtttttgtcaattcccgcatcatccacatcttgtgaacgaatttttagccgtttttcaccgctggtttatgattatcgtcgtaatcgctttgaccctttcacaatttcacgccttatttccctacaatcattgtttcgcgatacttaatttatttttaaaaaaatatcgttaaaacatcgtttggcgttgtgaacatcgttataattaataaacgactttttcgtcgtttgaatttataacgacgttttttcgttaaaaaagtcgttttgtcgttcactagctccaagtacaaataagtttattatttatttagtaatcagaacgccaaaactttgcaaaacttaaaattttccggagattttcccttgcaaaaaaagaagagccgatctcgagttaaaaactagacagctaaaaaataaactgtgattcgatagaggaggtcaaaatatgggcctatgcaaattttaaagaaaatcccaactgagaaaaaaaaattcaactagacaaagttttttctttttctctcattttgacgcactatttccatgtctctaacatataaaataacacatggttcatttttttgccaataaacaattttttaaacttttgactaattaagaaatattcttcagaattttcccttataagaacagatacagctctaatagacgctgccggaaaaatttacccctaagaatcgaccaaaaaaatttttttaaatacaccactaagaattggaaaattttttcaaaaattcttcccccaaattttttttcatgacaaaatttttgatttaaaaaatgtataaaggaaatgtagctcatttgcaactgcaatcagtgaataaaaattattttttgctcaatttttggctaaaaattaggtcgctattcgtcactatttcggactttttttcactattttgtcacttttttggcactttttcgtcattattttagttaactatttcgggatttttcgtcactaaaagtcgcgtccctatcaatgaccatcctcagaaaattagcacttacagtagaaagaattcaaggaaaaagctttctcgagtaacttcaagaattttttgattttgcatttagccggtatgtaaaatttctataaacttcaagctttatgtcgttggataccaagaatgtggggtaatatgtagttctgcagtttgtagaatttcatagtcatgaaaacatttcttgggcgttttcagggtcgatgagtatgaatatgacattaacatttcgaccaatttcaaacccctgatcaacatggcctaagaaacagggtatggtcattgagtggatgcctaaagtgcaatagagccatttcttgtgaatcgactttgggtttaaatgctttttaaagagaattcgaatgttcgactttcctgcgtttcgctttccattttcacccgctccattctttgtgtgtttccgttactttccttctgtccatttgcattgtattattttctaatgtcctctgaccttttatttttcattcgtttttgctttacattttccttgcttacctagacgtagtattattgtgtggttttgtcttcatttctttcttcgtttagtctgaatttcatcgctcatggcagccaaaaatgaaaatggaatccaattgccacgtaagtctaacaataagcaaacacctcgagtttgaatacaatatgctttttcctttcagagaaactcaacaacgaccatggagttcgtggcatcgcgccggttgacgtgctcatcaatgcatttgaacttaatctgaagggcgcacctgacatggtgtaccagcacgaacttcgttttgtgggagaatatcaaatgaaaaagggcagagaaggccaactagaaacgcgtgaattggcacaaggaccacagaatgagtgagtgttttgaaaaaagagaaattcgaattttcaaactttgttcgaaaatggtttcatttcagcgagtgtaaagagacgcgtcgtgagttgcattggtcgctctggcgaattttgctcgatcagaatgccgacttttttgggggcgagaagaacaagttcagctacgactgcgctcttctcctttattctgtgcgtcgtcttatggtaaacggagagatgcgcgaatttgtgatcaatgccgaaagtttggtgagtcattcattcttcgcaattggcacttcattgccaaatagaagatgttgcgctacttttaaagcgtggcgttttgaaaattttttcacttttttttgttctatttttttacacatataatgatgatgaatattaagcattaacagaacaattatggcgaataaaagaataattatggcgaagaagatcactgaaagcattaataatagtttttcctagagtgccacgggaccgggaattttgggcaaacccgggaccgggaccttttcgggttgaaaaaccgggaatttttggctgggaaaaccgggaaaaaaccgggactagtcccggtcaaaaccgggcccttggtactcagttgtccgctatccgtggcactctagttttccttcaagtcgaaaaatttgttcacacatgtatgaattcgttaaatttgtactagttccatgaattcttttcgtcttttgcttcaattgagcccagagtccttcacatttattcgtgttgacgttgaattcggtaccgtaatattcatcatcattatatgtgtaaaaaaatagaacaaaaaaagtgaaaaatttttcaaaacgccacgcttttaaagtagcgccgaaaatgtaaagcgcattaaagaaaccgatttgaataactcagagactacagattcaatttgttggcatggcattcccttcaaaatcgcctttgccttatttttgggtccctttgcccttgtttatgttatttacttctttgcttattgttagttttgcatttcaattccgcagaatgcgttgtccgtccgtagccgtgcgtatctgcgcagctgcgaacgcgtgaaggcctttctgactgccacagaagaagtggaggttcgcaatatgaaagtgacggagccgggcggtgaccaatcggtgtgccaatttttggagttgcttagcacgcagcgaatgtacgaaaagtaagcattttgtcgttggtttcacatttaaatctcttcggcgtgttcaaagtaaatggaagtgggtggttgtgcactgacaatgaatcgttttagaaatcaacactttgtcttcggaaatcgaatgtttgagaagaacagcgttttgcagctgcagggcatcccgctcatttgcaaggagggcatgcagaagaatgtgcgcttcgtcggcgacagtccccagcagagcactgccgtcattcagttggacggtacgctatgcgccattcactcaaaatgtcgttgtttcagccaagaaatcggctttctttccggccattggactcgtcgatttcgtcggttacttcatcaattccgatcctcaccgtctcgaaagtgacgttcagcagaaggctcgcgttgttaacaagcaaatcaaaggtaacatttcgaaaacctcagaattactcaaatttcatcaaactcaggccttgccgtccaaacaatccatttgcctgaaaatcaggtcgtttcttcggactgttccttttgtgttccttttcattgcatccctttcagatgactttctctgcttcgggtttgactgaccgcggagccaacgaaataacttttacgatcgacaaccatcagacgaatttggtgcagtattacgaccaaaagtacaacaggcggctgcgctacccgtgccttgcgtgtgtcatccatcgcaggggcaatcaggaatcgtacttcccgatggaagtgctgaacattgtgtgagtccaactttattcgggtttgccattttagggatacaatatcccgtgggcgattacagaaatccctggacagatttcgtttaacattgtgtatttttgtatttttttttacttcgtttagcgatggacaacgtgtgtcattggacaaacagacgcccaaactcgccgaacaaatgatcaaaaaatgccaggttctgcccgtcgatttgccgcgtggcattgagacacagcgtgacaaagggatgatccaaaatgccaacccattctttcgtgcgcacgaaattcgtgtcgagaccaatatgatgcaagcggaagcgcaactcctttacccgccggcaatttgcttctcggcgccgattgagaaaatcgaaccgaacaatcgtggtggtcagttgcgtctttcgaatttagcattgattttgttcggcttttttttagtgttggacttccgtttggctgaccgtggacagccattgcctcttcgttattctgtcccctgtaaatttccgaaggtttgggcggttgttatcgtgcaaaactccgttcaaagggaccagtgcaggtgggtcaacggagtcagagcgaattcaatggccccattgttgtcagaatgttctgtgagtgtttgattcgatgtgcccatgcgcgcggggttcagatggaaatgccaccacgagtcgacaattttgaggacacatcgatgtgagttggacaaaaaatcagttttggttttatttgggatgggatgaacggacagacaaatagccatcctttaaattcttttagtgagcatgttagtgaacaattcgcctattatgcaaacaatcgctgtaaatttgtgcttttcttcgcgcctgggaaggagtcggctcacgctggtgatattcaccacgtttttaaacttcaggaaattgaacatggcaagcgctctctccctcttctcccctctctctctcccctctccctttccctatctctctctctctcttctcccctctctctctcccctctctctctcccctctctttcctctctctctctcccctctctctttccctatctttccctctcttctcccctctctctctttccctcttgtctatccatctctctctctttccctcttgtccatccatctctctctcccccctctctcttctcccctctctttctcccctctctctttccctatctttccctctcttctcccctctctctctccctatctctctctctttccctcttgtccatccatttctctctcccctctctctttccctctcttctcccctctctctctccctatctctctctctttccctcttgtccatccatctctttcttcttaaggtgttctgactcaacatgtcgcgcctaaaaccgtggacaaggcccttggtcgccagggtgccatcatggtccttgacaacatcatgctgaagacgaacctgaaaatgggcggtgccaattatgaaatttgtgctgcacaggcattcaaagaggctaataggattcgctatgacattctgtaagtgcttggtcgtgagaatttgaaccagtttcattatcagttccgaacaatggttgggtagaaaacggatgtttttcggcttggacatgtcccacgcgccgccacagactttattcgaacgacgtacgggaaaagcgccggccattccgacgattgttggcgtaagtgggcttgacggtcgctgctgcttctgtcccagagtttgattttgccgtttcccagatggcctacacgatctccgagcacttgctgcagatgaatggcacctattggatgcagcagccgcgtgttgccaccgtacaaatggcttctccgatggtcaacgcggtcaaggaggcactgatgactttcaatgccaaaaacgggttcttccctgaacacatcttcgtgttcagagctggtgcttcggaaggcgaatacaaaaaggtgggcgagacggaagagttgcaaaaaggagaccaattgaaggtggcatattgggagggcggggcattcgccactgctttcgctgaactgacgaaggaacgcaaaatgtcgaagaagcctgcgttgacactgattgtgtgtcaacgtaactcaaactatcgcatcattccgaacaacgttcgcccgggcggtcgcgcacctgagcagaattgtcagccgggcactgtgctggacaaaagggtcgaatgcactttcaaattggatgttggacaattatgttgaatttcaggcaatgcattcctcactgacggaatttcttttggtcggccatcggactatccaagtgagtttttattgacaaattgacaccccgctctcactaccttttccattttttacagggaaccgcccagcctttgcgctgcactgtcgttatcgacactgccgaacctcggatcaaactcagcgaattggaacagatcagctacgcgttgtgctaccagcatgggatttgttgcagttcgacagctgttccgggcgttctctattcagccggggacttggcgaagcgtgggcgcaacaattggcgcacattcacgtgacatccccccccccccccttcctctgctggagacgttcccttcctttcacagctctgacggggaaaccatccaggaattcgacttgccgccccagggccagcctgaggacgttagggctcaagtgcaagcccagttggacggttcgttcgcacagttttttcctttccgatggagcatttgaattcagaacaacgcggcaattactttgccaaagtcaccgacgaactccatccgacccttcgtaccaagttttgggcatagatttaaaggaaggaaattggtagagaatattttatccttttttgatgcgttttctctgatcattatttgtttgttttcctattcgccttttattctcattcaataggattgaaaagttaaactgcctaattgtactagaaatctcgtccttctt

SEQ ID NO: 502 - DNA, 6641 bp, Heterodera glycines
  genomic virtual cDNA Sequence=SeqID_567; coordinates=6622..6468 ,6410..6227,5937..5752,5695..5575,5480..5377,5325..5123,4904..4823 ,4768..4606,4557..4498,4383..4343,4301..4192,4149..3998,3954..3892 ,3836..3603,3553..3451,...
  genomic virtual cDNA coordinates=3374..3285,3219..3008,2963..2895 ,2827..2786,2719..2482,2428..2209,2170..2080,2028..1873,1762..1511 ,1458..1118,1074..960,915..716,569..441,392..263,215..68
  coding sequence=SeqID_824; coordinates=6622..6468,6410..6227 ,5937..5752,5695..5575,5480..5377,5325..5123,4904..4823,4768..4606 ,4557..4498,4383..4343,4301..4192,4149..3998,3954..3892,3836..3603 ,3553..3451,3374..3285,...
  coding coordinates=3219..3008,2963..2895,2827..2786,2719..2482 ,2428..2209,2170..2080,2028..1873,1762..1511,1458..1118,1074..960 ,915..716,569..441,392..263,215..68
  peptide sequence=SeqID_1064
ctagagtcttctaaaatattgcacaaaacacgaagccttttaaaatagtaatttagtttccgatcacctcttctgcttcaccgctttggtctccgcttgtatgatccgttctcgcattttcacttcgttgccgctcgaatcgaaacgattttccgcttctttcagcagtttctccacggtgtccaattgcgcatcgtccacattgtctaaggaacctaaaataaaaataaaatttcgacaaaacaaacgcaaatcaattgactgagttgggccaatgcttccgtaagttttgtgtccgagtcactcagcttttcctgcagtgaatttgcagtcgcttcggagagagtcgcttttttcgcgacttcgttggaacgttccgcgtcggaaattgcctaattattaattgtcttctcgtatttatgactattttttctgccaacttggttctcaaaatcctttgttgtggtcaaaacggagtccaattcgctgctgagagtgtccagcgcacttttcgtttctgtggccccagccatcgtttgttcagtggcgtctgttaaattggccgcttccttaacaaatttcagtccgtcagtttttatgtccacccctcagattggtcacttcattcccccgttgattttctgggggggggggggggggggggacgaccctctccgccctcagatagcttttcctgtgcttcgccgccacttaccatggccaaattctgcgctttcattttggcctcctccgccacttccgccgcttcttttgcattttgactcgcgtctccgaccgcatcttcggcttcctttgtcatcgcctgcgcctcttcgatttccttttcgatatccgccaaattggtcatttcctcggtcgcttccgcgcggctttgttcgattttactatgaaagtctgcaaataaatttttatttgtttgccttttgcaacaattaaaccggaaagcgcgtcgtgcgaatccttcgcatcgttccacgtcttcgtggccaattcgaaagccgtttgggtgcgcgcattaaaagactcggcttcgtcaaaggaattgtccacactctttgggaagagaaggcaataaaaagcattatgcttttcccaccatttgcttctgttgcgcatttcgcaactgttcgcacgcttcctccactaatttatccactttttctaccaattccgcttgcttttccgcctccgaccgtgttttagacagcgcttccaaaccctcttcctgtgcccttttgactttctccatcaactcatcagaaaaaacgttcggcagacggatactgtccactccgctcagaatgaaggcggccccgtcgtgtgtttggtttgtctcgagggactgttccgtcgccatttgttggatggctttcagtcgctgttccaactcgtggacctcggtcaacaaagcagaaatttgcagactggtgcttgaagctgcaataattcgtaagtgattttgaacaatgagctccgatgagtcgctcacctccaaaaattgcttcgttggcgtcgctgagcgattgccgcgactccttccgaatttgctcagccaacgaaaggatctcccggcgacgctgctcctgcgtatcagacaactgcttggattcgccagcgatctccgacaattgctgactcttttccccgtaacggtcgaacgcctcctgcgcttttgccaagtgctgttctccttgtgtttgcacataattcactccaacagacagctctttatgggtggtttctgtaaatgatacggtagggaattgacgcgagaagagaaacaatacgggaggggaaaggtagtgtatccccccgcccccgtgaatacgtcgctggttgtttatttattacccttgtccgtgctaaactgtcccaattgctgttcaatcaccgcagcattcgtgtcgatttgctggagtctgtcgcgaagtcccagcaccaaagtgtccgcttctgcaagttgcgccctcatggaaattgcctggtcgcgaatgtgcgagtcgtccccttctgctggtcgatgtgtaattactctctcattagggacgtagaacttacccatttttttcagtgctctttcatgcagtgactcgacctccactcgcactttttgcacatgcgcgtcaaattcgcgatcgtccactttgatctaaacaaccaaatgaaggttttttcactcacaatcaccgggttattgatgatctcgtccaggttttcgcgcaattcactcatagttccgttgagctcatttttgcgcgattggatcagtgcgtaacagtcgtcacatgcgggacaaccaccgcgcaaattgaaacgattttcggaacattggtcacagcgacggccttccacattctgtcggcacaaacactgcccactggcaacgtcgcattccaaagtctcagagctaaacaccaaagggtaaaccgataggtttggaatattcccagtcagtctcacccggtcggatcgcagccgcattccaagcacccttccgggccgaagccgaaatgccgcgttgcgcactgatcacagcgtctgccggtcaccccctttttgcattggcattggccggtaatcaaatcacacacgcccccatccaaactgcccaaagggtcacaaccacactgatggcacccatttccggaggaaatattaaagaagccgggggcacattgatcacaacgaaggccaatcacttaacggaccgagtattcagaacattctgccagcgaccccccccccccctccttttttgaccgaccgtttggttggcacgaacactgcccatccgtctgacgacattctgaaagagaagcgttaaaaagccacgaaaatcttaatctgggacagtcgaagaatttcaaccttaccaagcgcctcaaagtcctgacccggcctcaaagtgccttgggtatagcagttacacgacctgcagtctcctgcaacatttcaaaatgaccattataaaacctgtcatcgccacctttcacttccgatagcgcgtccccccaaaatccggccatgcatttgtcacatcgccaccccgtcgtgtgataaatgcaccgtttgcactctccactgatcgtgtcgcactttccaatcgcatttgggtcggtattgctgttgcagtcgcatttctgacagggaatgccctcggccggattcccgaatgactcttccgcacaaatgtcgcatctgtccaaacagaccgccgggttaatccgagccgaatccatctctcccgtctcccggacactcactttcgtcctgcgtatccctctggacattccgtgcataacgtatccccatcgcccatcaaaatacacgggccgttctcaggacagtcgcatctgttaaattctgtgtcaaaactcatccacaaaaatgtagtcgagataaaacatccattgcattttaacaacacactttttgcagtcatcagctgtccccgtcagcgcatcgccataaaaccctcgcgcacatcgttcgcatgtttcgccggcggtgttgtgttggcaaatgcacgagccttaaaaagggagtcccattgaatcaattgagaaaaggtggaaaatgacctgattcggaatcgcagctgtcggaatggccgtgacattcgcagggaatgcatttggctagcggaccgccaaaatgaagcgtgcgcttatagccgggggcacacgattcgcaaaattggccgacgaatgcgtcggggcatttgcactgctcaacccaattggcaggctcggccaagtcgacgttgggcacagaagcagccgaattgacggtgaaattatacaggtaaccgacatctgttcaaaaatggaaagaaagcacataatccattctccgctgctggaaactaaccgcctttggagaaagtgccacgaattttaaaggcgctcacattggagaggacggcgatgaaatctaccaaaatggcattagaagattggcaaggacaaaggctgacccgtctcgcggagagatggactccactgaagcgaaggatggaaatgcacgcggaaacgaaagcgttgctcgcgaacggcaggcaacggattgccctgggcgaagattggcaacaccaactcttgtccattggcaccgacaatgacaatgtccctttagcatttgtaaagcaaaatgaatgcaacatttttttactttttgcttgggccggggtttggaagctgaacgcggagatgaaagtcaatgaaattgttataaatgtgtcgctgatctcccaaaaattgtgacggagcaaaaaaatacaccttaagattggcaattttacacattaagcatttttatttacaggataatcgtctaattgagaaacagcggccgcgcgatcgactgaaaaaaggaaaaacagcaattagagaaagaagcatcgttaaattccatgcccctccacttttctttccctcccccctttttccctctccgcgtttccgcctcttctctgaccttgggcccattggacgtcctccaattgtcgttctgatccgcccgaccagtcttcagtgcctaaaaacgtgcaagttatcgcccataaagtcgtctattaaaacagactatcaaaaaactgtgaagacacattcacagcaaaatatccttcggccgccgaacaaacggacgaatggccgaaacagaaacacggagaacagccgaaagggttggaggaggacaacaggaagaagctgggcttgcacttatcacagcgctgaccctcaacattctaaaaacgaaaaaaggccatgagaaaacagaaaagaagaacaaatggaacaacctctttgcaaacacacgatccggaggaggaggaacaagtcggggtgttgttgaaggagccatttgcatcacaacgacaatctctgagggcagtggggaaaaactaagaaaaatgtcagtgaaacaggtttgagcaactgtgagtagaaagcatgcctttcactgctccctacccccaaatggcgggagcaggtcgtttccccccccccccgccgttcccccccccccccctcgccacccaaaatacaatttccccgatttccgctttgtgtataaatcaaatctcacaatcaacacccacttgcatcctgtggcaccaaagtcgtagaatccatgttcgcaacgatcgcagaattggccgccgacccccggcttacagcgacattggcccttctcgtcgcattgagtgtcggcggaaccgatctcatcgcactgacacggacgacaataatgttcgctctggcgacgccaatggtcgggaagacagtgttcacaatgggggccatgaaattggaggagaaattcatggtcagaggaatggatttgcacaccgacctgagtgttgccagcacagtcaatgcaatggccaccatggcccgtgttctcgaaaagtttggcgtcgaagtaacaccgattggagagaccgttgcaattgcaggctaaagagaaaaactgatgagcacagagtgtgcagaatgaaacggaaaaacaaatgaatcaaatttgccgtcagaattctcaacccaaaccgacggaggcattcgttggcttccatggaggtggcgggtcgccacggtctatccacgaagaagggggcgcactgctgacagtccacgccggcggtgttgtgctgacagtcgcacaccaattgttccttgatggcacacgcattgtctttcccttctttgtcctaccatcccatccctaaacctctccccgtcctgtggacttcacgcattggttggcgtgaccattgcatttgcatcgtccgccaaccgcaaagtcggaaattccgtaataatacgagcgaagcacacgactgtctccgaatatttcgtcaccaaatgtgttcattcgaaccaatgaaatgcgtatttgttctgcagccacccattcctaagggatggtaaatacgtgaattattttttgatagggctcgaccctgacatttatgacccagactccgacaaggccgttgtcaaaaatatttcggaggagggaatccgaagacgtttttcaaaactaagtaaggtaaaatgggggtccggcggtgccgggaaaaatttgaagattttaatatataagaaaattgtgcaaaaaaaatttgagtgtcggggtcgaagttgagaacgtttggacaggaaataaccaacccaaaaaggacaataaaaatcaaaggcattgcctggagcacttcgctctcctcaaaattctcagcagaagggcgtccgtcgagcgtggagaaggcaatatcgcctccagtcagtggagaaatgtcagagaactcacgtgtgcattgcgcaaccgcttcatttcccggcagaatcggcgctttgtcttgcaatttgaaagtggaacggcaggacccgctaaagagcaataaacggaacaattgaaatgctaaaacgcaaactggtcaaaaccacctataatattgccagggaatccagtcgtcttcggctctgttctttttgtaaacgacgaaactctcaggacgaggactggcaaatttcaaccgaatatacgtaatatcgtaacgtttgtgcatgtgcaatgtgagattgactgtctgtggatattgaataccttcctaaaattaa

SEQ ID NO: 503 - DNA, 4431 bp, Heterodera glycines
  genomic virtual cDNA Sequence=SeqID_566; coordinates=4134..4073 ,4016..3870,3826..3769,3716..3586,3544..3400,3357..3261,3212..3136 ,3088..2993,2942..2779,2728..2543,2503..2440,2382..2251,2205..1993 ,1944..1768,1721..1669,...
  genomic virtual cDNA coordinates=1614..1412,1369..1294,1188..990 ,947..840,784..586
  coding sequence=SeqID_823; coordinates=4134..4073,4016..3870 ,3826..3769,3716..3586,3544..3400,3357..3261,3212..3136,3088..2993 ,2942..2779,2728..2543,2503..2440,2382..2251,2205..1993,1944..1768 ,1721..1669,1614..1412,...
  coding coordinates=1369..1294,1188..990,947..840,784..692
  peptide sequence=SeqID_1063
tgttgctggacgaggccaggcctcaagttgaagcgacaaaaggcgccacgaaagtcccgactgattgagcccgaaccaatcgcaccgcaggggagcgcggtgtaagggaaatgacggaaagggcggaaaatatcgatgaaaagacgctcccgactgaaaacattgcgaagccaaaagaacgcgtaacgacacaaaaaagggatcagttggagaacctaagggagaagaaaacgcattcccaacggatattaataaaaaaagccaattcttatttttaacacctgagaaaattttggacgatcgaacggcgtccgctcctccgccgcctcactgtccgcccgtacaaaccatccgaaacgcccacccaatgcgccaaaatcgaactcctcttcctccattccattctccattcgagacttagggcgttaagccagaagaacttttgaaggcttgttagtgttaccaactcttattgtgattctttgaaattatatgtaattaataccagtcgacaatgactgttagattatttgcaattatagggaaaagtaaacaatcatttcctcctttaaacaatgaactaagttacaaagaatgatttacattgttactataaattaattaaaagtggactaatgacagaatgaacaaatggaatgtcacagatcattagagtgggaagggactgttgttaggaggcgaggcaggcgatgctcgtcacttcagcgtcaattgtattcaaggcacccgccaaccgataactgattctgagtcgtagacgaggctaaagaaaaaccggccaaagtacttaggcaaaaaattaaacaaataaatgctaccgctttcgaatttgccagccgccgcaaattcgccttttggcttatcgtggacaaagcattggcctgaagactcgtcgaattcgccggaagcaattcaatttgataagcctaacagtttttgtttaaattgagtgatcaattaaataatacttttgtaacggccactgccaaattgaaatcttctactccagcgggggtattgttaactgtttgaaaccgcaattgtgccaatccattggagtcgaatccgttggaatccacgaataattgcatctcgataccacgctggttgagcacgatttgacccgttttcaactgatcatcttccacaagggcaccgtttttattactgtgtcaaaaaagtaacacggaaactgtttagaatgtttgggaagtcatggtaaccgatcaaatcagacggcaatttttaaataaatctatcggtccctttcacctggactcaaaactaaaaaggtcgtcgatggggtctttgccaatatttcttgaaaggggctgcacatttggaacccctaaacgagaaattgttttcgctaactgatggtttataccaccgccgaagagaatgtcaaccaaagcaggagaatccgtattgcccaacccgagcaagtcaatttcatcggccttcggtttttggctttggtgttctttttgcgccactattaattcctggtgattatcgtccatttcaattggcgtcgctgcggtgtgaagggcattgtgttcaatggcgggcattcgctccagcagcccattcctatcgaattaaaagtcagttggtcaccgccaaacaaaaggcatgaacaaaaacctcagttcatcctttgacagtaatcgtgagaattcaacggaacgttgttgcagctgaatttcaaaaaggtaacaaaaagatgtctgattgttagagcacctccaaattcatgtgtgccgaatattgtcgtattaacgcatgaatttgttcggcgtgcgagtcgaatcgcgtgctaagtttggcaagtgcagttagtccatactcacgggttggcacagtgagctgtggatgaggcatcaaaagttcgaacaattccaccacttcatcctcgctcacctaacataacgaattaaaaccaaatacaaaataaaatcgtacttttatatttgcctcctccgtatttcccggagtgacaagcaaatcaccgaattcgccaatgctccaaaatgcgatttgcattaagggctgagcatttactatgtgttcccgtttggaggcatgaaacaattggacggttgcgtaatgctgcagttcctgctgggaagagatgagctgaatcatcgcactgacaacttcatcaggtacatggttagctgcctaaaaaaacaaaaagtaggaagcaaaaggaatgtccgatcataccaattgcagcacgtttatcattgtgtccaaatgccaaacaagactcggggagaagcgctccgtcgcaacgtacattttagaagaacactcagctttgaaatcggagtcggcagtttcgaggaaaattataatctgaatccgatatgaaagaatgaatagaaaaataggaattagtaaacaaaaaaggacctccttggacatgctcgcgatgttcgtttggttcataagggcaaagcaaagttcaagagccctcctaaaaagtctgcttattccaactacttttatcagttactttttgatggaaatgtcggcatccttcagacattccaccacagtggtgcgatgcctttgcactgcttggaaatcaattgcaacagttttgagcagagtgttaagtgcaacatatcgaatgtttttgtcggtgttaagcaaaaaacgacccaaaatgttcacggccaaaactcgcaagccgctttcactgaatttggtcatttttacgtactgttagccttgctatttcatgcccacctttttgtttccattatagtcaatactgtttcatataaaatggcattgccaacatttttcgtcgtttccgtattcgtcgccacctgtgccaaaatgtcattcatctcttcactgacccgtgggtcatctctgcccaaaatcctcaatagcctgagaattttgaccttaaattcaaaattagctaattgtaagaaatctatgtgaaaagaaagacctgcaaaaatgggtcacttataccagcgacgtcatgctcagcagaatactcattcatcagcaagtttttgagtatgcgcaccaaattaggcaccatccaaaatgtaaaaccgaatttatttggttgttaaatcaataaagaacctttttgaagtgaatgcgtacatcggcactcaaatcgcacatttccgagacgagtgtaatgcccgccattagtacacctttaaaccctcaaaaatgcaaaagcctatggtaaaagtggcatttaccgtggtgtttttcgttgagcaatgagcgtgtgctggagataaacatttcaataaggtcggggacctttcggacgatacgaaacgcacacagagcggcctcaataccagcaaatagaggaaatgtccaaacatttcctacctttttcttgaggtaggtgttagtcgacttcaataaaagcttctcaacttcgcttgccaaatctcgacacatttccgccgaacaaattgagccaagagtacataaagccaaaccggcgacgaattgttccggatcatttaaatggctatgaaaagatataacgaagaaaaaagaaatatttaaaacccctttaagcaatttgtaacaagtaaatgaatttcggaacgctcatccaacaaaagcatggcgcccaaataaccaattcgaacgtcagtgaatcgtttatccttgctgcccaccaatttaacacattcaacctttcgatttggaaggattgaaacggatttcgtcttaaaaatgaatgtttacttgtccgaaatgtgcaggataaccaagcatgtgaatatagagaagtttagccatattccttaatttaattttcgatcgaatgcgaaactccgtgcaattgcctgcatttgtatttgttgtcgtcgtccctgaaggaatctctgatgtttgcactttctttctccaccactgcccgttcctcggccgctgttcgtgccgctcggacttgacgaatcaaatcacgcaagcgcatcgacgcacccaatgtccttaaaatgttaaagtcatgcctatcaattataggtttgtgacaattaattcacaccttcctagtcttgatttgacttcatcaattttctcaattgtcatttcaacaacatttgccattttgttgcactgattattctaaatttcgataattagtgatgcaaataaaaaaaattattttgcttccgaaaatgtttaaaaattcgaaaacacttgcctataaaatttataaataaatttggtttaatgtcccttcccgtcaaaccaatgtttgctcaattttgttcctactgtagttcaaaaaaattcaaaattttatttgtctatcggatacacagtaaggccttttgaaaattcaactgcataaattatgaagtttaatatgactcaatggataattattcaaatataaaataa

SEQ ID NO: 504 - DNA, 3086 bp, Heterodera glycines
cttctcaggataaactccggcacggagaaagctggccttccatgcgtccacttcgtccaagtttttagcactcagctccaattctttgtagtctttgtaaatgttcctgagaaggaaggaacaaatttcaataaggaaatgaaaaaataacaaaacccaaaaaacaaagcaacgaaaagcaaaggcacaaaagaaaaatggggaaattggagacaaaacgcaacaaaaggaaaaaggacagaaaggggcaacccaaagggacgacaattgggacgaggacagaacggcaaaaaggcagctcactatcatcgcgagttatgtgcgatttggccctttccgcccactcacctcctggaagcgaaaaacgtaaaaatggagagacaaatgaacacacataattagggataaaaggtggaaattgtaaaagggagggggcagatagggttgtataaaaacagcaattcccgggtcaaactgttcagtttttgaagcatcccttgttaatgcatgtaaaataatgcccaaaaatggacaggaccgaattcacaaagggaaaattggaaagagggaagaatgtattggttttgcgcatttgtgccaaataaaagtttaatgaaacttggcactgtttttggctgatggcttcgtccactccgacacagaccaaaaattgggggaaaatcggaagggatgaagactcactcacatgctaaatgcacacttttcattcaatgattgcgcattttgtaaaaaaaatacaatggaagggaaacggcaaggaatgaatgaatgaatgggcccggccaccccgttcccttcccgtctcactttccgtccgggtagaaaagtgcaaatttgtgctgccgggacatgaagccggcctcgaggtccttcagtttgatgccgtccagtgggagcatgtacttcttctccttctcctgcaaaacccgtttttcggttacttcgccttctttcttcctttttttacctcgtcgtctttgtaccacgaaagactgtccgatgttaggacgaaccaacactcgcgagaaccgcgaacaaaactgatgttgtgcacggagagccatcccttgcggatcacttggttgcccaggtttttcttcgtgttcgtggacgacgcctttgcctcggcactgaattttttttaacaattatttttgtatttaaaaaacgagaaacatttatttatttttaaaacttaaaagcaaaaaataaagaaaatttaaactgcaattacttggaaaagccgatgaagtcctcgtggtttgtgttcctaaatacaacacactattaatattcccccggattgttggtttgaatccgttgcgtttcaaaatgcctaaactctcccccgccaaatccgttgctcacatatatgccaattcgtagtcgaccagcatggaaatgtgctgtttggtgaacatttcctgctgccgcatgaaattggtcacaatttgctccacacagtcgcgcagtcgtgggtatcggttgacgcacaccgcgcactgtcgcacgacgttggccaactcattgaccaccaaatcgacgcatttaagcgccggctccttcagccgttcgatttgcttcttcacgatcgcttcgaatgccatgtcgggggtgaacagaccgaccctggcaaaggcaattagcgaatgatgggcataataattggggaaggaaccgaatgccgtggatgttgcgaatggcgaattgaatctcacggcgcatttccttctcgtcgatggtcattttcacgatttcgaaggggaaacgctcgtggaagagccgattgatgcgagcaccgccggagagttcgttggtgctgaccattttggcggaagaaccctcaatggaccgctccatgtcggtggtgaactgctggaccatcctaagcaaaatggcaacggatgcaagaccaatttattcacagaagcgaccacgtttgataaattagcaaaacaaatattagctaaattctcaatatcagcgacccattagccattgaacgaacataattaaatttcaacagagaaatacacatttagacacccacgtggcgtaaaataagcaattatccccaattatattaattgtatgttttctgagtcgtttctttatggaaggggctgatgtgtgactaaaatttgaccaatgccttccccccccccactcactgcatcagtgccttagttttgcgcgacgggtcgttgaattggaagtttttgtactcggccacctccttctccatggagtacagcttcttctgcaggttgtccctcagcgtgggcagtgtgtctttgatgtgattggtcagctgttggttcagtgccttttgcaggtacggcgtgcccaatctgtccgccatgtgccggtattgttggtgtgacagaaaaaatttccgctcggcgtccagcgcctggcggatgtccttgcggccgacgatgtccttctgagaacgattgatcacgccgacataacctaagcagaaaaggggaagcgaaggcattggaagggaaaaacactcggaaaaggaggaaaatggcatccaaaatgcccaaagaataccccgtctgagtgggaacactttgttctcgaggatgtcccgcgcgtcagtgccttcgtccatcaagtccaacttggtcagtactccgatggtgcggaggccctgagggtccacttcccgggccaatttaagcgcgtccgaagtggccaagtcgctgttggccggtgtaacggccaaaacgaggcaagtttcgcgggaaatgtacgtgccgatcatgtcacggatttgctgctcaatgtcgggcggctgatcgcccaccggaactttggtcagtccgggcaaatcgatcaaagtcaaattgagcactaaaaatattcccaaatttcacaagcagcatcaaattaaatcatcagaaaattttatttacaaattcaaaatttaatgaagaaagtttgtcgattttcgcctacatacgggcataattgggtattgatttgactgttaagctggcttttaaagacacgcaccccgccaaaaaatataaccaaatggacaaattccgaaa

SEQ ID NO: 505 - DNA, 4554 bp, Heterodera glycines
  genomic virtual cDNA Sequence=SeqID_544; coordinates=414..516 ,571..770,826..999,1053..1206,1261..1487,1533..1646,1694..1879 ,1940..2062,2107..2220,2273..2438,2500..2708,2757..2861,2912..3058 ,3115..3189,3234..3438,...
  genomic virtual cDNA coordinates=3490..3677,3725..3931,3990..4076 ,4126..4226,4274..4409
  coding sequence=SeqID_786; coordinates=414..516,571..770,826..999 ,1053..1206,1261..1487,1533..1646,1694..1879,1940..2062,2107..2220 ,2273..2438,2500..2708,2757..2861,2912..3058,3115..3189,3234..3438 ,3490..3677,3725..3931,...
  coding coordinates=3990..4076,4126..4226,4274..4409
  peptide sequence=SeqID_1031
ttcgaccaattcgagattccgaaaccaaattcgaacaaaaagtcgaaaattcaaaattttcgaatttcgggtttttggccgaacaaggtctaaatacattaaaatgaactttaatgtcatcagtgcttcaataaaagattgtttaaaccatttttagcctaaaaatcaaaattcgaaatttttgaattttcgactttttgttcgaatttggtttcggaatctcgaattggtcgaaatggatgtcgtattcgtgatcagcgaccccgaaaacccaataatacttgttttcaggagtttttaaaccaaaaaaaaaattgaaaatttctggccaaaaaaggggacccaaacccaatgagtaccgccgcgacaaatgcctttgatataattgtttattgtggtttttcctgtttagttatgcgcttggacattccgccatggaacacttgcgcaaggcgtcggttctcgtcagtggcctcggctccgtgggcgtggaggtggcgaagaatctgatccttggtgccgccattctttgattttactttgcatgactaaacaatcgccgcttttcaggcggtgttcgctcggtgactcttcacgacacaaaagcgttggcgttcagagatttgtcggcgcatttctacgccaaggaaagcgacgtgggaacgaaccgtgccaaagtttgcttcgacaaattggcggagctcaacgacactgtgaactgtgcattgtctgtggaaaatctgtcggaggatttcgtcaaacaattcgacgtcagcaaacgcttccttccttttcccgtctcgcctaattccgtcgttctttcagttggtcgttctcaccgacgcgtccttttccactcagacggaagtgaacggttggatgcgcaaccatcgcaaaatgttcatctcggcagacgcgcgcggacttttctcttatgcatttgtggacttgggcgacgaattcgttgtgaacgattccgacggggagacgtgcaaagaggtggaaattggaataattaatttaattgcgaattgaatggttccgattttcaggtgctcgttgagtacatcgactgcgaaagcggcgacatgacgacactcgaaggcgcatttcaccagttggaggacggggaccacgttgtgttcaccgactttgagcacgccgaactgaacgaacttccaccagtgccagtcactttgaagggaagtgagtgccaccactgatcatttgttggttcatctacagtcctcccatttttaggcaaagtcttcaacattggaaatgctctcgcggccttttctggcgcagttcaaggccccgtttcgcgtggacgtgttcagcaagtcaaagtgcccaagaaaatgtccttcaagccattgtctcgcgcactcgccgagcccgactttatgatttgggactttgccaagttcgacgaacctgcacaacttcacgccctttggcaggctttgtacagttttgaggagatggttcgtcatcttgcgactttccatttggttgggttttcctttcagaaaaactacagccctttgccccgttccgatgccgacgcaaaattgttaaaggaaatgctgccaaaagatgcgcccgaaatgccggactcactgctcttcaacttctcttaccaggtcccttttgtgcctttttcaacttcgaattcctcccccgtcttaaggcgtgcggaaatctccaacccatcgcttcgctcatcggcggtttggtggcccaagaggcgatgaaggcagtgacgcaccacacgacgcccctcaagcagtttctgtacaccgattctcttgaggcgttgccgggcgccgattcgacctttgacgccgccaagttggagaagaacgattgtgcaccggtgagtttttggacggacaactaattgctgttggagtgttcaaaaactgtccatttgcagcgcaacaatcgctacgacggacaggcggccgttttcgggtgggcctttcaggaggcgctgcagcaacagaaatggttcattgttggcgccggagcgattggctgtgagctgctgaagaacatggtcagtcatttgctgccaattgtaataaaagtacgttttgccaggcgatgatgggcttgggctgtggcaacagtggctcgctgaccatcaccgaccccgacaccatcgaagtgtccaatttgaaccgccagtttctgtttcgtcgtcctgatgttggggtcagttgcgagtcttaaatgttaccaaattcttgtcatcgcctttctgtagaaaaagaagtccgaagtcgccgcccgttccgtcaaagcgtttaactcgaccattcacatcaatccgatgtctgagatcgtcgccgagtcgaccgagcacatcttcggcgacgacttcttcgcccgtctgaacggcgtctgtaatgcgctggacaatgtcgaagcacgtaagaaattaggagaagggggggggcagactcaaattggcacttttgcccattttgccaggccgttacgttgaccgccgctgcgtgtactatcagcttccgctgctcgagtccggcacaatgggcgcaaagggcaacacgcaagtggtcttcccgcacttgacggagtcttacggctccacgtccgacccgcccgagaaggagacgcccatctgcacgctgcgcaatttcccctaccaaatccatcacaccattcaatgggcgcgagctgtgaaatttattgacctaatttcagttgtaggaaaagtcccgtttaagaagttcaccgactatttcacttcggttgcggagacggtcaaccaatacttggacaatgtgaacgactttttgcaccgagtgaaccaaatgactttttctcagcgggtcctttctttttccatcttttatctttttttatccgagttcttttgcagatcgaagtgctcagtacgcttgagcgtgcgttggtcgtcgaatacccgaaaaatgcggaagaatgtgtgagttgggcccgtgaactgttcgacacgctttaccacaacgacattgcccaaatgctgcacaatttcccttccagcatggtcgttttcctttccatccatccatttttttcttttttatataaatttgcttttagcttactgcccaaggcgacaaattttggagtggaaccaaacgctgtccgcacactttgaacttcgacgttaacaacgtgactgcccaatttaagccaatgaacccgttgtccatttttagcctgaacacttcgagttcgtcttctccgcttccattttgcgtgcccaatcttacagtttggctccgatcactgagcgcaaaaaagtggcacaattggccatggcgtactgctccaaaccgttcagaccacaagagggagtgcgcatcgctgtgaccgacgcggaggcgactgccaatgatggcaacacagcaaatggcgatggaggtgggcatttttgattcatttatcatcatattttcgattacaattttccagacgaaactgtacttcggctgaacgatctgaacgtgaaattggccaggctgaacttggagaacattcgccgcatgacgcccattgactttgagaaggacgacgactccaaccaccacgtcgacttcgtgacgagtgcctccaatttgcgagccgataattacgacatcgaaaaggctgatcggatgaaagtgggttgatttctcgacggatttatcccgaatgatttcgcattcagacaaaacaaattgcgggcaaaatcatcccggcgttggccaccacaactgcgctcgtctcagggctcgtctgcatcgaactctacaaaaccattgaggcggatggaaggcgctcgacggctcagatcgaacacatcaaaaatgcatttatcaacttggctacgcctttcattgcgttcagcgagccgggcaaagcgcagaagaagaaggtgagttttgattctgtttgggctatttccgtcattcgttattttctccgcttttcagtacctcgacattgacttcactctttgggaccgtttcgaagttgacggaccgatgacattggggcaactgattgattgggttgaggtggtcattgcttccaccgtttaactttttgcatttttttctgttcgtttagagtaagagtggcctcaccgtttcaatgatttcttccggcgtctcccttttgtatgcgttctttcagcccgcagaaaaagttgccgagcgcaagaacatggagtgagttttaattggctttttgtttctgtttaattgtcaaacttcagtcttattgcggttttcgaggaagtgtctcgtggcaaagtgccggaccatcgccgagcgatcgttcttgaggcgttgacccagaatgaggaaaacgaagacgttgatatcccattcattaaatataatttccgttaaatcattgttctttgagtacgctgtatattggatattgttgtgtctagagatcggaaattatacaatgctgtttaggctatcaggacttgaaaaaattgggcgcaattgtctgagccgcaaacacactgatcattatttcttcaat

SEQ ID NO: 506 - DNA, 2252 bp, Heterodera glycines
  genomic virtual cDNA Sequence=SeqID_545; coordinates=1699..1622 ,1310..1023,967..884,837..651,604..518,466..350,298..206,150..71
  coding sequence=SeqID_787; coordinates=1699..1622,1310..1023,967..884, 837..651,604..518,466..350,298..206,150..71
  peptide sequence=SeqID_1032
cggtaatgaggggtggggggggagagtgatcggcgatcaattctttggccgccaaagatctgccggctcgtcaagtcatcagcttcacgtacgaattgtaattggacacgtcgcgcttgagaatctcacgcaccggacccatcacgcgctctgaaggcaattaattggccaatgtgaaatggtggaaaatgccaaacaaactgaccaaatcgtgcccggtccaatttcagacatttcagcagagttttggccacgacggtggcggcacgagggcgatcgagaaggagggcgatttcccctttaatgagccggtaattaatgcagcggaggagtgagtgccaaaaccgaccgaaatagtcagagggtcccaattttccgaccacttcgaagggcgcgtcgtcgttcggtctctgcagcacctcagcttcgccctccacaatgatgaagaattcgtccccaggatgtccttaaatggtcgctaattgccctccgtctgtcttccccttcgctcttttaccctgctccaccacgtgggtgcccgaggggaattggcactgttccaacgcatccgccacattggccctttcccatttgtctaagtcggctgtaaaagagagaagaatgaatggggcagaatggcattatattaccaagaatctgaactttgctcaggaattcgtcgtacattttccgctttcgcatcgtcgaccccataagaatggcgcggtaagtgatgcggtcgatggcccacagtttgaccgtgttcgtcttcgcgactacggtggctgcgcgcggagtgccataaatcagtgccaactcgccaaatgaacctccctccttcaaaaaacagtttaaagcatttgcggctgcctttccgtcacaccttaatgctcaacacgaactcgccattgacgaacacatcgacctcgccactgtcaatcacataaaaattgtcgccctcttcaccctgaattgtcaattgtccgtcttttgtcgtccaatttgcttcgcttttcctccacctgctcaatgattgtctccccgaggtgtttctccaccggaaacatggcgtcgaaaatggccttttcctcgtccaagtccaaatgcgcaaacagcacatttttgcacatcgccgctcgcaaagccttttgcacgtcgtcgtctttcgggatgaccactcgctggtaattggccgcctcattttcgtccggcacctccgccgacacgcccaaccgacggcgattgccctggggcagtcggggcggctcctccaaagtgtcgtcgtcatccggcacggaatggacagtttcctatgaatttatgggagggtgaatttggcataaaagggagtccaagaaaaaaatgctattccatataaaccaactaatgaaacgattgagtgcccgcaaaaagagagttaaccttttgagaagcgaaccgttgcattttgaaataattagggacaaatgagggattgggcaaaggcaaagttgggatgggagaaagcgaggtttgcacagccgaagagaagcggtcgcgcaaatcgaccccgaaatgttagccttagcgccccctcagcagatccgcggaatttttcattcaattcgaggaaaatgcaaacatcggacggacggaggaaacggacgcgtttctcaaactcaccacggagacggacaatcaacattctcatgcactccatcaagtcacgcgaataaaccatcaaaattcaaatgctctcttctcttcctcccccctccattggccatctctccgatgtttcccccattttccttcctcgtccatttgtccccttctcccctccttttgctccattatcctcgtctcattattttcttcctcctctttatttatctgcttctgatcaccttgtttgtcttctcggccaaaacctttcttggtgacccctctccgccgccttccctttgctgcgcctgcgaattctcttccccttttccctccgcctctccggcgctaagatttgcgcgtcgccggcgcaaattggtcaaatgttgacccatctgaccgaaagcacttcagagagagccaaaatcaacacgcaatttgcattgaccagccgaaattgccaagaataagcggagatacgacgaaggattagccaatttggtgaaggaaataaggcatgaaagaaggggagagatgaaggcgaagaacgaatgaaaaacggcggatgacgacgaatgaacgcttctcgggggacgagggggaagatg

SEQ ID NO: 507 - DNA, 3207 bp, Heterodera glycines
  genomic virtual cDNA Sequence=SeqID_546; coordinates=3128..2721 ,2610..2401,2346..2174,2120..1936,1880..1750,1698..1579,1515..1365 ,1304..1096,1049..935,889..851,802..714,667..530,406..351,301..1
  coding sequence=SeqID_807; coordinates=3128..2721,2610..2401 ,2346..2174,2120..1936,1880..1750,1698..1579,1515..1365,1304..1096 ,1049..935,889..851,802..714,667..530,406..351,301..184
  peptide sequence=SeqID_1049
aaatacgaaccaatcatcaggcataagaaaacgctcacacaaacaataggcatgacaagatataaacaactactagtttaggtccagcagaagagtgattgagaggaaaggggcactctccaaaaggaaggaacagcgagtaaaagggggttaagggaaatcggaaagggttgcgaggaagtgtcaaaaaatgaagtcctccttcgccatgtcgagagcccagcggaatttgtcgcgttgcgttttgctgaatattttctcaacgggcacgtcattctttttgcaccatgcaaccgaaatcctgaaattttttttggacatagtaaattggaatattcgatagaaccaacctcggatccaagtagttcagttttgaggttcccagtgcaatttgtttgttttcatcctgaaatcaaaaatgaccaatctttgctgttcccgattcgttgatttgaagggtgacttatttccccgaaaaatcaaattccaaatttgttcggaatttttgccaacccttccttccccctgccttgtccgtgcgctgtgtgttcagtttggcgatctgttccttcaatctttcgtatttttttgccattttctcgtccaccgatttgctcttcttcagctgatccttcaactccttgtactcctgcttcttctcttttatctgaattttgcttaggatttgcgtttccgtttcatgtcatattcactttattctccaaattttccatcgacttttcgtgcgtttttggcactgccctttgatggttacaaaggatggccacctgacgatttgcacctgaatttaggcaatataagtgaaatgcctctgaaccagtggctttacgattgtaggaaagcattttctcgtggacggaatcggaagctgaaatttcggaattaatttggcaattaaaaatgagttggatacgatttgtcagtttgtccagctgttcttggagagtgatcgacgcgttatacgtacgaaacactttcgcggtcagtccgtccatcagttccttcaggtattggttcaacgaactcgtctaaacaagcgagtaaataagcaatgtttcctttttgctctctcacatccaatcggtcgaacaaatcgtcccccgggtctttctcctccataaaaagcttcagatttttgaacacttgcttttccaccggcacacggttgtaatagcggatggagtctttgccgaggaagtcgaattcaacaacatacttcaggtcgtccatatcatcgtgcaatttgatgtgctcacaacgcaacgagcaacaaccgaccgtgtctgaaagccaagttgcatttttccaagtttacattttaaggcagatgtgtgaaatttgaccggccgcttcgtcggtgtctttttcattgcccgcacgaagtgccaatttgtcgataaaatatagtgccacggcacgctgacggatacgcatttccttagacttaaagtcggcgaggtactgctggcggatttgaccgacatgtccttttaactaaaaacattgcagttttatcgtagtgtctctggttgatttgtaactcgcaaaatggcacacctttctcgccttctcaaacttctcccaatccttttggcctttgagtttgctggacggattcagcattatgtacttgttgctgcccaacacattttcggtccatgaacacagccaagtgacctgtaaatcacggacatttccccaatatattcgtgttctccccaaatgtacagtgttatcatgacggatttccttccatttgtgcccctccggcggcataatcttcagtcctcttgagcagttgatgaccacatcctccggctggacccgtttcttcagagaacccatctttggatggtcacctgttcatcaacaagtctcgctttcctcttcgttctcttatttcactcaaattacctctccccctgaatagtcccggcggttctattcggaagttgccaattttctgtttgtatccgtccaacatggcgaacccgtacacctttgcctcgccttccttctcctctttctccgcctttttctcctctttgctgcgcgctttgcgcttctccgactccgacacgtaaaaagcgtgcatttgcctttcaatggatgtaaagttacaaaatctctcgtctttttattttttgtttacctaaaatcgcatttggccaaatctttaatttcggctcgctccgcctttgtcatcactttgacccaatccttgaaaaagttctggttgaacaccggttttgacgtgtagtcgtggtcgagcattttcgcgtaaaaggaagccacttcttcggccggcaaagacaaatccatctccttaaaaaactcccatatcaatttttggttttaaaagttgtaattccaccatacctttccgtcgtatttgaacttgatgtgttttggcaatggcacataggccggtgcaaagacgggccctttgtggacaagcgtttgccatttgatggacccatcggaggcgcccgcgttcgactcgtcctcctcccaccagcgccacacttcctcttcttcctcctgtttcttcacacgtttcttggacggacttccctgggaagaggagggctggaaatgtccaaaaataccaaggttaaatatataatattccagggaaattagaatgctttttctcttccattttagtgtcccttccctcccattgtttcccttcgcttcttcttccgactgacctcttccttcacttcaactttcgttgtcttccgtttcttgtgctcaaccccagcgccgctctcttccttgacctccaccttggtaacttttgttgttttcgttgactttttgctgtcgcttttcttcgccggggatgggtccgacttttgtttctttttctgaagtatgtcatcctttttcatccgttttccttctcttcgccttacctttggctgatattcctcctcttccccgtcggagtcgtcgtcaaagtcttcttcctctccgctgctttcgttcttttttcgactttttgaggtcgattcctttgactttttcggcataacttcctcagcttttttcccctttttcttctcattgctggtttcttcttttcttaaattggtttgttttcaaatgatgttaccataaaaaggcatttcttctaatatataaaaaagcgctcaaaatgttcgttaccgtttccccgtg

SEQ ID NO: 508 - DNA, 7265 bp, Heterodera glycines
  genomic virtual cDNA Sequence=SeqID_547; coordinates=6173..6048 ,5864..5722,5653..5485,5422..5376,5037..4901,4511..4426,4078..3892 ,3420..3089,2742..2623,2119..2008,1908..1860,1404..1174,452..296 ,117..1
  coding sequence=SeqID_811; coordinates=6173..6048,5864..5722 ,5653..5485,5422..5376,5037..4901,4511..4426,4078..3892,3420..3089 ,2742..2623,2119..2008,1908..1860,1404..1174,452..296,117..1
  peptide sequence=SeqID_1053
cgtttgctgctcatgttgttgctgttgtgccaacagttgttggccaccaatgttgcgccgctttcgtcgtccatgggacatgaacagttcgttggtgcccgagtccaagcagttgctctacagtagagtgagatgaatattttgccaaattttgtgccaaagtccaggcttttttttaaatgtcgagctctaatctcatcaaattccagaatattctctaaatggcttggaattcagtacggtgtcatggtactgtaatgaatgaacacattttttgtgccgaaaaatcaccgaccggcggacatccgttgggtccggcacagaacatgacggtgcacacaatttgtatgtcgtaggagccgtccaaacggaacgccttcatctcggccttgagtcgattcttgtcaaagtcttgctccaccgggccaaccagggcagggtagcggggacagctttaaaaagtgccgtaaataattccggccgttaaatgtggcactttcccactcccatttggaaataagtggcacggactctaaaaaggcgacacctttcataaatgccaaggcaaacgacgatagagatgaaaaaagatgaaaaacaattttttttttttgaatggagcataccaattgaactgtttcaaaaacacgccatggaccccccaagcccgtagccaggaaaaattttcggggggggggttttttttttttttttttttttgcaaatttatccaataatttttttttcctgctgggtaacaactggcttttttgcactaaaaatgaccaaattttggccgttttaaggcaaaaaacttgtaaaaatagtggaaaatgtaggtccggcggtgccgataggcgccgccggaaacaaatttttggaaatttgagtgctatttgttacgaaaattgtctataaaatttttaaattttcgtttggggggggcaattcgaaaaaattttccattatttgctggaaaatttttaaaaattttcatttcgggggggggaattccccccccttccccccccctggctacgggcctgggacccccccccgtaaaaagatggcaaatgctttacaaaaattgccccctcccaaaaaagcaaataccatacaaaaattggcaaaaaaacggcaaatgccatacaaagagcattggctcctcctcacccgttgtcgatgatggtgaatggcactggctcgccttcgccgcccacccgagtggccacacattcggtgaccatcatattgtggggcccggcctgctcgctgttcaccaccaagtgcagctgatcaccgatggatgccttctccagcggttggttgtccttgtcgaggaacgacagttgcgcagtgatcggcggcggtgtgccggcgctcagcacttggggctcggcctccctttgatgggtggacaaacaattaataggattgttaattaattagtagtcggatacaaaaaaataaaaataaacacaagaattaattaatgagtttgggttggaattggacattgaatggaaatttgccaatgtagcgctcaattaattaattaaactaattaataagttggtgggtgtgaaaattgtcgtatgagttaattagttcaggccatttttcagcaagctggattatacaaattaattaaattaattattaacgaatgattttgggatgaaatttgccaatgaagccagtgcttattaattagtcaactaattaatgagtggggttaaaaattgttatgttaattaattaagtattaaattagttaattcataataactgggctggttccccgtggcccaattcaaaatattctaaacgcactatcgtttcccgactgacagacaaactttgtctcgaatatggtggttacgatcactgtgccctcaaagccgggttcttggccggcggcatcgccacctccggcaccaccgccgccgcctccggcactgactacggcaccgccagcgctgttgctggtccgcaccaagcggtcaatgtccatgttcacgtcgcatgacacgcggtagaagcggtcccactccgtggtgacctggtgcggcaacactccgtccaacgagacgaccaccaacgcctccaatttgccgtcctgtggacagaaagatttttgataaagcaattcgttttgataaaaaaacagaggaggtctgatcagcttttaccggcaatgattggacaaatttatatctgattttgatcaagcacccatttcctattggtatatttatttgatcaaaaaaagacaatgggtctgattggcttttgtccgcaattataggacaaatgtataattttatgatctggttatgatttatttggtcaataataccctcccccaatcagtgaccaaatgatttattggtatttaaattcaaatttatcaacaagccacaagtctccagagcgcattgccagaaaaaggaaaaagctcattgttgctactaaataggctcttcttgcaaaaagctgaggctatttaaatcagaaactgattgattgtatggcttattcagtctgatcaaattcaaagtaatgctttgaagagaaactgatcaggagaagagcaataaactaatttccttgcttttggaccttaattgtagtgccacatgccggcgacacatttggcggcgggaatgtgatggaaatttgctttgcattctcgaccacttgggagcacgtgctgaacttctccgccgcataaatggcacccttaaatggagcggggggggggggggtctaattcagaaaaaacgcataaaaagaaaaaaacgaagttaagttaaattaaatggttgtaaattctggacaatttctctccccccccccccccgtccgataaattaaaaaaaattttataagaaatttcattgaatatgcttttaaatctctgaaaattttcaacaatttttattttgaatttttttaattttccatgagggcggaaacggactgctaccaaatatgactattattggttaacgagccggaccattttcttgagaaatttcaagaaacatttttttgtaacgccggcccaaccgtcgaacagacggaccgtgtacggctctttggtgttcacaatgaagcggatgccgtcattggtgcacagtgccatgcccccaaactgggactcgcagttgaactcgtagaagtcgtaggacggattctttttgatgttcgccgtcgcttggcccaccgcataaatgtggcacgtgctctgtgtgcggtcgtaattgatcgatttgcagttcaaattttggaagcacagcgaaatgcagtcagacacggtgacgccctgggcgctggccaccggttggccctcaatggacacgccgatgaagcggttgaatgccgcctgttgacggcacgtggacgagctcagatcggctgtgaattttttttttttttggttagtgatggattgatgaaaaaatgtggcacaatgattgattgggccgaccgatcggtggaaatttggccgggataaagctatgcccaaaaaaatgtgaaactttaagcccataatttttggcttctctctaattgatcagcgccaacggtgattagaatcttaagaatgaacccgggacttattctgaactttattaagcgttgatcaatctgaatcagactcgataaagtgatcaaaatccaattgaattcggctaaggatcagcttaaccgttttttgggcttcatcactcaaagaagagtgatcagagaatctcacaggatgcgcaccgatacccattctgatcactttttgacttgttggtcagacttcggagtgaccaaccatgaacaaaaattagtgatcagagaatttcgggtaaaaatattgttttttttgcctctcacccgccacacaaatgggctcgtaatagtctttgctgtgcaccgccacttgttgatcagcgcgcgagaatgtgtcctcgtcgctgacaatgcagtttttctcgttgggcgagaattccaccgagcgacagaaggtgttcagcgagtccaggcacttctgcagacagttggactcttgtggctcaacagactgtaaacaaaatgacattggttggatactgtaaactgtaaaatgggtgtggaatactgtaaaaacggagagtgagggtactgtagctgtacataaaaatgggtgagaatagcaaacttaaaaacggagggtgaatttggtttagcaaactataaacatgaaggcggccgggtaagaaaaggaaaaaggcctaaaaacgggcatggaatacagaaaactgaggatatggtggacctggtacagaataatgtaaaaatgtgctgttacagtaaaacaaaataaaaattcttccaatcatttttcatactgtttttttcgtgataaatttgctcaatttcccggttcacctgagtgtggtcatagaacttgatctcgaactgggtggtcttgacgaacacaaggttgccgccctgctgaccgcagcgattttgtcctggaaagaaaatcaatcaattcaaagccatggattttctaaaaaaaaaaatcgttatttattttgttttcaatccccatcaaaaggagggctttatctcagggaggggctcaattttaagaaatacggtagtattttaacaacatttaacccccgaaccgtcgggactgatgactcgagataatgtaatttcattttttcaaggtcaggattcgaatgagtcaggatttcgggactagcccggcttggttgataagctccgaatgatccgggattttcatttttagaaactcgaaagcctaatctaaaaaccgatttttgtggactcgtctcccgaccggaaaatgaccccgagaacccgttgccaccactcggacaacaacacgcactgttcaagcagttgttgtcatagtaatccaccggctggttggtcatccgcaaatgggtgggcttcgagcggcggtcctccgtgctcatctcacacgcgtatgagtcataattgtagttgacggaacggcacacgaatctggcacaacacaaaagaaaaattgctgcaatgaatggatgtgtgggtgagagtctcggtttttatgagatcagaaaatttctcgggattttttgccattttcgggcaaaatttgcgactcaaaaattttttcccgattttttgggtacttcatatatatacatatatatccaaaaaaccttttatttctgtgttttttttactaaaaatatatgacttactcatctaaattcattccctgccatttttgaggcaaaaatttctactcaaaataaaatttttccaggttttctgggtctctctattcacgggataaattttcggttgaaaaaactcactctttttccagaaggcatgcgctcaagcactgctcccgggaaggcacctttaaaacggggcggtaaattttaaaatttcacaatatttttcgaattccgaaccatttacctgaatacttttccgcacaaagccgtccagcgacgttttgcgcatgcgttcaaatgaaaaggagcggtaggtgcacgcctcgtgcgcgttcacgcccggcaagcaggtcttctcgtagtagaaattgtttgcggatgggtttgggttcaggtcggcagtgccggccgggctgaacatggaatgccaaggaaaaaatcaaaaattcctccgcgccatgccgcaccaaacattccccaccttgcggcatcgtcaaaaaagtagcacgtctcgcgtccgtcaaagttaaaagatgcgcacagcctctgagcaccggtcgtgggttcgatgttgttccggcagtattgcgagcaggtcaggtcatggccagccgtggaaacaacctggaaattagtaaaaacaattatgtaaaatcattttaattgaccaattctgtcccagcctaatatgttctgctgatgtagtttatggattattttatgcgacccgttcactcggagcagatttgattgaaaataactgctaaattctggatccgacaataaaaaagtgcccttccggctcaccaatggcgtgccgtccagacgggcacgtgaaatgcgaacaaatgttgctgtttcatgattggcacattcaaacgcgccaaatgtgccgggtgtggcgagtgccaaaagcactgcaacaaatggcaccagcgcaatcggtgccggaggggacaaatgccgaggacgacggactggtgccgatgatgtgggtggtagtggtgccgaacacgacaatgttctgttgttggcacgacgcattttcccggattgagagaaattattcggcgcgacctttcgagggcataaaattgtcgatgaatttaattagacaagaatttcggggataaaatgggtacaagaataccatgggatttgaaaacggaaaattcgctggccgcggcacgtcaaatgagagaaatagtaggcaaaaaaaaaggagggattgatctgacttgcactaggggttgtcccaaacgaagcatcattatcactaataatggatgcgcgaatttatgtgtcaagggaaaaccctcctcccggaaaatggggtcgagtaaaactctatactgtaacatctgtacagtattattgaccagttctggttggtctacacttcaatgaagggtaaacccctgcctgaatcgggaacatcccgatttattgagtcccaatcccgattctcgacataaatcccgaatccatgtcatagtgccggaggcttaaaactcgcctcgcacattcacaaacgaatgttgtgcaaacggttttccgtaatgggataagacggtggaaggggaaggaagaggaggaggaggcgaaggaatgggaacacagcacaaccagagcaaaggaagacggaggatgatgatggtatggctgtgaccgcaacggaatggaaggggggggggaagaatttgggtcataaacccccgaggggttctcatgcccaacggggcgggagggggtgggggaggaggtgtttcgcagcagtaagtggataataccgccttcggaagacactttgtgtgttatagagagatgctcatccgactatctcgaatttacaccgctattttggcgggatttacgcgaaacttcgtaaaaaactggcacatttgccctaaggccacatgattttcgagtgtcgagaatgggtgggtcaagaggcgggagacaatgaattagctagcattatattatgatcattattgcctccttcatgatttacgctcttgaagg

SEQ ID NO: 509 - DNA, 4406 bp, Heterodera glycines
  genomic virtual cDNA Sequence=SeqID_548; coordinates=1563..1778 ,2003..2279,2504..2699,3122..3454,3556..3696,3885..3998,4064..4269
  coding sequence=SeqID_813; coordinates=1563..1778,2003..2279 ,2504..2699,3122..3454,3556..3696,3885..3998,4064..4269
  peptide sequence=SeqID_1055
aaaatttttccctacgttcaaattttcttgaaattttgcataggcccatattttgaccccctctatcggatccctgtttattttatgaaagttatgtttttaactcgagatcggctcttccatttttacaagggaaaatcccaagaaaatttaaagttttgcaaagttttggcgttctgattaatagataaataataaacttatttgcactgggagcccaaaattgaatcgccatgtttaaaatttaaacatcactccagcgcactgatttacccgggcaatgcgggtacatgaatcatgccgaagagcaacggatgttggcgcatttgaagagcacgtgaaaaggaggagagtattggaatggaggacattttgggaaactttaattaaagaatgaaaaaggtagcagcagcagcacacagtcacacacagcagaacctattcccttcctacacatacatatcctttcattttctttttcttatcagcaaaacaacaaaaggtgataatttgaatcggcgtctgtcgccgggtactgctcgagaatcctgtgctaggcctagagagtcccacgactcgggaaatatgtagtcggaggactgactatacatatgcaactttgcagattccaatccaatcgaaactaagacttttgccggattatttccttttcataaggcatttatactttaggcactcagagttttgcattgtgaaatttcaaatttcacaacatatgataattggcattatgtttttttgaaaaagtgttttttaaattctatcaaatttaaaattgtttcctttgccttttctaccactctttaattgcctgcgattgatttttgattgtcgtttatggaagagttcacatttttttccatccattcctttacaaaaattggagggaattctcttcctatttatgtcatgtcgcaaaagaatatgcatggaatggtactgctgttgtatgggcccatattttttgagattgatgggatggaattggagaataaaaatgagcacaagaaaaggaaggaaaggtgaaggccttccatcgtgtgatctttggtcttttccatcagctcacaaatattcgagtggaaaggaggggggggggaaggggtaacaacgattcatttttggtgtgcaatcgcattgaaaggagagaaagtggaaaaatgaaaatggcaccgccccgtcccctttcacatatttgatgggtgtgtatattcttaatttgttatttgcatggttttatttatggaatttcatttttctggttcttttttatttcatttcattttaaagaacttggtaaattaccttttgtttgttcgaatttcttgaatttgatgtttcgctttattctgactgacagtgtccgactagtcagctcaatttgcgctaaaaatcggatttttctgtgagaatttaagcctcatttgcactttcacatttttctctcccatacataaataattatgcccagtctaacctccacaatttttagtccgaccaaattttccactcattttgcgtccaaaacattccatccaaaaatgaccatttctgcgaccgctgacgttgacaagctccaggatgcggccaaccgaatgcgcatttcgtccattgagcagacgtgcgccgccaactcgggccacccgaccagcagttgcagcgcagcggaaattgtggccactctgttctttgccgaaatgcgttatgacgtgaaggacccgcgcagcgcatccgccgaccgtttcattctgtccaaggtttgcaaaaagtcgcgggaactcgctgatcgcgcgaaattcggttgtgtccggcacgggtcgtacgactatttttattggaattgggtattccagttagtggatgccattatcggggagtgatttaatattccaattcgttgcttctactatatttccacaattcggactttcctccaatattcccatcccacatcaattggccatacaatttcaatttccagggtcacgcttgcccaattctgtacgccgcttgggaagaggcgggcctgctcagccgtgaccaagtgctctccctgcgcaagattgactccgacattgaaggacatccgaccccgcggctcaacttcatcgacgtggccaccggctcgctgggccagggtctgtcatgcgctgccggcatggcgtacactggcaaatatgtggaccattcgtcctaccgcgtgtactgtttgatgggcgacggagagagtgcggaaggctccgtgtgggaggcagcaggtgaactcaaaatccacggatagaggagacgtagtcaaagcctgggaacctacgggaaaatattttttcatgaccgttagtttctgttgaaactacatttaaaaattaatcataatttgacataagccggaatcgggattgcatggtttaggagaaataaaaaaaattttgttgtttttttttctaattttatgttggggcaacgaatatttgtcccttttcagcatttgcaagtttctacaagttggacaatctggtggccattgtggacgttaaccgacttggacaaagtcaggagacccaactgcagcacgacattgaagcgtatgtgcaacggtttgccgcgttcggttggaatgccatcggattggaggacggacacgacatctcggcacttttgaatgcttacgccaatgccaagtaaactcagggacagtatttttccttttcctgaattactgattgattgtgagccgaaattcctccttttccttcctgctgctggggagcaggacaaaacgtcgtcggggcataatgtcgacgcaaaaatttttaattagaaaaaaaattaaaattttttatttacctagtctaattcgaaatttttttctaaaataaaatcttataaagaaaacaagggaaaaaatgtccccgttttttttcttaaaacttgagcagattttattttcattaacacttagattttcaaaaaaagacaaatatttttttaaaatttttcttggactttttaaacaacattttttcatcgactttttggggtgtgcccttccccctggactggtattttaacacaatcccattgaatttatattggcgttaaggaacgtgactggcaaacccacggcaatcatcgccaaaacgctcaagggcaagggcattgacggcgttgccgacctgaacaaccagcacgggaagccggtgtcgaaggacaaggcggagcccatccgggcattgctcaaaagtgacaagccggcaaattggaccatcccggcaccgattcgggacgcaccggcggtcgacttaggcatcggtgccatcgcaatgagtgcaccgccgcagtacaaaatgggcgaaaaggtggccactcgacaggcgtacggaaacgccttgctgaagctggcggaggccaacaaacgcgtcattgccttagacgggtgggacagataataggcacctaccgaatttaaatggatttaaataaaaaaaaatcctttttgatgtgtcaattcaatttttaattgttttttccgtttagtgacatctccaactccaccttctccaacctggtgcaaaagaagctacccgagcagtttgtccagtgttacattgctgagcagaacatggtcggtgttggagttggcatggcgtgccgtgggcgtgtgcttccgcatgtcaggtgggcagaaagaagccttttggattgccaaatggccaagaagacaaactgctgttatattaaggggattttaaaaacaattaaaaatttttttgttacactgaatttacaacagaaaaaaaaccaccgggtttttgccaaaatttttattaaatttgccccctattttatgcattttacttttttagcacttttgccgccttcttcacccgtgccggtgaccaaattcgcatgggcgccgtgtccttcacaaatgtcaaattcaccggctctcactgcggcgtttccatcggcgaggacgggtaaactgctgctggcagagcacttggaaaaaaagggaattgcttcaatttctgttttgtttcagtcccagtcaaatggccctcgaggacttggcgctgttcagcgctttgcccgccagtgtcgtcctctacccatccgacgcggtgtcggccgaacgtgcgactgagttggccgccaattacacgggcatcacttacacgcgcgtctctcgacccgccaccccagtgctctacacaagtgacgagaagttcgagctgggcaagtgcaaggtgggcagcgatgggaggctagaaaattttcaaaaatgtttttgaattttaaatagggtttcataaataattttgtagtcgtcactaatttcgttagaatttcaatttaatggggtggtcggtgtcggtttatgtaaa

SEQ ID NO: 510 - DNA, 2359 bp, Heterodera glycines
  genomic virtual cDNA Sequence=SeqID_549; coordinates=2122..2072 ,1912..1809,1752..1659,1599..1492,1401..1296,1237..1116,925..735
  coding sequence=SeqID_814; coordinates=2122..2072,1912..1809 ,1752..1659,1599..1492,1401..1296,1237..1116,925..735
  peptide sequence=SeqID_1056
ttttaagaaaaaatcatagaatttcttataagaaaatttaaaaaaaaaattagaaaaaattttaaggattttttttgaaatttatgataaattagtaagttttttcgaaaaattttccaaaaaatcactaaaaaattttttcaaaaatttttcattggaatttccatataaaaaaattctaagaatttttttcttgaaaatttccaaattttttaaaaaaaatttaaaaattttccaaaaaatcactaaaaaattttttcaaaaatttttcattggaatttccatataaaaaaattctaagaattttttcttgaaaatttccaaattttttaaaaaaaatttttggcgaaattatgtcccggcgaaatttcggcggcgaaattatgtcccggcgaaatttcggccggcgaaattccgtccggcgaaatttcggcggcgtaatttcggcggcgaaatttcggcggcgaaattttggggtgcacccacaacaaagcaataccaataaatcaaacccacacatttcgaaatgcacttaatttacactcacattcaccaaatattcatgcatatcatccttttcattttgttttttcttccattttgttcccttttttgtttcccatttccaaattacggaattttaatatttaattaatttcccttaaatttgtttgtacgtatttttgtatttcatagtaacaatttagtgaataaaaatgtaattattatcagttttgaaatggaattccccaccttttccgtgctttcccaacactccgaaagagaaggactcgtcgatgaaaatgcgcactttgtgtcgccatttcagctcgatcagtttgggcagtgggcaaatgtcgcccgaatttgtgtaaattccttcgacaacgatcaaacggcgaatggacgctttccttttcggattctgcgaaaatggctttttgctgaattctacagaacaaattcttacaagtataaaaaatttaaatgggtttgctaaacaatctaatccgatataataatccgaattttggtgcggctcaattggggagggccgtcgcgcggaatgcattccctcggcaattcttttgtttcccctttcccgttctccccaccattttgtctttctcctccaactcgaccattttgcgctccaagtccgccatgtcattgtgttcaaaccataaaatgtcacttctcgacgccatcagtccggattgtatggcgaaattaacacctaaaaacatggcttttattttccatggccaacaaatgattgggcgactcccggggacctttgtccgcaaaaatgacatcgcccctccttgaataagctgggatggcacttgcgatggtggggaatccgtagctgtacagaatggcctcttcacagcccatgaactgtcaatttgaatgacaattacggtatgacaatacagtgtgaaagtgccgccaaaacgaactatctgcaaatttttgctttgtccctacctcagccaattccctttccaagtccaaatgtacgtccaccgttccgtagaaattcctgggcccgcatgagcccacgccgtatttgaaaatggcatttttggctacttcctatgaaatggaaagcaaaacaaaaatatttttaaataagccatgtatgaacaacaaacttcaattttctggtttccgataaagccgaaaaaatcagtcgacgccaaattgacgcatcgtttgtcatcgatgacaacaaatttgcccattcgcctgtatttggtttgtatccgtgataccggtccaaacaattcaaatgaaaatcgaacccttcaattgaacggggccgataattcgggtcgttttgttccctttccgagtaaagcggcaccaacggactcggctcccaattcgcaataaccgcttccttttcctgcacacaaaaaccaatctttgccagcagagaatggccgtttttaatcgaattcaaatggcacttgggtaatcgcttttttttttgttttgttgaatttatgggttttttcgacgccaaaatttctgtcgccgtcccatcgttctttccctcacctcttcgctcagttccgcttttttcccctttttctttcgcttccctcccatcattttaaagcgccaacacatgcaaatggtcaaaacagttgcgaccagtaaaggccagctgcgaattgtcaaggcgaaaacgcagagcaaaacggaggatgccatgccaaaggaacgcaccgtttgggtgagagggggcgccatcggagaggcgaaatcggacagaatgcaaaccaaaaatatattaacattatcaaacattgcttattgttagtgtacaaaataacaaatacaattcgca

SEQ ID NO: 511 - DNA, 5091 bp, Heterodera glycines
  genomic virtual cDNA Sequence=SeqID_550; coordinates=4426..4285 ,4185..4085,3917..3429,3274..3130,3087..2964,2907..2848,2792..2547 ,2493..2376,2320..2235,2181..2083,2037..1863,1681..1549,1161..1097 ,1046..965,914..840,697..495,453..304,204..1
  coding sequence=SeqID_790; coordinates=4426..4285,4185..4085 ,3917..3429,3274..3130,3087..2964,2907..2848,2792..2547,2493..2376 ,2320..2235,2181..2083,2037..1863,1681..1549,1161..1097,1046..965 ,914..840,697..495,453..304,204..1
  peptide sequence=SeqID_1233
aaaagccgtcccaacagaccctccctggacgagttgaagcttttccatggccaacttaggcgccgatgcgccctttggcggcacaattcccggctccgcgtaacaatccttcaccaaaaagtccaattcgtcgtccatggccatcaattcccagcgaagttccaaaatatcgcccaactttgcctgtggcacatttcaattagcctcccttcttcccgttctctcctcgccttttctcacctgcaaaagcggctcgcgcagttcagttgtgctaggtttgccggcggcgtcttccgagcgaacttctctcatcggcatcatttgcattagcaccgggttgcccagttcgatctttccgcgcggttggatcagcgacggctgcggcccctgcagcgtcaaattggctgcagcggtcactttgcctcccaacatgctcgaataattgcaggaaatctgaatgaagggcaaagtcagtgactgatcggtcggcgaacttcgtaaagttggtccatcgaagtgacgaggccggggatgcccaaattgttggtctgaacgaccaccaccgttttgtacgtgccgttgtccatgtccacgaggccacaatccctctgcgattggcgacgttgtctgaacattatagcaaaacttgcgaaagccttttttgaacactgtttttcgcggtttccaaaagaaccttctgtttttgtgcttcttccgatgcttctcttccacttccattggaatgctttccaattgttccgttccctcaagcgaagtgccattggttttgtcaacggaatgtgccgtctgcgagtgcgccttggggcgacgatgagaaatgccttccggggaggtcaaagtgatcggtttcatgccaaagtttgcaggaagtccgagcactaaagtgacgctgtccttggcctccacctgcgaatgttcggctcaaatgtccgtccgttggcactttctgtccccacctcaactcggcacgtgtcgtatttgttcttgacgaacatcactcccgagaagggttcgctgtgttttatctgacaaacaaacagagcatttggccaaagatggtcaagggacggcccacctgaacacttatgccctcgtaattgcaaatcgtgtgcacttcgctgccggggatttggatgggcgacggcaactgattcgggtcggggccgttgttggccactgagaagccattgcccccacttgactccggcaccgatttggtctcagatgcctgctgaaagtgtttttgataggtgtttttttgtcatatccgcttggattccccccccccccccgggatttttctacgtcattgcctggggttggtctttgtcctttggcgaggatggcactccgaatgccttcgactctctgtccgtttctgtcccttcgttttctgtttgaattggccctttcgttggcccttttctcagtccgtccgtttttatcgtcggctaaattcaaagttttcttttttcttttctctttcctttgcctttttgttaagtgcgccgttcgttcgttcgttcagtccaacttttttgtcctcttttgcgccttttccttcagaagtgccgctcaccaatgcctttttttcctttttttacattaatttcccaatttttgatttgatccctttcatttctcctcatcccatatccctcttccccttattctctcacctctccctcctttctttctctctctctctctcctctttctctctctcctctccctcattatctctctttctctctctctctctcctctttctctctctcctctccctcattatctctctttctctctcttctatctcagtttgtctttcttttctttctcactttgctttttggcacattcgctgcgcttgattcctccgattggacttctttcagtgcacaaacattccgataaaagtccacttgttcactcttctgcatcgcccccgacactgtgcccaattgtccgatcactgcgcatgtgccatttcgccgattgtaattaagtccttcacaactgaaatgtatttcataaattttaatgtttttaatcaaaaaccgttgtccggcaccggcacacaaattcaaacatttggagagaggcacagaatgcaattctttgctcagttcgcccccgacccattgggaatacaaatggcgactttgtgggtaaaattggtatagtttgtcatttccgaaattggaaattgtcacctgaacgcggccccctcggggtcgacgcatcccattgattggccctcgggcgatgtctccaaacagtggaggtcataaagatcgaccttcagcagaacaaagcatgatcaatctcgaccagtcagcacttggccagcccacctgtcccttcggctcggggcgcagcgaaccgcggccgtccaaataaagcaaattgcaaatgccggacgatttgtcgaagttgaaggaacggcatttgtcgggagagtgagcggcacatctaagaaaggcaaatcattcgttggccggagaaagtgccggtcattcactcacttttgggcacattcgcgcacattcgcctgcaccgtttccactacgtgaatggcaccgtccccttcgggcagtgctgcatttaatgtccgcacgattttcggacttcgcgccccctctccggcgctgcactgttccgactccaagcgacagtttatgtcgaaatagtcgaccacaaagtcgtcctcctcaggaatgaacaggtccggcttagaatggcgcgactccgcgttcaaaatgcattcttgcctagggggacaaattggaagaggaaaggaggggggggggcgggggacggactcactcgttgtaataatacatcaccgatttacacacaaagttttgtcccgtctcaggaggagggctgaacaatgaacagcttcgactcgtcaattaattaatgaatattcattggctgactttgtgcattggtccaaacacattgtcactgacggcacattttccatcacaaaagaggcaaagcccaccaaaagcatttgcggcactcgcgtaaacgacggaacgccgcggcacgtacgcggggctaagaaaggagcgcatttgaggctgggaatagcgaactcacaggcaaagcatttcttctcgaaataagtccatcccggcacttcggccaaattggcacggcccaaagggcgcgagcgttcgtccgacaaaacgcaactgcgcgtcaagttactgtacatgaacgatttgcagttgaagtcgtttgccttttgagggaaggggtcatccaacacttcctcatttgtccattttcattgattcgtttgtccgtttttcgttgctttttctctcttttcgcccaattgtccgttttttgttcctttttctcttttttcgtccatttttcggtttttttgttaccgtaacacttaaccgttgcgtgcacaactcttcacattcgctcagctccaacccttcaaaactgtggtccaattcgtccgacaattggcgtccttccaccgccacgtattgcgttacgtacggtgcgtaacattgtgctgcaattgcgaattgttggtcgttcaaaatgccgcttgttttgaaattgtcaaaatgccaatggcactcacatccggcgcaattgttgtccaagtagatgaccgtgtcctcgtgctcgtccacgaaaaggtcaggccgatccaatcggtcctccgtgttcaaaatgcattccgcgtccacagggtaatacatgaccgactcgcattcgaagccgaacgtatcgaacgcattcagacaagcggacagacagcggtggactgagtcggcggagaccacctcacgcgcgaaacccaccaaaatcttttgttcatgaacgtcgaaatggaaaggcgaggaacagatgcgctcactctgcagaaaatttgggggaggaatcagtggcataatgaaaacggattgagatgtgaccgaggggactctgccaaaaccaaaacaaacgccccagggatggaatggcatggcccttcccattaataccatttggcaatttcccttggtattttggcactttcacccaccttcacacaattcttcgtcaccgtccgtgtcgccatttcttcaccaaattctgccacggcaccttcagatgccgacttcggaccgaccaattggcattgtcctcccccgccggcggccaattgggtgtaacggacgccaacgcaatcctaaagagggacaaacaaaacaatgaacttacgccagtggattaaacatacatttgcgacggaacaaagttcggtacattcgagaaaccctccggggacgggcgccgatcggagagggacagtgccggaggcgacggaagtgttgtggtggaggaggaaaacaggcgaatcgcccgcagggcattccgacaaaagtgctaaacgcacaaaatggccattcaacaagagaccctcataatcaatcaattggattattttggcatttcatttttaccttttgtttttgctccattaattaagttaattacccctccccccaattataatgctttgttttcagtgttttccgttcgacccatagaatttgctttgtgaaaagcaattcaggtgaaggtcacccgcaagagtgtctcctcttcttcgtcaagataatgatgattaagatgacggtccgccaaaccgccgtcactggcgatggaaaaggcggcggagaacacaaatcaaaaagcaaaccccccagggctattcaaagaggaaagacattggcacatcaaaaaaaacttacgaatggactgatcggcggagatggcaatgacaaatgagagaaaaaagagagggaaaagcgatcggacggaaggaaggccaaggcgaagacaatgcctttctcttctgtgggggaaaggccaactggacaaagagaggcgcatgcttaaggaaaaatgggggaaaagccaataaaagggaaaagcgagggaaaggaaagaaaaagggaaaagcgaatattttacgaggaatttgatcggaggcttttgctttgatttgaccatatacaaacggcgaaagtggctttctcttctccg

SEQ ID NO: 512 - DNA, 2530 bp, Heterodera glycines
  genomic virtual cDNA Sequence=SeqID_551; coordinates=2238..2091 ,1798..1531,1176..1094,1031..888,483..268,165..1
  coding sequence=SeqID_800; coordinates=2210..2091,1798..1531 ,1176..1094,1031..888,483..268,165..46
  peptide sequence=SeqID_1043
caatgaatgtcaatatttcgcatcacttttctttcttttttctcatcattcactcttcgccaccgtcgcttccttcttcagggcgcgcttgcgcgtctgcagtgagttgtcgcgcacgaatttgttcagcaacggggcggggacgtagccgaacatcagctcggcctaaatgggggagggcaaattctaacaaatttggaattcgtacaaattcgaaaaatgcaacaaaaaaaaccccgaaatgaaaattttgccggttcgaccgacctgaatttggtgggacaaacagccggtggtctcgtcaaccaaaccaatgctgcggagcgcttgggcggcaaattcctcggggctgggcgtgaagaaggaagccttgcgaatcttggccattttggtggccaccatcatcgggcacaccgtttggatgacaatgtcggtgtcggcgtattccatgcgcagaatggaggacaaccaacacacgtatttctgagacagagattcaaatgatttttttgataagattgaattctttaaattatttccaaaatgaaaaggaatcgaataaaattttcttgtgtatttttagggtttttagtgatcggcgtatcttagaaaattaaaagttctaatcatttgaaaaacattttttgagaaattctaaataatttgaaacgttcgatgacactctttagttggtggctccattttaaaattatttctcatgaatttttaatattcaatttaaaatcggggtgagtcatctataaagtattaccgaattgttttatgaggtcccaaatcattaattagaccaaaaaatatacaatacagcccaataaaagcaaaatgttttcaaaattccaacgcggcaccccccttttcccctccaccttcgacgcggaataagcggccaggtaaaaccaattgaaatacgctgccgaggaggccaaattgacgacgacgccgcgtccccgttccctcatctgtttgagcacaaaagcggagagtaccgtagtgggcagggtgttgatcaccttgaaaggtacaaaatcaaaacacttaagaccaccagcagttcaactgatttaaaacgtacggtaatgtcggagacgcgttgcagtccgccctcaatacggtccaatcgctcggggtactcgtagctcatcccgacattgttcactgaaacaatgtttacattcgtttgattattaattgatgctctttaatacaatccattatttcgggaaaacggacactctaaggaaatgttaaacataaaaaggtccaagtggtgcgctctttatacgatggtttgtttttcaccggccttttttgctctaaaaatttttggtaaattaatcttgttgggatttgaggggaaggtgaatttgggatttttgacgaattcctcaccaaaattcaatatgcttttaaagacttactaaaattccaaaaatatatatatatatcaggaattcataaagcattcattccgtgctaacaattttgtcatccatcagcggtagtgcctaccgagcattccaacttcaatgttggaaagttgggagaaaattgtctgctcgtagtccttcaggtttgcgttggtgaagtcgaatgagatgcacttcacttccacattgggatatttctgtttgatttcctccgccactgcgttcagtttgtccatggagcgtgagatgagcaccacgttgaagtttttcttggccaactcgagcgcgtatgccttgccaatgccgtcagtgctgccggtgaccactgcccactcggcacccgcgagcacctggaaacaaccgatttgaacggaaatgttagggaattggaacgccgcattccccaccaaagattttgcaatgcttaaatttcaaaaaatgaattattttgctccatttttctatatttttgaatgaaatttaaaaaagtaaaaatttaaatatgaaaattaatcttttttttgtgagtgtattcttttattctgacagttctcttcacccataatttgggaaaaatataaattgatattttttgggaaataagacttggtcggtctaaatccgacgaggtcctctacccaccttgatattctgaggaacagcgaacaaataggggaaaaccacattgtacagagagcggaagagtttctggagaaaaatggcaattgtcaaatagccggctaatgtgacaagaaaagacatggcaaaatattaaagtgaacaaatgccttaaaatttgttacacaaaaattactaaggaataaaattaaatgagaaattccaaaatttaatttttgtgggaaattttataagattaaaatagcaaaggccaattgccacgccccaaatcatcgaattggacaaaaagttaatgaatgcgtggggcggttgaattgaaaaggtggccgattaaatttcttttgcaaaaacagaaatgaaagtcgcacaaaaatgcgaacgtaaaattggaattgtaatgaatgaatagaaaacactcatcggttgattggagaaaaatgtgg

SEQ ID NO: 513 - DNA, 3796 bp, Heterodera glycines
  genomic virtual cDNA Sequence=SeqID_552; coordinates=3606..3564 ,3501..3338,2995..2869,2319..2122,1375..1154,455..258
  coding sequence=SeqID_804; coordinates=3602..3564,3501..3338 ,2995..2869,2319..2122,1375..1154,455..258
  peptide sequence=SeqID_1046
aaaaactccgaaaacccaaattcctaggcccgtcactgattaaactttcccttcctggataagtccgtgtcgaccaacacacacatttttttttaattttttttttattcaacctaaatactcaatcaaataacaaacaacacaatagcagcagcaacaccatttccatttcattgtacacaaaatgtgtgtgcatatttgtggtggtgatcaaagcatccctcctcatccgtcgctgatcaaaatgaatggaccgatcagacgaccggcttctgcggcggctcgatcaccttcagctccggctcgtccttgggcggctttggcgccgacgactcgggcgtccacccgcggccgggcagtcgccggaagatcaccttctccgtcttcatcagtgcccacacattgcgcttggcgtacagtagcacaaacgtgagcagtggcaacagcgtgatcaactgagtgtgtgtgtatatgtgaaaatttttgaaaaaatgaaattttcccggctggtaaggcaccagcgaagccatcaaaaggatctggtgccgatgaaaaaaaattttttttttttttttggatttgtagggttataaatttgccgattttcgaggcaataaaaaagaaaaatgggggataacactttttgaaatctatcaatttattggcaattttgcaaaaaaaaaaatcctccggcagtgctaaccggcaccgttgaacgggtgcactcggtgtacccctgaaacggctccgctgaaatgtggcgggacaaaacttcgcgaaaaacatttttttttattgccaagcctaattcggaaagaaaatttcaaagaaataaaaaacaagtttgttccatgaatttttgttttcaaaaaatttcaaaacaaatttttgagtgccggcgacgctacggcggcaacgttttgttcagtttgaaacgtttctcgagtctcgggaatttaggtggatgtagagcagtccaataaacagagcatcccatctttgccctccccccggggtacgaattccggacttgttgttcccccggaattgcagattccgtttttttttttatttggggggcctagaggtctacgaaactataactctggggtaagtgccaaccaccgcaaatgacaacggcaaattggctgaccttccatgcccagcgtttgcgcgtgtcgtgccattgttcgccggcccagcgcaagaaggtgcaaatgtccttggcctgttgcgacattgttgccggtgtgccatcctcatagtcaatgccttcgtcaaacagttgttgcggcatggccaacacacagccgttggggaagtacgggttgaacgccttgccctcctccacgtcaatgcccgccggtgcatcaaagccatagctgaaccaaacaaaatgcaacaatgggaaattttggggaattgaaaaaacgaggaattaaatttttattggaaatcaaagtccaacttccccatttcgtccgtatccgacaaacaccgcaaatgctatttaaatgcgagaattttacaggattttgaaaagaaacaattcaacaaatgaggggggggggggggtagattctctctgacaatgaaatcatcaagagtctgatcacaatctgagtattgtaagcatcttgatttcttgattcactgacaggtgtacaaaaaacaaaaatttaaaaaaatggtcgaatttttggaaaatttacctattcaataaacagtaattcttcataaaactaaaaaattcgtttgaaattttttcaaaaatctcgcgtatttttcactagagtaggtcgggaccgggaattttgggcaaaaccgggaccgggacttttcgggttgaaaacccgggaatttttggctgggaaaaccgggaaaaaaccgggactagtcccggtcccggtcaaaaccgggacttcggtactcagttgtccgtgttttggtcccggtcccgctctactctatttttcaccgtacgactaactttttcgctgctcttccagtcctgggttggaaatttttttttaatttttttgatttttggtgggtctaaagaatcttgggacctccgtcactgtacactacgcttttttaaaaatgctgacaacaacaaacaaacccggtcaacagatggaacacgtagtcctcggccccttcccgggcccacataatcagtgacaaatcgggtggcaatgcgccactgttcgccgccgcggcagctttgttgtttttgtaggggcttggcaacgtgtcgttgagcagcccgggacgaagaatttccacaccattatcgtccaagtccgggatcagtgcctgaagggaatgagtttttttttttgaaattttcgccatttttaggggttaaaggccccgacccagtgcggggggttcgaattgtaagacatatttgttttagaaaaattttgtttttattgtttttcgactttttatgaaatttactgcttgatgaggatgttgcaaaccgaaatttttaaatttatccagcgatttccgacaaattttgtcgggaaatattcctccccgatacccgacttttcatatcaagcagagtgtcaaggcttggctctacattgaacatgatttatccaaaacttttggctccgtgttatcatttagtatttgataattcagggagattttgttgtatttagcttgttaaatttttgaaaactaaaaatcgttaccaaaaaggttgaaaaccctgattttttaaaattaaataaacccataaagaaccattgagacattaaacattttacggttcgtgcaacatgttaaaatttaaaaaaagactcaaaaataatgctcaaattttgcaaattttacggcaaaaaaaaaaacctcggcagcctccgtcttcgcctcatcccgtgtcatgaaattgtcgacaaaatggttgtaacggatgaatttcaaggaatggcatgcggcacacacttgcttgtacacttggtaaccgcgacgaaccctgaaaaaataaaataattcataaaaaacatggaggggttccaattttgggtattatttgagggaccaaaaaactcatccataatggttttgcttgcatatatccaccaaactaaatagaaaagtgccctttttattgcgaggtaaatagaaaggattgatttcaacggtttcttggacgacgagttttttttaatttcaggcgttgattaaaaaaaaaaaaattttttttttttaaatcgggccaaatccaaattttgtttaggcaattggagacattacggttgaaaacttggcacattaaaataaagatgttaaatgtggaacaagaaaaaaaacggacgatcgcatgtcaattgcgtccatcagtccgccgtgggaccatggcaaatggctcgggtgcacaacaaagtcgtaggcacgcgcaccgctattctccaacgagtacagcaacacactgccaccggtggccaatgcgccgaacaacacaaatttggatgctttacgctgaaatttggcgaaaatcaggcggagaaattcaaaaaaaaatttttgtttgtttggcttaccaagttaagccctaatgccgctgctgaccgaaatgacataatttagaaagaaaatattggggtattttgttcggtctaaacatggaaaaagaggtaataatggcattaataaaatttttggcgctatatggaaagtgaccagttttgaaaattttttcaaaaggggggacccttttgttttgcaaaatttttttaagatagtcataaaaatgtattctctggggtttttgggg

SEQ ID NO: 514 - DNA, 3395 bp, Heterodera glycines
  genomic virtual cDNA Sequence=SeqID_553; coordinates=669..708 ,755..883,927..1076,1125..1327,1393..1576,1979..2218,2281..2518 ,2569..2706
  coding sequence=SeqID_806; coordinates=669..708,755..883,927..1076 ,1125..1327,1393..1576,1979..2218,2281..2518,2569..2706
  peptide sequence=SeqID_1048
atggactgcgactcatcgatggcattttgccagtggcatttcgatgaccacccaatggcccgggggaagtctctcttcgcggataggtggcacattgtgccgagcttttgtgtgccatttcgttttgttttatttgcttttttttagtatttatcctcaatgtttcaaaaatttaagctgatgcaaattcgtcgttcccgagtttgtttttgtcatttgttctaatgccaaccgaaggagaaggaaaaagtcagaaaaaagcggccaaaaatttgtcaaacgaagtgagtttttcagagaaattgaagcggaggatgaataaataattttttgtttaagtaaaaagtgaattttgtccaatttggcaatatttaatataacattactgtaagagggaatttatatatttttttttcgaaacgaaacctttcataaaaataattttttatttgattttcggtctcaatttgtactttttatttgattctctctcccttttttgttttataagttttatatcaaattttcatttgaagctcataaattttcgtttttagcgtcaaaaagttaaacttttcctcaacccgcgacaaaaaatgccaccgacgacaagagaacacattaaggtatttttttccaaactagtatttccaatctttttctgccaggaatcccaatatggctttgtttacggcgtttcgggaccgggttggttttatttcgcctcattttttgataattttttacttttaagtggtaactgctgagaaaatgtccggtgctgcaatgtacgaactcgtcagagtcggccattctgaattggtgggcgaaatcatccgattggaaggcgactacgccacgattcaagtctacgaggagacttgtaagctcgtcaagttcgataagttcactcgtcctccgttaagcgtccgtcacaatcggtgaccccgtgctgcggacggggcagcctttgtctgttgagcttggcccgggcattatgggctccatttttgacggaatacaacggccattgcacgacatttcagaaatgaccaaatccatttacattccgaagggtaaaatttgtgattttattcccttcgaattttaatttgacattttaggggtcaatgtgaaggcattaaaccgtgcaaaacgatgggaatttatgccgaggaaagatttgcgagttggggaccacgtgacgggcggagatatcatcggaatggtgcacgaaagtgcgttggtcaagcacaaaattatggtggagccgaaggcgtgcggaacggtcaaattcatcgccccgcaaggccaatacaccgtcgaagttggcatttggacgaaatgccaaacttattgactctttccccccccccccccccctccacaaaggacaccattttggaagtcgaattcgctggacacacccaaaagcttacgatgatgcacatttggccagtcagaaacccccgcccgtccgccgaaaaattagcggccaatttccctctcctctgtgggcagcgcgtgttggacgcgctcttcccgtgtgtccagggcggcacaacggcaattcctggtaaacagttatttttgctctcattggcacttcggcgtttttctattttatatttttttaaattttcaatctattttgttggtctaataaaactttgtgaaacgtgctaatagagaccgaaattttgaaatgaccagtacttggaaaagggaccgggacgggatccccccgatcccaatttttggagcggagcccgacgagacttttcaaaaacgatgaaaaaatgtaataactatttttttaacttttctccgacgatgattagggagagtaattccatatttgcagtgtaattggtcgcttttcaaatttttgctccgttagctctgtttttacccaatttccttataatttttcttccccagtcttttaatctgttgtcatttgtccgtcctttttcaggtgcctttggctgtggtaaaactgtcatttcgcagtcgttgtccaaatattccaactccgatgccattatttacgtgggctgtggcgagcgtggcaacgaaatgtcggaagtgttgcgcgactttcccgaactgacgatggaagtggatggagtgaccacgtccatcatggagaggacggcgctggtggccaacacttcgaatatgcccgtggcggcgcgtgaagcgtccatttacacgggtgggcactttgccaagactgtatttttatttttcgttaaatctcccctcccccttccgcaggaattactctggccgaatacttccgcgacatgggtctgaacgtggccatgatggccgactcgacctcccgatgggccgaggcgctccgtgagatttcgggccgtctcggggaaatgccggctgactcgggttaccccgcctatttggccgcacggctcgcttccttctacgaaagggcgggaaaagtgaaatgttttgggtcgcctgaacgcgaagggtccgtcactattgtcggcgcgtaagtgcatgtcgaccgatggcactttcccttcccttccctttgctcagagtgtcgccgcccggcggagacttcgccgaccccgtcacatcggcaaccctcggcattgtccaagtgttttggggactcgacaaaaaattggcccaacgaaagcacttcccttcaatcaattggctcatttcttacaggtgggccaaattgggaaaaagtgaagaaaaaggaaagggtggactttgtttattacaaaaaaaagtcaaaaacaatggttgtgcgatatcatcggccaacactttacggacattagctaatctttcgtcaataattgcgtcctttttcgtccgttctgtccctccctttgtctttttctgtctcaaaaattgctgaactgttccaccggttgttcctcgctgtgcgcgagttgcgcgtgtcgcgttgcctccggcaatgcgtaattttcccccggcgcgtgctgctgtctgcacctctgtctttctctgttttgtgctgctgcccttccctttatgcagccgaccattgacgacagacaaacgcactaaacagcaccttctttctctgctttgtctttgtattttagggtccattgcttttattggacctttgaccctccgcttttattctcagttaattctcattacggctgtttgattcgactcactgatttgtcccctccgctcatataatcgatgtattggtaccaaatcaccatgaaaccaatcgccagaacattgaacagaaaacagaggacaaagcctccctcaattgcgcttattgtcaccaaaactttccagtggaattcggtctgaaaattgcatttcatcgccgtcataaattcacaaaatgatttcacctgatagaa

SEQ ID NO: 515 - DNA, 3400 bp, Heterodera glycines
  genomic virtual cDNA Sequence=SeqID_554; coordinates=1..100,159..232 ,287..466,689..1048,1196..1326,1404..1728,1822..1977,2036..2383 ,2565..2926
  coding sequence=SeqID_812; coordinates=1..100,159..232,287..466 ,689..1048,1196..1326,1404..1728,1822..1977,2036..2383,2565..2840
  peptide sequence=SeqID_1054
ccagctaaagctaatgcaattggtattgacctcggcacgacgtattcgtgtgttggagtcttccagcacggaaaggtggagatcatcgcgaacgaccaaggtgcagtaaagaccggacgtgctttccctcaaaatattgttaccatcccgaatttcaggcaaccgcaccacgccgtcctatgtcgcgttcaccgacaccgaacgtttgatcggcgatgcggccaagaaccaggcaacttttcacaaaatcaactgtttaagcagtttaaactgatttgtttgacaggtggcgatgaacccatccaacaccgtgttcgacgccaaacgtctcatcggacgcaagttcgacgacccggcggtgcagtcggacatgaagcactggccgttcaaagtggtgcagggagagggtgctcgtccgaaagtgatggtggaagtcaaaggcgaggacaaagcgttcttccctgaggtttgtgctgtttgctaaactgctccatccccccgccccagttgaaaattttgaatggaggcaatttcgtatgcttgattctttttcggaaaatctacaatctgaggaattaaagctttcagaaaaatgaaatttgggagggaagaggactctaaaagcaaccaaaattggcgtttgttgagtgtttgcttgttgtacttaaatgtgtttttttttttgcaggaggtttcgtccatggtgcttatcaagatgaaggagacggccgaggccttccttggccagactgtcacggatgcggtggtcacagtgcccgcttacttcaacgactcgcagcgtcaggccaccaaggacgcggggaccatcgccgggctgaacgtgttgcgcatcatcaacgagccgacagccgccgcgattgcctacggcttggacaagaaggggcagggtgagcgccatgtgctcattttcgacttgggcggtggcactttcgacgtgtccatccttaccatcgaggacggcatcttcgaggtgaaatcgaccgccggtgacactcatctcggtggcgaggacttcgacaatcgaatggtttgattttcgaatttgccagcaattcaaaatggttcgaactaaggtttaagaaaaatgaaaaagatagtttggtcgaaccaacacttaaaatgaatgaaaagcattttcttttgcttgtttgaatttaaactgcttttccttcaggtcaaccactttgtcgcggagttcaagcgcaagcacaagaaggacctcagttcgaaccctcgtgcgttgcgtcgtttgcgtacggcctgcgagcgcgccaagcgcactctgtccggttccacccaggccaggtttgtttctttccctttttggcgggtcatttcacaaactcatttgccccatgtaaaactaattccttcaatttcagcatcgaaattgactctctcttcgacggcatcgacttctacaccaacatcacgcgcgcccgcttcgaggagctttgcgccgaccttttccgcaacaccatggaccctgtggagaaggctttgcgcgacgcgaagatggacaagtcccagatccacgacattgtgttggtcggcggctcgactcgaattccgaaggtgcagaagcttctctccgactttttctccggcaaggagctgaacaaaagcatcaacccggacgaggcggtggcctacggagcggctgtccaggcggccattctttccggcgacaagtcggaaactgttcaggtgaacgattaagcctacctatcttaaatttcgaattaaattttgtttttcttgtttgttttttttgactgttgtgtattcctttctttttaggacttgctgctgcttgacgttgcccctctctccctgggcattgaaacggccggcggcgtgatgacttcactcatcaagcgcaacacgaccattccgacaaagacgtcgcagacattcaccacctattcggacaatcagcctggtgtgctgattcaggtaaagcaacggcatttccccttttgattgtttctgtgtgaaaactgttcaatttgaggtctacgaaggcgagcgcgcgatgaccaaggacaacaacctgctgggcaagttcgagctcagcggcattccgccggcgccacgaggagtgcctcaaatcgaagtcactttcgacatcgacgccaacggcattttgaacgtgtcggcccaggacaagtctaccgggaaacagaacaagatcaccatcaccaacgacaaaggccgcctttccaaggaggaaattgagcgcatggtgcaggaggcggagaagttttccaaggaggacgaggtgcagcgtgaccgtgtgtctgccaagaacgccttggagtcctactgcttcaacatcaagcagacaatggaggactcaaatgtacgttttttgtggagtcctttactttttttttattccacctcccgtcgcaaatgattaaaattttggtagcgggcgttaacaattttctgagccctttacaaaactactgtcagaatgggttgagtgagacccaggggactgcggtgttttttcctcctttctatcttttgattttaagctgaaggacaagatcagcgaggacgacaagaagaaggtgctggagaagtgcggtgaggtgctggcatggctcgacgccaaccaggcggcagagaaggaggaatttgagcaccagcagaaggaactcgaagggatctgtaatcccatcatcaccaagctctaccaagccggcggcgcaatgcccggcggtccaatgcctggcggagggatgcccggaggtggcggcgctgctggtgcgggaggagccggtggaccgaccatcgaggaagtggactaagcgagtcgatctcttcgcgatcatttttttgtttgatcgattatttaattttatttttttctcgcgtaaattgtttgacatataaattcattggttgcttacttacgaatctcaccgaacatgcccttctgctttaaaccgtatgttaaatgtaaaaagccaaagacaaattggttcgggaaatcattgataccttgtgtggttagtgatttataatcggaaattcaatattttaaaattcactttatgatcgtatctatatagaatgatattttttgatgtacaattgtttttgactatttttaggttattgcgatcaaattagaaacaaaattgggtaatggtgaagctggtgcccccccccctttttggaataaaaaattttttcttttaaaaagtcgtgaaaactcgttttacggggtttttagggttgctgatcacgaatatgacattcttttcgaccgattccgaatcccagacccgagttcggacaaaaagtcgaaaattaaaaatttttcaattttcagatttttgttcaaactttgtttaaatacacgaaa

SEQ ID NO: 516 - DNA, 3776 bp, Heterodera glycines
  genomic virtual cDNA Sequence=SeqID_555; coordinates=1..63,297..418 ,493..692,740..804
  coding sequence=SeqID_819; coordinates=1..63,297..418,493..692 ,740..804
  peptide sequence=SeqID_1059
ataatggtcggctcaggcggcgtaggcaaatcggcactgacacttcagtttttgtacgacgaggcgagtgattttagagagaagggccaattgaatgtgtaaggagacccgagaaataatttcgaaaaaatggtagtgattggagttgttttatacagttttgatcaattgtgcttatcccttttcatttaattttggactttgatattggtgtttttcatatttacacatgccaacactccctcccccctccctccgctctgtcttcactggaataatttactttcatatcacagtttgtggagaattacgaaccgaccaaagcagatgctcacagaaagcaagttgtgttggacggggaatattgtgcggtcgacattttggacacggcgggacaggaggactattcggcgataaggtcggcaaatggttaaatagtttttcggaaattacaatcacaattactctcttttatttcttaaactaattcagggacaattactatcggtcgggagaaggtttcatctgcgtcttctccatcaccgatttggattcctttgatcaactcgtcgaatttcgggagcaaattttgcgtgtcaaaaatgccgacccaaatgtttgcattttgttagtcggtaacaagtctgatttggacgcggaaaggaaagtgcctttggagcaagcgcaacaacgtgaccaattccaccaacgatggaaaggagctcttttttgcatttaggtgccgaactttggggctgtcctttcgtggagacttcggcaaaaacacgcgaaaatgtggacaaggttagccaagggcagaaagccaaccgaattcggattatcagttgtcatcgattcttatgggttttctttttgcattcgattgtgtttcattacggtctctcaaaattattcatacataatcggtttaaggtcttttatgacatcatgagggaaataaagcggaaaaaggtgggcacaatgcgagcgggcggtgccaacggcggcgatgcggcgggtgccaatggaaaacggaaagcgaaacggacatggaagggatgcaccattctttgaggggaggaggccaaaggaagcggagagaggaggcaacaatcggaaatattctgtccataatatttaagtattcactgtctggaaaagtggccaatggtcagaaagttttttggattgttcaaataaatttcactggctaaggccgtcccttcaatggccactgcgactaaaatcacacactttttgcgctttgttgttttttcgatttctttaattttattgagccttttttcatttgcttataaacaacaaataaatgcaatggttgtcatttcacttaacggtaaaagttgccattgctttccttttttatttgttttcgttttcctttacggttcctatcaaaaaaggtcgcttttatgatgatgaactccgacaattcgagtgctatcaacagcaaatccttcgatcaaatttcggagattggatcaatggccacggacggactgcttcaggacgacggagtgccggattatgcaaaaatcataatcaaacagcagcaggcactcattgccacgcttatgaacatgcaacagcagcagcaggaggtcattgaaacaaggaaaatttggcgtgattggttttatgagccgagattagtccggggaaatttctaccgacggcaattataatttgttgagaaataaataattgaaaatcggctgttcagtctcggtacgcgtcgaccatctcactttttcaacagcatcagccgcactttctctccaacaacgattcgtcctttccccctcctggcatccccacccatccgtctcctccgcccggcatccgtccacccgtctctcccgcgccagtgtcggcacctccgccgcctccaccgggctttcgtgcacccccaggcttcaacgtaagcgtcagttcccgcaagttcgaactcgactccaccaaatccgacaccggcggctcccacaaattcgacatcagagaggagctgaagaaggcatttgccttagacgacaccaacgaaaacgacagctcctccgccgagcagcagaatttgtcaccacgttcgcagaacattcgcgaggcacagaacgcgcgtctgcccatgtcgagcagtttctcgtccatcgaaaatttgcaaaatttcaccggtttaagccaacaggtgggcatttcacagcaaaaattacgaggaaatattacatacaaaagaaatgatagtgaacattcttccttccatttcctttgctttttaaggactcatcttcgcccgtctccgcgctcagtcggcagcccatcgccgcggccgttccgtctcctcagtccgcgtcgtcgtcggtgtgcgccttggcacttaattatgtgttggttgatcaaatggtgttgaattatgagcgagtgtacgagcaaaaggagaaaatggccagcgaaacgtatgactgacaatgagcgaatgatttgcatttttacgtggaacaatgggcgaccatttgaactttttcagtctcaccatggtggacagacagtcttcgcccgaacggagcatttaccaacgctttgccaacctcggcgccgtcctctacattttgcagcgacttcaccgactccaccccgacggcttcaccgtggcacaatatgtgcagtttgagaatgttcgtaacattggtacttttcgatttctaattccaatcaattctttgctcctttccccagtccccgttagttccacttataagcattttttgttgaaatatggggctttatttttatgccataacggtaaataatttttttgttagcgtcagaagcgagctcggccgacctctgagggcttttttttcaacaacactttgccatcggtggcttcgttgttggaatcggacgacgatttgctaagagtggacataaaggaagagaagttttacgtgtcggaggaggtcactcagacgcacctcttctgtctgagcaagaatttgtgtgagtgtttttagacttatttgatgtcatcatagcattttcaaaaattatttaaccaaaaatgcaacaaatagaaaattggtcaattcgggggttacgatcgttccttcctccgtgtggagagtaaccgccccttttgttctatttcaggctccaatttgttccgtcttttgcgtcgctgcagctccaacaatgccatccgcgtccagcatttgctcgaaatctctgtaaaacgattcgttgtgtccctccaccattccaaatgccatttcagtcccaattggtgcccatcggcgcccccatgcccaactccaacgctttggtcgacctgtgcaatcgcttcccgaccattttcaaattgcgttgttcgcctcaagacaattgtgagtaaatgcaattggtctgctgagtgtgtccttctcccttctcttcctcagatcgctttgacaattcggtgattatgctcaacgaacagttgctggacagcgagaatttggcgtggcgcgtcgttttggacactgacgaattttaaagggtgaattggcgaagaagcggactctgaccaaatttgccataaaatctttttgttgttttgtggagaaatggaaatttacggggataaatcatcaaaaaaaaaattgtccacgctacacgaaatttatgaggacgaaaagataaattaaaaatagagtatactcgaaaaagagaccgctatttgaatttagggatttttgggtagaaacaatgagttatcgggattg

SEQ ID NO: 517 - DNA, 2051 bp, Heterodera glycines
  genomic virtual cDNA Sequence=SeqID_556; coordinates=36..164,216..317, 361..396,608..801
  coding sequence=SeqID_822; coordinates=36..164,216..317,361..396 ,608..700
  peptide sequence=SeqID_1062
tttcaattttcatttccaatcaagtttttctttaggcctaccctttggcggatattcaactttctcagaagttgcttgatcttgttcagcaggcaacgaactatcatcaattgaaaaagggtgctaatgaggcaaccaaaacactgaaccgaggcattgctgaggtgaaataagttttggaacttatatttaaaaataaattccttaattcataggtgatcattttggcagctgatgcagaaccattggaaatcattttgcatttgccattgttgtgcgaagacaaaaacgtcccatatgtattcgtgaaaagcaaggtgattgactattttgaagttctaaaataagttaaatatttaggctgcacttgggcgtgcatgcggtgtgactcggccggtgggtttgctttgctttaatttaccgaacaaaaataaatgtcaatccatttttatttatgtatagagcaattaagaaaaacaccaaaaagataaccttttattttattaaatacctatgtatctagggttttataagactcgctgcgaatcctaaactttgaagaactcccttgtaaacagggaatttacttgttcgcttattcctttaggtgatcgcaacttcgatcattcaaaatgaaggatctcagttgaagtctcagattcagaagattaaagaagatgtggaaaagttacttatttgattaaaaatttgcaagcttatcactgttttgttattccatcttgttttgttgtttcatgatttgttcgacgacaattaaaatgactctgaaagcaaaaaaaatcttattcagtattaattgtttactacttacctttatatttaattaattggaaagtttgtttaaacatgaaatatttgctcatttgtacctttaagtgcttttttaggcttatcaaaacattttaaacagaatggctgacattaatgctattttggatggtactgacggtgatgaagcgctgaatttgaatgatttggatgaaaaagaggttcttggtgatgacgaggaggaccaacaccaaaatcaacacacaacgtatgtgaatgcgtccattgaccacttatttaatggcccgacggataaaacaaatgggatgccttttaaaaaagcactagatattatttacttatcaatgaaaaacactggcttctagttccattcagcagcatttgtatatactgtttagaaaagaagaagtggaagacctttacgacgaagccatggctccgtccggtgcactctctgaaaagcgcgagtcggctgaagttatttcgtcgttgccaagttcgattcagcacaaatcgtcgtttgccatgcctatgatgatcaaatctgagcccggcattgctggcgggtcgcaaagtggcaaacgctactgctgctacattggcaatatgacttggtggaccacagacgatcaactccaggtttaattaacatttgtttcggctttgttctgcttccattcgcactgtgttagttatttcactattcattttttaagaaactgattcaaaccctcggcgtcgacgatatgattgacgtgaaattctacgagaatcgcaacaacggacagagcaaaggttttgcgctggcagtgttcgccagtgaaccgtcggtgaaagcggtgatggagaaattgccaagcaaaaagctgcacgaacaatcgctggcggtgttgccgtacactaagcagtcgttggccaagttggaggaggccaccaaacgctacgaccaggtcccctcttgtttctgcaaaatgttatcctatggctcttctgcattctttgcatttctttgaactccgatcattgcttgtcgggacgtagccagtccaatcaatccttggcattttgtcaccccttacactttgcaaacaaaagaaacgtaaacaaaaaagggagacttgtgcccggcgtagtgcaataacctcttcttcctggctacgtcatttattgtcttatcctactcatttggaccaactttcgataacaatcctatgagttgcattttaatgtcatggaaaatg

SEQ ID NO: 518 - DNA, 1403 bp, Heterodera glycines
  genomic virtual cDNA Sequence=SeqID_557; coordinates=3..313,957..1131
  coding sequence=SeqID_826; coordinates=3..313,957..1131
  peptide sequence=SeqID_1066
tcggcgagttcggcctgcgcaacaagcgtgaggtgtggcgtgtcaagctatcgttggccaaaattcggaagcgtgcccgtgagctgttgacgctggaggacaaggacccgaaacggttgtttgagggcaacgcgctgttgcgtcgtttggtccgcatcggtgtgctggaggaggacaagatgaagctggattatgtgctcggcttgcgcgtcgaggacttcatggagcgtcggctgcaaacccaagtgttcaagctgggcttggccaagtccattcaccaggcccgtgtgttcatccgtcagcgccacattcggtacggcacagctgcgaaatgacagacaatcaaacgtttttttttttcaatttggcacttttataatggcatataggggtccctagtttagacagtcaaatgggagggcctttttgcattttttaaagatgagtctctctaatcgtgaaaattcaccggacattttcggggtcgttgaccacaaatcttacacccatttctgccaattctgatgcgtaatcagaaaaaatggtcagattttatgaccaaggacctcgaaatctatgggaacatagttgtcgcgaatttttcagacaaaaaacttgcaaacagcgaaattgggtcctacttggtcttaaaataaacgcgttttttgagttttttaactttttcatgtcttttaaaggctgtaacttttgcgagaaaactaataatttggtctctgaagacacgtataactcccgatttaattttgggtacaagttttttgggtttctatattagctgaactctatattatgtataacatgctggaagtggtaacatggtgaccacattcatcattgccaattttgttgccaaatttcaaaaaaaaaaattaaaaaaaaaatttttttagtcaaatgccattccaacaaaatccattttttttctttgctttcagtgtccgtcgtcaagtggtcaacatcccatcatttgttgtccgtctcgactcccaaaagcacattgatctgtccgcaaagtcgccgtacgctggcggtcggccgggccgtgtcaagcgaaagaatgcgaaaaaaggtgccggaggcggcggctcgggtggcgaggaggaggactgatcgacgatgatcagttgataatttttttttgttcgacaccccctttttgttgaaacacaatgttgattaaagcgctttgttataacatgttcactaaagacccaaattttgaaatgaactgggccgggcttaccggataaaagtgtgacaaatactatgctgacatgttttcatgacaaacccaaaaaacagcatttgaaaatttgcgggggtaatagtttagatggtacccccccttttttaaaaatttttttcaattttcaaaaaatcat

SEQ ID NO: 519 - DNA, 3041 bp, Heterodera glycines
  genomic virtual cDNA Sequence=SeqID_559; coordinates=2870..2753 ,2689..2444,2348..2235,2089..1982,1939..1776,1623..1374,1318..1137 ,1082..981,928..843,783..536
  coding sequence=SeqID_789; coordinates=2866..2753,2689..2444 ,2348..2235,2089..1982,1939..1776,1623..1374,1318..1137,1082..981 ,928..843,783..668
  peptide sequence=SeqID_1033
ctgttggtgctgctgttgttgaacctgagacaccggaatttggcccgtcaaaaaattttgaagcatttttaaagatagaaaaataaaaatatttttgcccgtctaagtcacaaagtttagagagtgtaagtaagtgtaaggcaattggatgaattaaaaaggaacggggaaaatggaaaataaaaaatatatattaaaaagagggattgattgaaaagcgaatacgtaaaaagtggggatgaatgaggaaaagaagggccaaagaatagtgagtacaaagaagaaaggataaacactcggatggtcaatgcgataatcgggcgtggccaaatgagcagtcatcaagaaataaaaatctatgaagcaagtggaacatatgttgtaaaagtgaaagagaaaaagcaactcaagaaaaagatggaaagggtagagatttattttattcaataaaacgaaatgaaaaaaacaatgaaattattgttgatgtaggaagggaggtgatgagtcgctaaattaggataaaaaattttaagggaaaagtacagaaaatcacaacacgacaaattaattaacgaaccggcgaatgcttaaatcgtaaatgatgccaaaatttacaatgtctgactacagctgtgtaaaaagtacagtgaaattggttccactattgttaggttcgcgttttcacttcctttgcttcttcccccgcagcgccttttgccccttcgagtccttcaatttgcttgccaagatattcccaattgtgcaccattaacttttggattgctgaaaaagatgtttaattatctggccacacgcatagttctcttattatccctactcacctaacaaagcgtggtaccgaacgtttgggtcctctgcactcaacaacttcatcactgcttgtttgccttggtattgttcgacaattctaaataaaatgaaattgttttgttcttctgaaattttgcggtaggataaacgtttttccgcgatggtaatgccggacgtattcgccaatgtcatgagcagcaacactgagcggcaatgggtcgctgctggtctcgagaattttgatgagtattctgagaatttgtttttgttatttataagctttataaaaaaaagtaataatccactttatcaattcaaagttcttttcattgaagcgttgtgcattttcgcgccagaatttctccaatttatgcaccggactccactggagtctgcccgatcggacctcggcacagtattcgtcaaacgaactcaaatcctgcaccgaggcgtgaagacgttcagacagaaattcaatgtcgtccacctgaatttgatttaatttcccatccaaaattgccaaaagttatgcagtctctcaccaagtccgggtcgtcaaactttttggcgtccatcaattcaagggttttcagcgttttgcattggaccatttgcagtgccgattcgcgcaccatctctctattgtcaattttctccaacaaatttcggaaggtcgcgagaatgatacgaatcactttttcctttgagcattcggagagaatatcgcccaacggttggataatgcccaatccctggacaaattgagcgatgttactgtcgaaggtaaggcacctgaacagcactttgaatattgattgacataaatatgtcgggcattttttaggtaaatttttttttatcgtcttactaaaatggggaaattaaattaacaaacttttttcaggattatttttgggttaaaagtgcgaaaaaacccaaccgaccaaaggcaaaaaatgagttggtattgaagttgaaaattggcacgaccattcaatgccaaaagaatgcttttaacgccgtcatactcaacgaattttcgtcgatacttttcctttcgtaacatcatttgtagacatcgaactgatgtatttatgtattcgttgctctattgaaaaatatttttaatagcattttaggaagggcaaccaaccgagttttttatttcctgttgaaggaaattgaaataagcttgcagttcttgtccatccataagcacagagccatagcaagccaattttgagaatattgcagacatcttcagaatggaaaaaggttaatgataacagattataagcacgacactattaaggaaattttcatgattaaacattgagacaaaaaatgaaatgaacgagtcccttttaaaatttctaaaaccaatttaggaaaactaaactcacttggttgacaatgaaactgtcatttcgcgttaaaatcccttggaaccacgaccaaatagttcgtttttgccgtcttgcataatcatggaaaatctctacccgggatttgtcctcctgaaaacaaccaagaattaaattaaatatatttaaaaataaattaaattcaataaaaaacgattttaattaaagtttaaatggaaatgaaagacctgcaaaaggtcgtcgaaaagggtgagaacgtaacggatcagctgatccttcgcaacttcggtgatcaaattgataatactccgtgccgaattcgtcttgtccttggctaacgcttcgtccctctcctgcttgtttttggccttttccaattcaataatgaaattgtactcattttgaggcaccaattgagagcgcaaatacgatgaccaattcggtttattcgccggatttcgcacttcggcagccgaaaattaagttttcattgaataaaatttaagtaaaaatgtaattggaatcaatgaacacacctcaagctgaagtttgctggtagctgttgtcatgtccacaggcgtaacgtgatgcccagccgcaatttcctcaacgtcaacagcaaaagtagcgccattctgttccgtaaccatttctaaaattgaagtgaaagaaaaacaatatttttgaaatatgaattgcataataataaaaaaaatgaattttgccgatcaacattaagaattttgctaaccgaaaaatggataatcagagaccaaaagttacttttaaaaaggcattcgtttcggaaatttaataattttaatt

SEQ ID NO: 520 - DNA, 2261 bp, Heterodera glycines
  genomic virtual cDNA Sequence=SeqID_560; coordinates=363..531 ,698..781,836..1057,1099..1281,1323..1448,1491..1752
  coding sequence=SeqID_794; coordinates=367..531,698..781,836..1057 ,1099..1281,1323..1448,1491..1652
  peptide sequence=SeqID_1037
tctattaacagagataaagaaatagtacgccaaaaagagaatgtttttttctctgcactctctatttattggttcatgtctcgttttttgaaacggtgtgttaagctatggagaatccaggaaaaaatatgtatttacataaaaaaagaatccctgataataatattttagctctcttctgtctctccatctttgtcttattctatcttgttccttctaataaaaattctttttcatcatatttcacttcaaacaaaatttaagtatcacaatcagtctcaaaaaacatcccaaatagcattgtcatcaaatttattaaaaataaaatttaagaagcctaattccttgaattaatcatctcatacaatggagcgtttattgcgattgggaggccttagtggtttgggagcaggttcattgaacgcaacaccacacgattcgaaccaagttgacacttcggaaactgtttacatcagttcattggctttattaaaaatgctaaaacatggacgagctggcgtcccgatggaggtaactaaaaactaatattttttatatttacacaccaaaaaaagtattaatcaaatccgctgaccgcaaatatcagagacacacacgtgtacgaatttgaaatggttaaatgaatgatattagtgatcagcggatgatttatgtcaaatttaaatgttccttttaggttatgggtttaatgctaggtgaatttgttgatgattatacggttaacgtgattgatgtctttgcaatgccgcagtctgggacggttaatttgtttttttttgtctgctttatttgccgataataattgaattttaagggagtttctgttgaggccgtcgatccagtctttcaggctaaaatgttggatatgcttaaacaaactggaaggcctgagatggttgttggttggtaccattctcacccgggatttggttgttggctttctggggtcgatataaacactcagcagagttttgaggcgttgtctgacagagcagttgctgttgtagttgacccaattcaatctgtgaagggaaaggttgcctttcttattagtttaccggtcaaattaaattttaggttgtcatcgatgcttttcgcacaattaacccacaggcaattgcactaaaccaagaacctcgtcagacaacgagcaacatcggccatttgcaaaagccttcaattcaagcccttatccacgggctaaatcgccattattattccattccaattgcttatcgtacaaacgagaatgagcaacaggcacttttgtagttttgtaaaatcatattaaacatttctagatgttgcttaacctcaacaaacaaagttggatggactctatgaatttggtaaattacaacgagcattgtacacgaactgagaaggctgttgagcatatgctaaagcttgcaaagctttacaagaaagttattatcgaacctaaactttgtttaattgcaatagtttagtcattggaagaagaagagaaaatgaccgaagaacaattggctatcaaaaatgttggaaagcaagacccgaagcggcatttaggagagactgtgagccagcttttggccgataatttggtgcagggattggctgcaatgcttgatgtttctgctttccagtaaatgaattgtgttgatgaccagagactgtttaattgtatctgtttatgcattatatgattcataaaatgtgtccttttaactaaatccaattttttacgcgtttctgaacggtttattattctttcactgtactttttatttgaatagttaattcgtgtcgttcgttattcagtgatgcttcgttcacaaagtgcggcgagtgtttctgaaattgatttaacatccaacagtgtctttaatgcttcctctctgggtttaagtttagtgaaaaaggaggattcttccgctcacgatcagtcaaattctttttgtgcaccgaaaaatgccgaacagctctctaagtgcttgttggatgttgaaactgcaaaaaggttgctcgcttcaaaattgccattgccggaactaaggccattgatggttggttgctacatgcgttaccatgcaatccgagaaattctgaaggttatccattttttagtaaagaaatttgttggcgttgacttattctgcataatgtagaattagctttgagctttattaataaatatatggtaaaattcaaaaaacgtttcccttcagaataggtatatgggttttactgctctataa

SEQ ID NO: 521 - DNA, 1087 bp, Heterodera glycines
  genomic virtual cDNA Sequence=SeqID_561; coordinates=1014..900 ,854..810,734..675,634..488,443..165,118..86,29..1
  coding sequence=SeqID_796; coordinates=998..900,854..810,734..675 ,634..488,443..165,118..86,29..1
  peptide sequence=SeqID_1039
tttaaaatttgctgctcacaatacccaggctgaatagttacaacagttctgttagtatttattagctttctaaaaatgaacttgcctccccattggtgccatccacccatttgagcaccttaaaaatgaattgctagtaaattaacgtgtatttttgtattcaccgcaatttcgatattctgcgcccccgattggaccactggggctaaagacttgagcatcagtttaagcgtagactcctcatcagctgtgttgtcgttgccgtattctttctccagatactccttcacaatcttttcatttcgccctattgaaccggccaacaattcgtagtaaactccggacggttccgtcttgaaaagatgaggggtcccatcagaatcgaagcctccgacaagcattgaaattccaaaaggccgacggccagtggtttgagtgtatctctaaaccaaacaaaaagttactcagatgttgtaagtcaattgacctgttttatatcagctatgatgcgagagatatgcatgacagatacgcggtcctcaagcgtcaatttgtaattttcgcattcaactcgagcacggtcgataaggacgcgtgcatcggcgctgagtccggcgaatgcgaccatcacatgctaaacataggcgtgcattgaagaggaataaggaatttaccgaatccaatgcatgtattttacgaatggtacgttcgtcttgcagagtcgggatagatttctgcaaaataaaagttcaccagaacagtttaagcaatttttatgtctgtgaatacactagctaaaaataatttactttttcgactccaattacaacacaattttttcctttcacggcaacctaaagcaatgcacattaatatttttaaaaagcaataaaacgcaccgctgttgagcccttcttcactgcttcttgcgcatagtcaacttgaaaaagtctgccatccggagaaaaaatcgtaattgcacgatcataacgctccatagtttatttgctaaaatcaagcttacaaaaagcggttaggcatttaaaatttaagctccgtaaaaattcaattaaaaatcatcacattt

SEQ ID NO: 522 - DNA, 3055 bp, Heterodera glycines
  genomic virtual cDNA Sequence=SeqID_562; coordinates=2790..2629 ,2578..2429,2195..2098,2024..1901,1744..1624,1526..1366,1073..945 ,889..779,646..491,90..1
  coding sequence=SeqID_798; coordinates=2790..2629,2578..2429 ,2195..2098,2024..1901,1744..1624,1526..1366,1073..945,889..779 ,646..491,90..1
  peptide sequence=SeqID_1041
ggatcctctagagtcatggttggtggcacgcagaccggtgaacatgctgatgccgctgttgtcaccgcggaagtgcttttcgcagatatactgttgaaaatgtgataaatatatacgttcaacaaattagagactaatgagcataattagcttagtgaatattacatctaaataatatattatattcgatcagtgatttattgtattgtaaaaggtgaagttgtttagtaaattggcactaaagttgttaatgaattcaaacttttggaaaacatattagccttgataaaattgtgaaaactgataaaatcaggtttctgtccctataattcaggcaaaagtgtggattatcgtattattttttcaaaaatgtatatgtatcagtgacgaattctccgatgactaattagggtgttgataaataagttcaaaatcggaattaagctgattctttttaatcaaatctgtcaaacaaagacaatctgcttaccaatacagttgttcgaagatcaaatttatggaagaattgtgtgacaaaaatgtgtatctcaaggatgccgtcctggtcatgccgttccacttgcttcagcacgtcgacaaaccattcaaaattcttatgcgtcggacaaatccacaggaaataaacctttaaaataaaataattatttaaaagtgccgaaaaataaaaataattcaattaatttcaaaataatgattaaaaagtgaattatgtaaaaaatggaattgattttgaataaaaataaattttctatcacacctttcggcactttatgccactatggttgcccgacgccctctccaacaccaaatccatcagcgtggaggcgtacggcgttatgccaatgccaccaccaacaaacacaacgacctgcaattgaagaatttcaaattaaatcaaggattaccctctctatcattatcacctcctggttgtgccattcttggttgccgtccccgaacggcccgctgaggttgaccaccgggtaaggcaatgcgttgtccttggcctcgctgagttcgttgcgcaaattccatgtccatgggccgaccgccttgacaatgtgaaaaatataagtttttgagaaagatttatagttgaaagtgtaggtgccacttttagcacattcactcccttatccttgaagtaattcgcgagtgcatttcattttccctcgtcatttacttctgccccattttaaaattaccaaagtttgaaaatttctcaaagattctaaaatttgaaaaacacttttctgagtgttttcattttgggataaattttttattctttaaaaaaatggcgcttttatttttttcaaatttaattttaacatttcttttcaccttaatgaataactcaagagttggcgattgtggcgcggatgccaatgaaaaagcatgggactcgttgaaagtgcaggagaaggcggggcacgagatgcgcacccattggccagaacgaaatttgaacgaatgaggacgcttgaattggatgtagatgatatctgaacgggggcacataacaaaaagaaattggaaaataaattagacaaaacttaattataatcaattaaaaattaaatttgttgtagaaaattcgacctgatggtaaaatggcggcatcaacgattctcaactgtttgtagtgtttgcgcatgccaataatacgatcaataataaaaataatcaccgggccaagcacaatgtaccaaaatttgggtgactgaaaaccagaattttaattattatgtttttattcattaccgtatttattgtaatagagcccttggtggctctatttttcacaaaaggagggctttatttcagagggggggctctaattcaaggggggctcctgtatttgactctgtcaactcacgtccaacagtttgggaagcccgtggagtatggtaagagcatacagtaacacattgagcagatgcgttatgcgaaatgcatgataggctcgcttcatcacagcaggcgcagagaaaacgtaaattctaaaatttaatttataataataattttaatacattattaacaaaaacaatttcaataaaaatcacatcatacatggacatgacagcgacaagcaaaatgccggtgattccggtcaatgtgccgaagaaccaatatgagatggatggcaaaaagttggagccgaacaccgcctgggggggggggggggggggggataaggatggtaggtggatgagaactaattgatgagtaaaaattcaatttttaactcggtaaaaccctgtcggcatcccggacccccgaaaacacagttaaatcccacaaaattggtcatttttggagcatgattttcgccctccccatcgcaacattttggacatttatggtttcaaagtttttaatcttaattaaataatttgtgtacttcctgaaagaggcacgcgatgccctcctgactttgggtggccacatggtaaaagttgacgcaatgtccaattgtgtgaatggcagcgaaagtgccggcggtgatggccacaattttgtggaaagtaattgccgagtcgagcggtaaatactgtataaataaagcaaaaaccaaaataatttaaatttccgaattttcacttcgccaacaaatgtctcgcgaagcattgtcagcagatttcggcacacggtcagcaaaattaatgccagatcaacagacaatgccgcagccgcccctcgagtgatcgcaatgccaacgcccatcacgcggcgcaagtcgcggtgctcattttcgtagcgataatctgcaaaaagcattaatcggttctttatgtgtaaagtcttaagactcaaagcatttaaattatggacaaatatgaaatttaaaaatatcgtaataaaaataaatcaatacacccaaaaagcatcaaattaccgtgtttacggtatttgagcccctcggcgggggttctatttttcaacctcgctcgaaagggggttcgaattcgggggggggggggttcaaataccgcaaatacggcaagctaaaaatatcaaaaaaaaaatt

SEQ ID NO: 523 - DNA, 2986 bp, Heterodera glycines
  genomic virtual cDNA Sequence=SeqID_564; coordinates=2..38,93..310 ,542..703,1004..1150,1207..1242,1289..1609,1859..1945,2013..2083 ,2142..2179,2263..2366,2475..2604
  coding sequence=SeqID_805; coordinates=2..38,93..310,542..703 ,1004..1150,1207..1242,1289..1609,1859..1945,2013..2083,2142..2179 ,2263..2366,2475..2528
  peptide sequence=SeqID_1047
ccccaatgagacggatgacaaaaccaaagaaataaaatgtgttttttgtgcttaacccaagtaaaacccatcatatttggtgtttctttctgtttcagcgcttgacgaggatgaaattgccgcacttagtaattacaacatgggaccgtacgcggatcagttgaagcaggcggagaaggacattgatgaaattcagaagcgcataaacactctttgcggagtgaaagagagcgacacggggctggcgccgcccattctttgggacattgcggccgacaaaatggccatgtcccatgagcagccgctgcaggtgaattttattttgattttggtcaataagacttgtttaaaatcttaaagatgagtgaaaatgaaaatagtttaaggaaaaactgaaaatgctaaattttaatgttagggattaggaaatggtcaaattcttggtgggtcaaaaatatcgaaaatttacaataataattcgcgacgctccaccttaggcaaatgttgcattcaatacaaattaaaatatctttttaaaaaggtggctcgctgcacaaaaatcatcaaagaagagggcaaagaaacgcgttacatgatcaatgtgaagcagttcgccaagttcgtcgtggacctgcacgaaaatgtggcgcccactgacattgaggagggaatgcgagtgggggtggaccgcaacaaataccaggcaatgtgcacattaatttatttcagaatttgcgtttcacagttacttaaacttttctgtgggttggaccatttttaagggatttgacaaaatacgccatgaattgattttaaaaattaaaaaagtgggcatttgactaattgtaagtaaaggcacaacaaaatcttcctttaaataagagagcagcatcttgatctcccctcccccgaaaattttccacaaaattttctgatgtattctaagtttttcaaaaaacgatttctcaccatccatcggcttacaaaacatttcatttttaagattcatttgcctttgccggcaaagattgacgcgtccgttacgatgatgcaagtggaggacaagccggacgttacctacgcggacattggcgggtgcgaagaacagatcaaaaagttgcgtgaagtggtcgagtttccgttgcttcaggtcggcaattcaatctctgtttttgtttttgttccattttgcctctttatttttagcctgagcgtttcacgagtttgggcattgagcctccggtgcgttttgccacaccttgggattgtccaacgttttccatttcagaagggcgttttgttttttggtccgccgggcaccggcaaaactttgtgtgcccgcgcggtcgccaatcggacggacgcgtgtttcatccgcgtcatcggttccgaattagtcaaaaaatacgttggcgaaggcgcgcgcatggtgcgcgagctgttttcgctggctaaaacgaaaaaggcgtgcattctcttcttcgacgaagtcgacgccatcggcggagcgcgatttgacgacggaaaagggggcgacaacgaagtgcaacggacgatgctcgagttggtcaaccaactggacggattcgactcacgcggggccatcaaggtgggtggggggatgtgtcttccattttggcttgaaggggaaggcaaagggggaggtcaaccgaaatttttgcgaacgggtccggtcttttaaatcgacgacttttagctttttttgcggcgccctttttgtcaaaaaaacttagggaacgggcaggggacccggcggtaccaataggcgcagccgtggattaattattgaatttttgatgaattgttaagaaaatttgttcaggatttctaatttcaggttttgatggccaccaacagaccggacacactcgacccggcgctcattcgtcccggtcgcattgaccgacgcattgaattttccttggtaaccaatgaaaataaatgccgatctgacaatgagtacacacactgctcattatgaatcttttcagcctgacctcaaggcacgaggaaacattctccaaattcacaccaaacggatgagcgtcgaccggaacattcggtcggtcattgtttttgacatacatttaaaatggagtacaacatgttcggtgtttcaggtacgaattgattgctcgactctgtccaaacacgacgggtgaacgaacgcccattaaaatgaaccctcttacaaatagcgattgcttaattaaccagaaaaagtacgttttgctttttgaggtgccgacttgcgcagcgtttgcactgaggcgggaatgttcgctttgcgtgcacgtcgaaaggtcataacggagcaagactttctcaaggctgttcagaaagtggtacgttttccttttgattgtgccaagtggattcttttatttggcttatccaaagtccttcgtttgttcgttctctttcgccctttgtattttacgttttaatttaaggtgaaaagctacgccaagttcagttcaacgccggcgtatatgacgcacaactgacaatacagttcttacaaaacggacttttttatatttgtgcacttttgtttcattacaatataaatgaggaaaccaattccgcagaatgtcttgttaacaaggactacttttacggcttttggaaattcaagcgtaaaaattgagtggcggtttcgtaaatgccgtgttaataatgcagtcccccccccatgtgtatgcggaaaaaagtggtttgtgcccagggatggcacggaattccgtcttcctaaattttattaagtagtaaagctaaagcaccacccaaaacaattgaccgataagtgtttaaaatttaccaataaataaataatattcaaagggaagtaactgtcgtctttggtgccgtttcttcatctttcgctccgtcttcgaacatttgacccattgcgttcagccgagcgtagcattccgcaacgccgaagaattcaatcagttctttg

SEQ ID NO: 524 - DNA, 3451 bp, Heterodera glycines
  genomic virtual cDNA Sequence=SeqID_565; coordinates=3450..3418 ,3349..3248,3029..2900,2457..2222,1770..1558,1374..1249,1145..1021 ,957..835,583..492,371..165
  coding sequence=SeqID_816; coordinates=3450..3418,3349..3248 ,3029..2900,2457..2222,1770..1558,1374..1249,1145..1021,957..835 ,583..492,371..165
  peptide sequence=SeqID_1058
tgcgttcacagttctgtaaaattttaaacttgcttggatttttctgtaaaatctaaaatcttttggagttagacaattacgggaaactttagcacttttaattgggtagtagtcaatcaagactgatgaattgtagtgctcgttggcattggcatttccgtcccatgcccacccactcacttgccagccaaacaccaatttggacagctcacggcccgacatgccggcagtcagcgaggcgatttgcttcattttggacagccagtcaaagtcgcccagcttcaggcgttgggtccgtgccccggaggtggccgggtcggcaatgtactgcttgaagtactggagcagtagacgttcacgctccagctcacctttggaaaaaaatagaaaattttaggcatcacaaaaatttcgtgaaaatttttcattcgttgattcgaagtgtgccaatgccattcgtaaagctatttattcctgggatttccactcaccgggcagtccaaattcgacaagttcgtccagacgatcgttgacagcccagtcgaactgctccggctggttgctggccactaccaacatgaacctaatggaaaagccatctttaataaagatattcaagtaaacaaatccttaaaaagatttaaaaaaagcatccccagttttcaaactaagaaactttgcaagaaaccttaaaaagttttacaaatttttttttcatttttcatagaaatcgtgttgtttgaattttctttttaattttagggtgatggaaacgagctgcccctaaaaattgtggcagccaaataattcgtaaatgaagcaccactgactgacttcctcgactgttccccggttctgaagaggaacgcgttgagcatggcgcgcatgtcctcgctgatctgttccgtgcttcgcttgcgcagaaaagcgtccgcttcgtccacaaagagcaccaaactgacaaaaaatgcaggaaaattattcatttgaaaaacggctaattaatttcaaatggcccaccctttgcgcgacgtttgggcccagtcaaaaattttatgaattgcggacactccgtcacggcccatcggtgccacgtcaccgccggtcattatggcgtagtcgagacccgaatggcgagccaaactctgataaacaatttaaaatattaaaataggggaatgaatttgcatgaccccatagaaaggaggtaaaatttcccaagaaaatgcaacaaaatggtggaccaaccttggcgaacattgtcttccccgtgcctggcggtccgtagaacaacacattgcggaacagtccaaagttacgctttgtgttcctcgtggtgatcgcaatgtcacgcagacgcgactcgaggcttggctaaaacaattctgtagcaaaatttttatttattacaacaaatgaccatttttagaggacattgattcaattaagatttaaaaatagaaaaatgtgggtcggaaagcatcgaaaggcactgcccgtgggggggggggggggtaaatctctccataaagcacggtaaatgatttgcgcactcacattgagcacaatgcccttcagcgggtcctcgcgggcacggaacagtgtccgcacactcgcaattggatgtttgaacagctcgaacagtgtgaggcgggacgtttcacgcaccagggacggcttaccaagccgtgcttccacctgtttggccacaacgccagtgccacgcttggcactgtaccaaccgaccgccagcacagtcagaccaccgaccttttttggaggaaggaggggtcatttaaaaagtggaagtatttataaattgcagttataaatatagttgttactgtatgtaaaattcagatatgggtattgtaaaatagtaaaaataattttataaaagaaatggaattaaaattgaaaactcatagtcaaaaaagtcattctaaatcacattttatctccaaaatcaaaattctaaaagccattacatatacaaaagctcatttttcaacaaaatcggatacaatttcatcaagtcgacaataaaattgaaaattagccctttcaaaattgaaaaaactgaaaatgagtaattgtttcacattctttttgctagcatttgttaattttttttctatttagataaaaccataaaaaacggaaaacatttttagataaaatacaaatataattaacaaattgggcataaaaaagcactcactgccgccataattttggagcgatcggagagaaactcggacagtccagcgcccacaacgccggcggttgtccgaatctgttccgtgaccgtcttgcgtcgctcctcctcactcgcacgcatcatctccaggttcacgtcacggttgtcgcgtgcggcacgcgccttggcgcgcacgtccgcgtcaatgcgttccaagtcgtatttgtgccgtagcgacagctcatgctcaatggtcgctgcaaaaatttgtggttttttacaaatttttacgaaacttataagcaacatttttcaggggaaaatctaattaaaaaatttctttgacagcaccgtagtgaaacttttttataggttaggttttacgcaatttgttaaaatttttgagggagaaacattggaaatagcattttttggttcaatttcttaccaaatttcgttaaattttgcaaaattgccaccgacaacgcctatcgttaccacggacgacaaaattcccgcaaaattttcagacccaaaaatgcataaaatttatttttcagtccccaaaaaatgcacaaaatttgtctttctgtcaaaaaatgctacaaaatttggcttatagcgtatataattttaaaattcaaaaaaatttctggttacgggcctgccctttacacaatgcttttagacaaaacccaccctttctgagtgcctcctgcttcttcaccgactcctcctgcctgcgcaatgtttcttcctgcattcgtgccttcatgctcatctcctcctcttgtcgcttccgtgccaattggtcctggtagtcggctctctgcaatttttttaaaaattaaattgccaaattttttattattttggtataaaaccatggaattgctgaatttttatgaaaaaaattaaaattaaaccgaaaacgggaggctaaaattaaattttttttttttttcatccataggatacccctccaaccggataaaatatcgaaaaaaacccaaaaatttgactgattgagtgttgtgctgcacttactgcgcgcgcatgttttgtctcctcaattaacgttttgcgcctttcttcctccgcaacgcgcacattctccgattgcatggccgcaattcgagcctccaattgctggaaaaaaataaatggaaattctgaatttttggacgggtgcatttttcagtgatattgcgactgaccttctgctgcaaatcgtactccttctgcttggtg

SEQ ID NO: 525 - DNA, 3201 bp, Heterodera glycines
  genomic virtual cDNA Sequence=SeqID_569; coordinates=725..844 ,889..1015,1574..1695,1752..1793,2207..2386,2438..2566,2616..2807
  coding sequence=SeqID_797; coordinates=749..844,889..1015,1574..1695 ,1752..1793,2207..2386,2438..2566,2616..2675
  peptide sequence=SeqID_1040
tggcatttcccgccaccggagcagtcgccgaattgttttgttgctgagcataattgatgaaactttgctgctgaccgtttgctgaagcgtaagcgccgtaattgaattgagtctgctgatatccgaacattctctgctagtgtcaatttggcgagcacaataaaaaaggaaggctaaaaataaaaaaagaataaaatacattaaagcttattatatgtaatccaacaaatttgattaagctaaaaatgagattttttttacaaaatatgtaaaaagcagcaggagaactcctcttgcgacagtcctctattgttgtaatcgataaaaaataatcgctctaatgacaattttcgttaatttttttcaaaataatcatgaaatttatgaaaaattttggcacccccacaaagtgtccaagccacgaaatgtccaaaagagtaaaaacccacgaaatgtccaaaatgtttcaaaatttataaaaacaaaatgagtctaatttaggatttttagggttttcggggtcgctgaatacgaatataccctttatattaccccttgcctaaccttaggcccatctgaataataaaaaactcaaattcgagacttggacatttcgtgggctggacattttgtgggtcagcgaaaattttatttgttacaacgtttctacttttacatctgaatctataagtactacttccctattttaaaataataattattaagtgaattttcgacttatctataaatgtttctgacccgcagcgaatacgacaggggagtgaacactttttccccggagggccgtctgttccaagtggaatatgccatcgaaactgtcaaggtgagttggaagaattcaattcagattcaccataattttcatagcttggttccacaagcatcggaattcacaccaaagaaggcgttcttttggctgcggaaaggcgttcaatgagcaaattggtggtggacgactcaatgagcaaaatttcggaagttgagaagcacattggtaaggcccattttccacaatatatgtatttagtcaaatgggtactaatgtcgtttacagaccataaaaaatagggtaatactgccgatggccccccccctttttttggagaaaaattcttcctgttctaaaaagtcgtgaaaacacgttatgggctttttaaagtcgctgatcacgaactgacattcattttgaccaatttccaatccaggacccgaattcgaacataagtcgagaattaattttaccaaaattcacttttgttagaatctgaacggaattcaggtccggggttcggatgcaatggtttatagttaattttttgcttttttaatctattttagaacataaaagtgaatttgaaattttttgagttttcgactttttgttcgagttcgggtccggggttcgaaataggtcgctaatggatgccggattcatgagcagcgaccctgatttattttaatggtctgtaaacgaaataaataccgtcaattgttacaataaatttgttgttaaattatttgatcccctcttttttaatcaatttgtgtttagccgtcgcctcggccggtctcatcgcagattcacgcacttgggtcgaacacgcgcgggtggaggctcaacacttttggtttacttacggtggcaaaattcgggtggaagacattactcaaaaggtggataaggaaaattaaaagtggtcgttttcattttcgttttatttttctttcaggtctcaagattggcactgcattttggggacgacgactcaactgtatcttttttcaaatttgattttcacttaaaaatcatgtttcaaacatgtttcattttaactattttgattatgtgggtcaggctgccccaagggggtggggagagatacgtaccccccccccctccctccccaagaccacttatccctcctaaaattctgaagggattttaaaaaattttccttgatagataccaatcgaaagcgctggtccaaatccctcaacctttttcaaaaatacaaaactcatctttttttacaaaatctgataataaagttttactgcgctattatggaaccatcggatcacttttcccatttagaaagtctttttgttttaaatttttgcaaacacttttttgcttaatcatttctcttccattggcatttttccaattcattcttgctttcagatcagtctcggccgtccgtttggagtttctatgctttttgccggcattgatcacacgggtgcgcatctcttccatttggacccgtccgggacgtacattaaatgtttggccaaggccatcggtgccggctccgatgcagcggaacaaacgctgcaagagcactgtaaaaactgcgacaaagtgaggaaaatgcactcattgcttttcacattttatcattatcattcgcagaaaatggaaatggccgaggcaaaacaagtcgcactgaacacactcaaacagctgatggaagagaaaatcaattccaaaaatgtggaaattgttatgattaagccgcagacggacaaggaaggcaaaacggtagcaattggaagaaaatgcatattttgttatttattcccattttcagttgggcaaaattgtgtggttagaggaatcggagttgcaagaaatcatttcgcgattgtagtcgaaggggacggatgagagaaggaaaatgggctttgcactgccccttttatgattggatgaccttttgttattctctgcctttttgtgactttttcagtgtataaggcaaatgaaagcaattaattgagaatttggctaatatccaataaatgtttcaattctctgctgaggcacagtgtccgccactgactgacactaatgacaagagtttaacgatgcgtagcactaataaaccgtatttctcacacaccacacaaaattttcatatgaggaggctctgatcgctcccaaaaaaagacattaaaaaacaatgtcagatgataaggcggagtcaatcagtccaactcttatcagaatttattgaacgcttttttgttggaataaaacgaaatatcatggaactaattgacatatttttgggcccggtaaatgccaaaattggtcgaatctttcagcagacaagaacgggacggcacaacagacagtgccgtcaatgtcttctggcacagtgtctccccttcgtg

SEQ ID NO: 526 - DNA, 976 bp, Heterodera glycines
  genomic virtual cDNA Sequence=SeqID_570; coordinates=1..128,173..298 ,350..471,530..595,644..969
  coding sequence=SeqID_802; coordinates=8..128,173..298,350..471 ,530..595,644..859
  peptide sequence=SeqID_1045
tgcataaatgaaccaagaacaagacaatatcccaactttcaagcttgtgttggttggtgacggtggtaccggaaagaccacttttgtgaaacgccatttgactggagaattcgagaagaaatatatcggtgtgtcaaaataataaccgcgattctttaattttgtcgtttagctacgcttggtgttgaggtccatcccctcacttttcacacttcgcgaggtcaaatccgattcaacgtttgggacacagccggccaggagaagtttggtggacttcgtgatgggtattatatccaaggttaatgaattaggaatcacttttttttactcaaacatcatatattcttaggccaatgtgctattgtcatgttcgacgtgaccgccagagtcacatacaaaaatgtgccgaattggcaccgcgatttggtccgagtttgtgagaacatcccaattgtgctggtggggaacaaagtgagaagttcaacggttctactttacttaaccatcaataaatctcgcctccttttaggtggatgtcaaagataggaaagtcaaggcgaaaagcatcacttttcaccgcaagaaaaatctccaggttcgttttttgtctatatatattcataaagcagtaccatctttgtagtattacgacatttccgcaaagagcaactacaatttcgagaagcccttcctttatctggcacgaaagctgatcggcgaccccaacctcgaattcgtggcgatgccggcactcgctccgcccgaagtacaaatggatcccgctttggctgccaaatacgagcaagaagtggccgaggcagcaagcgctgaactcccggacgatgatgaggacatttgaagagatggaaggacggctgggacagattcctgggacagcaatttccgagcagacaaagttatgtccattgttttaactgattgtttgatgagtaaaggaaagcgaatgaattgggat

SEQ ID NO: 527 - DNA, 3071 bp, Heterodera glycines
  genomic virtual cDNA Sequence=SeqID_571; coordinates=330..599 ,642..750,801..943,1011..1268,1403..1542,1608..1812,1863..2007 ,2061..2281,2404..2517,2568..2585
  coding sequence=SeqID_815; coordinates=330..599,642..750,801..943 ,1011..1268,1403..1542,1608..1812,1863..2007,2061..2281,2404..2517 ,2568..2585
  peptide sequence=SeqID_1057
tttaaatttcttgaaattttgtataggcctatattttgaccccctctagcgattccaagtttattttatggaacttaagtttttaactcgagatcggctcttcagttcttacaagggaaaatctcggcaaaatttttaaattagtggggttttttggcgttttgaatatatgtaatgagaatatccgaaattcagtttttttcaattatactttggaattattttttgtttatgtctcgagcacaaaaattagttacacaaacattttgcagacagcttttaattgataccacgaattagtttgtattgttttagatttgacaaataaaatgtccccttctctttccgttgccaactcaaatgtctctcgaccgcttggccaaccaaaagtagcgggcttcaaagataaggataagccggaaagtgttcgtactagcaacattgtggcagcaaaggctgttgcggatgcggtgcggacgagtcttgggcctcggggaatggacaaaatgatccaatcgggcaacggagaagtgacaattaccaacgatggggcgactattctcaaccaaatgtcggttgtgcatcccaccgcaaaaatggcaagatttgtgttgtttgcttttatcaattgcactgttcagttggtcgagctgtccaaggcgcaggacattgaggcgggcgatggtaccaccactgttgtggtgttggccgggtctttgttggacgctgcagaaaaacttcttgccaaaggttgattaagctcgcttatacgccaaattttagcacttttgtttttaaaggaattcatccgaccaccatttccgactcattccaacgggcggccacattttctgaaaaagttctcgaggaaatggccacacccattgacattaacgatgacgacgagttggtgaagctcgccatgacgagtttgaactcgaaggtcctcagttcactttctgcactttctttcgtttgcccattgtttccttcgattttccttttttcaggtcgtttcgcaatattcccatcttttggcaccaatggcggtgcaggcagtgaagaaactgatgagttcaccggaggactcaagtgtcaatctgaagttgattaaagtcgttaaaaagttgggcgaaacggtggaggagtcgcagctcattgagggggcgctgatcgatcagaaatcgatgggccacggaggccccgcgcgggtggagaaggcgaagattggcctcatccaattccaaatctcaccaccaaagcccaacgtacgtccatttcatgcatagacaatggggcggtggggggggggggggggttcatagattgggcttgcaattagcgaaattcaaaaaaaaaaaaattttggctaccttttcccaatacttaattggtatttcagatggaaaatcaagtggtcatctctgactatgctcaaatggaccgtgcgctgaaggaagaacgaaattacattttggaactgtgcaagcaaatcaaaaaggccgggtgcaatgtgctgctaatccaaaagtccattttacggtaagcggtgatgaacgctgactcgttttccgacatgttttcatttttaacattatcctctttagcgatgccatcaacgaaatggcgctgcattttttcgcaaaaatgaaaattatggtgatcaaagacatcgagcgggatgacatcgaattctatgccaaaatcctcgggtgtcgcccggtggcatccgttgaccattttgtcccggaatcgctcggaacggccgatttggtggaggaaattgagacggctgatgggaaagtcctcaaagtcggtggagttttactctcctttttggctatttttgtaactattttcaggtgaccggccttaaacagagtgggtgcgctgtgtccattttggttcgcggctccagcaaattggtgttggacgaagccgagcgctctctgcacgacgcattgtgcgttattcgctgtttggtgaagaaacgcgcccttctgcccggtaaaaataccttgtatatcgttccaattcgacgatttgcttctcttccacaggcggcggtgcccccgaaatggaagtgtccgtccgcgtccgcgcagctgctcagacaaaacacggagccgaacagtattgctggaaggcatttgcggacgcactcgaagtggtgccatacactttggcagaaaacgcgggactgtcgcccatcgaaacagtgacggagatgcgcagtcagcacgcaatgggaaacaaagagcacggagtgaatgtgcgaatggtgagcaagcggaatgggagaaggggcggacaccccacaccttttcagtttatttattaatgaactgtctgttgcccaaattatggttttctcattattatgacatgtttgagtcctttcagggtgcaattacggacattcgcgaagaaaatgtggtgcagcctcttttggtcagttcgttcgccgtcaaacaggcagccgaatgtgtgcgcagcattctcaaaatcgacgacattgtgagtcttacccaggccatgtctcccattcattctctttccaattttaggttctgtcagtgcgttaaatgtgacggagaaaggcaataagaaattgttatgcaaccatttaataatgttatgacgttcattgcgtaaatcgctttttacttttaaatatttgtccaacaaaagtttaaacaaaatgatttgttatatttttttctttaatacaaaagtgcattttaaacgatgatacagcagacactgctcaaaatacaatgaaaactgctcttgagttggcaaaaaaaattgtttgtggtgtatttattgcacacgtttttcgccaaaaagttggccgaattcttacgggagtaggtccgccgaatatttaaaaattattttggtttttgaatttaaggtgattccatgctgccgactatccacgatggcgacattctatgggctcgagtttgggatccgaacgatgctttacgaccgggggacgtcgtgtgtttagttgaccctctcgatgcagaagagtaagggaacaattctataatattccgttcgtg

SEQ ID NO: 528 - DNA, 3441 bp, Heterodera glycines
  genomic virtual cDNA Sequence=SeqID_572; coordinates=355..513 ,843..980,1033..1247,1296..1388,1436..1620,1665..1724,1780..1864 ,2026..2125,2182..2347,2408..2528,2572..2641,2687..2743,2790..2954
  coding sequence=SeqID_817; coordinates=355..513,843..980,1033..1247 ,1296..1388,1436..1620,1665..1724,1780..1864,2026..2125,2182..2347 ,2408..2528,2572..2641,2687..2743,2790..2846
  peptide sequence=SeqID_1264
ttagttacaaaaaattccgttcgtttttgcgcaaagcttttgacgaaacgaatgtgtccgcgaatgaacccgcgcaattgacgcaaattcaaaacgaaattcagcaacaggccgggagtcagcctttctcacgggccgagttgaaggcggcatttgaccaattgtccgcggagaatatcattttcatggatcatgaccaaattcttctcttgtaatttcgttttatttattttattttttacttgtgtttggcgttttgataaatttggcacttttttcttttattccaacaaattgctaccgattcgtcgtctttaatcattttgtttttttccacatagttataaccgttaagcgtattttgtaatggccgctgataattttgacgctcaacgtattttgaacattttggccgagagagacaatttccaaagtaatgaactcgccgatcagttggccattgaccaccagcgactgatcggtgccatcaaaagtctgcaggtcaaagaaggggtgagcttttgtctgtttttatgcgtcatttattatcaaaattcattttatatcgtatctttacagaatgaccatgttttggtttttaaatagttaagtttaacaaccccgaaaacatttttaagagaaactttaaaaaaatttagaaattaatttctcaaaaaatgttcgagttcgggttagggattcggaattggtcgaaatggaggccggatttgttcacagcgccttaaaaaaacccctagaaaagtattagtattagaaaaattttcagaataaaaataaaataaaaattttcgggaccatgatcttcacaattccctttttagttggtttgcacttcggaagtcaaaatcaaacgcatcgaattgaccacggaaggcgaggaaattatccaaaagggctcccacgagttcaatgtgtacaaaatcgtcggagaaaagggcatttccaaatcagaaattgaagtaatcatgcaaaaaatagttataaacatttaatggatgcattctctgtcagaaaacatcctttggtcccatcggattgggcaaggccatgcaatgcgggtgggtgggcatggacacacgcgacggagtgcctttggtggtgcggaaggtggcaaatgccgaggacggggccaaggagcaattgaaattggtgaagaacggaaagggcgaccaattgacggcccaatgcgtggcccaactgaaaaagcgcaaatggataatggaaaggtgcacaaaatgacattcagcgaaaagaaattgttttgcaaattttagcgcaattaaagccctttccgttgccaaagggccgaacttcacgacgactgtgcagaagcaggaattggatttgacttcggagatgattgcctcgtaaattgccaatgatgaccattttatttactcaatgtccatttcatgggttcgtggcgtggcaagcagttcaaacagtacaatttctccgcgatgggcgtgccgcccccctccggccatctccaccctttgctcaaagtgcgtgccgaatttcgcgacattttcttccaaatgggtttctctgaaatgccaacaaatcgtttcgtggagagttccttctggaactttgacggtgagtaatttcgcttttccttacctccccttccctccctttagctttgttccaaccccaacaacacccggcacgcgactcacatgacaccttttttctttcaagtattgccccttttcttttatgctttttgcttggaaataatcattttacatttagaaccggctctttcgacagaattcccggaggattatcttgaaagcgtcagaaaagttcattcagagggcggtttcggttccattgggtagcttatctattagagatcggatttgaaaaaagcctggatttcctggacaaaaattcaggtccaggaaaaattcaggctttgatccaggtccaggccaatctctagtttttactcatacattttagtttttttacaaatcattttcgctgattgttaagctatcgctacgattggaagttggaagaagcgcagaagaatttgctgaggacgcacaccaccgccgtttctgcccgtcagctttaccttctcgcacaaaaagtgtcccttttcgatttccatcataatttctccgttgtttttctccgtccctccagcctttccaaccgtccaaaatgttcagcatcgaccgcgtgttccgcaacgaaacattggatgccgctcacttggccgaattccaccaagttgaaggcgttgtggcagaacgaaacctctcactggcgcatgtcatcggacttttcactgaattcttcaggaaatgcggtcaattagaaagattctttgtcttcctcatttgttactaattaaaattggaccatttaggaattgaaaatctccgcttcaaacccacttacaacccgtacaccgaaccatccatggaaatttacgcttttcacaccggactgaacaaatgggtggagattggcaattcgggcatgtttaggcaagaaatcattcattttatctatggctaattttgcatttaggcctgagatgttgcttccgatgggacttccggaagatgttgccgtggctgggttcggtctctctcgaacggtgggggttcggttcggcttaaatcagtctctaagcccccttttcaggccaaccatgatcagatacggcatttccaacataagagagctttttggccataaggcattcaccatttgctcactaacagataaattttttatattttcagattgatctcgaaatgatctacagaaaccctttgtgcaggttggagcagaaaaactagtgacgaaatgggagtgccaataaacattcgatgacttttttatgttgactgagctttttgtttgttttgttgttgactatgagtgatgagtgtaattaaagacattttattatctcacaaaattcttaagcaccacgaccataggggccactttcgtggcgagctcgtcgcccaggcgaaacactgcgcgcgcgcggtgctggctaaaaacggggtttttttccatttcctattcttaatcgtttcgttaccgtgccgaaaagaagatgcgatgcaagcgccaaattgaaatcaattcggtgctgaacatctgggaccccttcatctctttgctgacgcaagacaataacttcttgcagcaaggctcggacttggtcttgcacattttgcattcggacgtgcaattcctaagagagaggaataaaaagtgggaggggaaggaaagaaagaaaaggaaagaaatgggaggaagtgaaggagaaagagagagcagcaaggggggaggaacacaggaaaatgaggaaaaagagtaagctaaaaagagaggaagaaaaggaaaaaaaggtggaggaaaaaggaagtgaatgagaaaagg

SEQ ID NO: 529 - DNA, 1325 bp, Heterodera glycines
  genomic virtual cDNA Sequence=SeqID_573; coordinates=1323..1145 ,1065..969,778..662,383..242
  coding sequence=SeqID_827; coordinates=1320..1145,1065..969,778..662 ,383..242
  peptide sequence=SeqID_1067
gctcacagtcacaaattccacatttcccccctcttttaagtgctaggtacttatcggttttggggcctagatttgattttttttaaacaacaaaggacgcgcagaattttgtgtgagttcctcgggcgctaagatgtcaaaaaaagatggcgcatattcacttgaagaaactttagtcatttagtttggcgcgtagtttttgcaattctgcgcgtccttgtaatattccgttttattttacccgtgttgaaaaggtgcgcctgtgcgtttaggtactgctcccaacggcagtcgtacatcagatcttgcatgacggccgtttggtcgtcggccgggtccttgtagaacatgttgatgtccgggaaccgaaagcgtttcggaaactgaagaaaacagacaacattttggttattgggtttaattcaaatttgcgaagttggttttgtcatggttacgcctttattttataaattccgtaaaaaaattgttggcttttcgatttggagaaaatgcgattttggcatccatttcaatgcgtcattaacaccgaaaccggaccggaatggcttttaagcatttttttgaaaaaatatgtgaatgaattttaggggaacataaccggagaaatgccaaaaatttaggtgtgtgccaattgtcagaccaaatgataatagtcgcgcatgtcattgttgtaacggtcaaccaaaatgtcgtccattttaaaggccggcatataataaaagcccaacgcatcggccaattcctttgcgatcgacgactaaaataaattttttgaaccaagaactcataaattttgaaaggtccacaaaacgcgatgtttaagactgcggaacttatttaggtatggcaaaccgaaattttataaaatcattttatggggagacatcaaatcaattgtttgattgaatttcgaaaaaattgccgtttgaatacccccaaaaacagacccggcccacgccaatgttgctttcgaaaacgatcagtttcgagttgatgtgccaacgcttcagcgttttgtcaagatgttgcatgaattggttgaagctgacgagggaggacagcaaaccaataacaacaacatttaatggttataatacaatgaatttttttgcaaaaattttacccccattgtttgtagggccaaggctccgggtaatcgtcaggcaattccaggtcaaatttggtcacaattgaccgagactgaatgagatttggcaccaattttttgttgttgagggcactgctggttaagagccttgggtaggaaaagcgaagactgaatacaaatttggaggccattttac

SEQ ID NO: 530 - DNA, 1681 bp, Heterodera glycines
  genomic virtual cDNA Sequence=SeqID_574; coordinates=276..353 ,697..800,849..897,1140..1400
  coding sequence=SeqID_828; coordinates=276..353,697..800,849..897 ,1140..1400
  peptide sequence=SeqID_1068
tgatgaaacaattttatgatagatttttgattggcatttgtctttttaaaaatttgcttctttgacttggaactttctgtcattatccaccattagttcctaattatgtccaagaagcaataaattttttatgaatcaagctaattttgcataattaaaaagtcttggggcgcatgcgtctgtttgcctatgttttttcgatgggatttggttttataataccctttttttcctcggttttcatttaccataatttgcccatttttattaaaaggatgatcaattacatgctgctgttctcgcgccagggcaaactccgtctgcagaagtggtacgtcgcatatccggacaaggtgggcaacacacacagcgggagcagaccattgacagtggggtcgggggcggttaattgcttagatggctgctctcacattggatttgactacttattgtttgtgatggcaaaattgcattagcccgttgtgattaattatctgattgtttagtttaatttttgtcccggtttatttagagattaaacaagtggtgagcggcacggtaaaatttaccggccttttttgtggccggtagatttaccgaccgactatctctgaaaaaccggttgtttttaccgttatgcatttgccgttcactattagctcttacaaaattgtttaaaaaagactgcattttcaggcaaaaaagaaaatcacccgcgagttggtaaccaccattttgtcacggaagcccaaaatgtgcgcattcctcgagtataaggacacgaaagttgtgtacaaacggtgtgccatattgaaaaccaatttaaaataaataatttaatttctcagttacgcttcgctttacttttgctgcgccattgagcagacggacaatgaggtgaatgaattgaaatttatgatgaattactaagatttttcaagaaaaaaatttccaaaaaaacgctgaaacattttttttttttgtaattttcttataaaaaacttaataagattttttcttgaaaaagtttctaagtttgtaattatcacttggtttgctgcttattccgaagtttgtttttgaaattcgactcgatttttacggtaattttttccgaattcgccccgaacttcgttcagttgctttgtctggaggtcatccaccgttatgtggagctgttggaccgttattttggcagtgtgtgcgagttggacatcatcttcaacttcgagaaggcctacttcattttggacgagtttttgttggccggcgaaattcaggagaccagcaaaaagcaagtgctgaaggcgatcagtgcgcaggatttgctgcaggatgtgagtggtggtggggacggcactgatcactttgttggacgcaataaaaagccaaacaaataattgttgaaattgttgatcctatctcattattccacagcaaattgtaccacctttgttattctcctgatcatattttgattcataaattatatttcttcctgacaatgagcattcattcactgttgatcacttttaatcgacattgatcagtcctctacttttttaatgtgctttgatcagatttaatcttcttctcgccccttaattgattgtttatcctttcaagcataggtcagagtataatatttgctcgtcactttaacattttatgcgtcccggta

SEQ ID NO: 531 - DNA, 5601 bp, Heterodera glycines
  genomic virtual cDNA Sequence=SeqID_575; coordinates=5045..4860 ,4807..4616,4550..4302,4245..3826,3780..3659,3610..3514,3465..3292 ,3062..2913,2832..2530,2455..2301,2240..2069,2028..1803,1735..1637 ,1593..1421,1370..1353,1303..1158,1105..525
  coding sequence=SeqID_791; coordinates=4997..4860,4807..4616 ,4550..4302,4245..3826,3780..3659,3610..3514,3465..3292,3062..2913 ,2832..2530,2455..2301,2240..2069,2028..1803,1735..1637,1593..1421 ,1370..1353,1303..1158,1105..664
  peptide sequence=SeqID_1034
cgttgttgacttccatttccattattttatgctgtttccccatgaaattatcaccgctcatcgaaaagaaaaatcaaaaatttaagtcacattttactcagtctttcgagttttctttgctctgtatttcgagagaatgtcatggcaaaacataaattacaaaacagtttaatttatctccctcccctccatgaaaaatttactttcgattgccacccacatatatcatcaatttgaaaattgcctatcattgtataaaaataaataaaaacattgtttgtatagactaaacttcatccactctattgaattcatgttttttgttggaagttttattgtaatcgaaacctcctctggcatttttgaaaagggaattattgacttttaaattagtgctttcttgtttacagtcgctagttcttgttcaactttttatatccaatttaatagccaaagctatttaattttttagcaacaaattaaaatacaattagtgatcattccgaaacgagatacacttcgaagaacttagttgtgtttaaccacaccacaaaatatttgaaacaaaaatggattaaatgcttttattcagaaagggtctggcaacaccattttcgtagaaaattaatcacatcgtgaccgctattcagcggttgatgaaaattatttcctattgtaagttctgttgttgtcgtttctgcgatggtgatgctgagtattccttggctgtgatattagaggtgggggctgcccgtacggcacgtgagactggatttgtggtggcgggtgactagtaatccaattttgcggtgggagcggcggaggcgggggcattgccatctgcccaaaactgaacaacggcacgggctgctgctgctgttgcccgttgtaaaattgaccctgctgccattgttgctgatgttggtactgcatttgatgttgttgttgtggtgagtttgtgctcatgtgccatggaagtgtgtgcgctggtggcgatgtttgcactgagaaaagagaggccggacaactgcgacggttgtcgtttatgtggtggttgagcgtacgatggcccgccatggagagatttgcacgtgggatgtcacgactgtaaatgtcaagtgctcattgtctcacgagacaacaatttgacgatgaacctgaatccgatttggggttggaaggagccgtgccgtcgttggtcccaatcgttcggtttgagcacacgaggcaattccttgatgccgtccagcctgttggctttgaagatgaagtgcattgggaattggggatctcggaactcaacctgtgcacaaaaaatataaatcgaacattgtaaatgataaaaaccgaaccataatgcaggtattctcctgaagagatgcaatttattgaaacataggctatttgtaaaacaactcactttgatgtcgccaaactccaacgaatttctgaacagcgacctatgcgcctcaccaaaagcgagtgcttcgacgtcataagacacttcgccagacatcccatacgctttgactgcgtcgatgtgcacccatttcttttcttcgtcatcgacaaattcaatttcagtctcgaattctaaatctcgatatttaaagaggaaatgccttaaatggcttaccctgtttcggtgcctgttcaggttttgagatagcttcttcattcgcttgttcctcttgtgccgtcgtttcttcggttttcgctatttgttcgctttcacctatttttaattaaaaaacaattttatatggcaaatgattggtagtcaaaatttaattttaatttaccattttccgcctgttgagtttcctcggcttctccttcagtttctcgcgtcccttcgcttgtttcttttgtgtcatcatttgttagttcatcttttatcgaagttgtcgtcttttgggagtgcacctcataaacgagcgaaaacaagttgtgtttattgccgacaaaaagacggtctggtccggtggcattccgcgcaatttcatcggttgtgagagtggcgtacacctaaaatattttttgttttttgaaaaaaaaattgtaaaaccgagtcaagtgcatccaaaagacgtttttcctcgacaaatggcagcagagcgacgccttgccaagcatatttcttcccgttcagatcaatttcaaaagtttccgggtaaaaatcaattatcggcgaacttgagtcggtcatcagccaacgccacccgtcaggaatatgagctctgcaaatgaataattataaaagtgccagtcggggaacaaaacaaaacatatcaacacacctgctagcagcaggaaacacacccattaactgctccaatggcttgaacggtttcgtgggcatgttgaagtcgggttggaaatcggcgatcagttcaaaatcggaggcaaacggcgcgtagtggtaagggtagtaccatttccagctggcacatccctaaaatacaaattcaaaatggacttgattcttttgaaaatacaatggctgctattacaaatagatgttctcgcctgataataataacgcaacacccagcagagtccctcaacataagcacatgccactttcttgcgaaattcaaggtcagtctcggacacttggaacttggctctgtagtagcggtccttccatccactttcccatagacggatttcgtcgagcacttcctcctcctcgtcagagtcgtatgccagtgccccaaccgcccccttggccaaaggcgccgtcttcccagagggagttacgagttttatctccggtttcaaggccgtttcggaggaaacggacgcagcagccactccctccttaaacgactaaaaaatgtcggtaatttaatgaacacacacgcaaacacaaaagaaaagcaaatttaaaatttaagcataaaggacactttagctggtggtgctccgttcggactgtcgactgaacttggggccaacttgcgcttccgatcaccgccatccgtggcctttcgtcggtcgacaggcgtcaacagcgactgcaatttgtgcgaactggcgacatccgcaagtctgacgaactgaaagggggaagtgaccatggaattaaaatacgattaaaaaaactacgaacaactgaatgggtttgagtcagtttttaatggcttcagtattcgaatttatcagtcactcaaaagagtgtcaaataagatcaaagtgaattgtttgtgtagttttattttcaaataagcatcataagccatccgcgtttaattgctctaatttaaattccaaatgttaaaatgccacctcctgtcggtctcccgccgccaatctgcgcatttcctcgcccgacattcgcttttgctgtccaagtggcattggtgctatcaaattggcattgtacggcataatttttgccattgcctgccgttgttgctgctttcgctgtttctttgattctttgaagcgcaattctttgagcttaagttgcttttgagtttgccatttctgtttaatttctgggccaacctgtctttgtttgaatatttcgtcctcaaccttcccaagtccgcccatgatcttcttcactctttcgatattcactatgccgttttcagtgagccagctaaaaatgtttctttaattcataaaaaatgattgaaatttttcgcacccgccagcctgataaaccatgtccttgtacaacttcacgagacggtcgatggcattttcacggatttctaacgatggcaaatgggggagaaaatcgttgcccacaaaaaaacacatcatgacctgagaatatcgtagtttcagaatagagactttgctttgaattacccaatcatcaatggctctctccaaatcgaacggaaatggcaaatttggcatggaaagttcacgctccaaatattcccgaagcactggcagacgtatgaagatgaagttcttctccttcttcaacgggtccgcttggtccggcccggtctcggcacgtgccaacccttcacaatgttcgacctcgtgcccgtattgaccgcaaagttcgcacggcctcggttgattcggcaaaaactcttctcgaattatgttgaaattggactcgtgggtggccaatccaagcatgataaggtcggcatcggcgccacaaagacagtgaacggtgttcgggtcatgcgccggcgaagcgcgctgacgtcggacgtagtccatgattttatgttcgccctcacccggcacattcgcatcggaaagaataacctaaaaacatttcattgttcaaaaataaaaccaaaacccagtaacaaaaaaagaacctggatcttttgccatgccgggtcgtaggtgatccgtttgtgcacgtaatagcgaagggcaacagaaagacgggccataaacggcgtgccgggtgttatgcaattggagtcaaagtgttcctcttcctttcgcggtggcggcaacggaattccttccgactccaaccgcttacgcacattttcgatgagctcgcgcttctccgccgcttcttgtgctgctcgaaaacgacgacttcgctgttggttcatctacaaagttagggttttgagatctttaaagttttgcgatgctttttatttccactcaaaaaaacctttgctctgggggcgaccccatcaactgccatgtagagaagttttcttggccgaacgatggaaaagaggcggtcaatatactcgaagatcaaaatgaacatttcttcctcggtcttcggcgcgggtcggtcttccggatgtgtgcacggatggataatgccgttcatgtccaagtaaagattgtcaaactcctaaaaatgcatcatttactcattgaatttttcatttgtccaattatctcacttggtaattctcatttggttgagttgcatctattgggatttttactccgtcaatttctcttctgcgctgttccaccgcgtcaacaatgatcgacacatactttcgtgaaagccaacggaaaaaggctggaactcccatgatacttcagcaaatttgagtttataaaataagggtactatcacttaaccggaaacaataaaaaaatattaattgttcaaagtgtaaaaaatattgtaaaacttataaaaatggctataaatatggcattaaaactattttagaagaaaaaaacatgatacaactaaaatttactcatttttagcgaaaaatcaacccaaaaagcgaaattttggcttttttgcttatttttgacataaactaaccaatttaaaaaaaaaaatttaatttaatcaatattctcgacaaaatttcgctaaaaatgactttttggaaaattttctggtctttaagggtcaaaatccaaatttagatgtttttcgtgcgtttcaggcctcccacagtccaggaaaaagatatagatttccatataggtaattggactccctacttattaggtatattgcaacttatgcaataggcgaaatactttttttaggctgaaattagatttttcagcatgatcgattttttttctcttgcagtgtttagaagaatccgtatttttttcggccgatacggattttttacggactacggatctttaatccgtaatcctgatccc

SEQ ID NO: 532 - DNA, 2514 bp, Heterodera glycines
  genomic virtual cDNA Sequence=SeqID_576; coordinates=402..523 ,571..725,772..948,1000..1134,1180..1388,1433..1511,1614..1712 ,1764..1860,1906..2052,2100..2270,2320..2393,2440..2514
  coding sequence=SeqID_793; coordinates=436..523,571..725,772..948 ,1000..1134,1180..1388,1433..1511,1614..1712,1764..1860,1906..2052 ,2100..2270,2320..2393,2440..2514
  peptide sequence=SeqID_1036
ttccattaaaatgttgtgccttaagttttatgtatgaaaattaaggaagttttacgggagcaggaatgggacccacgcaaaactctcgctccagtaagaaatcccgctagccaaatgaacttgaacggtcgccggattcccgcttcgccggctctaatgaaaataggtaggttatttgtttttaaaatttaacaaaaagtttggcataactcttggcaaaatgtcgaggagtgaaaatgaaattttcgttagtctttcgtctctgttgttctttcatctcttaaagtcgttgacgttaacgttaacatgtaatgctaaaagaaatgcttttgacaatttaattttgttttagccttttattacctttttaattagtttataattttgcataaaattcactgactgttctttttcactttccttcaattcaacaaaatggcgaaatctgcaattgatgttaatcgcggcatcacagaagaccaaacagctaccataagaaattatttcacacaaccgcacttaagtatttattaaaaagtcaaatattatgtattaattcaatcttttcagtttacaaaactgtcactggagtgcgcgggcctttggtcatattgggcgatgttaaattcccacaatacgctgaaattgtgaaacttacactgcctaatggagaaaaacgcatgggacaagtactcgaagtaacgaaggacaaagctgtcgttcaggtaaatgcgaatttaacaaattattattccattggtgaaagttaaggtgtttgaaggtacgtcaggtatcgatgcaaaaaacacaatttgcgagttcactggcgatattatgagaacacccgtttccgaggatatgcttggaagaatattcaatggatccggcacacccatcgacaaagggcccaatgttttggcggaggattacttggacatcgatggacaggttttaaaggcgtaattaatttgcaaattgatatgacctttaatgttttagcctatcaacccatggtccagaatttatcccgaagaaatgattcagaccggcatttccgcaattgatgttatgaatagtatcgccaggggacagaaaatcccaattttttctgctgcaggtcttccgcataatgaggtgactaaatggtgtcgacctgtgcaattctttccccattgtcagatcgctgctcaaattgtacgccaagggggcctcgtcaaacagccgaacagaaagaaggaaaatgaggtggagggtgacgacgactttgccattgtgtttgctgcaatgggtgtcaacatggagacagcgcgctttttcaaacaagactttgaagaaaacggttccatggaaaatgtgtgccttttccttaacttggctaatgacccaacgtaatttaatgtatggtaattcacgcatacataaaaaattatagcatcgaacggatcatcacaccacgactcgcgctgacttgtgcagaatttctggcttaccaatgccaaaaacacgtcttggtaaggaggaaattacctttaaagaatagctttgtaaacacaatctcggataagaattatttagtgtttcgattgttttttaatgcttttgtattcgttaaggttgtgctcactgacatgtcttattacgctgaagcacttcgcgaagtgtccgccgcccgagaggaagtgcccggtcgtcgtggttttcccggttacatggtaatctccactagtacattttcatgtattttaactttgtcttgttgttagtacactgacttggccagaatatacgaacgtgccgggcgtgttgaaggccgaaaggggtcaatcacacaaattccaattttgtctatgcctaatgacggtaaaagaataattggtggtaggaattttttatttgaccttttagacatcacccacccaattcccgatttgaccggttacataacggaaggccaaatttatgtggatcgccaacttcacaatcgtcagatttaccctccaataaatgtacttccatcgctgtcgcgtctgatgaaatcggccattggcgagggtaaaggacaatgtttcgcttccaactcttacattttgctttgctaggaatgacccgtgccgatcattcggatgtgtccaaccaactttacgcatgttatgccattggtaaagacgtgcaagcaatgaaagcggtggttggagaggaggcactgtcgtcggatgatttgctctacttggagtttctcacgaaatttgaaaagaatttcatttcacaaggtcaacaaaatcctttaaatgcatttagtatcaaaggagttcgttttagggaattatgaaaaccggacggtgttcgactcactcgacattggttggcagctgttgcgcatttttccaagagaagtgaatgaattccctcttacttttattttgaaacgtttcttttaagatgttgaagcgaattccagcgaaaacattggataaatattacccaaggggaggcactggggcgaggaacgaatga

SEQ ID NO: 533 - DNA, 3380 bp, Heterodera glycines
  genomic virtual cDNA Sequence=SeqID_577; coordinates=2..25,505..595 ,648..793,966..1151,1306..1488,1764..1992,2104..2198,2258..2337 ,2506..2662,2712..2845,3232..3380
  coding sequence=SeqID_810; coordinates=2..25,505..595,648..793 ,966..1151,1306..1488,1764..1992,2104..2198,2258..2337,2506..2662 ,2712..2845,3232..3380
  peptide sequence=SeqID_1052
tggcgcaacacaacaagtgcagaaggttcacattcagttgggatggggtcgggggcaaaacggagacgggagggttttggatatcattttttatttaaatctaaatcatcttactcaggtaatattcaaacaattatagttataactaaacgctgagattttatttaaaagtaccgttttgattggcgtaattcgcttcaggcgtattacttcccccccccccccccccaccgcaacgctttccccttgaaataattctaatttttttgctataaatagactctctcttaaaaaacctaaaaacttcatttaaaaaaaacttgactataaaattttctttgaaacttgttaaaaaatttgaaaaaaaatactttttcaaatttttattgttttttgtttggaagaacctctaacaaaaaataaaaataaaacttaacggaggcgtggaaccaattcatgtgggggagaataagctacttttaaattcggttttccctttttaagttgactgatcagttcctctccttcatttcgcttgaagatgacctcttcatgctcagccgttacacaaaaagcagcccattctctttttacggttcataaatcaaattctttacaattattattcacagtgccggtttttatagcaattaatgacccgtcgataaccgccgatcaaattgacgcgttggtcgccgacattgccaatggactgttcgccgtctgtgtgacgcttggtgttgtgccggtgatcaaatgtccgaaaaacaacgcggcggagagagtggccgaagttggcacggcacgggaaatccctcctcttttccattttttaatatttttttttctactaattcttttcaaaaagacactttttgttgacaaatcttggaaacactttgaatttggtacattaaattggattacaacatttgatttttatatgataattgtccatttttcagaaacttgatcaaaaaattcgtgacaatctccgcgacgcccgcaacaacttgttcgtccaggaaaacattcgggcaggccatctgagcattcatcgtcccgtgttggtcatcgccgatcggaccaccgatctgtccacgatgttgcaccacacgtggacttaccaggcgatgatcgcggacattttggttgtgaatttgaaaattttagacatttttacacctaaaactatttatttcctattttttaattgcacaataaattccgaaaaataattacagatacaaataaaattgaaaatttcacaattatttatgattaaagtgggttttccccttttaggaaatggaattgaacagagtgcggatgaaagacaaaaatgggcgccaaaaggactacgaatttggcacggaagacaaactgtgggccaactacaaaggcagcccattcccattggtggcggaagccatccaagaggatttggaggcgtacagacgcaacgaagacgaaatcaaacggctaaaggttggttggtggaggcgaaattaatatgaaaatggaaagaatccaaaacgcattgaaaatttgaaaaaattgaccatttttggttttttttgaacaaacagttaatttttgctatttcgatttgattttatcaaatgaatattctaaaaaattctaaaagggtacaacattcttgggaacttttgatgaaattggtaggtatttttgcatttttaacggatgaaatttcaaaaaatcggttaaaagtcctctcaaatgcatttttctttcattaggaatcgatgggactgtccgacggcgactcggccgaaatggccgtcgacatttttggcactgccgccacggcgaaactttccacggcggtcggcagtctgcccgaacttttggagaagaagcggctgatcgacttgcacacgaacgtggccaccgcactgctggacaacatcaaaacccgaaaattggacgtattatacgaaacggaggagaaacttttgacaggccaaggttcgtgcacttcattccgccaccgtcgttctccccactccccgaaaattaataaaaacaaattagaaattttccaaaaaaaaaatccctaggatttttttcatttttcagaaattccggtcattgaaacgttgcgcgactgtccggacaaagacgacattttgcggctgattttgatcgctttgtgttctcggaatatgccaactgtacattttcacgtttaattaaaatataaaaaaattttgcgcaaaattccccttgtcaggctgaacagcgcgaacttcaggctttcattgacgaacgtgcaattagctcggatgcgctgcattttgtgcggcaactcaggtgtacgaaattgggtgcttttaaatttgggattttgataattcaagccctaatttccccaagatttttcttattttaaaaatattaccgaatttgtcagcattttttttagtcccgaaaaacatgattttcgatagtgttgtacaaataacagtgcatttcttttagggctttttctcatttgggtgccgaggcggaacagcaccaaggggccggcaccaagacggtcagcatgttctccaaactgctcagccactcatcgcgcttcgtcatggagggcgtcaaaaatttggtgcccaaaaagcataacttaccactgacgaaggtgcatttattttaattagctttttgtatatttaatattttattagatggttgaacagctgaccaccgatgtgaaaatgggcgtcggagtggctggtattacgggcagttcgtccgactttgacccggaccaattccgactgttcgaccctaaactattgcagggctcggccgtaaacagagagtgcgtagtttcctggagctaaaccccaaaacgtcgtcgggacataacgccggcaaaaacaaataaaaattttttaaaaatttcaggaaaaactaagaattttttaaagctttaaaaacctaggtgttactgaaaacaaaattttcagaatttcctgataagtaccaaaaaaattgattttttttttgtttccttgagtttccttaataaaactttttcgaatttggtagatttttttgaatcaagcttaggtaaataaatttttgaactttttctaaaattaaaaaaaattgcggcgacattatgtcccggtgatgttttgtcctgctcccgtttcctgagctttccggaaaattgtcctttaaatttctccttttttgcttcagtgttcgtcccacccaagcagcagccgacgtgatcgttttcgtgatcggcggtggcaattacgtggagtaccaaaatgtgcaggaatgggccaaggcacggggcctccaacggtgcacctacggatgcacggagatggtcaacccgaagc

SEQ ID NO: 534 - DNA, 2489 bp, Heterodera glycines
  genomic virtual cDNA Sequence=SeqID_579; coordinates=2472..2286 ,2213..2124,2075..1937,1717..1506,1325..1055,905..717,630..308
  coding sequence=SeqID_821; coordinates=2472..2286,2213..2124 ,2075..1937,1717..1506,1325..1055,905..717,630..447
  peptide sequence=SeqID_1061
taaatttttttgaaattttaagcaattttcttaataaaagtgcattaaaacgcctatcggcacagccggacccccattttaccatatttttgaaaaatggagaccaaaatggcaaaaaatataaattttttcgagaaaacggcgaaaaattttgtaaaatacacccattaattcgggatttcaaaaaacgaaaaatacaccctaaaaatcgaatttttgacttcagcctcccccccccccgaagccaagggtctggctacgcccttgcagaattcgatctgcgcaaaacttcctccatgtgtttgccttttaccattttttattttgttttgtttgttttcaatcacattaaacgagtaaagtacaaacaacaatatgcatcgtaaataagttacaatatacaaaggaagtacaaaataaaagacatcaaatgatgtgagaattgattagactcttagtttcttcagggacggctcttcggcagaagcgggtgaattgcttccgctggtgtccaatgattttccggttgagtccagggaattgtttagcatggacacgcgtggagaagccgccgcggcggagcagcgtcgttccgctcgtctaccccggtccaagtcctccttggaaagcctgcaatttgaagcaaaaccgtgacacatcaacaaaaaagaatttatatttggcactgccaaaaataatttttcaaataaaaggaccatttgatgagattcctttggcgcgtgtaagaggggtgaattctcatcgtttctttgaagtccttcagcacggacgcacttttgtaaacggtgtccgtaaatccctgcaactcttctgtgagatcaatttttttcgtaagttgcttgttcaggtccaatccgatgaaccacaaagtgcacacggggttccttaacaatgaatgaaaagttaaaacagagtgaatcatcattctttgtcagttcattttcattttttggattttgtaatgccacgcattttaagcgtgggtgggggagagataatttattagttcgtgagttgaataataataaattactcgtaatcgatgtcgagctccaatttgtatgcgggtttatactgccggggattgacatggcaaagattcacgcaggaattccgctcgaaggacgccaccaaatggcggattttggactcaaccaacccgcaaaagttcaggtggtcctcctcattttcggtgagacaaagcagcgcaatgaaatgtttgtagcgagtgaaaaaattgacttcctcgaatagctttttccaagtggcatgtccattgaatatttctagcatattgtctaggcctaaaaagatgaaaactgtgtagagaatgggtgttccagtgggtggggggggggaattcgaggcttctctgccccccccccaatttaatgattcaaattgtgcctccccttccctacccatggcactgtgtcttttggactttgcttgtgtccctcccttaatgccttcgctttgcacaccttctttgaattcattggtcatcacttgtctcgttgaccttgtcacattaaatgtggaattctgttctgggaaggctggcgtaatgattggcatcaaatggtagcggtccgatgcgcgtgttctcggatcccaaatcatgtcaatgaaatagggtatgtcaatccgcggggtagcgtcgacatccttcagaatgacgggatgtggccaatccctgtgagtcagaaaaaaactactgcacttaaaatttgtatttgacaaattaatttttttttgccactgtagccaaaaaaaagtttcaaatttactaagaaacactcggagaagccgctgtatgttagctggggttcgtatgcccttcgtacccaccctttccccatggatactgtcccacgccggtcgaggcttcccaccgtttgccctttgtccataccatgcagaaaaaacgaggaaaaatttctgcaataaaacagaaggtgttgcatttggatacaattgacaggtccgggcgacgagaattgcccaagaaatgccgccaagaaagcccaacacattggaataaatgccatggtctgcgaaagaggcacagtgaatgaatggaaaatgtagaaaaaactgacttttagcccaaagcttaacggctctaagaaccaaaatgaaattcagtcgatttgggaccaatcgcaaaatttcatcggccacacgacaacctgaaaatagaagattgattcaaatggaaagaaatgatcatattcaaggaaaaaggaaatgaaaaagagcaccattcagagaacgaatgctcttctcgtccaagttcttaagcaaattgtcgtctgagagttcctggtcttcctttatttctttcaacgccaaacgagcgaataaaatgtcgagttcaatgccatcgtagcgcagtttgatcagaggtacgaaggcgtcctcaactttgtggaggtccgccgttttttcatgactctagaggatcc

SEQ ID NO: 535 - DNA, 5201 bp, Heterodera glycines
  genomic virtual cDNA Sequence=SeqID_580; coordinates=3891..3838 ,3752..3586,3506..3342,3201..3025,2979..2832,2739..2593,2526..2445 ,2394..2273,2217..2024,1930..1837,1785..1487,1351..1234,1183..928 ,562..411
  coding sequence=SeqID_792; coordinates=3891..3838,3752..3586 ,3506..3342,3201..3025,2979..2832,2739..2593,2526..2445,2394..2273 ,2217..2024,1930..1837,1785..1487,1351..1234,1183..928,562..411
  peptide sequence=SeqID_1035
ctttgctttcgcgtggatttgcccgagagattataaaccgagtccaaaagctacggaaacaggtgcttacagtgggacaattacagttttctaagattatttttgtgatggcagggcaaattggtcgagactgacaaggccgttgcatattgtactgtaatgccagaggattcaccgcttggcttggcactcaaagaacatcgcgagaacatccaacaggcaactggcactccgttgttcatgaacgaaacccccaatggggacacttttctggcggaaagctgtgacaaaatcaaaaatttcgatttccaggtagcattgacattacgccattaggaattttaaatgtatgtttatgtagctgaggttgctaagactgaacgattgaagaaatgcactgaagaatttcattatacattaaatacataggtatatgtatgtatgtgtaagaatttttggctttcgttgttacaaatgcactcaattgctttatattctattgtttttatttttgttgagattgtttgattagtgtataccagggttgttgtgaatcgaagaataaaatgcgaaatacgaaacgggtacttttcaatttttggcctacatctctatatttaagccagattaaattatttaggtttttcctgggatgaaaaatgtgctgattactaacctgatctcgttttgtaaaaaaaacacatcgatttttcttaatacaagttaagatttgtgatcagcacatttttagaggatggtcaatgactgaatacatacactgtactagagccaataccgatcaaaagtggcaacattgagacgaagttcttgttcgaatccaatcacaaaaaaacaattaacaaggggaatcatttgaccatcaaacattttgtcagcttttatcttctcccccccccccattttttcattggttttccctttcgtttttctgttgtgtctctctcgtctttcttttctgctcttccttcgcctgtctcttcatttccttttccttctgcagttgtatcttccgttgctctttttctctctgcgctgcctctttctgttctctctctttaattagtgtctctctgtccaccaatttaacacaagtgtctttgctgtggtcctccaaccgaacgcccaattccgggaggatttcgtcgcgcagtctgtcacactcctggaaaatggagcaaacttagtttgaaatattaactggtttaaatgtactttcaaaattccaatgtttttctgtgcccgagcctcgcttctgacgacctctcgaaactgtgcaagtatttccaagtacggcatgataatcgcttctctgtcgtcagaagttgcgcagctaaaatgagaatttttttgattccatggcttaataatcattgcgccattcttaaatttttaaaagtaaaaacaaaaagttattaatttggtatggtcgttgcagaatatcgagcttactcaagtaatattttaccagtctttagtaaagaattcgtatttgcccacgtccggctgtacgccaaatatgcaaagcaattctctgacgaaattggcacattttgtcagcagttggcaattaagtacggcttcctcctgtttccggaccataatgtaagtgttcagaagggaaatgatcgtcctgattttgtcaagaactgcgcgtgtgtcgatggagtcgcacatggccaaatgcacggacactttgatcgcgttgaatttgttcagcacttccatctcctcttcaccgtattttttgaagcacttgaaatttttaaatttttcgttatcatttaaaattatttttacctgggacaattcatccacttctttaatttgctttcttataatatccttcacattgaggaagaattcgcagaaacatttttcgaaatgaatggcatgttccatcgtcgattcgctgaacattttgacaataattattttttaggattgcaatttcatttttgccataattgtctaattccgtatttcctccatttccttggtccacctgtagtccaaattgtccgtccaattgtgcatcaggaaaaggaggcgcagttgtcgagcagtgtatttgttcaacgcctcccttatcgtcacaaagttcttcaaactcttcgacatttttagcccttcgattcgtaatgtgccgcaatggaggaaaaagttaacccaatgatcgttgtcattgtacgcctcacacttaaaggaaaaaatattcaaaacggaattttccatcaacagttagagtactcacttgagcaatttcgttgtcatggtggggaaatttgagatcaaatccgccggcgtgaatgtccaatttgtccccgcaaatggccccactcattgccgaacattcgatgtgccaaccgggccgacctgaacagaaaacaaattggaaaacaggtgatgtggaataaatgacacacctttgccccagggactttcccagaagggctctccgtctttggaggctttccaaagcgcaaaatccgacggcgagcgcttttcctacaaaaactgcaataaattcgacaattaattaattggggaaaaaggggtgcagttgttgcgcactttcaaattgtccactgccacgctgagttcgccttccccctctcgcaaatgtttttccgcactttctgcatcagcatacgcctcggggaggagttttgcataggaatggttgggttttgatgcgaattgggcagtgttaaaatacacctaaaaggaataaaattgggtaaaaagaaaggctaaagaaacatttataaaaggatcactgtagagatcaaatgcattcaaaaaaaacttactgatccatcagacacataagcgtatccgttgcggatgatttgctgcacataatcaatgatttcgggaatgtactcgctgaccctggtcaacacgtccggctcaagaacatttaacgcattcatatcgcacaaaaattcattttcataccttaaaaaacatgactcaaataaaggcatattcggatttccttactttctggccaatttcgcgaaaatgtcgtgtttagtgaccgtatttccccgggtaacgtccaaccaatcggagagcacttctttcgcactttccaccaatttgcgcaccaaaacagtgcgaacatcagctgattgcccattgtctggctgggaaatacgcgttttgaattgaacgagatcagtctcgaatttggcaatctgaaaatttacggattagaaattggaacaatcaaataaaggcaaggcacagactcgaataatccggcacttaatttttgaagtgttcaaacgaaataatctttaaaattcggcttccactcactgaccgtatcgacaaaaagttttcttttgtcggtgtcgggttcaatggatgcctttttgagataatgctgaagtgctgcttgaagatgttgttccaattcctcaaatccaaccgaatcaatgccattcaaatattgctcaaaaagaaagttttggcgtgcccttaaaaaggcaaaacaaataatttttaaatatatcattaaagttcgtttatccaaaattaggggaatcggaaaagaaccttttgatgattttgtcgtcaatgtccgttacattcatcacatagagcacgtcgtaattaaaataatcggtcagcactcgccttacaatatcaaaggacagataagctctcgcgtgtcccatatgggcggaatcgtaaacagtcggaccacaaatataacatttcacctgaacagataaaaagaaatgattaatgaactttgctccccttctaaaatacccaaaaatgccttttcaaaccctcagaattcacctgattccctgaaatgggttcaaatgtttctttgtcgcgcgtaaaactattcatcagccgtaaacggggcttttcctcattgttttgctttttgtaggccgtccatttgcaaggcattgcactaacggagcaaatttgagtaaaattaaaaagaacagtcgctgaaaaacggaatgtgtatggaggaatagaacgaataatttgcataaactaaaaaaaggagaaaaggtatgtatttcggtggattaaatggttgaggaaaattaaaaagaattaaaaatacaacgcatttgcctatagaaaagtaaactataaataagttacaaagaaaaagtgcagaaaatagaaacaaaatccatctttttaaatggccaaataaatgaaagtgaaatcggtaacggacaggcgaaagcatccgatcgactcgcaattggcgcccgtttgttttgggcgcaatttccaaaatgtgtggatgatgatgcaatccgagtgagtcgctcgcccacccatccatcacccgccccacttatatgtaagccatccttatttgatatgagaagcaattccccacctgacgaatgagttgaggaattccaattacgaatgttagataaaattcgatttgcaaaatctatgtacataaatgttttgtccatggacaaggaaaggtttgagatttttagatttggaaaatttacactgcgttgtcaaagtgaaatgtttgcttacaatatgtttcctaccattgttgcatttaattattaattaggaatatcattagttcgcctaattggcttttgcgccccaccaacttccctccctccctcgcttcgcttcttcattcatctatcaacgtgcattcccatttattgttaaatgacatatgtaggtattatttattgttgattcatttgttcgttccctttttctgccaatttccaaaacgactcgcgatgtgtgcgtttttcgtttttctctattcgttccaattgttggattgaattttagggagtgagcgaaagagggacgataagaaagggtagtcaatgaacgaataataaatacaacaccaaaactatcgttgacgttccttcccttttcttcatctcgaagaagtgttttctcgaggcgtttaaactgtgttttacttcaatccttcaaaactcaaaagttcgattaaattcaattttgaaagaagcaaaagaggaaagagacggagagaaaagcggcgggcgaatgcaccggcggaatgagtgaatgcatctgccgtccgtctgccgtccgtctgccgatcagacgatgggcactcactcactttccctcccagcttttcctctttcaactcgccgttcatcaattcacta

SEQ ID NO: 536 - DNA, 3181 bp, Heterodera glycines
  genomic virtual cDNA Sequence=SeqID_581; coordinates=423..674 ,800..1097,1149..1313,1401..1609,1656..1809,1857..2005,2053..2233 ,2276..2361,2408..2469,2518..2779
  coding sequence=SeqID_799; coordinates=444..674,800..1097,1149..1313 ,1401..1609,1656..1809,1857..2005,2053..2233,2276..2361,2408..2469 ,2518..2695
  peptide sequence=SeqID_1042
atactaaataagacattaagaccaatccaaaataataatttaaaacacttacggctttttccaccattgaggtccaatgcggtaactgctgctggtactgttcatacatttggacacgatcaaagaacaagaatttcttatgtttctcataatctaaaaatagaaattcggtgatggagttatacagtgttaacgatacacaatacaatagcagtaattaaaaaaggaagtaaaaaatccgtatgaggttagagttcaaagcaaatttttaaatttctaactaactacatttagccaataatttatttaaaatatttaatgaaaaaatgactggttggtctaagaccagagcaatatatgattagctgattgggcaaatcagcttaacattgtttcgtagtatcgacataaagttgctttttagccatacaatatttgcttagatggatttgttaaaatcttacgacggctcttcatcatcggacaatgaacaagaattggcagatataccttcttcgtccaatcacaacaaattgctcgctttgaaaatcccatccatcaacttaacacccaacgtgattgaacaacgcgccattcaacaggttgcggttgtggatccaaaaaccaaagagttgtatcacaatccgcgcttcgacgaattgtttaaaccagaggtagtgccttatgtcttattgtgtagggttagttatatcttttaatatttgtgatccaccggatttcgaacccttaaatgttttccttttgtgatagtgtaataaataaatttttccctcttcagagcggcccacaaaatccgtttaaaagtgaacatcaacgagcagaaaagaacacactgaccggctatgtggagccagcgcatttcaacgccttccattttgagcgttcacttcgctcctacgatacgcttggctatgcggataatccaacggcagacacaaccagcgcaaagttcgttggtgacgttggacaagcgcaagaaaaggccggcgagtcgctttttgaatcagtaaaaactggcggacagaagcgaaagagagtgataaattacgacgcatcaaacgttgacggatatacgggtaaaaacgacaggaaatactaattgtaagataataacttcatttgtaaaggaccgtgggcaaggtttgaggacgagaagacaattgctcgaccggacccagaattgcagaaggaaatggacgaaattgtgcggaaacggaaactgaaaagtcgtgctggccgaagagcggccatcgcggaattgcatttggcagaagagagcaccaaattgcacagtgaacatttatcttttttcaattccataataaaacaattagactttggtttcatattgcactttatcacaccaaatttaattgcagtaaaagatgacactgactatttgggccgttcctttatggaaccgccgaaatacacgggcaccaatctgcgcgaggactttgtgcccgaccgctgtttcccgcccacaaaacaagcacacacctacagcagtcacaccaaaccggtgaccgccatccgatggtttcctcgtagtgcgcacatgtttatctcttgttccatggacggaaaagtaagacggatacaccggaattgggaaaataaacgtacggcttcaggtcaaattgtgggaagtgtacggcaaccgtaagttgatccgcacatacactggacacaaagtgcccgtgaaggacatttattttaacaacaccggcactgaatttctaagtgccgcttatgacaattacatcaaattgtgggacactgaaaccggtgaattcttcaatttaatgttcaaatatttattttgtcatctaaaggtcaggtgaaaaaccgctacacaattggaggccatcgggcgtatgtggtcaaattcaacccggacgatgataaacaaaacattttcatggccggaatgtccaacaaaaagatcatccaatgggacacgcgaactggcgaaatcgaacaagtggaaaaataattcaatttttgaactaattaatgtaattttttaaggaatacgaccgtcatttgggtccagtgaactcgatcacctttttcgacaaaaaccgtcgtttcgtttctacttcggacgataaatctcttcgcatttgggaatttggcattcccgtggatacaaaactgattcaacatgctggactacattccattccttcaatgactagggcaccaaatggtgttagaagaatatgcaattttaaataaatgttaattccagaaaaatggatcgttgggcagtccatggacaatcgaattgtccttttccaaatcgtcgatgacaagttgcgattcgctcgtaaaaaggtggttttacgaaaaagaatttttttaatcgtgccttacaaattaggccttccgtggtcacaatacagcagggtacgcctgctcaactgatttttcgccagagatgaggttatctagcacataattcaaaaggcattcctttcttttttttcttagttttctcgcttccggtgatgcggacggtaaaatcacaatgtgggactggcgcacacacaaaattgtctccacatggaaggcacatgataatgtgtgcatttcaacactgtggcatccgcacgagaaatcgcggatgatttcttgcggatgggacaatgtaatcaaaatgtgggtctgacaatgaagtaaagctgacgacgattcaatgatttaaagtgaatttatttgtaatgtctcaaccgataaaaggaaaaacgtcctatttttttatcaactacctcaaaacttttatcaaataaatgaaaataaataccttaacataaataatgtagcaatctatcaacattaatcacatgtctcactgaatctgggcgtgatacggtcacccttttatttgtaacatcgggaacttgtcgatttgtcagtcacctaggctgaaatacaaggaaaggaaaaaaattagtttaaaaaaagaaaagtaccaaaatgaacaggcttttcggcacagaattgaaagtgtgcttcataatcaaatgattaagttgttccaaatcctcactgccgaattccaaatcagcatagtcaggaatggaagagacacagcgaatggtaggttttgggaaattgacgaagccgagcgaaattgggacaacgcactgctcaa

SEQ ID NO: 537 - DNA, 1751 bp, Heterodera glycines
  genomic virtual cDNA Sequence=SeqID_582; coordinates=1375..1303 ,1258..1157,1079..976,807..719,567..497,452..240
  coding sequence=SeqID_801; coordinates=1350..1303,1258..1157 ,1079..976,807..719,567..497,452..240
  peptide sequence=SeqID_1044
tttcgggcaaaaacaccagtgctattttaaaaaattcagcgcccgagagccaaaaacagggatttgtactaaagtaaaatgggggtccggcggtgccaataagcgccgccgggaaaatttttgaaagtgagtgcaatttgttaccctatgagatttcttttcctaacttttgcgtgctggactgggattagaaaaggacccgaatattcgctcattgccgctggtttgctatgcctcacattctcatccaaactgccagcgtccgcctgcagcgtctctttgagggagcgaatcgcatggcgaatcaatgcgtctctgtcagccgtctcaaattctggtaggttcttttcgagataagttcgcgcactttgtgaccgagcaccaatcgaagcagcaaacatttcggacacgtcccccgagggttcggctttcacaacgtgaggccctttgtcctgtcaaaaagcaaatatacatggaaaagctgtaagagacgaacatcatatccaatgatgagcagtcccacaccaaatgggcggcgtccgtaatattgggtattggactgaagttctggaaaagtcgaatatattcgccagcggcgtcggttacaagaagacaaaaaaataaaatataaggaattagtcttggctctctttgcaagcaatggaagggggggggttgacgaactctttatcaaaatttgttagattttcaaacttactcaagcctaatttacggttgagcagttcaaccgaaattggattatgatagttccagcgaaactcggcgcattcactttgcataaagcgtctgaaataaataaatttaatattcaggtgtaattttctaggccaaaaaatagataaaagttgggcccatcgactttagttagtttattttgagatttgtggtcccactgacatcacgcaattatgaatatttctcaaattttcgctttatttctgtattcgaactcacgccaaaatgcgtccatctgaaataagcccagacatagacaagccgagatgatcgtccaatttgaaaactttctgctgatatgaagaaagctcgttttgtgcacgctaaaactcggaaaaaagtcatctgtggtcactttttaacaactccccctccattacagaatatattgaccaattaccataagtgcgaccacaacagcataatctttgctacgaattgctactgctgcactgccctgtctcatcgcttcgactgcataatcaatttggtgaagacggccctttaaatagcaaaagctaaaagtaaaaggcaaatatgcacaacctgcgggctgaacacagtaacgtcgctatcgtattggttgcggaacattttaggattattgcattcaacaactttaagggaaaattggatatttaattgaccatgtctagagtaaaattctagagctcggtattttgaagaaagcctggacctggattggatttcattttgttttctgaacaaaaaccaggtctaggaaaaagccaggttgccaagacctggggatccaggaaaaacccaggccttgatccaggtcgagctcaaatagttaaaaataataatgattcatcagaaaaaaacatttagatttttaattctcatcatttgcttggttattggagttttcatttgattatttgaaattattaatttggctttttattatttatttttttgaatgaccaaataaggatttactaaacattttagaaattgtttttcgaatttcg

SEQ ID NO: 538 - DNA, 2477 bp, Heterodera glycines
  genomic virtual cDNA Sequence=SeqID_583; coordinates=182..230 ,285..535,578..742,784..869,918..1077,1515..1618,1661..1937
  coding sequence=SeqID_808; coordinates=182..230,285..535,578..742 ,784..869,918..1077,1515..1618,1661..1844
  peptide sequence=SeqID_1050
aaggtggctaattaatgggacctagtaaaaaaagaatttttaaaaaatagagaatttttcatttttctaggactaaatttattttaaatctttaaaaaaacagttattttaataaaagttgggtacaagttgccccgataatcctttgatttcttaagaatttgagcgcatttttctttccatgatcaaaagattgacgaatggaactgagctcaaacttagtaaaaacggtcagtcctttgatttttgtcttaatagttttggctatgccatccatttgacaggtacggaactcagttttcggcctggtctaattcatggaggagaattggagttcgactgtggggttcaacgttgtatcagttactttttggagcctctcattctcatggcgcctttttgcaaaaaacctttgaatgtgaatctgaccggtgttacaaattccgtcgatgaactcagcatcgacgccattcgggctacttggctcccggtcttttcccgctttgttcttgccgaccaatgcacagaaataaaagtcataaaactttatttattgagtttttttttatattttcagatcaaagccagaggtttcaagccgagtggcggtggttcagtgactttctccagtcccatcaaaaggaatttgcgtgctgtgcaatgcattaagccaggaaaagtttgcaagatcagaggtctcgcttacgtatgcaaagtgacgccatcaatcgcatctcgaatggtaattacgccgtcgtttcgtgtccttttacactttttcagattgacggagctaaaaagatgcttcacggaaacatttctgacatttacattacgattgaccagaggaagggcccccagggcggactgtccgtttttatttattttaattttacaaatatatatttgttttaaagatctcccggctttggaatcttcttgacggctgaaaccaccgaaggcgtatttttccatggagaagcgatgtcgcgccctaagggccaaaacgaagaccaaacagtgccggaagaaattggggaacaggcggcaagacgtttgctggatgaaattcatatggtaagtgctttctcttatcatgggttcgaactgttcatttttacacatatatcttgtttttttctaatcattccaaagaggtcaacaaaaacctacaccgctaccttttccagggattttttaaatatttttaaaattatttttctctcgattttctgattttaaatatttatttactaatcaggacgggaccgctcctttcttctctaccgttttccgcgcccctggaaagttattttttaaatttttatgaaaatttttgagtcaaaaaagtcgactaggtttttttgttttcatctggtcagaatccgaatttcaaaaattatgttatattcgtgaaaggagaggccctgacaagctactgacatatggaatctagattatgcccataaacggaaaaatattgtattatagtgtgataagaaagaaagctttagggaggctgtgcagattcgtcctgtcaatctttggccgccactttcatgactctctgcgacagagatgtttcgaaatttctccttggtccactcacaattaacaggtgcatttttcaattctttgtctttttattactcgtttttagcgtacacacccttcggaatttgcaaatgtttttcgagcaaatgtttaaattggaggaatggtggaaggttatgaaagaaatcgtcggaaaaggcggaaatgcgatgaaaaacggaagtgaggacaaatgtttgatgacctgtgttggggttggtttcttcaacatcaacaaagaccaactttaattgttcttttttgttaattttatatttgtttttatttattgtaataagactgaccgattgaattcggcaaaaaatacatttcttattttaaaatgaattaatggttaatttggaaaacaaacggaaagtgatgaaatgactgaagaaggtgcaaatacgacatttacggctgctttgattagcgatggacgtgctgaaaatcagttggagcaaaagaaacccagccaattgcattccctcccattttccatggattttaatgggccggcattggtctccaaattcttccagactgaggatggcgctaatgggctcaaagcagcactgttccgaggacatttgcttttgggcaaaacggtcagagcgccggagggttttgcgttttatgcagtcaaagagagtgaacattcacaatcagaagagggaggtgaggagcaacagttgaaaaggacggggttttttcttagaattggaaagtggcagcaaaggaaaacattctcattaatatttccatagagatgagcacgtacaatgttgtggactctgttccgtcgatggatgtttgggagtacgacgaaccaccagaaagtcgtaagaaatgcctgcagaatgcattggttgctctgcaagttg

SEQ ID NO: 539 - DNA, 5202 bp, Heterodera glycines
  genomic virtual cDNA Sequence=SeqID_584; coordinates=399..494 ,600..667,712..910,956..1089,1136..1330,1390..1498,1560..1700 ,1742..1891,1953..2108,2153..2314,2359..2617,2669..3028,3086..3371 ,3418..3538,3589..3740,...
  genomic virtual cDNA coordinates=3788..4064,4114..4224,4279..4434 ,4497..4615,4660..4834,4895..5063
  coding sequence=SeqID_809; coordinates=399..494,600..667,712..910 ,956..1089,1136..1330,1390..1498,1560..1700,1742..1891,1953..2108 ,2153..2314,2359..2617,2669..3028,3086..3371,3418..3538,3589..3740 ,3788..4064,4114..4224,...
  coding coordinates=4279..4434,4497..4615,4660..4834,4895..5005
  peptide sequence=SeqID_1051
attgaaaataaaacattaaatcaatttgccttatttttgcacaagtctttaatttaatctattgtgttatttttgaaaatcaaacaaaatttggatagattttgggcttacaatcgataccttttttggtcttaaaaatcccagtcctactcatttgcaactgcaatcagtgaataaaaattatttttgctcaatttttggctgaaaatttgtcactattcgtcactattttggactttttgccactattttgtcactattttaacatttttactcactattttagttaactaaggcttatttttaggcaaaagcctttacgaagtcaagaaacttaacattttttatgtactagaaaagacaagtttcgtttatttttttgattcatccatttcaaaatgttttttgacgacgatgacgaccaacagcccagggaggaatttgaaggcgatgagcaaatggatgtaaatgaatttaatattgaaacacatcaaacgggacaggaagaggaggaagaagaaatctcaacagagctttggcaggtgtgttttttgtttggtttggtccaaacttttctaattctttgaaatgcctttaaggaagcgtgttgggtggtgatttcggcttattttgacgagaagggactggtgcgacaacaacttgacaggttggcactgaatttattctggaaaagttctttttctttcacagcttcgacgaatttatccaaatgagtgtgcaacgaattgttgaaaattcaccggcagtcgaattgcagacagaattgcaacatatgtccggggaaattgagacaccgacgcgtttttccttaaaatttggccaaatttacctttcgaaaccgacgcattgggagaaggatggggcgccgactccgctaatgcccaacgaagttcaaattgacatcattcacagctatcaaattattaattcccaggctcgcttacgaaacttgacttattcttccccgctttacgttgacattacaaaaacaatttcgcgcgagggcgaagaggaccaagttgaacagtacgagaaggtgttcattggcaaaatccccataatgctcaggtggaaaatgccaaaagtcaatttgtacttttcaatgtgtaaataggtcgagctattgcatgctttccaatatgaatgatcgcgacttaaccgagctgaatgagtgtccacttgacccgggtggttattttattatcaacggcagtgaaaaagtgctaattgcacaagaaaagatggcgaccaacacagtgtacgtcttttcaatgaaagatggaaaatacatgtacagaacggagtgtcggtcggagcacctggggttggtcgactttttgtccggctaaatttcttcgccttttttagccgtccaccatcccaattttgtgttaatatgacaaacaaaggtggaaaagctgcctctaagacaccgatgggccagaaaattgttgcagtgattccttacattaagcaggtattggcatgattcattgtcagttttttttgttctcattttttctttttattcttttgaggaaatcaatatcatcattcttttccgtgccctcggtttcgtctccgatcgcgacattcttgagcatatcatttatgattttgatgaccaggaaatgatggaattggtcaagccgagtctcgacgaagctgttgtcattcaagttaagcaattcgaggggatggacaaagaaccgtttttaaggagcaaaatgttgcgctgaatttcattggaactcgtggcgcgaagccgggagtcacaaaagaacagcgaataaaatatgcgaaggaaattctacagaaggaaatgcttccccatattagcatagcggaacattgcgagaccaaaaaagctgtttgtttatgcatggcttattataacgaaattttaatgtttattattgcattttattaagtattttatcggctatatggtccatcgtcttctattggctgcgctcggtcgtcgcgagttggatgaccgtgatcacattggcaacaaacgcttggatttggctggtccattaatggcaacgcttttccgtgctcttttccgcaacttgttaaaagaagtgttattcacatttgcttaacaattgcaaaatttgttcaaaaggtccgtctgactgctcaaaaatacatcaacaaaaatggcaattttaatttggatgtttgcgttcggcctacgcttatcactcgtggattgtcctattctttggcaaccggaaattggggagagcagaaaagagcgcatcaaactcgagcaggcgttagccaagtaaaaacaccttcgaagatccaaagttttccaactaaattcaggtgcttaatcgactcacttacactgccacactttcgcatttgcgacgatgcaattcgcctattggacgtgaagggaaattggcaaagcctcgccaattgcacaacactcagtggggaatgatttgcccagcggagacacctgaaggccaagctgtgggcctggtcaaaaacctcgctttaatggcttacatatcagtcggttcactgcctgaaccgatcctcgaattcttagaagaatggtccatggaaaacttggagggtttgtcttttgtctcttctactattttagctatttctttttgaaatttagaagtggcgccaatgtccattgcggacagcacgaaaatattcgtcaatggcgcttgggtgggcattcatcgcaatcccgaccaactgatgacaacattgctgaaattgcgtcgccaaatggacatcatcgtttccgaagtgtccatggtccgtgacattagagatcgtgaaattcgcataagtactgacgcggggcgcgtgtgtcgaccgttgttaattgtgaacgatcgcaagttggtgttgaagaagcaccacatagaacagctcaaggagagggacgtcatggacgaacagcaacagttcacttggtccgatttggtggccggcggagtggtggagcttatcgacgccatggaagagggtaaagagcaatttcaaaaaatgcaattatttacgcgaatactgaaaagtgattaagaaactattatggttgcaatgacacccgaagacctcaaaactggtgggtactgtgaaagctacacgcattgtgagattcatccggcgatgattctcggcgtctgcgcgtctatcattccttttccggaccacaaccaaagtccccgaaacacttaccaaagtgccatgggaaaacaggcgatgggtgtttacacaaccaactttcacgttcggatggacacattggcacatgtgctgtactacccgcaaaagcccctggtgaccacgcgttccatggaatatttacggtgaaacttgttttgcttttttgtgttaattatagacgttttccagtttcaatgaactccctgccggcataaatgccatcgtcgccattctttcgtatggtggctataaccaggaggactccgtgattatgaatcaggctgggattgatcgtggtctgttccgttcggtcggttttttgtttttatatgcccaatttcatgggcgtatcatttctaggtgttttaccggtcatatcgtgattcggaacaagagattgacaatgtgaacgagcaactgattgagaagccgacgcgcgacaaatgcaaagggatgcgaaacgccatttatgagaaattggacgatgacggcatcacttcgccaggcactcggtgtgtttaaaaataaaaagcattttaattgacgactattttatcagagtgtcaggtgacgatgtgatcattggaaaaacaattgctttgccggaggtggaggacgagttggaagccagcacagcgcgctactctaagaaggatgcgtcgacaacacttcgaagcagtgagacaggcattgttgaccaggtgatggtcagtgtcaacgcggagggcaacaaattcgtcaaaattcgcgtccgttcaattcgaacacctcaaatcggggacaaatttgcttcacgtcatggtcaaaagggaacaatgggaatgatgtacagacaagtcagtgctttcagctccttactaaccaaaatgtacccttttatattaggaggatatgcctttcacatgcgagggcataacgccggacattatcattaatccacacgctgtgccgagtcgtatgacaattggacatttgattgaatgcctccaaggaaaggtcggattacatattgaaatccatttgaatgcattattattattgttgttaaagctttctgcaaacaaaggcgaaattggcgacgccacccctttcaacgacacagtcaatgtgcagaaaataagtgctttgcttgagggctacggctaccaattgcgtggcaatgaaataatgtacaacggatttaccgggcaaaagttgagcacacaggtcccagaaaaacaatgcgaatgtttgtgatctgtggttaatccatttcctcatgataacaggtgtttctgggcccaacttactaccaacggcttaagcacatggtcgaggacaaaattcactcacgcgcccgagggcctgttcaggggatgaaccgacagccaatggaaggcagggcacggtaagaagtgttaaacaaaaccatgaacacttcaatgccttaagtgacggtggactgcgatttggtgaaatggaaagagattgtcaaatttcacacggcgctgctcaatttttacgggagagactttttgaggtgtccgatccatacacagtttatgtgtgcaatcaatgcggattggtggtgattttcaatcaacggacgaacactttcgagtgcaaagtgagcagcatttgccttcctaatcgagtattcatgctttttaattacgaatttatttaggcatgtcaaaataaaacgcaagtgtcagctgttcgaattccttacgcgtgtaagctgttgttccaggaactcatgtccatgtctatcgcaccgcgaatgatgaccaaatagtctttgtttttgtttgttcatttttttttatttttgaattgaataaatttaaaaagatttgatatcggttcaaccgagcaaattacgacagtttgcaaccggggtatctattgtgtgttgtttatgtttattttgaattcataaaaatttaatttggcgtaatgtttgtctgccagtgaatgacccaaaatgctaaa

SEQ ID NO: 540 - DNA, 3660 bp, Heterodera glycines
  genomic virtual cDNA Sequence=SeqID_585; coordinates=282..368,466..660
  coding sequence=SeqID_818; coordinates=282..368,466..660
  peptide sequence=SeqID_1235
tgtccacaacttacagaaaaaagtccaacgaacgcattgtgcacccgggaggacccggcgaggaacgtgcgtatttcatgggaaagcacagaattaccccataaatgattagcaatgggtgtgcttatttatcagtaaaattgccctttgggattctcccgttttttattattaaaatccgattttttttgtgcattttttagtttcaattctgttggttttttccacttaaattcatcttcctaacaataagtgcatatgtaaatagttttaaatatttagcgcaaattgaagtgatcccatgcaaagtttgcggcgacaaatcctccggcgtccattacggcgtcatcacttgcgaaggatgcaaagtgcggaactttatttaaattggcataatattcccttactttgaatgacctcatcaatattaattgtctcttcattactgatttgtcaacttttcagggctttttccgtcgttctcaaaatgccccggtgaattaccaatgcgcgcggcaaaagtgctgcacggtggacagagtcagtcgcaaccgatgtcagttctgtcggcttaaaaaatgtttggagttgggaatgagccgggaggcggtcaaattcggccgaatgtccaaaaaacagcgggaaaaggtcgaagatgaggtgagtgagtgataagcgaacgatagctttaaagatttgtcgcattcgtggcaatgatttccattcatttgcttttacattggtaaattttcatcccaaatggtttaggtccgtctccataaacagcgaaacggcgaattctgtgctctgtccacgttgccggccggttcttccgtcattgccccgcccggtgcttttcctccccaacagtcccacccaaatttgtccgctcctccgtctgtcggaccgagtacacccgttggttcatcttccgccagttcggctggttgcagggatttcaaagtgagtgatcattttcaaattcatattgcaacattcctttgctttgcttattttcatgttttattttagcaggaatttaaatattcgccgccctcaaacaatgcgcagaatgtttcctccgcttctttgcctctgccgttgtattacggccatcccccgggcacccatccccaccacgcccaccaccaactgcaacaacatcaacaacaacagttggtccatcagtccaacgcgtaccacgaggaggaaatgccctctttccacacaatggacggtcagtgcgaaaatggcgtccttttggccttatttttgccactgtccaggccaatccagctcctccgccatgccactgctctaccaacagcagccccatcatgcgttggcgcccatttcgtattcgccaaatgcggcagtgttttcccagtccggtgccatccatcactccgctgccgtaccatcgagcaggtcagcgcgtcggcatttttttaatcttttgctatcatttgcatatttttcgtctgattaagtggggggtatccggtgactgctgattcgtcgattgcttccgctccgttgaacaaccaaagtttggtctcctcaactgtggacgacgatctgatcaaacgcgtggacttcgcctacgagcaggcgtattccgcctatttgaaccaccatttgccgattgatgacgaccctttcggcacaatggtcgacccgcaacagttggaccggctgatgaacatggtcagttggtccgtttggccgtttttctattttcatttttgtttgtcttttgccaattcgtattttttgtcatttttgaatttgcatgcgattcgatttgtttgatttgtgttgttttgcttgtggtggtggtggggtgattttggcgacggtttccgctgtttgatggcggcgttggtgctaaccatcattcaaaggtgcgctttggatgggcactgagtgagtgagtgccagtgcgtgacagagcacttctgacagtgggagatcagacaacgcgaagggataaatgcgttttgggaaggggaattgacgcgccacccaccgactgttgctgaccttgggcggcaattttggagagatttcgatgagttgagctggagaggcgaagcgggggatgtagggggggggggtgagttcgatcttgtggggatgcgtttatgtgatgaatggaggcgggcgaagggtgcggttggaaaggcgccttctcttaggggggggggggggggtcttatcgtttacagagggaaaggcaactgcaagcaaagattctttttcaaaacatattgtagtccaaatgactaaattctgcaggagcaactctttccccccccccttgccattttccccgaaaaattaaaaaaaaattcaagaaaagcgctttttcaaaatttatgataaattactaaattttttcaagttccaaaagatcgctgcattgtttttctattttttttatttttcagaaccgtgccgatgggtggctgaagttcgccaatgagttgaccaatgttaccaaatgtatcatcgaattcgccaaaatggtcaaagagtttctggagttggagcaggaccacaaaatacacgcattgaaaaagacaacgttcgacttggcaatcattgcaatggcacaagtggggaaagggggaaattgcgtaaaaaattaaatgaaacgggacggaaattcagcactatcatcagcaaagtcaaacattgcatgtgaacaatttggtgctgcccgtgtaccaatttcgctgttcggacagaaaggacgaggaatttggcaaagaggtgggaaaagcgactcgcaaatgttcaaatgttgttgtccatgggtcaatggcagttttcgaacaatgggcaacacacacaatttttaaatttcaattaaaaccattctaaaaaacaacaatgtattttttttcgaaaaagctaaaatttatatgatttttcaaccttctggagaaaaaatccatccctaattttttggaaaaattctagattttaattgaaattattaaaaaaacaaactatacgaattggcatttttacaaacacaccgttgtccatatgccatttgtttctttggcgtttgtccttccctttttgtcatcccatttatttttttcctccttttcagcttatcagtcggcttcagtacctcagctcattccaattgacttccactgaaaccgcccttttgtccgcctttgtgctgatggaccaatcccaggcgcccggcatggaagcgtttgtgggacagttgaagagctgtttggggggtcagttgcaccagcggatgccggacggggacgaggcattgcgccaactgctcgagttccttccgcgcctgcgggaattggcaaaaacgcatcgcaaatgtttgggacgcttccgattacaaatggtggaccagcaaagcgaacaccaaacggacagaggcgccgcggaggttggcggcaccgcccgaattttatctgaaaatgtgaatttgcaatcatttccaggccaatgtgctcgccagcttcccgcccctttacacggaactctttgccggaaatagcgactgacagcgaatgggggaaaaagacggagttggcttcggcgaagggggaatcactacggcgaatgcgcgaacttttaaatgccgtcactttagcgggaattttcattttg

SEQ ID NO: 541 - DNA, 3101 bp, Heterodera glycines
  genomic virtual cDNA Sequence=SeqID_586; coordinates=2129..2022 ,1917..1708,1653..1501,1445..1385,1325..1129,997..803,736..599 ,509..310,249..102
  coding sequence=SeqID_825; coordinates=2129..2022,1917..1708 ,1653..1501,1445..1385,1325..1129,997..803,736..599,509..310,249..102
  peptide sequence=SeqID_1065
aggtgcatattttcaagttgattgatatgagtatgaaatagtttcgaattgttcgacctccctacgcccattcaatgcttttttaccaaatccgcaggctcctcgcgaacggtgaaatctttgatcgacgtttcacattcaatgcgaccacagaatggggccaaaacgacgcactttttgtcgagcagaggcgtcatttcctccaagtcgagacaaatgaccatgtgttcgtctcgaatttgttcaacccttggaagagatggtaaacaataatattttgttggggaatatataaatcaaagcactcacttcttgtacatttcgccgtgaatggtgtccaacaattgtttgatgctttcgcccaaattggacaatggcaaaggcaccttttggcccgagtgacgaatgaccgcaagcgcttgttccttggccaaatccttggggcccaactcgagacggatgggcacacctttcagctcccaatgattgaatttccatcctggcgaaacctttaaaaaagtgataataacaaagacagtgtgatggaaataagtttttttgaaagatagtgcaaattttgtgtccgtatttcgcttacattgtcacgttggtccaaaactgcccgaactccatgctcctccttcagcattttgacaagtgcttctgacttttcaatcagttcgacccgcttttcatccgacaatttaacggtaattccgacggggataacaacgacctgaaaagcaaattagtaagatttgaagtcgttttgaaagagtctccaaaatgaacaaatccctgcctgaatgtccgcaacgcgtggtggcaacaccaacccggtgtcgtccccgtggatcatcaccatggcaccgatggttcgcgtggaaagaccccaactgttttggtggacgaactccacttgccctttgacgagtgagtcaaattcgatgttgaacattttggagaagttttggcccaaatggtgcgaagtcccgccctgaaaattgcagaattgtcgaaaaaactgaactggaaaaccaaggaaacacctataaatagactatttggttcaatgaattcgctaatttttttgtaaagtttgtaacaaaatgccgactctctttccacctgaatgcctcggccattgaccggcacatacgcctcaaccgtcgtggtaaaatctgcgccagcaaatttctccttttcagatttgcgccctttcaccaccggaatggccaataaatccgtgtagacgcgagcatacaaattcagaatgtcgtacacttcctcctcagcctcctcttttgtcgcgtaggctgtgtgtccttaattttgaggaaaaagaattgtcttacactttatttcatgatgcttttgaaaccaccttcctgccacaaaaattcccgggtccgcaaaaatggagtcggatgtttgaattcccatcgcttaaatggaaaagaataatttgcattttttatgggaaaataaagcaaatcttaccacaacattgcaccattggttgattttgataggcaaatccctgtgtgatttgcaccatttggcaaaggttgggtacatcaccgtttcactggtcggccgaatggcaattggaacggccaagtcggagtttccggccttggtcacccaagcaaccttaaaaattcgttttataaaaattcaaattctcctccccatttttaagttaacctccggggcaaagtcggccacgtgcgttttttcgcgttcgagcgcagcagcggagacgaacatgggaaagtaacagttcttgacgcccagctttttgatttcagcgtcgaagaatgcttggatgtgttcccacacggaatacgcccagggacggatgacgtagcagccggacacgtcgtaatactcaataagttctgccttgacgatcacctggaaagcgcagcgaagtgtttctttctatgtcaacagtcacactcgatttagaaagcgaatgcgaaacgatttgttgctttgtgatttttgccattttgtacctgggaataccattcggaatagttctccgtctttgtcacatccaacccaagccttgtctgtttcttagtccccgcttcatctccggtgttttgctgctgttgctgctgttgtgcggcaacctttttttctttgttttgttgtttctgttgctccttccccatttctcgatttcttttcaacgaatttataatgttttctgcaattacgggaccgtttgaatatgcatttaatgaggcgcgaaagagatgtctgtaaacacacagaaatcttaacgatatcatcttatctgagaaaagaagcaacaatgcaatttgcataaatttgaaaatgaaatgttaaatgtggtaatactgtagaactggtgtccgggcaaaaaaaaatttaaaattttctcttttctaaaagttggggattttctaagctgctgatgttagagctcggtattttgaaaaacgcctagacctggattcaatgttggacctggatttcctggacaaaaatccaggaaaatccaggtccaggaaaaatccaggctcctcgagacctggatccaggcctgggcctggatttcttaaaacttattttaaaaaccaaaactgtttgaaaaaaaattaattatttgcttagaaacatcaaaaatttatcgataaagataaagaaaaaaaaaaaaattgccatcagaagggcgggaaccacttactctgatgactgatcacagtaaaatagtcacagagtaagtgaataaatatcaagtgagatcacaggttaaagataaacaataacgaaaaatttatatgaaaataaaatcgaggtcaaagtcaataaaatgcctcaaaagttaataattctttatacacacagcggcccaattttgggctccaagtacaaataagtttattatttatttagtaatcagaacgccaaaactttgcaaaacttaaaatttattggggattttcccttgtaaaaatggaagagccgatctcgagttaaaaacataacttcgaaaaaataaacagggattcgatagagggggtcaaaatatgggcctatgcaaaattttaagaaaattggtcaat

SEQ ID NO: 542 - DNA, 4451 bp, Heterodera glycines
  genomic virtual cDNA Sequence=SeqID_558; coordinates=2428..4112
  coding sequence=SeqID_788; coordinates=2428..4112
  peptide sequence=SeqID_1028
atgaagtcgtgagtcatgtcgaagaatgcgaaaattttcttgcaacttcgaatgaatacttcaaaaataattatgtagcaacagatgatcaaaatgtgtcaatcgatagaattttgattgaaattctggaaaaaaggcaattccagattcggaaaaacaaagtctgttggaattggtttcgcaattcaagagtattttcgctgtttccgattcacagctaacccaaacaacccttattcagcatgaaattgagacaggaattgcagcaccagtgagatcgaaaatgagaccagtgccttacgcatatagagaaaaagtggccgaaatgttgaaagattatttagaaagggatttaattcgtccttcatattccccgtgggccagcccagttatcgtgccaaagcgcgatgggtcgctccgtttttgtgttgactatcgtgccgtgaattcgataacacgaaaggatagttttccattgccaaacatagacaatactcttgttactgggaggtaaaaaattttttacaacgcttgatttcatgtcaggctactggcaaattcggatgaaacccgaatcggtcgaaaaaacggcgttcataactgagtttgggctccacgagtttgtggtaatgccgtgggttatcgaatgcagtggccacttttcagcgttttatgaatcgactttttgaaggaatgatcaataaatttttatttgtttatatcgatgatgtgttaattgcttccgaatcacttgaaagccatctcgaacactagaaatgcgtttttgagcgtattgaaaaatcaggcttaaaattgaactctcgaaatgccaatttagtgccgaagaattgccgtttttaggtcacactttgactagaaatggaatcaaaatgaacgaagaaaaaatacaaccagtcaaaaatttaccggttcctaaaacaaaaaaagaattacagtcattattaggcttcttcacttattataggaagtttatttactcggttggaaccattgcagcaccactttttcgtttgttaaagaaggagacaaaatttgaaattggcgaaatggaaaagaatgcaattgataaattgaaagagaaaattttaagtgatgttgtactttatttcccaaattttgaggcagcgaaaaatgacccattgaggaatttcattataatgacggatgccagtaaaattggcatttcggcaattctcagtcagcagaatgaaaaaggcagaattcgtccaatttattttgcctcaaggcaatgtaacaaatttgagtcgttatgcgccgaccgagctggaagcattggcaattcgatttggagtcatcagttcataacaatgattcctactagagtaataacggaccataaatcgctgatcggaatgtttaaaagtaaaaaggaaaccggaaatgcacgagttgacaaatggatccttgaattaaactcaaaattcactctgaaagttgaataccaaccggggaaaaagaatatgattgcggatgttttgtcaagaacattcgagacaaaagagtgtgaaacgttagaaattgctgcgccggaagatattgcattgattgggatgttaagaattgaattggggcaagaaaagaatttgactgttcatgagaaaatggaatgtgttcgtgaaacaaaagaaagcgaaatgaaatttgtttatgattttttgagtcagagatttattcctgaagatcctaggcaacaaaaaagtctgatggacatttgccacaaatatattttgctagatgaattgttgtatttttgtaaatcggacggaaaattgaaacttttcgttccagaaaaattcagaaatgagttgttgagacagcggcatgaaagtaaatgtgcagagcatatgagtggcaaaaaattattcattcaactttcggaattttattattggccaaatatgctgggagattgtgtccgtgagcatttgaaatgtcgaatctgtgcgcatacgcgaattgcgcgttcaaaccaaccaccaatgcgagttgttaactcgtcagagcctttggaattagtgtgtttagacattctcgatgttggaccaagcaattcgaaccaaaaatattgtaagccgggactcgggtctcggctaccgattgggattgaaggggagaggctcctccccattggaacgcccaccgggattccccttttaagccatggctctcccagccgtcgaggccagtcagtcagtcaattccccagtcatcactcccactactggccctccccctaagccgaccgatgggacggagcctttccgcgggggctacggcccagtccaacaatccgtcggtggacggaggagatcgatctcagtggtcggaactaagcaggccgaatcccgaaacccggcacggcttaactggtagcaccggatggtttattgtgagctgttgaaaatgatggagtcggagtaccaacagttacgcgaactgtctgccgggcgcatggtcgatttggactcgctgatcgccttcatccgtgctgctcagcttgaattgctttggatccatcagcgtgaggaattggaagtgacacgcaactggagcgcctggacattccgatgctgcaaaactacttcaagcagctgctccatgagattgagctgcacgagaagcagttcaacgacgtgcacaaccagggcgccgcgctgatcaaccaacgccacccggcgggcgaagtgatcgaggtgtacctgcgcaccatgcagaaccaatgggattggatgctgaacctgagcaagtgcctggagggccacctgcgcgacgcgtacaatgccaaggcatttgtggaggagtcggagcaggtggagcagcagatgcagcaacagttggaccatcttgatcgtgaatattctcgtactgatttttcgctggacgatggtgaacagatgttgcgacagcttgactctgtccgtgaatacatccaacaattgcatgcgcgactcatttcactgaccgacaggtgtgcccaaatttcaccgctttggcaacgtggcgaacgcatttcaaaaccgctgccggtgatggcactttgcgagtacaagagcaaggacaaaattcacatcagacaaggggatgagtgcactctgttggacaaccatgaccaaattcagtggcgagtgcgcggtatggacggcgttgaggcttccgtcccatcggtggtgttccgcattcctccgcctgacccgcgattggcctcgttcctcagccgactgcacaaccaattcgagaagttgcgcaaactgtgggatcgcacccatcatttggtccgttacaacatggtgctgaacacaatgcgcacagtgcgtgcatgggacttggacactttcctgtcgattccatccgatcaacgggacgagatcatcaaagctttgaatgaggacgtgaacaagctgctgtccgagatggaccccaacgatcccttggccaagcggcttaaggacgagctgcggatgacgaacgaacatttctacgatttgttggcacgcgctcagaaagagccggagcccgactactccaaccagttcgatgctgcatgtgccgagttggtgcgcaagttcgaggagggctggaagcagctgaaccaccgggtgcaggaacgagtggccaccaacttggaggagttggaacgccaaatcaaagagcacaaggcattcgaagatgcactgcagacgcttgacgtggacgtgtcgaatgtgaaggaactgtaccgccagctgccccacccaacgcccacccagcgtgcagcgcacgacaacatggtgcagcgctggcaagacatttgggagctgtcgcgcatgtacgtggagcggctgaaggggcttgaatcggtgttgaacgggttggacgaagtgacggacattgtgcgacgccatgagatcacgctggcctcctttgacgacatgccggccgcgctggagcgcctgcgcggcgtgcacgcccagctgctggagctgaatatggtactgcaacagcaggaaaacatcgtcaagaagctgaaccgggacactgcaacgctgcgccaacatgttgcgcgcacgcgtttcggcgctgcaaaccatccggtgctaccagttaagccgtgccgggtttcgggattcggcctgcttagttccgacccctgagatcgatctcctccgtccaccgacggattgttggactgggccgtagcccccgcggaaaggctccgtcccatcggtcggctttgggggagggccagtagtgggagtgatgactggggaattgactgactgactggcctcgacggctgggagagccatcgcttaaaaggggaatcccggtgggcgttccaatggggaggtgcctctccccttcaatcccaatcggtagccgagacccgagtcccgacttacacctccaccccagggcaggaaccgtccctg

SEQ ID NO: 543 - DNA, 1485 bp, Heterodera glycines
  genomic DNA sequence=SeqID_504; coding sequence=SeqID_785
aatttgactttgatcgatttgcccggactgaccaaagttccggtgggcgatcagccgcccgacattgagcagcaaatccgtgacatgatcggcacgtacatttcccgcgaaacttgcctcgttttggccgttacaccggccaacagcgacttggccacttcggacgcgcttaaattggcccgggaagtggaccctcagggcctccgcaccatcggagtactgaccaagttggacttgatggacgaaggcactgacgcgcgggacatcctcgagaacaaagtgttcccactcagacggggttatgtcggcgtgatcaatcgttctcagaaggacatcgtcggccgcaaggacatccgccaggcgctggacgccgagcggaaattttttctgtcacaccaacaataccggcacatggcggacagattgggcacgccgtacctgcaaaaggcactgaaccaacagctgaccaatcacatcaaagacacactgcccacgctgagggacaacctgcagaagaagctgtactccatggagaaggaggtggccgagtacaaaaacttccaattcaacgacccgtcgcgcaaaactaaggcactgatgcagatggtccagcagttcaccaccgacatggagcggtccattgagggttcttccgccaaaatggtcagcaccaacgaactctccggcggtgctcgcatcaatcggctcttccacgagcgtttccccttcgaaatcgtgaaaatgaccatcgacgagaaggaaatgcgccgtgagattcaattcgccattcgcaacatccacggcattcgggtcggtctgttcacccccgacatggcattcgaagcgatcgtgaagaagcaaatcgaacggctgaaggagccggcgcttaaatgcgtcgatttggtggtcaatgagttggccaacgtcgtgcgacagtgcgcggtgtgcgtcaaccgatacccacgactgcgcgactgtgtggagcaaattgtgaccaatttcatgcggcagcaggaaatgttcaccaaacagcacatttccatgctggtcgactacgaattggcatatatgaacacaaaccacgaggacttcatcggcttttccaatgccgaggcaaaggcgtcgtccacgaacacgaagaaaaacctgggcaaccaagtgatccgcaagggatggctctccgtgcacaacatcagttttgttcgcggttctcgcgagtgttggttcgtcctaacatcggacagtctttcgtggtacaaagacgacgaggagaaggagaagaagtacatgctcccactggacggcatcaaactgaaggacctcgaggccggcttcatgtcccggcagcacaaatttgcacttttctacccggacggaaagaacatttacaaagactacaaagaattggagctgagtgctaaaaacttggacgaagtggacgcatggaaggccagctttctccgtgccggagtttatcctgagaag

SEQ ID NO: 544 - DNA, 3021 bp, Heterodera glycines
  genomic DNA sequence=SeqID_505; coding sequence=SeqID_786
tatgcgcttggacattccgccatggaacacttgcgcaaggcgtcggttctcgtcagtggcctcggctccgtgggcgtggaggtggcgaagaatctgatccttggcggtgttcgctcggtgactcttcacgacacaaaagcgttggcgttcagagatttgtcggcgcatttctacgccaaggaaagcgacgtgggaacgaaccgtgccaaagtttgcttcgacaaattggcggagctcaacgacactgtgaactgtgcattgtctgtggaaaatctgtcggaggatttcgtcaaacaattcgacttggtcgttctcaccgacgcgtccttttccactcagacggaagtgaacggttggatgcgcaaccatcgcaaaatgttcatctcggcagacgcgcgcggacttttctcttatgcatttgtggacttgggcgacgaattcgttgtgaacgattccgacggggagacgtgcaaagaggtgctcgttgagtacatcgactgcgaaagcggcgacatgacgacactcgaaggcgcatttcaccagttggaggacggggaccacgttgtgttcaccgactttgagcacgccgaactgaacgaacttccaccagtgccagtcactttgaagggaagcaaagtcttcaacattggaaatgctctcgcggccttttctggcgcagttcaaggccccgtttcgcgtggacgtgttcagcaagtcaaagtgcccaagaaaatgtccttcaagccattgtctcgcgcactcgccgagcccgactttatgatttgggactttgccaagttcgacgaacctgcacaacttcacgccctttggcaggctttgtacagttttgaggagatgaaaaactacagccctttgccccgttccgatgccgacgcaaaattgttaaaggaaatgctgccaaaagatgcgcccgaaatgccggactcactgctcttcaacttctcttaccaggcgtgcggaaatctccaacccatcgcttcgctcatcggcggtttggtggcccaagaggcgatgaaggcagtgacgcaccacacgacgcccctcaagcagtttctgtacaccgattctcttgaggcgttgccgggcgccgattcgacctttgacgccgccaagttggagaagaacgattgtgcaccgcgcaacaatcgctacgacggacaggcggccgttttcgggtgggcctttcaggaggcgctgcagcaacagaaatggttcattgttggcgccggagcgattggctgtgagctgctgaagaacatggcgatgatgggcttgggctgtggcaacagtggctcgctgaccatcaccgaccccgacaccatcgaagtgtccaatttgaaccgccagtttctgtttcgtcgtcctgatgttgggaaaaagaagtccgaagtcgccgcccgttccgtcaaagcgtttaactcgaccattcacatcaatccgatgtctgagatcgtcgccgagtcgaccgagcacatcttcggcgacgacttcttcgcccgtctgaacggcgtctgtaatgcgctggacaatgtcgaagcacgccgttacgttgaccgccgctgcgtgtactatcagcttccgctgctcgagtccggcacaatgggcgcaaagggcaacacgcaagtggtcttcccgcacttgacggagtcttacggctccacgtccgacccgcccgagaaggagacgcccatctgcacgctgcgcaatttcccctaccaaatccatcacaccattcaatgggcgcgagctaagttcaccgactatttcacttcggttgcggagacggtcaaccaatacttggacaatgtgaacgactttttgcaccgagtgaaccaaatgactttttctcagcggatcgaagtgctcagtacgcttgagcgtgcgttggtcgtcgaatacccgaaaaatgcggaagaatgtgtgagttgggcccgtgaactgttcgacacgctttaccacaacgacattgcccaaatgctgcacaatttcccttccagcatgcttactgcccaaggcgacaaattttggagtggaaccaaacgctgtccgcacactttgaacttcgacgttaacaaccctgaacacttcgagttcgtcttctccgcttccattttgcgtgcccaatcttacagtttggctccgatcactgagcgcaaaaaagtggcacaattggccatggcgtactgctccaaaccgttcagaccacaagagggagtgcgcatcgctgtgaccgacgcggaggcgactgccaatgatggcaacacagcaaatggcgatggagacgaaactgtacttcggctgaacgatctgaacgtgaaattggccaggctgaacttggagaacattcgccgcatgacgcccattgactttgagaaggacgacgactccaaccaccacgtcgacttcgtgacgagtgcctccaatttgcgagccgataattacgacatcgaaaaggctgatcggatgaaaacaaaacaaattgcgggcaaaatcatcccggcgttggccaccacaactgcgctcgtctcagggctcgtctgcatcgaactctacaaaaccattgaggcggatggaaggcgctcgacggctcagatcgaacacatcaaaaatgcatttatcaacttggctacgcctttcattgcgttcagcgagccgggcaaagcgcagaagaagaagtacctcgacattgacttcactctttgggaccgtttcgaagttgacggaccgatgacattggggcaactgattgattgggttgaggtgagtaagagtggcctcaccgtttcaatgatttcttccggcgtctcccttttgtatgcgttctttcagcccgcagaaaaagttgccgagcgcaagaacatggatcttattgcggttttcgaggaagtgtctcgtggcaaagtgccggaccatcgccgagcgatcgttcttgaggcgttgacccagaatgaggaaaacgaagacgttgatatcccattcattaaatataatttccgttaa

SEQ ID NO: 545 - DNA, 1014 bp, Heterodera glycines
  genomic DNA sequence=SeqID_506; coding sequence=SeqID_787
atggagtgcatgagaatgttgattgtccgtctccgtggtgagtttgagaaacgcgtccgtttcctccgtccgtccgatgaaactgtccattccgtgccggatgacgacgacactttggaggagccgccccgactgccccagggcaatcgccgtcggttgggcgtgtcggcggaggtgccggacgaaaatgaggcggccaattaccagcgagtggtcatcccgaaagacgacgacgtgcaaaaggctttgcgagcggcgatgtgcaaaaatgtgctgtttgcgcatttggacttggacgaggaaaaggccattttcgacgccatgtttccggtggagaaacacctcggggagacaatcattgagcagggtgaagagggcgacaatttttatgtgattgacagtggcgaggtcgatgtgttcgtcaatggcgagttcgtgttgagcattaaggagggaggttcatttggcgagttggcactgatttatggcactccgcgcgcagccaccgtagtcgcgaagacgaacacggtcaaactgtgggccatcgaccgcatcacttaccgcgccattcttatggggtcgacgatgcgaaagcggaaaatgtacgacgaattcctgagcaaagttcagattcttgccgacttagacaaatgggaaagggccaatgtggcggatgcgttggaacagtgccaattcccctcgggcacccacgtggtggagcagggacatcctggggacgaattcttcatcattgtggagggcgaagctgaggtgctgcagagaccgaacgacgacgcgcccttcgaagtggtcggaaaattgggaccctctgactatttcggggaaatcgccctccttctcgatcgccctcgtgccgccaccgtcgtggccaaaactctgctgaaatgtctgaaattggaccgggcacgatttgagcgcgtgatgggtccggtgcgtgagattctcaagcgcgacgtgtccaattacaattcgtacgtgaagctgatgacttga

SEQ ID NO: 546 - DNA, 2325 bp, Heterodera glycines
  genomic DNA sequence=SeqID_507; coding sequence=SeqID_807
aaacaaaccaatttaagaaaagaagaaaccagcaatgagaagaaaaaggggaaaaaagctgaggaagttatgccgaaaaagtcaaaggaatcgacctcaaaaagtcgaaaaaagaacgaaagcagcggagaggaagaagactttgacgacgactccgacggggaagaggaggaatatcagccaaaggtaaggcgaagagaaggaaaacggatgaaaaaggatgacatacttcagaaaaagaaacaaaagtcggacccatccccggcgaagaaaagcgacagcaaaaagtcaacgaaaacaacaaaagttaccaaggtggaggtcaaggaagagagcggcgctggggttgagcacaagaaacggaagacaacgaaagttgaagtgaaggaagaggtcagtcggaagaagccctcctcttcccagggaagtccgtccaagaaacgtgtgaagaaacaggaggaagaagaggaagtgtggcgctggtgggaggaggacgagtcgaacgcgggcgcctccgatgggtccatcaaatggcaaacgcttgtccacaaagggcccgtctttgcaccggcctatgtgccattgccaaaacacatcaagttcaaatacgacggaaaggagatggatttgtctttgccggccgaagaagtggcttccttttacgcgaaaatgctcgaccacgactacacgtcaaaaccggtgttcaaccagaactttttcaaggattgggtcaaagtgatgacaaaggcggagcgagccgaaattaaagatttggccaaatgcgattttaggcaaatgcacgctttttacgtgtcggagtcggagaagcgcaaagcgcgcagcaaagaggagaaaaaggcggagaaagaggagaaggaaggcgaggcaaaggtgtacgggttcgccatgttggacggatacaaacagaaaattggcaacttccgaatagaaccgccgggactattcagggggagaggtgaccatccaaagatgggttctctgaagaaacgggtccagccggaggatgtggtcatcaactgctcaagaggactgaagattatgccgccggaggggcacaaatggaaggaaatccgtcatgataacactgtcacttggctgtgttcatggaccgaaaatgtgttgggcagcaacaagtacataatgctgaatccgtccagcaaactcaaaggccaaaaggattgggagaagtttgagaaggcgagaaagttaaaaggacatgtcggtcaaatccgccagcagtacctcgccgactttaagtctaaggaaatgcgtatccgtcagcgtgccgtggcactatattttatcgacaaattggcacttcgtgcgggcaatgaaaaagacaccgacgaagcggccgacacggtcggttgttgctcgttgcgttgtgagcacatcaaattgcacgatgatatggacgacctgaagtatgttgttgaattcgacttcctcggcaaagactccatccgctattacaaccgtgtgccggtggaaaagcaagtgttcaaaaatctgaagctttttatggaggagaaagacccgggggacgatttgttcgaccgattggatacgagttcgttgaaccaatacctgaaggaactgatggacggactgaccgcgaaagtgtttcgtacgtataacgcgtcgatcactctccaagaacagctggacaaactgacaaatccttccgattccgtccacgagaaaatgctttcctacaatcgtgcaaatcgtcaggtggccatcctttgtaaccatcaaagggcagtgccaaaaacgcacgaaaagtcgatggaaaatttggagaataaaataaaagagaagaagcaggagtacaaggagttgaaggatcagctgaagaagagcaaatcggtggacgagaaaatggcaaaaaaatacgaaagattgaaggaacagatcgccaaactgaacacacagcgcacggacaaggatgaaaacaaacaaattgcactgggaacctcaaaactgaactacttggatccgaggatttcggttgcatggtgcaaaaagaatgacgtgcccgttgagaaaatattcagcaaaacgcaacgcgacaaattccgctgggctctcgacatggcgaaggaggacttcattttttgacacttcctcgcaaccctttccgatttcccttaacccccttttactcgctgttccttccttttggagagtgcccctttcctctcaatcactcttctgctggacctaaactagtagttgtttatatcttgtcatgcctattgtttgtgtgagcgttttcttatgcctgatgattggttcgtattt

SEQ ID NO: 547 - DNA, 2013 bp, Heterodera glycines
  genomic DNA sequence=SeqID_508; coding sequence=SeqID_811
gtgccatttgttgcagtgcttttggcactcgccacacccggcacatttggcgcgtttgaatgtgccaatcatgaaacagcaacatttgttcgcatttcacgtgcccgtctggacggcacgccattggttgtttccacggctggccatgacctgacctgctcgcaatactgccggaacaacatcgaacccacgaccggtgctcagaggctgtgcgcatcttttaactttgacggacgcgagacgtgctacttttttgacgatgccgcaagcccggccggcactgccgacctgaacccaaacccatccgcaaacaatttctactacgagaagacctgcttgccgggcgtgaacgcgcacgaggcgtgcacctaccgctccttttcatttgaacgcatgcgcaaaacgtcgctggacggctttgtgcggaaaagtattcaggtgccttcccgggagcagtgcttgagcgcatgccttctggaaaaagaattcgtgtgccgttccgtcaactacaattatgactcatacgcgtgtgagatgagcacggaggaccgccgctcgaagcccacccatttgcggatgaccaaccagccggtggattactatgacaacaactgcttgaacagacaaaatcgctgcggtcagcagggcggcaaccttgtgttcgtcaagaccacccagttcgagatcaagttctatgaccacactcagtctgttgagccacaagagtccaactgtctgcagaagtgcctggactcgctgaacaccttctgtcgctcggtggaattctcgcccaacgagaaaaactgcattgtcagcgacgaggacacattctcgcgcgctgatcaacaagtggcggtgcacagcaaagactattacgagcccatttgtgtggcggccgatctgagctcgtccacgtgccgtcaacaggcggcattcaaccgcttcatcggcgtgtccattgagggccaaccggtggccagcgcccagggcgtcaccgtgtctgactgcatttcgctgtgcttccaaaatttgaactgcaaatcgatcaattacgaccgcacacagagcacgtgccacatttatgcggtgggccaagcgacggcgaacatcaaaaagaatccgtcctacgacttctacgagttcaactgcgagtcccagtttgggggcatggcactgtgcaccaatgacggcatccgcttcattgtgaacaccaaagagccgtacacgggtgccatttatgcggcggagaagttcagcacgtgctcccaagtggtcgagaatgcaaagcaaatttccatcacattcccgccgccaaatgtgtcgccggcatgtggcactacaattaaggacggcaaattggaggcgttggtggtcgtctcgttggacggagtgttgccgcaccaggtcaccacggagtgggaccgcttctaccgcgtgtcatgcgacgtgaacatggacaaacccggctttgagggcacagtgatcgtaaccaccatattcgagacaaaggaggccgagccccaagtgctgagcgccggcacaccgccgccgatcactgcgcaactgtcgttcctcgacaaggacaaccaaccgctggagaaggcatccatcggtgatcagctgcacttggtggtgaacagcgagcaggccgggccccacaatatgatggtcaccgaatgtgtggccactcgggtgggcggcgaaggcgagccagtgccattcaccatcatcgacaacggctgtccccgctaccctgccctggttggcccggtggagcaagactttgacaagaatcgactcaaggccgagatgaaggcgttccgtttggacggctcctacgacatacaaattgtgtgcaccgtcatgttctgtgccggacccaacggatgtccgccgagcaactgcttggactcgggcaccaacgaactgttcatgtcccatggacgacgaaagcggcgcaacattggtggccaacaactgttggcacaacagcaacaacatgagcagcaaacg

SEQ ID NO: 548 - DNA, 1483 bp, Heterodera glycines
  genomic DNA sequence=SeqID_509; coding sequence=SeqID_813
atgaccatttctgcgaccgctgacgttgacaagctccaggatgcggccaaccgaatgcgcatttcgtccattgagcagacgtgcgccgccaactcgggccacccgaccagcagttgcagcgcagcggaaattgtggccactctgttctttgccgaaatgcgttatgacgtgaaggacccgcgcagcgcatccgccgaccgtttcattctgtccaagggtcacgcttgcccaattctgtacgccgcttgggaagaggcgggcctgctcagccgtgaccaagtgctctccctgcgcaagattgactccgacattgaaggacatccgaccccgcggctcaacttcatcgacgtggccaccggctcgctgggccagggtctgtcatgcgctgccggcatggcgtacactggcaaatatgtggaccattcgtcctaccgcgtgtactgtttgatgggcgacggagagagtgcggaaggctccgtgtgggaggcagcagcatttgcaagtttctacaagttggacaatctggtggccattgtggacgttaaccgacttggacaaagtcaggagacccaactgcagcacgacattgaagcgtatgtgcaacggtttgccgcgttcggttggaatgccatcggattggaggacggacacgacatctcggcacttttgaatgcttacgccaatgccaagaacgtgactggcaaacccacggcaatcatcgccaaaacgctcaagggcaagggcattgacggcgttgccgacctgaacaaccagcacgggaagccggtgtcgaaggacaaggcggagcccatccgggcattgctcaaaagtgacaagccggcaaattggaccatcccggcaccgattcgggacgcaccggcggtcgacttaggcatcggtgccatcgcaatgagtgcaccgccgcagtacaaaatgggcgaaaaggtggccactcgacaggcgtacggaaacgccttgctgaagctggcggaggccaacaaacgcgtcattgccttagacggtgacatctccaactccaccttctccaacctggtgcaaaagaagctacccgagcagtttgtccagtgttacattgctgagcagaacatggtcggtgttggagttggcatggcgtgccgtgggcgtgtgcttccgcatgtcagcacttttgccgccttcttcacccgtgccggtgaccaaattcgcatgggcgccgtgtccttcacaaatgtcaaattcaccggctctcactgcggcgtttccatcggcgaggacggtcccagtcaaatggccctcgaggacttggcgctgttcagcgctttgcccgccagtgtcgtcctctacccatccgacgcggtgtcggccgaacgtgcgactgagttggccgccaattacacgggcatcacttacacgcgcgtctctcgacccgccaccccagtgctctacacaagtgacgagaagttcgagctgggcaagtgcaagg

SEQ ID NO: 549 - DNA, 776 bp, Heterodera glycines
  genomic DNA sequence=SeqID_510; coding sequence=SeqID_814
aatgatgggagggaagcgaaagaaaaaggggaaaaaagcggaactgagcgagaaaaggaagcggttattgcgaattgggagccgagtccgttggtgccgctttactcggaaagggaacaaaacgacccgaattatcggccccgttcaattgaagggcgaatgggcaaatttgttgtcatcgatgacaaacgatgcgtcaatttggcgtcgactgattttttcggctttatcggaaaccagaaaattgaagaagtagccaaaaatgccattttcaaatacggcgtgggctcatgcgggcccaggaatttctacggaacggtggacgtacatttggacttggaaagggaattggctgagttcatgggctgtgaagaggccattctgtacagctacggattccccaccatcgcaagtgccatcccagcttattcaaggaggggcgatgtcatttttgcggacaaaggtgttaatttcgccatacaatccggactgatggcgtcgagaagtgacattttatggtttgaacacaatgacatggcggacttggagcgcaaaatggtcgagttggaggagaaagacaaaatgaatccgaaaaggaaagcgtccattcgccgtttgatcgttgtcgaaggaatttacacaaattcgggcgacatttgcccactgcccaaactgatcgagctgaaatggcgacacaaagtgcgcattttcatcgacgagtccttctctttcggagtgttgggaaagcacggaaaaggtggggaattccatttcaa

SEQ ID NO: 550 - DNA, 2697 bp, Heterodera glycines
  genomic DNA sequence=SeqID_511; coding sequence=SeqID_790
cttttgtcggaatgccctgcgggcgattcgcctgttttcctcctccaccacaacacttccgtcgcctccggcactgtccctctccgatcggcgcccgtccccggagggtttctcgaatgtaccgaactttgttccgtcgcaagacaatgccaattggtcggtccgaagtcggcatctgaaggtgccgtggcagaatttggtgaagaaatggcgacacggacggtgacgaagaattgtgtgaagagtgagcgcatctgttcctcgcctttccatttcgacgttcatgaacaaaagattttggtgggtttcgcgcgtgaggtggtctccgccgactcagtccaccgctgtctgtccgcttgtctgaatgcgttcgatacgttcggcttcgaatgcgagtcggtcatgtattaccctgtggacgcggaatgcattttgaacacggaggaccgattggatcggcctgaccttttcgtggacgagcacgaggacacggtcatctacttggacaacaattgcgccggatgtgagtgccattggcattttgacaatttcaaaacaagcggcattttgaacgaccaacaattcgcaattgcagcacaatgttacgcaccgtacgtaacgcaatacgtggcggtggaaggacgccaattgtcggacgaattggaccacagttttgaagggttggagctgagcgaatgtgaagagttgtgcacgcaacggttaagtgttacggcaaacgacttcaactgcaaatcgttcatgtacagtaacttgacgcgcagttgcgttttgtcggacgaacgctcgcgccctttgggccgtgccaatttggccgaagtgccgggatggacttatttcgagaagaaatgctttgcctccccgcgtacgtgccgcggcgttccgtcgtttacgcgagtgccgcaaatgcttttggtgggctttgcctcttttgtgatggaaaatgtgccgtcagtgacaatgtgtttggaccaatgcacaaaccctcctcctgagacgggacaaaactttgtgtgtaaatcggtgatgtattattacaacgagcaagaatgcattttgaacgcggagtcgcgccattctaagccggacctgttcattcctgaggaggacgactttgtggtcgactatttcgacataaactgtcgcttggagtcggaacagtgcagcgccggagagggggcgcgaagtccgaaaatcgtgcggacattaaatgcagcactgcccgaaggggacggtgccattcacgtagtggaaacggtgcaggcgaatgtgcgcgaatgtgcccaaaaatgtgccgctcactctcccgacaaatgccgttccttcaacttcgacaaatcgtccggcatttgcaatttgctttatttggacggccgcggttcgctgcgccccgagccgaagggacaggtcgatctttatgacctccactgtttggagacatcgcccgagggccaatcaatgggatgcgtcgaccccgagggggccgcgttcagtcgccatttgtattcccaatgggtcgggggcgaactgagcaaagaattgcattctgtgcctctctccaaatgtttgaatttgtgtgccggtgccggacattgtgaaggacttaattacaatcggcgaaatggcacatgcgcagtgatcggacaattgggcacagtgtcgggggcgatgcagaagagtgaacaagtggacttttatcggaatgtttgtgcactgaaagaagtccaatcggaggaatcaagcgcagcgaatgtgccaaaaagcaaaagggatatgggatgaggagaaatgaaagggatcaaatcaaaaattgggaaattaatgtaaaaaaaggaaaaaaaggcattggtgagcggcacttctgaaggaaaaggcgcaaaagaggacaaaaaagttggaccgcccatccaaatccccggcagcgaagtgcacacgatttgcaattacgagggcataagtgttcagataaaacacagcgaacccttctcgggagtgatgttcgtcaagaacaaatacgacacgtgccgagttgaggtggggacagaaaacagcgtcactttagtgctcggacttcctgcaaactttggcatgaaaccgatcactttgacctccccggaaggcaaaggttcttttggaaaccgcgaaaaacagtgttcaaaaaaggctttcgcaagttttgctataatgttcagacaacgtcgccaatcgcagagggattgtggcctcgtggacatggacaacggcacgtacaaaacggtggtggtcgttcagaccaacaatttgggcatccccggcctcgtcacttcgatggaccaactttacgaaatttcctgcaattattcgagcatgttgggaggcaaagtgaccgctgcagccaatttgacgctgcaggggccgcagccgtcgctgatccaaccgcgcggaaagatcgaactgggcaacccggtgctaatgcaaatgatgccgatgagagaagctaattgaaatgtgccacaggcaaagttgggcgatattttggaacttcgctgggaattgatggccatggacgacgaattggactttttggtgaaggattgttacgcggagccgggaattgtgccgccaaagggcgcatcggcgcctaagttggccatggaaaagcttcaactcgtccagggagggtctgttgggacggctttt

SEQ ID NO: 551 - DNA, 1024 bp, Heterodera glycines
  genomic DNA sequence=SeqID_512; coding sequence=SeqID_800
aggcatttgttcactttaatattttgccatgtcttttcttgtcacattagccggctatttgacaattgccatttttctccagaaactcttccgctctctgtacaatgtggttttcccctatttgttcgctgttcctcagaatatcaaggtgctcgcgggtgccgagtgggcagtggtcaccggcagcactgacggcattggcaaggcatacgcgctcgagttggccaagaaaaacttcaacgtggtgctcatctcacgctccatggacaaactgaacgcagtggcggaggaaatcaaacagaaatatcccaatgtggaagtgaagtgcatctcattcgacttcaccaacgcaaacctgaaggactacgagcagacaattttctcccaactttccaacattgaagttggaatgctcgtgaacaatgtcgggatgagctacgagtaccccgagcgattggaccgtattgagggcggactgcaacgcgtctccgacattaccgtgatcaacaccctgcccactacggtactctccgcttttgtgctcaaacagatgagggaacggggacgcggcgtcgtcgtcaatttggcctcctcggcagcgtatttcaattggttttacctggccgcttattccgcgtcgaagaaatacgtgtgttggttgtcctccattctgcgcatggaatacgccgacaccgacattgtcatccaaacggtgtgcccgatgatggtggccaccaaaatggccaagattcgcaaggcttccttcttcacgcccagccccgaggaatttgccgcccaagcgctccgcagcattggtttggttgacgagaccaccggctgtttgtcccaccaaattcaggccgagctgatgttcggctacgtccccgccccgttgctgaacaaattcgtgcgcgacaactcactgcagacgcgcaagcgcgccctgaagaaggaagcgacggtggcgaagagtgaatgatgagaaaaaagaaagaaaagtgatgcgaaatattgacattcattg

SEQ ID NO: 552 - DNA, 952 bp, Heterodera glycines
  genomic DNA sequence=SeqID_513; coding sequence=SeqID_804
aattatgtcatttcggtcagcagcggcattagggcttaacttgcgtaaagcatccaaatttgtgttgttcggcgcattggccaccggtggcagtgtgttgctgtactcgttggagaatagcggtgcgcgtgcctacgactttgttgtgcacccgagccatttgccatggtcccacggcggactgatggacgcaattgacatgcgatcggttcgtcgcggttaccaagtgtacaagcaagtgtgtgccgcatgccattccttgaaattcatccgttacaaccattttgtcgacaatttcatgacacgggatgaggcgaagacggaggctgccgaggcactgatcccggacttggacgataatggtgtggaaattcttcgtcccgggctgctcaacgacacgttgccaagcccctacaaaaacaacaaagctgccgcggcggcgaacagtggcgcattgccacccgatttgtcactgattatgtgggcccgggaaggggccgaggactacgtgttccatctgttgaccgggttttttgatgcaccggcgggcattgacgtggaggagggcaaggcgttcaacccgtacttccccaacggctgtgtgttggccatgccgcaacaactgtttgacgaaggcattgactatgaggatggcacaccggcaacaatgtcgcaacaggccaaggacatttgcaccttcttgcgctgggccggcgaacaatggcacgacacgcgcaaacgctgggcatggaagttgatcacgctgttgccactgctcacgtttgtgctactgtacgccaagcgcaatgtgtgggcactgatgaagacggagaaggtgatcttccggcgactgcccggccgcgggtggacgcccgagtcgtcggcgccaaagccgcccaaggacgagccggagctgaaggtgatcgagccgccgcagaagccggtcgtctga

SEQ ID NO: 553 - DNA, 1322 bp, Heterodera glycines
  genomic DNA sequence=SeqID_514; coding sequence=SeqID_806
gaatcccaatatggctttgtttacggcgtttcgggaccggtggtaactgctgagaaaatgtccggtgctgcaatgtacgaactcgtcagagtcggccattctgaattggtgggcgaaatcatccgattggaaggcgactacgccacgattcaagtctacgaggagacttcgtccgtcacaatcggtgaccccgtgctgcggacggggcagcctttgtctgttgagcttggcccgggcattatgggctccatttttgacggaatacaacggccattgcacgacatttcagaaatgaccaaatccatttacattccgaagggggtcaatgtgaaggcattaaaccgtgcaaaacgatgggaatttatgccgaggaaagatttgcgagttggggaccacgtgacgggcggagatatcatcggaatggtgcacgaaagtgcgttggtcaagcacaaaattatggtggagccgaaggcgtgcggaacggtcaaattcatcgccccgcaaggccaatacaccgtcgaagacaccattttggaagtcgaattcgctggacacacccaaaagcttacgatgatgcacatttggccagtcagaaacccccgcccgtccgccgaaaaattagcggccaatttccctctcctctgtgggcagcgcgtgttggacgcgctcttcccgtgtgtccagggcggcacaacggcaattcctggtgcctttggctgtggtaaaactgtcatttcgcagtcgttgtccaaatattccaactccgatgccattatttacgtgggctgtggcgagcgtggcaacgaaatgtcggaagtgttgcgcgactttcccgaactgacgatggaagtggatggagtgaccacgtccatcatggagaggacggcgctggtggccaacacttcgaatatgcccgtggcggcgcgtgaagcgtccatttacacgggaattactctggccgaatacttccgcgacatgggtctgaacgtggccatgatggccgactcgacctcccgatgggccgaggcgctccgtgagatttcgggccgtctcggggaaatgccggctgactcgggttaccccgcctatttggccgcacggctcgcttccttctacgaaagggcgggaaaagtgaaatgttttgggtcgcctgaacgcgaagggtccgtcactattgtcggcgcagtgtcgccgcccggcggagacttcgccgaccccgtcacatcggcaaccctcggcattgtccaagtgttttggggactcgacaaaaaattggcccaacgaaagcacttcccttcaatcaattggctcatttcttacag

SEQ ID NO: 554 - DNA, 2036 bp, Heterodera glycines
  genomic DNA sequence=SeqID_515; coding sequence=SeqID_812
ccagctaaagctaatgcaattggtattgacctcggcacgacgtattcgtgtgttggagtcttccagcacggaaaggtggagatcatcgcgaacgaccaaggcaaccgcaccacgccgtcctatgtcgcgttcaccgacaccgaacgtttgatcggcgatgcggccaagaaccaggtggcgatgaacccatccaacaccgtgttcgacgccaaacgtctcatcggacgcaagttcgacgacccggcggtgcagtcggacatgaagcactggccgttcaaagtggtgcagggagagggtgctcgtccgaaagtgatggtggaagtcaaaggcgaggacaaagcgttcttccctgaggaggtttcgtccatggtgcttatcaagatgaaggagacggccgaggccttccttggccagactgtcacggatgcggtggtcacagtgcccgcttacttcaacgactcgcagcgtcaggccaccaaggacgcggggaccatcgccgggctgaacgtgttgcgcatcatcaacgagccgacagccgccgcgattgcctacggcttggacaagaaggggcagggtgagcgccatgtgctcattttcgacttgggcggtggcactttcgacgtgtccatccttaccatcgaggacggcatcttcgaggtgaaatcgaccgccggtgacactcatctcggtggcgaggacttcgacaatcgaatggtcaaccactttgtcgcggagttcaagcgcaagcacaagaaggacctcagttcgaaccctcgtgcgttgcgtcgtttgcgtacggcctgcgagcgcgccaagcgcactctgtccggttccacccaggccagcatcgaaattgactctctcttcgacggcatcgacttctacaccaacatcacgcgcgcccgcttcgaggagctttgcgccgaccttttccgcaacaccatggaccctgtggagaaggctttgcgcgacgcgaagatggacaagtcccagatccacgacattgtgttggtcggcggctcgactcgaattccgaaggtgcagaagcttctctccgactttttctccggcaaggagctgaacaaaagcatcaacccggacgaggcggtggcctacggagcggctgtccaggcggccattctttccggcgacaagtcggaaactgttcaggacttgctgctgcttgacgttgcccctctctccctgggcattgaaacggccggcggcgtgatgacttcactcatcaagcgcaacacgaccattccgacaaagacgtcgcagacattcaccacctattcggacaatcagcctggtgtgctgattcaggtctacgaaggcgagcgcgcgatgaccaaggacaacaacctgctgggcaagttcgagctcagcggcattccgccggcgccacgaggagtgcctcaaatcgaagtcactttcgacatcgacgccaacggcattttgaacgtgtcggcccaggacaagtctaccgggaaacagaacaagatcaccatcaccaacgacaaaggccgcctttccaaggaggaaattgagcgcatggtgcaggaggcggagaagttttccaaggaggacgaggtgcagcgtgaccgtgtgtctgccaagaacgccttggagtcctactgcttcaacatcaagcagacaatggaggactcaaatctgaaggacaagatcagcgaggacgacaagaagaaggtgctggagaagtgcggtgaggtgctggcatggctcgacgccaaccaggcggcagagaaggaggaatttgagcaccagcagaaggaactcgaagggatctgtaatcccatcatcaccaagctctaccaagccggcggcgcaatgcccggcggtccaatgcctggcggagggatgcccggaggtggcggcgctgctggtgcgggaggagccggtggaccgaccatcgaggaagtggactaagcgagtcgatctcttcgcgatcatttttttgtttgatcgattatttaattttatttttttctcgcgtaaattgtttgacatataaa

SEQ ID NO: 555 - DNA, 450 bp, Heterodera glycines
  genomic DNA sequence=SeqID_516; coding sequence=SeqID_819
ataatggtcggctcaggcggcgtaggcaaatcggcactgacacttcagtttttgtacgacgagtttgtggagaattacgaaccgaccaaagcagatgctcacagaaagcaagttgtgttggacggggaatattgtgcggtcgacattttggacacggcgggacaggaggactattcggcgataagggacaattactatcggtcgggagaaggtttcatctgcgtcttctccatcaccgatttggattcctttgatcaactcgtcgaatttcgggagcaaattttgcgtgtcaaaaatgccgacccaaatgtttgcattttgttagtcggtaacaagtctgatttggacgcggaaaggaaagtgcctttggagcaagcgcaacaacgtgccgaactttggggctgtcctttcgtggagacttcggcaaaaacacgcgaaaatgtggacaag

SEQ ID NO: 556 - DNA, 461 bp, Heterodera glycines
  genomic DNA sequence=SeqID_517; coding sequence=SeqID_822
gcctaccctttggcggatattcaactttctcagaagttgcttgatcttgttcagcaggcaacgaactatcatcaattgaaaaagggtgctaatgaggcaaccaaaacactgaaccgaggcattgctgaggtgatcattttggcagctgatgcagaaccattggaaatcattttgcatttgccattgttgtgcgaagacaaaaacgtcccatatgtattcgtgaaaagcaaggctgcacttgggcgtgcatgcggtgtgactcggccggtgatcgcaacttcgatcattcaaaatgaaggatctcagttgaagtctcagattcagaagattaaagaagatgtggaaaagttacttatttgattaaaaatttgcaagcttatcactgttttgttattccatcttgttttgttgtttcatgatttgttcgacgacaattaaaatgactctgaaagcaaaaaaaa

SEQ ID NO: 557 - DNA, 486 bp, Heterodera glycines
  genomic DNA sequence=SeqID_518; coding sequence=SeqID_826
ggcgagttcggcctgcgcaacaagcgtgaggtgtggcgtgtcaagctatcgttggccaaaattcggaagcgtgcccgtgagctgttgacgctggaggacaaggacccgaaacggttgtttgagggcaacgcgctgttgcgtcgtttggtccgcatcggtgtgctggaggaggacaagatgaagctggattatgtgctcggcttgcgcgtcgaggacttcatggagcgtcggctgcaaacccaagtgttcaagctgggcttggccaagtccattcaccaggcccgtgtgttcatccgtcagcgccacattcgtgtccgtcgtcaagtggtcaacatcccatcatttgttgtccgtctcgactcccaaaagcacattgatctgtccgcaaagtcgccgtacgctggcggtcggccgggccgtgtcaagcgaaagaatgcgaaaaaaggtgccggaggcggcggctcgggtggcgaggaggaggactga

SEQ ID NO: 558 - DNA, 1685 bp, Heterodera glycines
  genomic DNA sequence=SeqID_542; coding sequence=SeqID_788
tattgtgagctgttgaaaatgatggagtcggagtaccaacagttacgcgaactgtctgccgggcgcatggtcgatttggactcgctgatcgccttcatccgtgctgctcagcttgaattgctttggatccatcagcgtgaggaattggaagtgacacgcaactggagcgcctggacattccgatgctgcaaaactacttcaagcagctgctccatgagattgagctgcacgagaagcagttcaacgacgtgcacaaccagggcgccgcgctgatcaaccaacgccacccggcgggcgaagtgatcgaggtgtacctgcgcaccatgcagaaccaatgggattggatgctgaacctgagcaagtgcctggagggccacctgcgcgacgcgtacaatgccaaggcatttgtggaggagtcggagcaggtggagcagcagatgcagcaacagttggaccatcttgatcgtgaatattctcgtactgatttttcgctggacgatggtgaacagatgttgcgacagcttgactctgtccgtgaatacatccaacaattgcatgcgcgactcatttcactgaccgacaggtgtgcccaaatttcaccgctttggcaacgtggcgaacgcatttcaaaaccgctgccggtgatggcactttgcgagtacaagagcaaggacaaaattcacatcagacaaggggatgagtgcactctgttggacaaccatgaccaaattcagtggcgagtgcgcggtatggacggcgttgaggcttccgtcccatcggtggtgttccgcattcctccgcctgacccgcgattggcctcgttcctcagccgactgcacaaccaattcgagaagttgcgcaaactgtgggatcgcacccatcatttggtccgttacaacatggtgctgaacacaatgcgcacagtgcgtgcatgggacttggacactttcctgtcgattccatccgatcaacgggacgagatcatcaaagctttgaatgaggacgtgaacaagctgctgtccgagatggaccccaacgatcccttggccaagcggcttaaggacgagctgcggatgacgaacgaacatttctacgatttgttggcacgcgctcagaaagagccggagcccgactactccaaccagttcgatgctgcatgtgccgagttggtgcgcaagttcgaggagggctggaagcagctgaaccaccgggtgcaggaacgagtggccaccaacttggaggagttggaacgccaaatcaaagagcacaaggcattcgaagatgcactgcagacgcttgacgtggacgtgtcgaatgtgaaggaactgtaccgccagctgccccacccaacgcccacccagcgtgcagcgcacgacaacatggtgcagcgctggcaagacatttgggagctgtcgcgcatgtacgtggagcggctgaaggggcttgaatcggtgttgaacgggttggacgaagtgacggacattgtgcgacgccatgagatcacgctggcctcctttgacgacatgccggccgcgctggagcgcctgcgcggcgtgcacgcccagctgctggagctgaatatggtactgcaacagcaggaaaacatcgtcaagaagctgaaccgggacactgcaacgctgcgccaacatgttgcgcgcacgcgtttcggcgctgcaaaccatccg

SEQ ID NO: 559 - DNA, 1618 bp, Heterodera glycines
  genomic DNA sequence=SeqID_519; coding sequence=SeqID_789
agaaatggttacggaacagaatggcgctacttttgctgttgacgttgaggaaattgcggctgggcatcacgttacgcctgtggacatgacaacagctaccagcaaacttcagcttgaggctgccgaagtgcgaaatccggcgaataaaccgaattggtcatcgtatttgcgctctcaattggtgcctcaaaatgagtacaatttcattattgaattggaaaaggccaaaaacaagcaggagagggacgaagcgttagccaaggacaagacgaattcggcacggagtattatcaatttgatcaccgaagttgcgaaggatcagctgatccgttacgttctcacccttttcgacgaccttttgcaggaggacaaatcccgggtagagattttccatgattatgcaagacggcaaaaacgaactatttggtcgtggttccaagggattttaacgcgaaatgacagtttcattgtcaaccaaatgtctgcaatattctcaaaattggcttgctatggctctgtgcttatggatggacaagaactgcaagcttatttcaatttccttcaacaggaaataaaaaactcggttagcaacgaatacataaatacatcagttcgatgtctacaaatgatgttacgaaaggaaaagtatcgacgaaaattcgttgagtatgacggcgttaaaagcattcttttggcattgaatggtcgtgccaattttcaacttcaataccaactcattttttgcctttggtgccttaccttcgacagtaacatcgctcaatttgtccagggattgggcattatccaaccgttgggcgatattctctccgaatgctcaaaggaaaaagtgattcgtatcattctcgcgaccttccgaaatttgttggagaaaattgacaatagagagatggtgcgcgaatcggcactgcaaatggtccaatgcaaaacgctgaaaacccttgaattgatggacgccaaaaagtttgacgacccggacttggtggacgacattgaatttctgtctgaacgtcttcacgcctcggtgcaggatttgagttcgtttgacgaatactgtgccgaggtccgatcgggcagactccagtggagtccggtgcataaattggagaaattctggcgcgaaaatgcacaacgcttcaatgaaaagaactttgaattgataaaaatactcatcaaaattctcgagaccagcagcgacccattgccgctcagtgttgctgctcatgacattggcgaatacgtccggcattaccatcgcggaaaaacaattgtcgaacaataccaaggcaaacaagcagtgatgaagttgttgagtgcagaggacccaaacgttcggtaccacgctttgttagcaatccaaaagttaatggtgcacaattgggaatatcttggcaagcaaattgaaggactcgaaggggcaaaaggcgctgcgggggaagaagcaaaggaagtgaaaacgcgaacctaacaatagtggaaccaatttcactgtactttttacacagctgtagtcagacattgtaaattttggcatcatttacgatttaagcattcgccggttcgttaattaatttgtcgtgttgtgattttctgtactttt

SEQ ID NO: 560 - DNA, 1046 bp, Heterodera glycines
  genomic DNA sequence=SeqID_520; coding sequence=SeqID_794
tacaatggagcgtttattgcgattgggaggccttagtggtttgggagcaggttcattgaacgcaacaccacacgattcgaaccaagttgacacttcggaaactgtttacatcagttcattggctttattaaaaatgctaaaacatggacgagctggcgtcccgatggaggttatgggtttaatgctaggtgaatttgttgatgattatacggttaacgtgattgatgtctttgcaatgccgcagtctgggacgggagtttctgttgaggccgtcgatccagtctttcaggctaaaatgttggatatgcttaaacaaactggaaggcctgagatggttgttggttggtaccattctcacccgggatttggttgttggctttctggggtcgatataaacactcagcagagttttgaggcgttgtctgacagagcagttgctgttgtagttgacccaattcaatctgtgaagggaaaggttgtcatcgatgcttttcgcacaattaacccacaggcaattgcactaaaccaagaacctcgtcagacaacgagcaacatcggccatttgcaaaagccttcaattcaagcccttatccacgggctaaatcgccattattattccattccaattgcttatcgtacaaacgagaatgagcaacagatgttgcttaacctcaacaaacaaagttggatggactctatgaatttggtaaattacaacgagcattgtacacgaactgagaaggctgttgagcatatgctaaagcttgcaaagctttacaagaaatcattggaagaagaagagaaaatgaccgaagaacaattggctatcaaaaatgttggaaagcaagacccgaagcggcatttaggagagactgtgagccagcttttggccgataatttggtgcagggattggctgcaatgcttgatgtttctgctttccagtaaatgaattgtgttgatgaccagagactgtttaattgtatctgtttatgcattatatgattcataaaatgtgtccttttaactaaatccaattttttacgcg

SEQ ID NO: 561 - DNA, 708 bp, Heterodera glycines
  genomic DNA sequence=SeqID_521; coding sequence=SeqID_796
ttttagcaaataaactatggagcgttatgatcgtgcaattacgattttttctccggatggcagactttttcaagttgactatgcgcaagaagcagtgaagaagggctcaacagcggttgccgtgaaaggaaaaaattgtgttgtaattggagtcgaaaaaaaatctatcccgactctgcaagacgaacgtaccattcgtaaaatacatgcattggattcgcatgtgatggtcgcattcgccggactcagcgccgatgcacgcgtccttatcgaccgtgctcgagttgaatgcgaaaattacaaattgacgcttgaggaccgcgtatctgtcatgcatatctctcgcatcatagctgatataaaacagagatacactcaaaccactggccgtcggccttttggaatttcaatgcttgtcggaggcttcgattctgatgggacccctcatcttttcaagacggaaccgtccggagtttactacgaattgttggccggttcaatagggcgaaatgaaaagattgtgaaggagtatctggagaaagaatacggcaacgacaacacagctgatgaggagtctacgcttaaactgatgctcaagtctttagccccagtggtccaatcgggggcgcagaatatcgaaattgcggtgctcaaatgggtggatggcaccaatggggagcctgggtattgtgagcagcaaattttaaa

SEQ ID NO: 562 - DNA, 1302 bp, Heterodera glycines
  genomic DNA sequence=SeqID_522; coding sequence=SeqID_798
tatcgctacgaaaatgagcaccgcgacttgcgccgcgtgatgggcgttggcattgcgatcactcgaggggcggctgcggcattgtctgttgatctggcattaattttgctgaccgtgtgccgaaatctgctgacaatgcttcgcgagacatttgttggcgaatatttaccgctcgactcggcaattactttccacaaaattgtggccatcaccgccggcactttcgctgccattcacacaattggacattgcgtcaacttttaccatgtggccacccaaagtcaggagggcatcgcgtgcctctttcaggaagcggtgttcggctccaactttttgccatccatctcatattggttcttcggcacattgaccggaatcaccggcattttgcttgtcgctgtcatgtccataatttacgttttctctgcgcctgctgtgatgaagcgagcctatcatgcatttcgcataacgcatctgctcaatgtgttactgtatgctcttaccatactccacgggcttcccaaactgttggactcacccaaattttggtacattgtgcttggcccggtgattatttttattattgatcgtattattggcatgcgcaaacactacaaacagttgagaatcgttgatgccgccattttaccatcagatatcatctacatccaattcaagcgtcctcattcgttcaaatttcgttctggccaatgggtgcgcatctcgtgccccgccttctcctgcactttcaacgagtcccatgctttttcattggcatccgcgccacaatcgccaactcttgagttattcattaaggcggtcggcccatggacatggaatttgcgcaacgaactcagcgaggccaaggacaacgcattgccttacccggtggtcaacctcagcgggccgttcggggacggcaaccaagaatggcacaaccaggaggtcgttgtgtttgttggtggtggcattggcataacgccgtacgcctccacgctgatggatttggtgttggagagggcgtcgggcaaccatagtggcataaagtgccgaaaggtttatttcctgtggatttgtccgacgcataagaattttgaatggtttgtcgacgtgctgaagcaagtggaacggcatgaccaggacggcatccttgagatacacatttttgtcacacaattcttccataaatttgatcttcgaacaactgtattgtatatctgcgaaaagcacttccgcggtgacaacagcggcatcagcatgttcaccggtctgcgtgccaccaaccatgactctagaggatcc

SEQ ID NO: 563 - DNA, 1105 bp, Heterodera glycines
  genomic DNA sequence=SeqID_336; coding sequence=SeqID_803
gccggtttcgcgggcgatgacgcgccccgcgcggtgtttccgtccattgtgggccgcccccgtcatcagggcgtcatggtcggcatgggacagaaggactcgtacgtgggagacgaggcgcagtccaagcgtggtattctgacgctgaagtacccgattgagcacggcatcgtcaccaactgggacgacatggagaagatctggcaccacaccttctacaacgagctgcgtgtcgcccccgaggagcacccggtgctgctcacagaggccccgctgaacccgaaggccaacagagaaaagatgacccaaatcatgttcgagacgttcaacacgccggccatgtacgtggccatccaggccgtgctgtccctgtacgcctccggccgtaccaccggtctcgtgttggactccggcgatggtgtcacccacaccgtgcccatctacgagggttacgccctgccccacgccatcctccgtttggacttggccggccgtgacctcactgactacctgatgaagatcctcactgagcgtggttactccttcgtgaccacggccgagcgtgagatcgtccgtgacatcaaagagaagttgtgctacgtggcactcgacttcgagcaggaaatggccactgccgcctcctcctcctcgctggagaagagctacgaactgcccgacggccaagtgatcaccgtcggcaacgagcgcttccgttgccccgaggcgctgttccagccgtccttcatcggcatggagtcggccggcatccacgagtccacctacaactcgatcatgaagtgcgacatcgacatccgtaaggacctgtacgccaacaatgtgctgtccggcggcaccaccatgtacccgggcattgctgaccgcatgcagaaggagatgaccgcgctggccccgtccaccatgaagatcaaaatcatcgctcccccggagcgcaagtactccgtctggatcggcggctccatcctcgcctccctgtccaccttccaacagatgtggatcagcaagcaggagtacgacgagtcgggcccgtccattgtccaccgcaagtgcttctgagcagcagctgcacgaccgcacggaggaggag

SEQ ID NO: 564 - DNA, 1351 bp, Heterodera glycines
  genomic DNA sequence=SeqID_523; coding sequence=SeqID_805
cccaatgagacggatgacaaaaccaaagaaataaaattttcagcgcttgacgaggatgaaattgccgcacttagtaattacaacatgggaccgtacgcggatcagttgaagcaggcggagaaggacattgatgaaattcagaagcgcataaacactctttgcggagtgaaagagagcgacacggggctggcgccgcccattctttgggacattgcggccgacaaaatggccatgtcccatgagcagccgctgcaggtggctcgctgcacaaaaatcatcaaagaagagggcaaagaaacgcgttacatgatcaatgtgaagcagttcgccaagttcgtcgtggacctgcacgaaaatgtggcgcccactgacattgaggagggaatgcgagtgggggtggaccgcaacaaataccagattcatttgcctttgccggcaaagattgacgcgtccgttacgatgatgcaagtggaggacaagccggacgttacctacgcggacattggcgggtgcgaagaacagatcaaaaagttgcgtgaagtggtcgagtttccgttgcttcagcctgagcgtttcacgagtttgggcattgagcctccgaagggcgttttgttttttggtccgccgggcaccggcaaaactttgtgtgcccgcgcggtcgccaatcggacggacgcgtgtttcatccgcgtcatcggttccgaattagtcaaaaaatacgttggcgaaggcgcgcgcatggtgcgcgagctgttttcgctggctaaaacgaaaaaggcgtgcattctcttcttcgacgaagtcgacgccatcggcggagcgcgatttgacgacggaaaagggggcgacaacgaagtgcaacggacgatgctcgagttggtcaaccaactggacggattcgactcacgcggggccatcaaggttttgatggccaccaacagaccggacacactcgacccggcgctcattcgtcccggtcgcattgaccgacgcattgaattttccttgcctgacctcaaggcacgaggaaacattctccaaattcacaccaaacggatgagcgtcgaccggaacattcggtacgaattgattgctcgactctgtccaaacacgacgggtgccgacttgcgcagcgtttgcactgaggcgggaatgttcgctttgcgtgcacgtcgaaaggtcataacggagcaagactttctcaaggctgttcagaaagtggtgaaaagctacgccaagttcagttcaacgccggcgtatatgacgcacaactgacaatacagttcttacaaaacggacttttttatatttgtgcacttttgtttcattacaatataaatgaggaaaccaa

SEQ ID NO: 565 - DNA, 1387 bp, Heterodera glycines
  genomic DNA sequence=SeqID_524; coding sequence=SeqID_816
accaagcagaaggagtacgatttgcagcagaagcaattggaggctcgaattgcggccatgcaatcggagaatgtgcgcgttgcggaggaagaaaggcgcaaaacgttaattgaggagacaaaacatgcgcgcgcaagagccgactaccaggaccaattggcacggaagcgacaagaggaggagatgagcatgaaggcacgaatgcaggaagaaacattgcgcaggcaggaggagtcggtgaagaagcaggaggcactcagaaaggcgaccattgagcatgagctgtcgctacggcacaaatacgacttggaacgcattgacgcggacgtgcgcgccaaggcgcgtgccgcacgcgacaaccgtgacgtgaacctggagatgatgcgtgcgagtgaggaggagcgacgcaagacggtcacggaacagattcggacaaccgccggcgttgtgggcgctggactgtccgagtttctctccgatcgctccaaaattatggcggcagtcggtggtctgactgtgctggcggtcggttggtacagtgccaagcgtggcactggcgttgtggccaaacaggtggaagcacggcttggtaagccgtccctggtgcgtgaaacgtcccgcctcacactgttcgagctgttcaaacatccaattgcgagtgtgcggacactgttccgtgcccgcgaggacccgctgaagggcattgtgctcaatccaagcctcgagtcgcgtctgcgtgacattgcgatcaccacgaggaacacaaagcgtaactttggactgttccgcaatgtgttgttctacggaccgccaggcacggggaagacaatgttcgccaagagtttggctcgccattcgggtctcgactacgccataatgaccggcggtgacgtggcaccgatgggccgtgacggagtgtccgcaattcataaaatttttgactgggcccaaacgtcgcgcaaaggtttggtgctctttgtggacgaagcggacgcttttctgcgcaagcgaagcacggaacagatcagcgaggacatgcgcgccatgctcaacgcgttcctcttcagaaccggggaacagtcgaggaagttcatgttggtagtggccagcaaccagccggagcagttcgactgggctgtcaacgatcgtctggacgaacttgtcgaatttggactgcccggtgagctggagcgtgaacgtctactgctccagtacttcaagcagtacattgccgacccggccacctccggggcacggacccaacgcctgaagctgggcgactttgactggctgtccaaaatgaagcaaatcgcctcgctgactgccggcatgtcgggccgtgagctgtccaaattggtgtttggctggcaagtgagtgggtgggcat

SEQ ID NO: 566 - DNA, 2587 bp, Heterodera glycines
  genomic DNA sequence=SeqID_503; coding sequence=SeqID_823
atggcaaatgttgttgaaatgacaattgagaaaattgatgaagtcaaatcaagactaggaaggacattgggtgcgtcgatgcgcttgcgtgatttgattcgtcaagtccgagcggcacgaacagcggccgaggaacgggcagtggtggagaaagaaagtgcaaacatcagagattccttcagggacgacgacaacaaatacaaatgcaggaatatggctaaacttctctatattcacatgcttggttatcctgcacatttcggacaagttgaatgtgttaaattggtgggcagcaaggataaacgattcactgacgttcgaattggttatttgggcgccatgcttttgttggatgagcgttccgaaattcatttacttgttacaaattgcttaaagggccatttaaatgatccggaacaattcgtcgccggtttggctttatgtactcttggctcaatttgttcggcggaaatgtgtcgagatttggcaagcgaagttgagaagcttttattgaagtcgactaacacctacctcaagaaaaaggccgctctgtgtgcgtttcgtatcgtccgaaaggtccccgaccttattgaaatgtttatctccagcacacgctcattgctcaacgaaaaacaccacggtgtactaatggcgggcattacactcgtctcggaaatgtgcgatttgagtgccgatgtacgcattcacttcaaaaagatggtgcctaatttggtgcgcatactcaaaaacttgctgatgaatgagtattctgctgagcatgacgtcgctggtataagtgacccatttttgcaggtcaaaattctcaggctattgaggattttgggcagagatgacccacgggtcagtgaagagatgaatgacattttggcacaggtggcgacgaatacggaaacgacgaaaaatgttggcaatgccattttatatgaaacagtattgactataatggaaacaaaaagtgaaagcggcttgcgagttttggccgtgaacattttgggtcgttttttgcttaacaccgacaaaaacattcgatatgttgcacttaacactctgctcaaaactgttgcaattgatttccaagcagtgcaaaggcatcgcaccactgtggtggaatgtctgaaggatgccgacatttccatcaaaaagagggctcttgaactttgctttgcccttatgaaccaaacgaacatcgcgagcatgtccaaggagattataattttcctcgaaactgccgactccgatttcaaagctgagtgttcttctaaaatgtacgttgcgacggagcgcttctccccgagtcttgtttggcatttggacacaatgataaacgtgctgcaattggcagctaaccatgtacctgatgaagttgtcagtgcgatgattcagctcatctcttcccagcaggaactgcagcattacgcaaccgtccaattgtttcatgcctccaaacgggaacacatagtaaatgctcagcccttaatgcaaatcgcattttggagcattggcgaattcggtgatttgcttgtcactccgggaaatacggaggaggcaaatgtgagcgaggatgaagtggtggaattgttcgaacttttgatgcctcatccacagctcactgtgccaacccgtgagtatggactaactgcacttgccaaacttagcacgcgattcgactcgcacgccgaacaaattcatgcgttaatacgacaatattcggcacacatgaatttggagctgcaacaacgttccgttgaattctcacgattactgtcaaaggatgaactgaggaatgggctgctggagcgaatgcccgccattgaacacaatgcccttcacaccgcagcgacgccaattgaaatggacgataatcaccaggaattaatagtggcgcaaaaagaacaccaaagccaaaaaccgaaggccgatgaaattgacttgctcgggttgggcaatacggattctcctgctttggttgacattctcttcggcggggttccaaatgtgcagcccctttcaagaaatattggcaaagaccccatcgacgacctttttagttttgagtccagtaataaaaacggtgcccttgtggaagatgatcagttgaaaacgggtcaaatcgtgctcaaccagcgtggtatcgagatgcaattattcgtggattccaacggattcgactccaatggattggcacaattgcggtttcaaacagttaacaatacccccgctggagtagaagatttcaatttggcagtggccgttacaaaagcttatcaaattgaattgcttccggcgaattcgacgagtcttcaggccaatgctttgtccacgataagccaaaaggcgaatttgcggcggctggcaaattcgaaagcgcctcgtctacgactcagaatcagttatcggttggcgggtgccttgaatacaattgacgctgaagtgacgagcatcgcctgcctcgcctcctaacaacagtcccttcccactctaatgatctgtgacattccatttgttcattctgtcattagtccacttttaattaatttatagtaacaatgtaaatcattctttgtaa

SEQ ID NO: 567 - DNA, 4394 bp, Heterodera glycines
  genomic DNA sequence=SeqID_502; coding sequence=SeqID_824
caatatccacagacagtcaatctcacattgcacatgcacaaacgttacgatattacgtatattcggttgaaatttgccagtcctcgtcctgagagtttcgtcgtttacaaaaagaacagagccgaagacgactggattccctggcaatattatagcgggtcctgccgttccactttcaaattgcaagacaaagcgccgattctgccgggaaatgaagcggttgcgcaatgcacacgtgagttctctgacatttctccactgactggaggcgatattgccttctccacgctcgacggacgcccttctgctgagaattttgaggagagcgaagtgctccaggaatgggtggctgcagaacaaatacgcatttcattggttcgaatgaacacatttggtgacgaaatattcggagacagtcgtgtgcttcgctcgtattattacggaatttccgactttgcggttggcggacgatgcaaatgcaatggtcacgccaaccaatgcgtgaagtccacaggacggggagaggaacaattggtgtgcgactgtcagcacaacaccgccggcgtggactgtcagcagtgcgcccccttcttcgtggatagaccgtggcgacccgccacctccatggaagccaacgaatgcctcccctgcaattgcaacggtctctccaatcggtgttacttcgacgccaaacttttcgagaacacgggccatggtggccattgcattgactgtgctggcaacactcagggcccccattgtgaacactgtcttcccgaccattggcgtcgccagagcgaacattattgtcgtccgtgtcagtgcgatgagatcggttccgccgacactcaatgcgacgagaagggccaatgtcgctgtaagccgggggtcggcggccaattctgcgatcgttgcgaacatggattctacgactttggtgccacaggatgcaaagattgtcgttgtgatgcaaatggctccttcaacaacaccccgacttgttcctcctcctccggatcgtgtgtttgcaaagagaatgttgagggtcagcgctgtgataagtgcaagcccagcttcttcctgttgtcctcctccaaccctttcggctgttctccgtgtttctgtttcggccattcgtccgtttgttcggcggccgaaggatattttgctgtgaatgtgtcttcacagttttttgatagcactgaagactggtcgggcggatcagaacgacaattggaggacgtccaatgggcccaagtcgatcgcgcggccgctgtttctcaattagacgattatcctgtgtatttttttgctccgtcacaatttttgggagatcagcgacacatttataacaatttcattgactttcatctccgcgttcagcttccaaaccccggcccaagcaaaaaggacattgtcattgtcggtgccaatggacaagagttggtgttgccaatcttcgcccagggcaatccgttgcctgccgttcgcgagcaacgctttcgtttccgcgtgcatttccatccttcgcttcagtggagtccatctctccgcgagacggatttcatcgccgtcctctccaatgtgagcgcctttaaaattcgtggcactttctccaaaggcgatgtcggttacctgtataatttcaccgtcaattcggctgcttctgtgcccaacgtcgacttggccgagcctgccaattgggttgagcagtgcaaatgccccgacgcattcgtcggccaattttgcgaatcgtgtgcccccggctataagcgcacgcttcattttggcggtccgctagccaaatgcattccctgcgaatgtcacggccattccgacagctgcgattccgaatcaggctcgtgcatttgccaacacaacaccgccggcgaaacatgcgaacgatgtgcgcgagggttttatggcgatgcgctgacggggacagctgatgactgcaaaaaatgcgactgtcctgagaacggcccgtgtattttgatgggcgatggggatacgttatgcacggaatgtccagagggatacgcaggacgaaaatgcgacatttgtgcggaagagtcattcgggaatccggccgagggcattccctgtcagaaatgcgactgcaacagcaataccgacccaaatgcgattggaaagtgcgacacgatcagtggagagtgcaaacggtgcatttatcacacgacggggtggcgatgtgacaaatgcatggccggattttggggggacgcgctatcggaagtgaaaggagactgcaggtcgtgtaactgctatacccaaggcactttgaggccgggtcaggactttgaggcgcttgaatgtcgtcagacggatgggcagtgttcgtgccaaccaaacgtgattggccttcgttgtgatcaatgtgcccccggcttctttaatatttcctccggaaatgggtgccatcagtgtggttgtgaccctttgggcagtttggatgggggcgtgtgtgatttgattaccggccaatgccaatgcaaaaagggggtgaccggcagacgctgtgatcagtgcgcaacgcggcatttcggcttcggcccggaagggtgcttggaatgcggctgcgatccgaccggctctgagactttggaatgcgacgttgccagtgggcagtgtttgtgccgacagaatgtggaaggccgtcgctgtgaccaatgttccgaaaatcgtttcaatttgcgcggtggttgtcccgcatgtgacgactgttacgcactgatccaatcgcgcaaaaatgagctcaacggaactatgagtgaattgcgcgaaaacctggacgagatcatcaataacccgatcaaagtggacgatcgcgaatttgacgcgcatgtgcaaaaagtgcgagtggaggtcgagtcactgcatgaaagagcactgaaaaaaatgggggacgactcgcacattcgcgaccaggcaatttccatgagggcgcaacttgcagaagcggacactttggtgctgggacttcgcgacagactccagcaaatcgacacgaatgctgcggtgattgaacagcaattgggacagtttagcacggacaaggaaaccacccataaagagctgtctgttggagtgaattatgtgcaaacacaaggagaacagcacttggcaaaagcgcaggaggcgttcgaccgttacggggaaaagagtcagcaattgtcggagatcgctggcgaatccaagcagttgtctgatacgcaggagcagcgtcgccgggagatcctttcgttggctgagcaaattcggaaggagtcgcggcaatcgctcagcgacgccaacgaagcaatttttggagcttcaagcaccagtctgcaaatttctgctttgttgaccgaggtccacgagttggaacagcgactgaaagccatccaacaaatggcgacggaacagtccctcgagacaaaccaaacacacgacggggccgccttcattctgagcggagtggacagtatccgtctgccgaacgttttttctgatgagttgatggagaaagtcaaaagggcacaggaagagggtttggaagcgctgtctaaaacacggtcggaggcggaaaagcaagcggaattggtagaaaaagtggataaattagtggaggaagcgtgcgaacagttgcgaaatgcgcaacagaagcaaatgagtgtggacaattcctttgacgaagccgagtcttttaatgcgcgcacccaaacggctttcgaattggccacgaagacgtggaacgatgcgaaggattcgcacgacgcgctttccgactttcatagtaaaatcgaacaaagccgcgcggaagcgaccgaggaaatgaccaatttggcggatatcgaaaaggaaatcgaagaggcgcaggcgatgacaaaggaagccgaagatgcggtcggagacgcgagtcaaaatgcaaaagaagcggcggaagtggcggaggaggccaaaatgaaagcgcagaatttggccatggaagcggccaatttaacagacgccactgaacaaacgatggctggggccacagaaacgaaaagtgcgctggacactctcagcagcgaattggactccgttttgaccacaacaaaggattttgagaaccaagcaatttccgacgcggaacgttccaacgaagtcgcgaaaaaagcgactctctccgaagcgactgcaaattcactgcaggaaaagctgagtgactcggacacaaaacttacggaagcattggcccaactcagttccttagacaatgtggacgatgcgcaattggacaccgtggagaaactgctgaaagaagcggaaaatcgtttcgattcgagcggcaacgaagtgaaaatgcgagaacggatcatacaagcggagaccaaagcggtgaagcagaagag

SEQ ID NO: 568 - DNA, 2684 bp, Heterodera glycines
  genomic DNA sequence=SeqID_337; coding sequence=SeqID_795
atggtgaactttaccgttgatgaaattcgtgcccttatggatcggaaaaaaaacatccgaaatatgtcggtcattgcccacgttgaccatggcaaatcgacacttaccgactcgctggtgtccaaagctggcattatcgctggtgcaaaggctggtgagacgcgcttcactgacacacgcaaggacgagcaggaacgttgcatcaccatcaaatctactgccatttcgatgttctttgaactcgaacgcaaagacttggagttcgtcaaaggcgaaagccaagcagacattgagcaggtcgacgggaagagccaaaagtacaacggtttcttgatcaatctgatcgactcgcctggccacgtggacttctccagcgaagttactgctgcgttgcgcgtcactgacggtgctttggtggtggtcgactgtgtgtcaggtgtttgcgtgcaaactgagacggtgttgcgtcaagcaattgccgagcgtatcaaaccggtgttgttcatgaacaagatggaccgtgcgctgctcgaacttcagcttggccaggaggaattgttccagacattccagcgcattgtggagaacatcaacgtgatcattgccacttacggagatgatgatggaccgatgggtccgatccaagtggacccgtccattggcaatgtcggctttggctctggacttcatggttgggctttcacattgaagcagtttgcggagatgtacgctgacaagtttggagtccagattgacaaattgatgaaaaatctgtggggcgatcgcttcttcaacatgaagaccaagaaatggaccaacaaccaagagcccgagaccaagcgaggcttctgccaatttgtgttggacccgatcttcaaagtgttcgacgctgtgatgaacatcaaaaaggacgaagtggcgaagttggtggagaagctgaacatcaaactgaccttggaagagaaggaacaggagggcaagccattgctgaaaacgatgatgcgcaaatggttgccagccggtgacactatgcttcagatgattgtcatgcatttgccatcgccagtcacggcgcaaagataccgcatggaaatgctatacgaagggccgcatgacgacgaggcggcggttgcaatgaaaaactgcgaccccaacgggccactgatgatgtacatctcgaagatggtgccaacctctgacaaagggcgcttctacgctttcggtcgcgtgtttgcgggcagagtcgccactgggatgaaagcgcgtatccaagggccaaattatgtggtcggcaaaaaggaggacctctacgagaagaccatccaacgcacaattctaatgatgggccgttacattgaaccgattgaggacattccggccggaaacattgccggactggtcggcgttgatcagtacctggtcaagggtgggaccatcaccacctacaaagacgcacacaacatgcgcgtgatgaaattctccgtgtcgcccgttgtccgtgtggcggtcgagccaaagaatgcgggcgatttgcccaagctggtcgaaggattgaagcgtttggccaagtcggacccgatggtccaatgcattttcgaggagtccggtgaacacatcattgccggcgcgggcgaactgcacttggagatctgcttgaaggacttggaggaggaccatgcttgcattccgctcaagaagtctgatccggtggtgtcctaccgtgagacggtcaccgaagaatccgaaattgtgtgcctgtccaaatcgcccaacaaacacaaccgtctgttctgcaaagctaggccgttgcctgatggactgccggaagccattgaacgcggcgacgtcaacccgacggacgacccgaaaaatcgtgccaaaatactcaccgagaaattcgaaatggacgcgaccgactcgcgcaaaatttggtgtttcggaccagagggcactggtgccaatttgctgattgacgtgacaaagggtgtgcagtacttgaacgaaattaaggattcggtagtggccggcttccaatgggcaaccaaggagggcgtgctctgcgatgagaacatgcgcggtgttcgtttcgacatccacgacgtcacactgcacgccgatgccattcaccgtggcggtggtcaaatcattccgacggcgcgtcgtgttttctacgcttcggtgttgacggcaaaacctcgtctgcttgagcctgtctatctcgtggagatccaatgtcccgaagcggctgttggtggcatttacggagtgctgaaccgtcgccgtggtgtcgtctttgaggagagtcaaattgccggcacaccgatgttcattgtcaaggcacatttgcccgtcaacgaatcattcggattcactgctgatttgcgttccaacactggtggtcaagcatttccgcaatgtgtgttcgaccattggcaagttcttcccggcgatccgtttgatggcacttctcgtcctggtcaagtggtcactgagacgcgaaaacgaaagggattgaaggagggcattccatcgcttgacaatttctatgacaaattgtaatacgtggatttaaattatggtggtgtttttgtttgttggctgacacaatacacttgttgtccttttattttgaaatcattgtgggtcgtatgtaattttatcctgttgttaaaaaatttaatgtt

SEQ ID NO: 569 - DNA, 912 bp, Heterodera glycines
  genomic DNA sequence=SeqID_525; coding sequence=SeqID_797
agtgaattttcgacttatctataaatgtttctgacccgcagcgaatacgacaggggagtgaacactttttccccggagggccgtctgttccaagtggaatatgccatcgaaactgtcaagcttggttccacaagcatcggaattcacaccaaagaaggcgttcttttggctgcggaaaggcgttcaatgagcaaattggtggtggacgactcaatgagcaaaatttcggaagttgagaagcacattgccgtcgcctcggccggtctcatcgcagattcacgcacttgggtcgaacacgcgcgggtggaggctcaacacttttggtttacttacggtggcaaaattcgggtggaagacattactcaaaaggtctcaagattggcactgcattttggggacgacgactcaactatcagtctcggccgtccgtttggagtttctatgctttttgccggcattgatcacacgggtgcgcatctcttccatttggacccgtccgggacgtacattaaatgtttggccaaggccatcggtgccggctccgatgcagcggaacaaacgctgcaagagcactgtaaaaactgcgacaaaaaaatggaaatggccgaggcaaaacaagtcgcactgaacacactcaaacagctgatggaagagaaaatcaattccaaaaatgtggaaattgttatgattaagccgcagacggacaaggaaggcaaaacgttgggcaaaattgtgtggttagaggaatcggagttgcaagaaatcatttcgcgattgtagtcgaaggggacggatgagagaaggaaaatgggctttgcactgccccttttatgattggatgaccttttgttattctctgcctttttgtgactttttcagtgtataaggcaaatgaaagcaattaattgagaa

SEQ ID NO: 570 - DNA, 768 bp, Heterodera glycines
  genomic DNA sequence=SeqID_526; coding sequence=SeqID_802
tgcataaatgaaccaagaacaagacaatatcccaactttcaagcttgtgttggttggtgacggtggtaccggaaagaccacttttgtgaaacgccatttgactggagaattcgagaagaaatatatcgctacgcttggtgttgaggtccatcccctcacttttcacacttcgcgaggtcaaatccgattcaacgtttgggacacagccggccaggagaagtttggtggacttcgtgatgggtattatatccaaggccaatgtgctattgtcatgttcgacgtgaccgccagagtcacatacaaaaatgtgccgaattggcaccgcgatttggtccgagtttgtgagaacatcccaattgtgctggtggggaacaaagtggatgtcaaagataggaaagtcaaggcgaaaagcatcacttttcaccgcaagaaaaatctccagtattacgacatttccgcaaagagcaactacaatttcgagaagcccttcctttatctggcacgaaagctgatcggcgaccccaacctcgaattcgtggcgatgccggcactcgctccgcccgaagtacaaatggatcccgctttggctgccaaatacgagcaagaagtggccgaggcagcaagcgctgaactcccggacgatgatgaggacatttgaagagatggaaggacggctgggacagattcctgggacagcaatttccgagcagacaaagttatgtccattgttttaactgattgtttgatgagtaaaggaaagcgaatgaa

SEQ ID NO: 571 - DNA, 1623 bp, Heterodera glycines
  genomic DNA sequence=SeqID_527; coding sequence=SeqID_815
atgtccccttctctttccgttgccaactcaaatgtctctcgaccgcttggccaaccaaaagtagcgggcttcaaagataaggataagccggaaagtgttcgtactagcaacattgtggcagcaaaggctgttgcggatgcggtgcggacgagtcttgggcctcggggaatggacaaaatgatccaatcgggcaacggagaagtgacaattaccaacgatggggcgactattctcaaccaaatgtcggttgtgcatcccaccgcaaaaatgttggtcgagctgtccaaggcgcaggacattgaggcgggcgatggtaccaccactgttgtggtgttggccgggtctttgttggacgctgcagaaaaacttcttgccaaaggaattcatccgaccaccatttccgactcattccaacgggcggccacattttctgaaaaagttctcgaggaaatggccacacccattgacattaacgatgacgacgagttggtgaagctcgccatgacgagtttgaactcgaaggtcgtttcgcaatattcccatcttttggcaccaatggcggtgcaggcagtgaagaaactgatgagttcaccggaggactcaagtgtcaatctgaagttgattaaagtcgttaaaaagttgggcgaaacggtggaggagtcgcagctcattgagggggcgctgatcgatcagaaatcgatgggccacggaggccccgcgcgggtggagaaggcgaagattggcctcatccaattccaaatctcaccaccaaagcccaacatggaaaatcaagtggtcatctctgactatgctcaaatggaccgtgcgctgaaggaagaacgaaattacattttggaactgtgcaagcaaatcaaaaaggccgggtgcaatgtgctgctaatccaaaagtccattttacgcgatgccatcaacgaaatggcgctgcattttttcgcaaaaatgaaaattatggtgatcaaagacatcgagcgggatgacatcgaattctatgccaaaatcctcgggtgtcgcccggtggcatccgttgaccattttgtcccggaatcgctcggaacggccgatttggtggaggaaattgagacggctgatgggaaagtcctcaaagtgaccggccttaaacagagtgggtgcgctgtgtccattttggttcgcggctccagcaaattggtgttggacgaagccgagcgctctctgcacgacgcattgtgcgttattcgctgtttggtgaagaaacgcgcccttctgcccggcggcggtgcccccgaaatggaagtgtccgtccgcgtccgcgcagctgctcagacaaaacacggagccgaacagtattgctggaaggcatttgcggacgcactcgaagtggtgccatacactttggcagaaaacgcgggactgtcgcccatcgaaacagtgacggagatgcgcagtcagcacgcaatgggaaacaaagagcacggagtgaatgtgcgaatgggtgcaattacggacattcgcgaagaaaatgtggtgcagcctcttttggtcagttcgttcgccgtcaaacaggcagccgaatgtgtgcgcagcattctcaaaatcgacgacattgttctgtcagtgcgttaa

SEQ ID NO: 572 - DNA, 1614 bp, Heterodera glycines
  genomic DNA sequence=SeqID_528; coding sequence=SeqID_817
gcgtattttgtaatggccgctgataattttgacgctcaacgtattttgaacattttggccgagagagacaatttccaaagtaatgaactcgccgatcagttggccattgaccaccagcgactgatcggtgccatcaaaagtctgcaggtcaaagaagggttggtttgcacttcggaagtcaaaatcaaacgcatcgaattgaccacggaaggcgaggaaattatccaaaagggctcccacgagttcaatgtgtacaaaatcgtcggagaaaagggcatttccaaatcagaaattgaaaaaacatcctttggtcccatcggattgggcaaggccatgcaatgcgggtgggtgggcatggacacacgcgacggagtgcctttggtggtgcggaaggtggcaaatgccgaggacggggccaaggagcaattgaaattggtgaagaacggaaagggcgaccaattgacggcccaatgcgtggcccaactgaaaaagcgcaaatggataatggaaagcgcaattaaagccctttccgttgccaaagggccgaacttcacgacgactgtgcagaagcaggaattggatttgacttcggagatgattgcctcgggttcgtggcgtggcaagcagttcaaacagtacaatttctccgcgatgggcgtgccgcccccctccggccatctccaccctttgctcaaagtgcgtgccgaatttcgcgacattttcttccaaatgggtttctctgaaatgccaacaaatcgtttcgtggagagttccttctggaactttgacgctttgttccaaccccaacaacacccggcacgcgactcacatgacaccttttttctttcaaaaccggctctttcgacagaattcccggaggattatcttgaaagcgtcagaaaagttcattcagagggcggtttcggttccattggctatcgctacgattggaagttggaagaagcgcagaagaatttgctgaggacgcacaccaccgccgtttctgcccgtcagctttaccttctcgcacaaaaacctttccaaccgtccaaaatgttcagcatcgaccgcgtgttccgcaacgaaacattggatgccgctcacttggccgaattccaccaagttgaaggcgttgtggcagaacgaaacctctcactggcgcatgtcatcggacttttcactgaattcttcaggaaatgcggaattgaaaatctccgcttcaaacccacttacaacccgtacaccgaaccatccatggaaatttacgcttttcacaccggactgaacaaatgggtggagattggcaattcgggcatgtttaggcctgagatgttgcttccgatgggacttccggaagatgttgccgtggctgggttcggtctctctcgaacgaggccaaccatgatcagatacggcatttccaacataagagagctttttggccataagattgatctcgaaatgatctacagaaaccctttgtgcaggttggagcagaaaaactagtgacgaaatgggagtgccaataaacattcgatgacttttttatgttgactgagctttttgtttgttttgttgttgactatgagtgatgagtgtaattaaagacatttt

SEQ ID NO: 573 - DNA, 535 bp, Heterodera glycines
  genomic DNA sequence=SeqID_529; coding sequence=SeqID_827
aaaatggcctccaaatttgtattcagtcttcgcttttcctacccaaggctcttaaccagcagtgccctcaacaacaaaaaattggtgccaaatctcattcagtctcggtcaattgtgaccaaatttgacctggaattgcctgacgattacccggagccttggccctacaaacaatggggcttcaaccaattcatgcaacatcttgacaaaacgctgaagcgttggcacatcaactcgaaactgatcgttttcgaaagcaacattggcgtgggccggtcgtcgatcgcaaaggaattggccgatgcgttgggcttttattatatgccggcctttaaaatggacgacattttggttgaccgttacaacaatgacatgcgcgactattatcatttgtttccgaaacgctttcggttcccggacatcaacatgttctacaaggacccggccgacgaccaaacggccgtcatgcaagatctgatgtacgactgccgttgggagcagtacctaaacgcacaggcgcaccttttcaacacgg

SEQ ID NO: 574 - DNA, 492 bp, Heterodera glycines
  genomic DNA sequence=SeqID_530; coding sequence=SeqID_828
atgatcaattacatgctgctgttctcgcgccagggcaaactccgtctgcagaagtggtacgtcgcatatccggacaaggcaaaaaagaaaatcacccgcgagttggtaaccaccattttgtcacggaagcccaaaatgtgcgcattcctcgagtataaggacacgaaagttgtgtacaaacgttacgcttcgctttacttttgctgcgccattgagcagacggacaatgagttgctttgtctggaggtcatccaccgttatgtggagctgttggaccgttattttggcagtgtgtgcgagttggacatcatcttcaacttcgagaaggcctacttcattttggacgagtttttgttggccggcgaaattcaggagaccagcaaaaagcaagtgctgaaggcgatcagtgcgcaggatttgctgcaggatgtgagtggtggtggggacggcactgatcactttgttggacgcaataaaaagccaaacaaataa

SEQ ID NO: 575 - DNA, 3463 bp, Heterodera glycines
  genomic DNA sequence=SeqID_531; coding sequence=SeqID_791
ttaagtgatagtacccttattttataaactcaaatttgctgaagtatcatgggagttccagcctttttccgttggctttcacgaaagtatgtgtcgatcattgttgacgcggtggaacagcgcagaagagaaattgacggagtaaaaatcccaatagatgcaactcaaccaaatgagaattaccaagagtttgacaatctttacttggacatgaacggcattatccatccgtgcacacatccggaagaccgacccgcgccgaagaccgaggaagaaatgttcattttgatcttcgagtatattgaccgcctcttttccatcgttcggccaagaaaacttctctacatggcagttgatggggtcgcccccagagcaaagatgaaccaacagcgaagtcgtcgttttcgagcagcacaagaagcggcggagaagcgcgagctcatcgaaaatgtgcgtaagcggttggagtcggaaggaattccgttgccgccaccgcgaaaggaagaggaacactttgactccaattgcataacacccggcacgccgtttatggcccgtctttctgttgcccttcgctattacgtgcacaaacggatcacctacgacccggcatggcaaaagatccaggttattctttccgatgcgaatgtgccgggtgagggcgaacataaaatcatggactacgtccgacgtcagcgcgcttcgccggcgcatgacccgaacaccgttcactgtctttgtggcgccgatgccgaccttatcatgcttggattggccacccacgagtccaatttcaacataattcgagaagagtttttgccgaatcaaccgaggccgtgcgaactttgcggtcaatacgggcacgaggtcgaacattgtgaagggttggcacgtgccgagaccgggccggaccaagcggacccgttgaagaaggagaagaacttcatcttcatacgtctgccagtgcttcgggaatatttggagcgtgaactttccatgccaaatttgccatttccgttcgatttggagagagccattgatgattgggtcatgatgtgtttttttgtgggcaacgattttctcccccatttgccatcgttagaaatccgtgaaaatgccatcgaccgtctcgtgaagttgtacaaggacatggtttatcaggctggcggctggctcactgaaaacggcatagtgaatatcgaaagagtgaagaagatcatgggcggacttgggaaggttgaggacgaaatattcaaacaaagacagctcaaagaattgcgcttcaaagaatcaaagaaacagcgaaagcagcaacaacggcaggcaatggcaaaaattatgccgtacaatgccaatttgatagcaccaatgccacttggacagcaaaagcgaatgtcgggcgaggaaatgcgcagattggcggcgggagaccgacaggagttcgtcagacttgcggatgtcgccagttcgcacaaattgcagtcgctgttgacgcctgtcgaccgacgaaaggccacggatggcggtgatcggaagcgcaagttggccccaagttcagtcgacagtccgaacggagcaccaccagctaaatcgtttaaggagggagtggctgctgcgtccgtttcctccgaaacggccttgaaaccggagataaaactcgtaactccctctgggaagacggcgcctttggccaagggggcggttggggcactggcatacgactctgacgaggaggaggaagtgctcgacgaaatccgtctatgggaaagtggatggaaggaccgctactacagagccaagttccaagtgtccgagactgaccttgaatttcgcaagaaagtggcatgtgcttatgttgagggactctgctgggtgttgcgttattattatcagggatgtgccagctggaaatggtactacccttaccactacgcgccgtttgcctccgattttgaactgatcgccgatttccaacccgacttcaacatgcccacgaaaccgttcaagccattggagcagttaatgggtgtgtttcctgctgctagcagagctcatattcctgacgggtggcgttggctgatgaccgactcaagttcgccgataattgatttttacccggaaacttttgaaattgatctgaacgggaagaaatatgcttggcaaggcgtcgctctgctgccatttgtcgaggaaaaacgtcttttggatgcacttgactcggtgtacgccactctcacaaccgatgaaattgcgcggaatgccaccggaccagaccgtctttttgtcggcaataaacacaacttgttttcgctcgtttatgaggtgcactcccaaaagacgacaacttcgataaaagatgaactaacaaatgatgacacaaaagaaacaagcgaagggacgcgagaaactgaaggagaagccgaggaaactcaacaggcggaaaatggtgaaagcgaacaaatagcgaaaaccgaagaaacgacggcacaagaggaacaagcgaatgaagaagctatctcaaaacctgaacaggcaccgaaacaggaattcgagactgaaattgaatttgtcgatgacgaagaaaagaaatgggtgcacatcgacgcagtcaaagcgtatgggatgtctggcgaagtgtcttatgacgtcgaagcactcgcttttggtgaggcgcataggtcgctgttcagaaattcgttggagtttggcgacatcaaagagaatacctgcattatggttgagttccgagatccccaattcccaatgcacttcatcttcaaagccaacaggctggacggcatcaaggaattgcctcgtgtgctcaaaccgaacgattgggaccaacgacggcacggctccttccaaccccaaatcggattcagtcgtgacatcccacgtgcaaatctctccatggcgggccatcgtacgctcaaccaccacataaacgacaaccgtcgcagttgtccggcctctcttttctcagtgcaaacatcgccaccagcgcacacacttccatggcacatgagcacaaactcaccacaacaacaacatcaaatgcagtaccaacatcagcaacaatggcagcagggtcaattttacaacgggcaacagcagcagcagcccgtgccgttgttcagttttgggcagatggcaatgcccccgcctccgccgctcccaccgcaaaattggattactagtcacccgccaccacaaatccagtctcacgtgccgtacgggcagcccccacctctaatatcacagccaaggaatactcagcatcaccatcgcagaaacgacaacaacagaacttacaataggaaataattttcatcaaccgctgaatagcggtcacgatgtgattaattttctacgaaaatggtgttgccagaccctttctgaataaaagcatttaatccatttttgtttcaaatattttgtggtgtggttaaacacaactaagttc

SEQ ID NO: 576 - DNA, 1540 bp, Heterodera glycines
  genomic DNA sequence=SeqID_532; coding sequence=SeqID_793
actgttctttttcactttccttcaattcaacaaaatggcgaaatctgcaattgatgttaatcgcggcatcacagaagaccaaacagctaccataagaaattatttcacacaaccgcacttaatttacaaaactgtcactggagtgcgcgggcctttggtcatattgggcgatgttaaattcccacaatacgctgaaattgtgaaacttacactgcctaatggagaaaaacgcatgggacaagtactcgaagtaacgaaggacaaagctgtcgttcaggtgtttgaaggtacgtcaggtatcgatgcaaaaaacacaatttgcgagttcactggcgatattatgagaacacccgtttccgaggatatgcttggaagaatattcaatggatccggcacacccatcgacaaagggcccaatgttttggcggaggattacttggacatcgatggacagcctatcaacccatggtccagaatttatcccgaagaaatgattcagaccggcatttccgcaattgatgttatgaatagtatcgccaggggacagaaaatcccaattttttctgctgcaggtcttccgcataatgagatcgctgctcaaattgtacgccaagggggcctcgtcaaacagccgaacagaaagaaggaaaatgaggtggagggtgacgacgactttgccattgtgtttgctgcaatgggtgtcaacatggagacagcgcgctttttcaaacaagactttgaagaaaacggttccatggaaaatgtgtgccttttccttaacttggctaatgacccaaccatcgaacggatcatcacaccacgactcgcgctgacttgtgcagaatttctggcttaccaatgccaaaaacacgtcttggttgtgctcactgacatgtcttattacgctgaagcacttcgcgaagtgtccgccgcccgagaggaagtgcccggtcgtcgtggttttcccggttacatgtacactgacttggccagaatatacgaacgtgccgggcgtgttgaaggccgaaaggggtcaatcacacaaattccaattttgtctatgcctaatgacgacatcacccacccaattcccgatttgaccggttacataacggaaggccaaatttatgtggatcgccaacttcacaatcgtcagatttaccctccaataaatgtacttccatcgctgtcgcgtctgatgaaatcggccattggcgagggaatgacccgtgccgatcattcggatgtgtccaaccaactttacgcatgttatgccattggtaaagacgtgcaagcaatgaaagcggtggttggagaggaggcactgtcgtcggatgatttgctctacttggagtttctcacgaaatttgaaaagaatttcatttcacaagggaattatgaaaaccggacggtgttcgactcactcgacattggttggcagctgttgcgcatttttccaagagaaatgttgaagcgaattccagcgaaaacattggataaatattacccaaggggaggcactggggcgaggaacgaatga

SEQ ID NO: 577 - DNA, 1474 bp, Heterodera glycines
  genomic DNA sequence=SeqID_533; coding sequence=SeqID_810
ggcgcaacacaacaagtgcagaagttgactgatcagttcctctccttcatttcgcttgaagatgacctcttcatgctcagccgttacacaaaaagcagcccattctctttttacgcaattaatgacccgtcgataaccgccgatcaaattgacgcgttggtcgccgacattgccaatggactgttcgccgtctgtgtgacgcttggtgttgtgccggtgatcaaatgtccgaaaaacaacgcggcggagagagtggccgaaaaacttgatcaaaaaattcgtgacaatctccgcgacgcccgcaacaacttgttcgtccaggaaaacattcgggcaggccatctgagcattcatcgtcccgtgttggtcatcgccgatcggaccaccgatctgtccacgatgttgcaccacacgtggacttaccaggcgatgatcgcggacattttggaaatggaattgaacagagtgcggatgaaagacaaaaatgggcgccaaaaggactacgaatttggcacggaagacaaactgtgggccaactacaaaggcagcccattcccattggtggcggaagccatccaagaggatttggaggcgtacagacgcaacgaagacgaaatcaaacggctaaaggaatcgatgggactgtccgacggcgactcggccgaaatggccgtcgacatttttggcactgccgccacggcgaaactttccacggcggtcggcagtctgcccgaacttttggagaagaagcggctgatcgacttgcacacgaacgtggccaccgcactgctggacaacatcaaaacccgaaaattggacgtattatacgaaacggaggagaaacttttgacaggccaagaaattccggtcattgaaacgttgcgcgactgtccggacaaagacgacattttgcggctgattttgatcgctttgtgttctcggaatatgccaactgctgaacagcgcgaacttcaggctttcattgacgaacgtgcaattagctcggatgcgctgcattttgtgcggcaactcagggctttttctcatttgggtgccgaggcggaacagcaccaaggggccggcaccaagacggtcagcatgttctccaaactgctcagccactcatcgcgcttcgtcatggagggcgtcaaaaatttggtgcccaaaaagcataacttaccactgacgaaggttgaacagctgaccaccgatgtgaaaatgggcgtcggagtggctggtattacgggcagttcgtccgactttgacccggaccaattccgactgttcgaccctaaactattgcagggctcggccgtaaacagagatgttcgtcccacccaagcagcagccgacgtgatcgttttcgtgatcggcggtggcaattacgtggagtaccaaaatgtgcaggaatgggccaaggcacggggcctccaacggtgcacctacggatgcacggagatggtcaacccgaagc

SEQ ID NO: 578 - DNA, 1245 bp, Heterodera glycines
  genomic DNA sequence=SeqID_338; coding sequence=SeqID_820
tgcatttcaggcggtgaagtggtcgaaatccaagggccggcttttgcggaatcgatctccgaaggtgacatccgctggaataagcaagtgggcgactttgtgaagacggacgacatcgtggcggaaattgagacggacaagacatcagtcgaagtgccagccccatttgccggcaaaatcgtggagcttttggtggaggaaggagcgaaagtattggccaaacaaaagctatacaaattggagaagggagccgaggggggtgaagggccggcgaaagaagcgaaggaggaaatgccgaaaaaggagggagaagtgccaaaaccgaagagagaggagcaagggcaagcagaacagcgaacggaaggtatgccaataagagatcggaattttcagattccattctcagctcctcccatgcagtcgaaaatgccgccactgccaaaggagccgatcagctcaaagcccgtctccgaaataaaagtgcccaagttccagcagcagccaccgcacgctcccgccggcgactccaccgccatcactggacaacgcagcgaaacgcgagtgaagatgaaccggatgagactgagaatagcggagcggctgaaggaggcgcagaacaccagcgccatgctgaccacgttcaacgaggtcgatctgtacaacgtggtacggatgcgcaagcagtaccaagaggcgttcacgaagaagcatggtgtcaagttgggtctgatgtctccgttcgtccgcgcgtccgcaattgggttgcaggaactgcccgtggttaatgctgtaatcgagggcgcagacattgtctacagaaactttgtggacatttccattgcggtggcaaccccgcggggtttggttgtgccggtggtgcgtaacgtggagtcgatgagctatgcggacattgagaagacgcttggcgatttgggagtgaaggcacgtgacaacaaattggcgattgaagacatggagggcggcactttcaccataagcaacggcggtgtgttcggctcgttgttcggcactccgatcatcaacccaccgcagtcggccattctcggcatgcacggcattttcgatcggcctgtggcggtggatggaaaggtcgaaattcgtccgatgatgtacatcgcactcacttacgaccatcgcctgatcgacggcagagaggcggtcacttttctgcgcaaaatcaaacaggcggtggaagacccgctgaccattctgttggatctctga

SEQ ID NO: 579 - DNA, 1411 bp, Heterodera glycines
  genomic DNA sequence=SeqID_534; coding sequence=SeqID_821
gaaaaaacggcggacctccacaaagttgaggacgccttcgtacctctgatcaaactgcgctacgatggcattgaactcgacattttattcgctcgtttggcgttgaaagaaataaaggaagaccaggaactctcagacgacaatttgcttaagaacttggacgagaagagcattcgttctctgaatggttgtcgtgtggccgatgaaattttgcgattggtcccaaatcgactgaatttcattttggttcttagagccgttaagctttgggctaaaaaccatggcatttattccaatgtgttgggctttcttggcggcatttcttgggcaattctcgtcgcccggacctgtcaattgtatccaaatgcaacaccttctgttttattgcagaaatttttcctcgttttttctgcatgggattggccacatcccgtcattctgaaggatgtcgacgctaccccgcggattgacataccctatttcattgacatgatttgggatccgagaacacgcgcatcggaccgctaccatttgatgccaatcattacgccagccttcccagaacagaattccacatttaatgtgacaaggtcaacgagacaagtgatgaccaatgaattcaaagaaggcctagacaatatgctagaaatattcaatggacatgccacttggaaaaagctattcgaggaagtcaattttttcactcgctacaaacatttcattgcgctgctttgtctcaccgaaaatgaggaggaccacctgaacttttgcgggttggttgagtccaaaatccgccatttggtggcgtccttcgagcggaattcctgcgtgaatctttgccatgtcaatccccggcagtataaacccgcatacaaattggagctcgacatcgattacgagaaccccgtgtgcactttgtggttcatcggattggacctgaacaagcaacttacgaaaaaaattgatctcacagaagagttgcagggatttacggacaccgtttacaaaagtgcgtccgtgctgaaggacttcaaagaaacgatgagaattcacccctcttacacgcgccaaaggaatctcatcaaatggctttccaaggaggacttggaccggggtagacgagcggaacgacgctgctccgccgcggcggcttctccacgcgtgtccatgctaaacaattccctggactcaaccggaaaatcattggacaccagcggaagcaattcacccgcttctgccgaagagccgtccctgaagaaactaagagtctaatcaattctcacatcatttgatgtcttttattttgtacttcctttgtatattgtaacttatttacgatgcatattgttgtttgtactttactcgtttaatgtgattgaaaacaaacaaaacaaaataaaaaatggtaaaa

SEQ ID NO: 580 - DNA, 2175 bp, Heterodera glycines
  genomic DNA sequence=SeqID_535; coding sequence=SeqID_792
atgaatagttttacgcgcgacaaagaaacatttgaacccatttcagggaatcaggtgaaatgttatatttgtggtccgactgtttacgattccgcccatatgggacacgcgagagcttatctgtcctttgatattgtaaggcgagtgctgaccgattattttaattacgacgtgctctatgtgatgaatgtaacggacattgacgacaaaatcatcaaaagggcacgccaaaactttctttttgagcaatatttgaatggcattgattcggttggatttgaggaattggaacaacatcttcaagcagcacttcagcattatctcaaaaaggcatccattgaacccgacaccgacaaaagaaaactttttgtcgatacggtcagtgatctcgttcaattcaaaacgcgtatttcccagccagacaatgggcaatcagctgatgttcgcactgttttggtgcgcaaattggtggaaagtgcgaaagaagtgctctccgattggttggacgttacccggggaaatacggtcactaaacacgacattttcgcgaaattggccagaaagtatgaaaatgaatttttgtgcgatatgaatgcgttaaatgttcttgagccggacgtgttgaccagggtcagcgagtacattcccgaaatcattgattatgtgcagcaaatcatccgcaacggatacgcttatgtgtctgatggatcagtgtattttaacactgcccaattcgcatcaaaacccaaccattcctatgcaaaactcctccccgaggcgtatgctgatgcagaaagtgcggaaaaacatttgcgagagggggaaggcgaactcagcgtggcagtggacaatttgaaagaaaagcgctcgccgtcggattttgcgctttggaaagcctccaaagacggagagcccttctgggaaagtccctggggcaaaggtcggcccggttggcacatcgaatgttcggcaatgagtggggccatttgcggggacaaattggacattcacgccggcggatttgatctcaaatttccccaccatgacaacgaaattgctcaatgtgaggcgtacaatgacaacgatcattgggttaactttttcctccattgcggcacattacgaatcgaagggctaaaaatgtcgaagagtttgaagaactttgtgacgataagggaggcgttgaacaaatacactgctcgacaactgcgcctccttttcctgatgcacaattggacggacaatttggactacagcgaatcgacgatggaacatgccattcatttcgaaaaatgtttctgcgaattcttcctcaatgtgaaggatattataagaaagcaaattaaagaaaaaaatttcaagtgcttcaaaaaatacggtgaagaggagatggaagtgctgaacaaattcaacgcgatcaaagtgtccgtgcatttggccatgtgcgactccatcgacacacgcgcagttcttgacaaaatcaggacgatcatttcccttctgaacacttacattatggtccggaaacaggaggaagccgtacttaattgccaactgctgacaaaatgtgccaatttcgtcagagaattgctttgcatatttggcgtacagccggacgtgggcaaatacgaattctttactaaagactgctgcgcaacttctgacgacagagaagcgattatcatgccgtacttggaaatacttgcacagtttcgagaggtcgtcagaagcgaggctcgggcacagaaaaacattggaattttgaaagagtgtgacagactgcgcgacgaaatcctcccggaattgggcgttcggttggaggaccacagcaaagacacttgtgttaaattggtggacagagagacactaattaaagagagagaacagaaagaggcagcgcagagagaaaaagagcaacggaagatacaactgcagaaggaaaaggaaatgaagagacaggcgaaggaagagcagaaaagaaagacgagagagacacaacagaaaaacgaaagggaaaaccaatttcttcgattcacaacaaccctggtatacactaatcaaacaatctcaacaaaaataaaaacaatagaatataaagcaattgagtgcatttgtaacaacgaaagccaaaaattcttacacatacatacatatacctatgtatttaatgtataa

SEQ ID NO: 581 - DNA, 1818 bp, Heterodera glycines
  genomic DNA sequence=SeqID_536; coding sequence=SeqID_799
agccatacaatatttgcttagatggatttgttaaaatcttacgacggctcttcatcatcggacaatgaacaagaattggcagatataccttcttcgtccaatcacaacaaattgctcgctttgaaaatcccatccatcaacttaacacccaacgtgattgaacaacgcgccattcaacaggttgcggttgtggatccaaaaaccaaagagttgtatcacaatccgcgcttcgacgaattgtttaaaccagagagcggcccacaaaatccgtttaaaagtgaacatcaacgagcagaaaagaacacactgaccggctatgtggagccagcgcatttcaacgccttccattttgagcgttcacttcgctcctacgatacgcttggctatgcggataatccaacggcagacacaaccagcgcaaagttcgttggtgacgttggacaagcgcaagaaaaggccggcgagtcgctttttgaatcagtaaaaactggcggacagaagcgaaagagagtgataaattacgacgcatcaaacgttgacggatatacgggaccgtgggcaaggtttgaggacgagaagacaattgctcgaccggacccagaattgcagaaggaaatggacgaaattgtgcggaaacggaaactgaaaagtcgtgctggccgaagagcggccatcgcggaattgcatttggcagaagagagcaccaaattgcacataaaagatgacactgactatttgggccgttcctttatggaaccgccgaaatacacgggcaccaatctgcgcgaggactttgtgcccgaccgctgtttcccgcccacaaaacaagcacacacctacagcagtcacaccaaaccggtgaccgccatccgatggtttcctcgtagtgcgcacatgtttatctcttgttccatggacggaaaagtcaaattgtgggaagtgtacggcaaccgtaagttgatccgcacatacactggacacaaagtgcccgtgaaggacatttattttaacaacaccggcactgaatttctaagtgccgcttatgacaattacatcaaattgtgggacactgaaaccggtcaggtgaaaaaccgctacacaattggaggccatcgggcgtatgtggtcaaattcaacccggacgatgataaacaaaacattttcatggccggaatgtccaacaaaaagatcatccaatgggacacgcgaactggcgaaatcgaacaagaatacgaccgtcatttgggtccagtgaactcgatcacctttttcgacaaaaaccgtcgtttcgtttctacttcggacgataaatctcttcgcatttgggaatttggcattcccgtggatacaaaactgattcaacatgctggactacattccattccttcaatgactagggcaccaaatgaaaaatggatcgttgggcagtccatggacaatcgaattgtccttttccaaatcgtcgatgacaagttgcgattcgctcgtaaaaaggccttccgtggtcacaatacagcagggtacgcctgctcaactgatttttcgccagagatgagttttctcgcttccggtgatgcggacggtaaaatcacaatgtgggactggcgcacacacaaaattgtctccacatggaaggcacatgataatgtgtgcatttcaacactgtggcatccgcacgagaaatcgcggatgatttcttgcggatgggacaatgtaatcaaaatgtgggtctgacaatgaagtaaagctgacgacgattcaatgatttaaagtgaatttatttgtaatgtctcaaccgataaaaggaaaaacgtccta

SEQ ID NO: 582 - DNA, 652 bp, Heterodera glycines
  genomic DNA sequence=SeqID_537; coding sequence=SeqID_801
agttgttgaatgcaataatcctaaaatgttccgcaaccaatacgatagcgacgttactgtgttcagcccgcagggccgtcttcaccaaattgattatgcagtcgaagcgatgagacagggcagtgcagcagtagcaattcgtagcaaagattatgctgttgtggtcgcacttatgcgtgcacaaaacgagctttcttcatatcagcagaaagttttcaaattggacgatcatctcggcttgtctatgtctgggcttatttcagatggacgcattttggcacgctttatgcaaagtgaatgcgccgagtttcgctggaactatcataatccaatttcggttgaactgctcaaccgtaaattaggcttgaaacttcagtccaatacccaatattacggacgccgcccatttggtgtgggactgctcatcattggatatgatgacaaagggcctcacgttgtgaaagccgaaccctcgggggacgtgtccgaaatgtttgctgcttcgattggtgctcggtcacaaagtgcgcgaacttatctcgaaaagaacctaccagaatttgagacggctgacagagacgcattgattcgccatgcgattcgctccctcaaagagacgctgcaggcggacgctggcagtttggatgagaat

SEQ ID NO: 583 - DNA, 1092 bp, Heterodera glycines
  genomic DNA sequence=SeqID_538; coding sequence=SeqID_808
atgatcaaaagattgacgaatggaactgagctcaaacttagtaaaaacggtacggaactcagttttcggcctggtctaattcatggaggagaattggagttcgactgtggggttcaacgttgtatcagttactttttggagcctctcattctcatggcgcctttttgcaaaaaacctttgaatgtgaatctgaccggtgttacaaattccgtcgatgaactcagcatcgacgccattcgggctacttggctcccggtcttttcccgctttgttcttgccgaccaatgcacagaaataaaaatcaaagccagaggtttcaagccgagtggcggtggttcagtgactttctccagtcccatcaaaaggaatttgcgtgctgtgcaatgcattaagccaggaaaagtttgcaagatcagaggtctcgcttacgtatgcaaagtgacgccatcaatcgcatctcgaatgattgacggagctaaaaagatgcttcacggaaacatttctgacatttacattacgattgaccagaggaagggcccccagggcggactatctcccggctttggaatcttcttgacggctgaaaccaccgaaggcgtatttttccatggagaagcgatgtcgcgccctaagggccaaaacgaagaccaaacagtgccggaagaaattggggaacaggcggcaagacgtttgctggatgaaattcatatgggaggctgtgcagattcgtcctgtcaatctttggccgccactttcatgactctctgcgacagagatgtttcgaaatttctccttggtccactcacaattaacagcgtacacacccttcggaatttgcaaatgtttttcgagcaaatgtttaaattggaggaatggtggaaggttatgaaagaaatcgtcggaaaaggcggaaatgcgatgaaaaacggaagtgaggacaaatgtttgatgacctgtgttggggttggtttcttcaacatcaacaaagaccaactttaattgttcttttttgttaattttatatttgtttttatttattgtaataagactgaccgattgaattcggcaaaaaatacatttcttattttaaaa

SEQ ID NO: 584 - DNA, 3595 bp, Heterodera glycines
  genomic DNA sequence=SeqID_539; coding sequence=SeqID_809
atgttttttgacgacgatgacgaccaacagcccagggaggaatttgaaggcgatgagcaaatggatgtaaatgaatttaatattgaaacacatcaagaagcgtgttgggtggtgatttcggcttattttgacgagaagggactggtgcgacaacaacttgacagcttcgacgaatttatccaaatgagtgtgcaacgaattgttgaaaattcaccggcagtcgaattgcagacagaattgcaacatatgtccggggaaattgagacaccgacgcgtttttccttaaaatttggccaaatttacctttcgaaaccgacgcattgggagaaggatggggcgccgactccgctaatgcccaacgaagctcgcttacgaaacttgacttattcttccccgctttacgttgacattacaaaaacaatttcgcgcgagggcgaagaggaccaagttgaacagtacgagaaggtgttcattggcaaaatccccataatgctcaggtcgagctattgcatgctttccaatatgaatgatcgcgacttaaccgagctgaatgagtgtccacttgacccgggtggttattttattatcaacggcagtgaaaaagtgctaattgcacaagaaaagatggcgaccaacacagtgtacgtcttttcaatgaaagatggaaaatacatgtacagaacggagtgtcgccgtccaccatcccaattttgtgttaatatgacaaacaaaggtggaaaagctgcctctaagacaccgatgggccagaaaattgttgcagtgattccttacattaagcaggaaatcaatatcatcattcttttccgtgccctcggtttcgtctccgatcgcgacattcttgagcatatcatttatgattttgatgaccaggaaatgatggaattggtcaagccgagtctcgacgaagctgttgtcattcaagagcaaaatgttgcgctgaatttcattggaactcgtggcgcgaagccgggagtcacaaaagaacagcgaataaaatatgcgaaggaaattctacagaaggaaatgcttccccatattagcatagcggaacattgcgagaccaaaaaagcttattttatcggctatatggtccatcgtcttctattggctgcgctcggtcgtcgcgagttggatgaccgtgatcacattggcaacaaacgcttggatttggctggtccattaatggcaacgcttttccgtgctcttttccgcaacttgttaaaagaagtccgtctgactgctcaaaaatacatcaacaaaaatggcaattttaatttggatgtttgcgttcggcctacgcttatcactcgtggattgtcctattctttggcaaccggaaattggggagagcagaaaagagcgcatcaaactcgagcaggcgttagccaagtgcttaatcgactcacttacactgccacactttcgcatttgcgacgatgcaattcgcctattggacgtgaagggaaattggcaaagcctcgccaattgcacaacactcagtggggaatgatttgcccagcggagacacctgaaggccaagctgtgggcctggtcaaaaacctcgctttaatggcttacatatcagtcggttcactgcctgaaccgatcctcgaattcttagaagaatggtccatggaaaacttggaggaagtggcgccaatgtccattgcggacagcacgaaaatattcgtcaatggcgcttgggtgggcattcatcgcaatcccgaccaactgatgacaacattgctgaaattgcgtcgccaaatggacatcatcgtttccgaagtgtccatggtccgtgacattagagatcgtgaaattcgcataagtactgacgcggggcgcgtgtgtcgaccgttgttaattgtgaacgatcgcaagttggtgttgaagaagcaccacatagaacagctcaaggagagggacgtcatggacgaacagcaacagttcacttggtccgatttggtggccggcggagtggtggagcttatcgacgccatggaagaggaaactattatggttgcaatgacacccgaagacctcaaaactggtgggtactgtgaaagctacacgcattgtgagattcatccggcgatgattctcggcgtctgcgcgtctatcattccttttccggaccacaaccaaagtccccgaaacacttaccaaagtgccatgggaaaacaggcgatgggtgtttacacaaccaactttcacgttcggatggacacattggcacatgtgctgtactacccgcaaaagcccctggtgaccacgcgttccatggaatatttacgtttcaatgaactccctgccggcataaatgccatcgtcgccattctttcgtatggtggctataaccaggaggactccgtgattatgaatcaggctgggattgatcgtggtctgttccgttcggtgttttaccggtcatatcgtgattcggaacaagagattgacaatgtgaacgagcaactgattgagaagccgacgcgcgacaaatgcaaagggatgcgaaacgccatttatgagaaattggacgatgacggcatcacttcgccaggcactcgagtgtcaggtgacgatgtgatcattggaaaaacaattgctttgccggaggtggaggacgagttggaagccagcacagcgcgctactctaagaaggatgcgtcgacaacacttcgaagcagtgagacaggcattgttgaccaggtgatggtcagtgtcaacgcggagggcaacaaattcgtcaaaattcgcgtccgttcaattcgaacacctcaaatcggggacaaatttgcttcacgtcatggtcaaaagggaacaatgggaatgatgtacagacaagaggatatgcctttcacatgcgagggcataacgccggacattatcattaatccacacgctgtgccgagtcgtatgacaattggacatttgattgaatgcctccaaggaaagctttctgcaaacaaaggcgaaattggcgacgccacccctttcaacgacacagtcaatgtgcagaaaataagtgctttgcttgagggctacggctaccaattgcgtggcaatgaaataatgtacaacggatttaccgggcaaaagttgagcacacaggtgtttctgggcccaacttactaccaacggcttaagcacatggtcgaggacaaaattcactcacgcgcccgagggcctgttcaggggatgaaccgacagccaatggaaggcagggcacgtgacggtggactgcgatttggtgaaatggaaagagattgtcaaatttcacacggcgctgctcaatttttacgggagagactttttgaggtgtccgatccatacacagtttatgtgtgcaatcaatgcggattggtggtgattttcaatcaacggacgaacactttcgagtgcaaagcatgtcaaaataaaacgcaagtgtcagctgttcgaattccttacgcgtgtaagctgttgttccaggaactcatgtccatgtctatcgcaccgcgaatgatgaccaaatagtctttgtttttgtttgttcatttttttttatttttgaattgaataaatttaaaaagat

SEQ ID NO: 585 - DNA, 282 bp, Heterodera glycines
  genomic DNA sequence=SeqID_540; coding sequence=SeqID_818
gcgcaaattgaagtgatcccatgcaaagtttgcggcgacaaatcctccggcgtccattacggcgtcatcacttgcgaaggatgcaaaggctttttccgtcgttctcaaaatgccccggtgaattaccaatgcgcgcggcaaaagtgctgcacggtggacagagtcagtcgcaaccgatgtcagttctgtcggcttaaaaaatgtttggagttgggaatgagccgggaggcggtcaaattcggccgaatgtccaaaaaacagcgggaaaaggtcgaagatgag

SEQ ID NO: 586 - DNA, 1410 bp, Heterodera glycines
  genomic DNA sequence=SeqID_541; coding sequence=SeqID_825
cagcagcaacagcagcaaaacaccggagatgaagcggggactaagaaacagacaaggcttgggttggatgtgacaaagacggagaactattccgaatggtattcccaggtgatcgtcaaggcagaacttattgagtattacgacgtgtccggctgctacgtcatccgtccctgggcgtattccgtgtgggaacacatccaagcattcttcgacgctgaaatcaaaaagctgggcgtcaagaactgttactttcccatgttcgtctccgctgctgcgctcgaacgcgaaaaaacgcacgtggccgactttgccccggaggttgcttgggtgaccaaggccggaaactccgacttggccgttccaattgccattcggccgaccagtgaaacggtgatgtacccaacctttgccaaatggtgcaaatcacacagggatttgcctatcaaaatcaaccaatggtgcaatgttgtgcgatgggaattcaaacatccgactccatttttgcggacccgggaatttttgtggcaggaaggacacacagcctacgcgacaaaagaggaggctgaggaggaagtgtacgacattctgaatttgtatgctcgcgtctacacggatttattggccattccggtggtgaaagggcgcaaatctgaaaaggagaaatttgctggcgcagattttaccacgacggttgaggcgtatgtgccggtcaatggccgaggcattcagggcgggacttcgcaccatttgggccaaaacttctccaaaatgttcaacatcgaatttgactcactcgtcaaagggcaagtggagttcgtccaccaaaacagttggggtctttccacgcgaaccatcggtgccatggtgatgatccacggggacgacaccgggttggtgttgccaccacgcgttgcggacattcaggtcgttgttatccccgtcggaattaccgttaaattgtcggatgaaaagcgggtcgaactgattgaaaagtcagaagcacttgtcaaaatgctgaaggaggagcatggagttcgggcagttttggaccaacgtgacaatgtttcgccaggatggaaattcaatcattgggagctgaaaggtgtgcccatccgtctcgagttgggccccaaggatttggccaaggaacaagcgcttgcggtcattcgtcactcgggccaaaaggtgcctttgccattgtccaatttgggcgaaagcatcaaacaattgttggacaccattcacggcgaaatgtacaagaaggttgaacaaattcgagacgaacacatggtcatttgtctcgacttggaggaaatgacgcctctgctcgacaaaaagtgcgtcgttttggccccattctgtggtcgcattgaatgtgaaacgtcgatcaaagatttcaccgttcgcgag

SEQ ID NO: 587 - DNA, 1833 bp, Heterodera glycines
  genomic DNA sequence=SeqID_301; coding sequence=SeqID_839
gaccgattcaaacttgaagacttgcttaaacgccggtttttctttgaccaaagttttgcaatttatggcggcgtttctggactttatgattacggtccgatgggttgtgcactaaaagccaacatgatacaggcttggcgcacgcattttgttctcgaggaaggcatgttggaagtcgagtgcacttcacttacaccagaatacgtcttaaaagcttctggccatgttgaccggtttatcgactggatggtgaaagacaaacaaacgggtgcttgttttagagccgatcacttggttaaaaatcaagtggaaactttgattcgggacaaaaaaactgatgaaaaagcaaagtccgaacttatgaatgtgcttgttatgcttgatgggatgagctgtgatgacttgcacgaagtcattaagaaattcaatttcaaatctccgttaaccggcggtgacttgtccgaacccgtttctttcaatctgatgtttcccactgaaattggacctacctgtgatcagcgagcctttctgagacccgagacggctcaaggaatctttatcaacttcaaacgccttttagaatttaaccagggacgacttccttttgctgcagcccaagtcggttctggctttagaaacgaaatttcgcctcgacaaggacttatccgcgtccgggagtttacaatgtgtgaaattgaacactttgttgacccgaccgacaagagacatcccaaattcgagaaaattgcacatttggaacttactttgtttcctgcttgcaatcaaatggaatcaaaaaatccccaaaagatttcaattggaaacgcagtcaaattgggtatcgtaaacaatgaaactttgggttattacatggcgcgaactcatttgtttcttctttctgttggcatttcgcccgataaactacgctttcggcaacatctttccaatgaaatggcccattacgctcaagactgttgggacgcggagtgttttacctcttacggatggatcgaatgtgttggaaatgcggacagagcttgctatgacttgcaccagcaccaaaaggcatcgggagtgaagctcgtagcggagaagaaactcggcgcgccgaagcaaatcgaagtggtcgaagcagtgccaaacaaacagttgctgggcaaagaattcaaatccgattcaaaacagattcttgcagctttggacgatttaactgaagcacagatcgaggaattggaacgggaaatcaaaagcaatggtaaatatcgcttgtctttgcgcgagggaaaaacttttgagctgaactcgtcaatggtggaagttaagcgtttcgagaagactgtccatgttgaagaagtgactccttcggtgattgagccttcctttgggattggtcgtattttttacgctgtgttggagcattcttttcggcaacgtgagggggacgaaaagcgatgctatcttgaacttccgcccctaattgcaccgatcaaatgctcaattttgcccatttcttctaatgagcgacttgacccaataatctttgctgttcgggaccaactgacctctcgagaaatctcttctaaaattgatgacagttctggttccattggtcgtcgctatgctcgaactgacgaaattggcataccatttggcattacggtggactttgagtctgagttgcagccgtggactgtgaccttgcgaaatgcgccaacaatgcaacaaattcgtgtttctgttagtgaaattggtgaagttgtcgggcatttggtgaaaggcaaaatgaattgggagacagcaatggccaaatacccaattttcaatgccaaataa

SEQ ID NO: 588 - DNA, 1785 bp, Heterodera glycines
  genomic DNA sequence=SeqID_302; coding sequence=SeqID_849
gtgttctgtgccatcaacgagctgggccaaaccaagcgtgtggatgaagcgctgtgtggccaaggcctggaggaaaagccggtggcacgagaggagtgcgtcaacgaggagaaatgcaccggcacatttttcaccagccagtggagcaactgtacggccaaatgcgacggtggcacacagacgcgtacagtagtctgcctgaactacgataaaaagccggtgccggaatggtgcgatgagaaggaaaagccggcggagcagcaggagtgcggcatggacaaatgccaaaattgtaccgacagtgagttcggctgctgtccggacggcgagtcgttcgcctccggcccttacctcgagggctgctccaactgttcgtccgtggccgagtttggctgctgcgcggacaatgtgacggcgcgggaggacgctcagggcacaaattgtcctgaggcagcggccggcaaaaagggggtgacattcgacgaagcggagggcagcggggaggcggcgccgccttccaaagaaatgtgcgcaattgaaactgtgggcaccaaggagaagctgcaaatcccatgcgcggaagcagccgccgtcacagaaacaatgaatgaaacggtgcaactgatcaaattggcgagcgccgatgaaacggcgccggaggccaaagaaacaaaattcggctgctgcccggactggagcacaccagcggaagggcccaactatgcgggatgtcccaaatttgttcttggcaattgcaatggcaccaaatttggctgttgccctgatgaggtgtccatggcacgcgggccggactttgaaggttgtggtgagcccacctgtgccgcgtcaacatttggctgctgcaaagaccgacgcaccatcgcatttgggcctcactatgccggctgtgaccgttcgtccttcccttgtgagctgtcaacgtacggatgttgcgaggacggcgagacggctgcgctgggccccaacggcaccggatgtggtgccagctgcttgctgaccaagtttggctgctgcccggacggcaaaacgcatgcccaaggcgcgaacaatgagggctgcggctgtgagtacgcgcagtacgggtgctgcccggacgggcacaatgcggccaaggggcccggcttttacggatgcccggagagctgtgcgcaaagcaaatttggctgctgtccggacggcaaaacgattgcccgagggccgaacaaagagggctgtccatgtcagtacacgcgttggggctgctgcccggacggcgagacaaccgcgttgggcccgctcaacgaaggctgtgacgattgtcgttatgccaagtacggttgctgtttggacggcgtgtccaaagcgatcgggcccgactatgctgggtgcccgaccaccacgcccgcgccttacatgctcggcggtaccgtatcaccatcgtacattgtgtcctgctcattgccgcaagaccagggccaagtgtgccattccggctaccagctggcgtggtattatgacatggtggagggcagctgctcacagttttggtacggcggctgtggcggaaacaacaaccgtttctccagcaaggagcagtgcgagcaaatttgtgtggagccaccacagattgggcgctgctatttgccacgcgtggaaggcccacagcgctgtgatcagttggcggcacgatattattacgactatttgacgcgacagtgcgcggccttttggtggcgcggatgtcgcggcaatgccaacaactttggctcatgggaagagtgccag

SEQ ID NO: 589 - DNA, 1206 bp, Heterodera glycines
  genomic DNA sequence=SeqID_303; coding sequence=SeqID_881
atgtcttccaaagcattgaatgtccgagtcataacaatggacgcagaattagaatttaccattctgccatcgacaactggcaagcagttgttcgaccaggtggtcaagacaatcaatttgcgcgagatttggtattttggtctccaatacacagacaccaaaggcttttcctcctggctgaagctgaacaagaaagtactgaaacaggacatcaaaaaggagcagactttgcagttcaaattccgtgcaaaattttaccctgaggatgttgctgaagaaatcatccaggatgtgaccctccgtctgttttacctgcaagtgaaggacctgattttgaccgacgaagtgtactgtccaccggaccaagcagtgcttctcggctcatacgcaatgcaggcaaaatacggtgactacagtaaggaggaacacagctcgggcagtcttgccaatgatcggctgattccacagcgtgttttgaaccagttcaaaatgaacatgtccgaatgggaaaatcgcgtgatgacttggtggacagaccacagggggatgaaccgtgagacggcaatgttggaatatttgaagattgctcaagacttggaccaatatggcgtgaattacttttccatacgaaataagaagggcagtgaactgtttttgggtgttgacgcattgggattgacaatttatgatcaaaatgacaaattgaatccgaaggtcggcttcccatggtccgaaattcgtaacatttctttcaacgacaagaaatttgtgatcaaaccggtcgacaaaaaggcacaggactttgtgttttatgcgcctcgacttcgcatcaacaaacgcattttggcgttgtgcatgggaaaccacgagctgtacatgcgacgaaggaagcccgactctattgaggtgcaacaaatgaagcagcaggccaaggaggagcgcatccagcgacagttggagcaagaacggctgcagcgagaaatgtgcgccagggaagcggctgaacagaaacaacatgaatatgaagccaaaatgttatccatgaaagaggagatggaaagtgcgcagcgcgagttggaagtagcacaagggcgaattcggcgcctggaagatcaaatttacgagttgaatgaggcaaaacgattgttggaagaaaaggagcacgagctacaaacattgaacactgaactggcatcagagagagct

SEQ ID NO: 590 - DNA, 820 bp, Heterodera glycines
  genomic DNA sequence=SeqID_304; coding sequence=SeqID_892
tgccttatgacgaggactccgagaattcaaacattttctttcttgatgctgattttctggaggacatgtttgggatgttttacaaagtcgcggcacgtgaaagaattgtcggatggtatcactctgggccgcgtctttgcaagaatgacattctgatcaacgaagtcatcaaacgctttaccccgaaccccgtgctggtcataatccaagcttctcaaggccgacaggatttggcactgccgacggatgcttatgtggaagtccaggaagtgcacaatgatggttctcccccggtgaaaacctttgaacacgttcccagtgaaatcggagcagaagaagcggaagaggtcggagtggagcacttgctcagagacatcaaaaatcaaacagccggcaccctctcgcaacgaattgctaatcagttgacgggaattcgtggtctcgagaaccatttggctggttttacgagctatttgcatcgtgttgcgagtcgagaattgcccatcaaccacgctatcatatttctaatacaagaaatgctcaatttgttgccggaggtcctctcaccggactttgtcgacgcgcacaatgtgcagacgaacgaccatttgatgtgcgtttacatcggttcgatggtgcggacgataatcgcattgcacaatctgatcgacaataagttaacgctgcaaaaagtggcagaaaaaagtgcgaaggaaaagacggtcaaagagacggaaaagaatgaagcaaatgacaaagagattgtcaaaaacaccaaataattgtatgaccattttgctggaaaatattttaaatcatt

SEQ ID NO: 591 - DNA, 1668 bp, Heterodera glycines
  genomic DNA sequence=SeqID_305; coding sequence=SeqID_963
cgatatttctgagactctcaaaatggcttctgttccaactcaaaaagatgagaaaacgaaacgaaatgaggagttggcaactgcgattctcaagaaaatgccgaagccgaacagactcattgtggaccaatcgcccaaagacgataacagcagcgttctaatggcacagactaaaatggatgacctgggattgtttcgcggcgattcgatccttctcaaaggcaaaaaacgtcgtgagacaactagcattgtcatagccagtgacacttgtcctcccgagaaaatcttgatgaatcgagttgtgcgtcagaatctccgcgtcaaactgggcgatgtcgtcagtgtgtcgtccgcttcaaatacgccaaatggactgcgcattcacgtgcttccgattgatgacaccgttgaggggctgaccggaaacttgttcgaggtgtttcttaagccctactttttggaggcctaccgtccggtttacaaaggcgacacgttcactgtcaacgcagcaatgcgaactgttgagtttaaggtgattgaaactgatccggcgcctgcttgcattgtggtcccaacaacgatcattcattgtgagggggaaccgatcaaacgtgaggacgaggagaacaatctgaacgacgtcggctatgatgacattggcgggatgcgcaagcagttggcgcagatcaaagagatggttgaactcccgctccgccacccgatgcttttcaaatccatcggcattaaacctccccgaggaatgcttttgttcggtccgccaggcactggaaaaacacttgtggcccgtgctgtcgcgaatgaaactggcgcattctttttcctgctcaatggacctgaaataatgagtaaattggctggtgagtcggagtcgaatttgcgcaaagcattttccgagtgcgagaagaattcgcctgccattcttttcatcgatgaaattgacgcaattgccccgaaaagagaaaagacacacggcgaagttgaacgtcgcattgtttcgcaattgctcactttgatggatggactgaagcagcgctcgaatgtcattgtcattggtgcaacaaatcgtcccaattccattgacccggctcttcgtcgctttgggcgtttcgatcgcgagattgacattggtattcctgacgcaattgggcgtttggaaattctgcgcattcacactaagaacatgaaattggcggacgacgtcgacttggaaaagattgctaatgagtgtcatggctatgttggtgccgatttggctgcactgtgctctgaggcggcaatgcagcaaattcgtcaaaagatggagctgatcgacttggaatcggaaaatattgatgcggaagtcttggcgcaattggctgttactatggacgactttcagtttgcactcggtaaaaacagtccgtccgcgttgcgtgaaaccgtcgttgagactccgaatgtcacttgggaagacattggaggccttgaaaatgtgaagagggaattacaggaattggtccagtacccggttgaacacccagagatgttcctcaaattcggaatgcaaccatcccgcggtgtcctcttctacggtccgcctggttgtggaaaaactttgcttgcgaaagcaattgcacgcgagtgccaagcaaacttcataagcatcaa

SEQ ID NO: 592 - DNA, 642 bp, Heterodera glycines
  genomic DNA sequence=SeqID_306; coding sequence=SeqID_931
atgacttcacgagacgatgaatatgactatctttttaaagtggttctgatcggcgactcgggcgttggcaagtccaatttgttgtcccgtttcacgcgcaatgagttcaacttggagagcaagtccaccatcggggtcgagtttgccaccagaagcatccaggtggacggcaaaacggtgaaggcacagatttgggacacggcgggccaggagcgctaccgggccatcacttcagcatactatcggggcgccgtcggcgcactgctcgtctacgacattgccaagcatttgacgtacgaaaatgtggaacgatggctgaaagaacttcgtgaccactccgaccagaacattgtgatcatgttggtgggcaacaaaagcgacttgcgccatctccgagcagtgccgaccgacgaggccaaggcgtacgcggagcgtaaccaactgtcattcattgagaccagcgcgttggacgccaccaatgtggaggcggcgttcaccaacattttggccgaaatttaccgtgccgttagcacccgacaagtgccgcccgaccgaatggtgccgatcagcagccagaacaacatcacgctgtcctccaccacggccaacaaggagaagaaggcgtgctgttcctccacctaa

SEQ ID NO: 593 - DNA, 2184 bp, Heterodera glycines
  genomic DNA sequence=SeqID_307; coding sequence=SeqID_950
gcaatcgtcccctttgacgttgaatatcaacagctaaagaagaccaacaccccggcaaagctttacgagttcaaactcgacatgttccaaagccaggcactcaaatgcctggacaatcaacagtctgtgctggtctcggctcacacatcggccgggaaaactgttgttgccctctacgcaattgccatggcattgcgggacaaacagcgagtgatttacacgtccccaatcaaagcattgagcaaccaaaagtaccgtgaacttgttgaagagttcgaagacgttggccttgtcaccggggatgtgacactgaacccaaatgcatcatgtgttgtgatgaccaccgaaatactgcgttcaatgctttaccgaggctgtgaaattgtgagagaagtcggctgggtgatctttgatgagattcattacatgcgcgacaaagaacgtggcgtcgtctgggaagaaactctcattttattgcccaaaaccaccaatttggtgtttctttctgcaactattccaaatgccaagcaattcacagaatggatttgctatttgcagcacaaacagtgcaacatcatttacacggactatcggcctgttcccctccaacatttggtttattctgccgggtcggacggtctttgggaagttgtgaacataaagggcgagtttaaacaggacaactttgccaaggcgatgagctgtttggaggagcgccaaccgatgggcggcgaagtgcggcctcagcacggacggcggagtggcgcgaacgacgcgacgcagaagagcaacgttgtgaaaatcattagaaccattcgagagcgagacatgttgccatgcattatcttttcattcagccgaaaggagtgcgaggcgtacgcctccgaaatcaaagacattgattttaatacagaagaagagaagcgcgccatcaaattgatcttcaacaatgccattgacctgctttccgacgaagacaaaaagctgtcccaaattcggcacgtgcttccctatttaatgcgtggcattggcattcatcattcgggccaattacccattatgaaggaagtggtcgagatccttttcggagagggtttgattaagacccttttcgccactgaaacatttgccatgggcataaatatgccggccaaaactgtccttttcacttcggcacgcaaatttgatggtgtcagtaacagatggataacaagtggcgaatacatccaaatgagcggaagggcggggagacggggcaaagacgagaagggactggtcattctgatggtggaccagcagatgagcgcggagacggccatgcaaataataaaaggcacgagcgatccactgaactcccaattccgactcacttacaatatggtgcttaatctgttgcgagtgccggacatcaatccgcagtttatgctcggcaattccttctatcagtggcagaattattcccgccttccggaccttctgcagaaacttaacaccaaaagacaacttttcctaagtgcgcatgtcgaccatttgtcggaattggaaggacttttcagattggagaagcaaattgagcagcagagaaatgccatcaaagcattggtactgaagccggcaaaagttatccgcttctttcagccaggccgaatgctcaaactcaaatgcttcgacaaggacttcggctggggcgtgctgttgaggtacaccaaaaagccgaacccactgaatccgttgtctcctgaaatgctatatttcctcgacgtggctgtgttcgtctcgcgcgaaagtgagaactgcgcgcaaaatctatgtgcggtgaaacctccgccgcccggggagaatggcgtggtggtggtgctgcccttcgctttcgactgtatccaagcagtgagcacaattcggctaaaaattcctcaagagctgaagagcaaggaggcattccaagcagtggccaagaccattctggaaacgaaaaaacgcttcgaccaactcattcccgaattggatcccatcgagcacatgaacatttccgacccgcagctgaaaaagtctttggaagagctaaaaaggtgcgaagagcggttcacggaacatccgctgagaaaccgacgcgacttcgatgaaatttgggaagcatttatgaagcggcaaaaactggaggacgaatacaaacaagccaagaag

SEQ ID NO: 594 - DNA, 504 bp, Heterodera glycines
  genomic DNA sequence=SeqID_308; coding sequence=SeqID_961
cgatcactctctgtcttggcaaagtggccgatgtttatctgatcgacgagcccagcgcgtacttggactccgagcagcgcttacatgcagccaaagtcatcaaacgcttcatcctgcacagcaaaaagagtggcttcattgttgagcacgattttatcatgtccacttatttggcggaccgcgtcatcgtttttgacggacaacccgccataaaagccactgcaaatgcccctcaaccgctggtgaacggaatgaaccgttttctgagccaactgaacatcactttccgaagggacaacgaaagtcatcggccgagaataaacaaattgaattcgcagctcgacgtggaccaaaagacgagtcaaaattacttttatttggacaattgaattaccattttctctgttgttcttgtttttttggttgctgttcaattgcgccgttttgttgataatattaccatatttttaacttcttaaaagtgcataaatgtgaatggatttg

SEQ ID NO: 595 - DNA, 1173 bp, Heterodera glycines
  genomic DNA sequence=SeqID_309; coding sequence=SeqID_988
gtattcttttaacatcaattttggattccaacaataaaatgattggggaagagcttacggatgttgacaaggctcgcattgcgtcagacattctgcttcagtcgccgccgggcgagttcaacgaggtgttcaacgacgtgcgcactttgttgcagaacgacgcacttttggaaaagggcgtctgtctggaggcggtccggcgctacaacaaggcacagtttgtgccggtcaaccccgagccgggcgctgaacacccgactttgatcaccgaacacaacgaattgccggacggacgtttcgtggacccaaaaacgggccgtgttttcaaatacgaccatttgcgaaaggaggcggccgatgcgcagccgtcggggcccaaggaaattgacgaaaaattggagccatggcgaaaggcactgcaaaaagagttggacgagtacatttacgagcatttccatctgaccggcgtcgccactgttttcacgccgttgcagcaccaaaaagagccgaaactcattctatgcattgagtcccatcagttccagccaaaaaactattggaacggtcgttggcgttccgaatggcattttcccaactttgacggctcttcaaaaacggcggggactctccaaaaatgcacgggcaaattgcgtttgcaggtgcactattatgaagacggaaatgtgcagctgatttcggagaaagaggcgacggtggaagtgaaaatgacgaatgaccgggagacgagtgcccgtgaactgttgcgggcaatttgcgaagcggagtcagcttatcagacctccatccaggagtcccaagtgcaaatggagagcaccttcaaggcgcttcgccgtcagttgcccgtcactcgctccaagctgaactggctgaacttccactccttccgcatcactcaacaggacatgaaacagccgccgacgcccaccgtcgctgtccaacaacagtcccagtgaaaaacaacaaatgaacggactgacggacggatgaatgacaccgcaactaattggagagagacactttcgcgtcctcaccactcatttgtttagttgtactcattcgttcttcatttcattaggcttattgggtgcgggcatttattaaccgtttggaaatggtgctttgcgattccttccattaaatttgtccaaattt

SEQ ID NO: 596 - DNA, 2619 bp, Heterodera glycines
  genomic DNA sequence=SeqID_310; coding sequence=SeqID_838
aatggggcgaaggaggaaaattcggagtccgatttcgaaaaaatggaagaggaagcccaaaaggacatcgaagagcgcgacgcactgtccaaaaggataagggaaagggagaagcacaacacgcggcacgtcatgtcaaagaacatttcagaaaaggacgacgaagccaacgatatgatgggcaaattgagatacgaaagtcggaagagttatttggcgaagcgcaaggaggacaaacgcatggaattggaggcgaaggttcacgatgatgagactatttttgcgaatgaaaagcttaccaaacgagagcaattggatgccaagtacagaaaggaagtgcttcactatgtgaagcaatatgacgaggcggggaatgtgcttaaggtgccgaggtatcatgtccccgatgcgagcagcaaaattattccaacggaatatgtggaggagaacgaattgcctggcggggacggacgtcgctgggaggatgagaaactcgggtccgccgtttttcattacggggcaaaggacgcgaaggcaaagccaatggaaaagggattgcttgaggacgaacagatcgattttgtggaagcactgcaacaactcgaagggactcgcgaaactgaagtgagaaaaggggcaaatcaaagacggttgtcattgcaagagacgcgcaaaactctgccagtttatgcgtatcgagacgaattcatcgaggcggtcaaagagcaccaagtgttgattatcattggtgaaaccggctccggaaaaaccacacaattgccacaatttctcttcgaatctggattttgctcgggagacaaacggttgggctgcactcagccgagaagagttgccgcgatgagtgttgcggcgcgagtcgcggaagagatgagcacgaaacttggcggaatggttgggtacacaatccgattcgaagactgctcatccgaaaggaccaaaatcaaatatctgaccgatgggatgttgcttcgcgagtttttgaatgaacctgaccttgcttcctatagcgttttgatgattgacgaagcgcatgaaaggacactccataccgatgttttatttggactcgtcaaggacatcgctcgcttccgcaaggatttgaaattgctgatctcatccgccactttagatgcgctcaaattttccacatttttcgacgacgcaccaatctttcgcattcccgggcgtagatttcctgtccaaatttactatacaaaagcacccgaggcggattatttggatgctgcaatgatttctgtgcttcaaattcacctgacccaacctcttcccggcgatattctcgtctttttaactggccaagaggaaattgaaactgtacaagaggccttgcaagaacgcataaaattgctcggctcccgtatcaaagaactgatagtgttgcctatttatgcaaatttgcctaccgatatgcaagcgaagattttcgaaccgacgccgccgaatgcccggaagtgcgttttggccacaaacattgcggagacttccgtgaccatcgatgggattgtgtacgttatcgaccctggctttgtgaagcagtcttcctacgatgcgcgtggcggtattgaccatttgaatgtggtcaccatttcgaaggcgtctgccaaccaaagggccggaagagcgggtcggactggcccggggaagtgtttccgtttgtacacagcctgggcctaccaacacgaattggaggagcaaccgatacccgagattcagaggaccaatctgggcaatgttgtgcttatgctactcagccttggcatcactgacctcgtccattttgactttttggatccgccaccttacgaagcactggctgccgcattagaacatttgtacgctctcggtgctttaaaccacaaagggatgttgactaaacttggacgacggatggccgaatttccttgtgatccggcaatgtccaaaatgataatttcctcagaaaaatacgaatgttctgaagagattatcactatttccgcgatgctttccgtaaatgcggcggtgttttaccgcccgaaagcgatggtaatccatgcggacacagcgcggaaaggattttggtcgtccagcggcgaccatctgactcttctgaatgtgtacaacaaatggagagaaaccaacttttcgatgcagtggtgtatcgaaaattttgtccaacatcgtacaatgaaacgggcaagggatattcgggatcagttggaaggactgctcgaacgagtggagattgagccgaaatcttcttccgacacaatggccattttaaagacaatcactgctggatatttccacaacttggccactttggacaagggcggtcaatacaaaactgtcaaacaccgccacactgtccaagtccacccaaattcttgtttgtttgaagaccgacttcgttgggtgatttactacgaattggtattcacttccaaagagttcatgcgagaaataattgaatgtgacccgaaatggatttcggaagtggcaccgcattactaccaacaaacccaattggaagattctgtcaacaaaaaaatgccgaaacaaatgggaaaagcaaaaagtgaactcgtcgggagttga

SEQ ID NO: 597 - DNA, 1048 bp, Heterodera glycines
  genomic DNA sequence=SeqID_311; coding sequence=SeqID_897
gataaacttaaaaattgggaggcattttctgaaaaaaaaaattcgaaaaattgaattataactttttgtacaagttcggtttcaatgttcagattggtcattaggcaaagggtccctccaaataacacgccctcaatcaacttataaagttgtatttagagacaaaaattatcgtaaatggctgtcggaaagaacaagaagatggggaaaaagggagcaaagaagaaggccgtcgacccatttacgcgcaaggaatggtacgacatcaaagcgcccgcaatgttcacacaccgaaacgttggcaaaactttagtgaaccgcacccagggaacacgcatttcaagtgactttctgaaaggtcgggtctacgaagtttcgttgggcgatctcaacagcacggacgccgactttaggaagttccgattgatctgcgaagaagtgcaaggcaaaatttgtttgaccaatttccacgggatgacattcaccagggacaaactgtgctccattgtcaaaaagtggcatacactcattgaggccaatgtggcagtgaagaccaccgacggtttcttactccgactcttttgcattggctttaccaaacgaaatgccaatcaaatcaagaagacgagctatgcaaagacatctcaagtacggatgattcgtgccaaaatggtggaaataatgcaaaaagaggtctcttccggcgacttgaaagaggtggtcaataagctgatcccggactccatcggcaaggacattgagaaggcgtgctccttctactacccgttgcaggacgtttacatccgtaaagtgaaggtgttgaagaagccgaagttcgagctgggcaaattgctggagatgcacggcgagggtgccggaacggtcgccactattacgacggccaccggagagaaaatcgaaagtcggccggacgcatacgaaccgcccgttcaacaaagcgtttaaatggtcagattgacaaaatggagatttatttgactgtttgcatccgaattgttttgctgttgttgttaaattgactttgttg

SEQ ID NO: 598 - DNA, 498 bp, Heterodera glycines
  genomic DNA sequence=SeqID_312; coding sequence=SeqID_857
atgccgaaacacgagaagggaacgccgaaagaaattgccaaccgtgcaaaggccaaagggctgcaaaagctcaaatggttctgccaaatgtgccagaaacagtgccgggatcagaacggcttcaagtgtcacatgatgagcgaaagtcaccagcgacaactgttgctttttgctgagaaccaaaactcgtatctgcgccagttcagccgcgaatttgaggccaattttatgcacattcttcgtcacacttttggttcaaaacgcatccgtgccaacgaagtttaccaggaatatattaaagacaaaggccatgtgcacatgaactcgacggtgtggcacactttgaccggctttgtgatgtatttgggcaagtccggcaaatgtaaaattgacgagaatgagaaaggttggcacattcaatacattgaccaggaggaggagttacgtcgtcaaaagttgcagcagcgcgccaaacaggaaaaggacgacgaggaacga

SEQ ID NO: 599 - DNA, 1682 bp, Heterodera glycines
  genomic DNA sequence=SeqID_313; coding sequence=SeqID_865
aagggcaatacatcgtggagcatttttcacagaaatgcggacaaccgatgtccgaaagttgaggccggaggcatggggatttatttgccctgtgcatacccccgatgggtcgccgtgtgggctgttgaaccatttgaccgcttcggccggtgttaccacgcacattacggaaacaaccaaactgaaacagactctgtcctcacttgggctcatcccgcacaatgccctgacttatcaccctaaagaatcgaagctttaccctgttgtgttagatggcgattttgttggttttatccctcgcaaaaaagctgcgtttattgaacgtcaattgcgcgcaatgaaagtcgcttctcatgatgatcgtgtgccagcatttacggaacttacgcttatcagacattcacccgactctgagaatattcaaatgcaattcgccgcgttttttatttacagcggccttggaagattgatgagaccagttaggaaccttttatttgatcaaatcgagcaaataggaatttttgaacaagtttacctttccattataattgaccccgaagaggcagaaccgggcgtaacaatgcaccaagaacttcatccctcgtctctgttctcattcgctggcaatttgattccttttcccgatcacaaccaatcgcctcgaaatgtgtatcaatgtcaaatgggaaaacagacaatgggggtcccagtccacgcttggcagacgcgtacggacaacaaaatgtacaaattgcaaactgcgcaaaaacctttactcaaattggaggcccatgacaaatacgaaatggacgaataccctctaggcacaaatgcgtgtgtggccgttatttcgtacactggatacgacatggaagatgcaatggtgatcaacaaggcttcgtatcagcgtggctttgcacatggaactgtcgttaaagtgcagaggatcagtttggttgatcgctccaccggtggttttggtcagagcaaaaatgcggaaatggtctttttggggaagccgaacgaacgcaattacggcatcggtgcggacggcctgcccattgaaggccgtctctaccagcagggcgactgctattacggcactttcaatttggtcagcggacaattcaacgagcacaaattcacgaacagtgagcccgcttattgcgggttggtgcgaattgtgcaggaggcggaccacaaaaacaaaaacgtgcacgtgttaatccaatggcgaatccaacggaatccgatcatcggcgacaaatttgcttcacgtcatggccaaaagggcatcaattcattcctttggccccccgagtcgatgcccttttccgagtcgggaatggtccccgacattatttttaaccctcacggttttccctcccgtatgaccattggaatgatgatcgaaagtatggccggaaaggccgcagcaatgcacggcacttcttacgatgcatcgccctttgttttcaatgagcaaaatacggccattgaacacttcgggaaactcctggccaaatccggatacaattattacggcaatgaaacgatgtattcggggatcgatggacgagaaatgaaggtccaaattttcttcggcattgtctattaccaacggttacggcatatgatagcggacaaattccaagtacgctcgacggggcccgtcgatccaa

SEQ ID NO: 600 - DNA, 1382 bp, Heterodera glycines
  genomic DNA sequence=SeqID_314; coding sequence=SeqID_908
gagacattgaaggcgactctcgacttggacgaaatatttggcaacgaaaacgaaggtggaaaatcggccggcagcagcagttcgtcgacgagttcttcgcgttcctccagccccgacttgaccaagtcacgttctccttctcccgaagtcaaacaagagattaaaacaagggatgaaattatccgttgccaacttttccggcgaaagctcgcgaaatttgttcatgctccgttcttcgctaaaacagtggtcggttgcttcgttcgcatttcaatcggtcccaacaaatcggatgggaagcaagtgtacagagcggctcaggtagtcgaagttgtggagacagcaaaagtttacgaagtcgagccgaacagtgacatccgtacaaacaaaggctttcgcctcaaggtgagcgatggcgagccaatgcgagtctatcggttggagttcgtctccaacagtcttattatggaaagcgagtttctgttttggttcaacaaaatgcggtcttcgaacacgcccatgctaaccgtcgactttgttgaccggaaaaggaaggaaattgtggacgcactcaactacaaatacaatgaggcggagatcaatttgctgatcaaagaaaagcagcgcttcaaaagacaaccgaccaatttcgcctttcaaaaatcggaattgctcagaatgaaggagcaagcagaacaaagcggcgatgtcgcgagggtgcgcgacttgcagcagcaagtcaacgaattggaagagaaggccaagaaaattgaacaccaaagaacgaagaacttaagtgccatcagtgccatcaaccagcggaatagggaccatatgaaacaaacattccttggtgccggaatggtgcgggaagagcaggagaaggacgacgacccattcacacggaagtcggcgcggatgaaagtggtctcgggatccgtgaagtccaaaaccgccggcgaaggaagtggcgccaatgccgagttatccgttatggacacgatggtttcttcgttgggttcgttgtcgtcttcgtcggagtcctctccaaacaaaaaagtgcaacttccctcaactcacgatttattcaacgcacatggaatcgacataaatattgacataaaaatgcccgccgtcgtcggcggttcgttgagagcgccgccaattaccgactcacaggcaccacgaacacaacagaagacgagcagctcgcggacactcacattggaagaatacaaaaagaagagaggacttgtgtgagaatggacaaatgggggagcgacccactgtaaacaattcttacgtcattttgtttcacatgaaattcatacttttcgtatttgtgtgatcgaattttctataccataaaagataccaagaca

SEQ ID NO: 601 - DNA, 1435 bp, Heterodera glycines
  genomic DNA sequence=SeqID_315; coding sequence=SeqID_916
cccgaatgccgtggtcattttcgatcggcctgaaaattcacagatgaatttgatcggtcatagtaaaggaaagtcgtcccatcgtgcgctggtcaatccagattgggacttccaacagttgggcatcggcggattggacaaagaattttcctccgttttccgccgcgctttcgcctcgcgggtttttccgcctgaattcatcgaacaaatggcgatgaagcatgtccgtggcattttgctctacggccccccggggacgggcaaaacgctcatcgcgcgacagatcggcaaaatgctcaacgcacgcgaaccaaaaattgtcaatgggcccgaaattctgagcaagtttgtcggcgaatctgaggcgaacatgcgcaaattgttcgccgacgccgaggaggaatggcgccgatgcgggcccaactcgtggctgcacataatcatttttgacgaaattgacgccaactgcaaacaaagaggatccatgggcggctcttctactggcgtccatgatacggtggtgaaccaactgctgaccaaaatggacggggtggagcagctgaacaacatccttgtcattggcatgacaaaccgcaaggatattatcgacgaggcgttgctgagaccgggacggatggaagtgcaactggaaatatcactgccggataagcagggccgcatccaaatcctgaacattcacacggcaccgatgagagaacacaacaaattggacagcgacgtaaacattgagcagatcgcaaaaaggaccaagaatttttcgggtgccgagttggaagggttagtccgtgccgcccaatcgtccgcaatgaaccgattggtcaaaccgggaggcaaagttcagcaggtaaaggacacaaatggacgaaagaaggaaaagccgaagggccaattcaggtggacgacgaagcaattgacgctgaatcggctgctgtacggcggtctttgcctgtggggcgactgcgtctcgcgagtgttggaggggggacgccttctgatcaaagagaccgctgcgcccgacacgcgcgggttcgtccgagctttgctagcgggtcctccaaacactggcaaatcctttttggctgcgcaaattgccaaggattcggagtttccgttcatcaaagtttgcactcccgaagagatggttgggtacagtgaagcggaaaaatgtgccaaaattcggaagattttcgaagacgcgtacaaatcgccgcttagctgtgtgatcatcgacaacatcgagcgactgatggattactccccaattggaccacgctactcgaacatggtgttgcaaacgcttcttgtactgcttgggaaacgaccaacccagaatatcgtctgcttgtcttggccaccacgtcgaatgagcagtttttgtacaaggccgacatgctcagcgtgttcagcaaagtga

SEQ ID NO: 602 - DNA, 1524 bp, Heterodera glycines
  genomic DNA sequence=SeqID_316; coding sequence=SeqID_917
atgcgcattattcttccttcccgtgcccatttattcgtcagggatgggttccgtccaattcatcccttgcgcagtttttctcggacggcgacgcaaaacagcagcaacacgacagatgtcgaccttgtcgtgattgggtccggtcccggcggttatgtggcggcaatcaaagcggcacagcttggcatgcgcaccgtttgtgtggagaagaacgacacgttgggcggcacttgtctgaacgtcggttgcatcccgtccaaggcgatgctcaacaattcccacttctatcacatggccaaacacggggatttgaacgcaagaggcgtcgaagtgagcccgacgctcaacttggacacgatgatgaaggcaaagttggcctctgtcaaggggctgaccagcggcattgccgcgttgttcaaagccaacaaagtgacacatttgagcggtgttggcacaatcagtggacccaacaaagtaaggacaaaaagtggcagcagcgatgtaatggaagtgaacacaaaaaacattctgatcgcatccggctctgaagtcacaccatttcctggcattgacattgacgaggaacagattgtctcctcaaccggagcattggcgttgaaaaaagtgccacaaaaaatggttgtgatcggcgccggtgtcattgggcttgaactgggcagtgtttggcaaaggttgggcgccgaagtgaccgccgtcgagtttatgagtgccatcggtggcgtgggcattgacggcgaagtgtccaaacaattccaacgttcattgaccaagcagggcatcaaatttttgatgaacaccaaagtgttgggtgcgcagcgaacgtccgatggacaggtcaaagtgcaggtggagacggtgaaggacggcaaaaagcaggagttgaactgtgacgtgctgctggtgtccattggacggcgaccgtacaccgatgggcttgggctgaacaatgtgcagctgaacacggacgagaagggccgtgtgccggtcaatgaacgcttccaaaccgcggtgccgtctatctatgccatcggcgatgtgatccaaggcccaatgttggcccacaaggcggaggacgaaggcattttggcggtggagggcattgcgggtgggccggtgcacattgactacaactgtgtgccgtccgttgtgtacacgcatcccgaggtggcatgggtgggccgagcggaggagcagatcaaacaggagggtgtcaactacaaagtgggcaaattcccgttcgtcgccaattcgcgtgccaaaaccaacaacgacgtggaaggctttgtgaaggtgatcggcgacaaggacactgatcggctgttgggtgtgcatatcatgggaccgaatgcgggtgaaatgattgccgaagcgacgcttgcgctggagtacggtgcctcctgtgaggacattgcgcgggtgtgccatccgcatccgaccctttccgaggcgttccgcgaggccaacctggcggcatactgtggcaaggcgatcaacagcatttga

SEQ ID NO: 603 - DNA, 1205 bp, Heterodera glycines
  genomic DNA sequence=SeqID_317; coding sequence=SeqID_923
gtgatgcgttctccatcaccgaccgataatgacaaagcgcgttccttaaatgcgtacagacgtaaattggccgaatataaagaaattgagaatcggcttaaggaattgcggactaaggaacgcgaaagtcacaaattgttcgacaagtcggaaaatgagattaaatcgcttcaatcggtcggtcaaattgttggcgaagtgcttaaacaattgacagaagagaaattcatagtcaaagcgaccaatgggccacgatatgtggtcggatgtcgtcggaccattgacaaggagaaactgaagcagggcacacgtgtggctttggacatgaccacgctgaccataatgcgccaacttccgcgcgaggtggacccgttggtgtacaaaatgagccacgaagaccctggcaatgtgagctatgccgaaattggaggtctctccgagcaaatcagagaactgagagaggttgttgaactgccgctgatcaatccggagttgttcaaacgcgtcggcataacaccgcccaagggctgtcttttgtacggaccgccgggcaccggaaaaacacttttggccagggcggtcgcttcgcagctcaactgtaactttctcaaggtcgtctcgtcggcgattgtggacaaatacattggagagtcggcacgaatgatccgcgaaatgttcaattacgcccgtgacaaccagccgtgcatcgtttttatggacgaaattgacgccatcggcggacgtcgtttttcggaggggacttcggccgaccgcgaaatccaacgcactttgatggagttgctgaatcagatggacgggttcgactcgcttggcaaagtcaaaatcatcatggccaccaatcgacccgacacgcttgacccggcactgctccgtccgggccgattagacagaaaaatcgaaattggactgcccaatggacagagtcgtcttgaggtgctgaagatccatgccaccaaagtgctgaaaaaagaagaaatcgattacgaagcggtggtcaaattgtccgagggattctcaggggcagacctgcgcaatgtgtgcacggaagctggactgaatgcgatccgaaaggagagggacggcgtggtacaggaggacttcatgaaggcagtccgtaaagttgcggacgccaaaaagttggagaccagtcttgactacaaacccgtgtgaaagggctgtaagca

SEQ ID NO: 604 - DNA, 807 bp, Heterodera glycines
  genomic DNA sequence=SeqID_318; coding sequence=SeqID_948
gtcattgactcgtccgatgtcgtcatcgaagttttggatgcccgcgatccgatgggtacgcgatgccgccaagtggaacagttcctgcaaaaggagaagccccacaaacatttgatccttgtgttgaacaaagtcgacttggtgccaaattgggttacgaagaaatggctccaaattctgtccaaggaaattccgaccatcgctttccacgcgtccattcagcatagtttcggcaaaggcgcattgatcaatttgctacgacaattttaccggctccaccgcaaggaacggcaacagatcagtgttgggatgatcggttatccgaacgtcggaaaatcctccgtcattaacacacttagggccaaaaaagtgtgcaaatcagccccattggcgggtgagacaaaagtgtggcaatatgtaatgatgatgaagggcatttacctgatcgactgtccgggcgtcgtttaccctccccacggggacacggaaaccgatttggtactcaaaggcgtggtccgagtggaaaatgtgcccgatccggagaatcacatccaaacagttttggacagagtccgtcccaaccatttgcggaggcactacaattttgtgaaaagtgaggattgcgaggattttatgaccaaaatcgctctttcctctggccgtcttctcagaggaggagagcccgacttaaacacggtggcacgtcaaattctgaatgattaccaacgtggcaatctcccgcattatgtggtgccccccgggtgcgagcggacattggcagacgacgacgacactaaaccggacgaa

SEQ ID NO: 605 - DNA, 2458 bp, Heterodera glycines
  genomic DNA sequence=SeqID_319; coding sequence=SeqID_977
aatcaaatttcaggggctattgatgtgattgttgtggaacaacctgacggctcattggcctccactccatttcatgttcggttcggaaagtacggcgtgttcaactacgagaacaaatacgtcgacattgaaatcaacggggaagagattgacctgaaaatgaaattgggagagaacggagtcgcctttttcttggcaaatgacgaagagggaattggcgagacaaaaaacgcggagggaaaggagtttttgagagaatcgcaaaacaaaaagtggagcgaagacacacaacagaacaatcggccgtcagcaattgacctggaaaaccaacggaaatgctcttttgcgagcagtagcagcagcaccagcagttgcacttcccaaccgcagcacaatgaatgcccaccaacggcgacgacaacagccgaaagaaagcaatcgacgccgccaaagcggtcaaaaatgttcaatccgtcctttctcaaccacaaggcgtccgtccaacagaaccgtcagcgactgcctttttcgtcgtccatttattcgtgccgaaggaatcgctctttgcccgatttggccaatttgttgtcgccttcgtcgaacatctacgactctgaaactgttgctgaagaggaggggatgggccgacggaagggcacaatgagcagccgaatggacgagttgagaaagtcggacgggacgccggaggtcaacaacgccctgaagcattccaattccgcatcggtgccgttgaagagttattataaacacgagtcagcaaaaactacccaattctcctcccctgacagtgacaagggacgggcagagggagaaaagggacagcgggcagaggacgacgagtcgaagagttgtgccccgtcgaccagcgaattggcggacggcgctttgtccgactcggaggtggacagacacggaagcattaaagatccagaatggaaatggggcgaaatccccaaatccaacgggaaagggtcgaacaaagcggacggaagtgcatcgaggaaaaaggtgagtcgatgggactattggtttggccgttggtcccgccaaaacaaagagaaggaaacggagggacggaccggcggtggcgaaaatggtctttcgttggaggacatcggcaacaacccggtcaaattcggcctttacatcggcccaagcaaaaccgaggccatttgcatttcctcaaaaagttcggacagcggaaatggaccttctcttggcaccagccccacaatgtcattctcgccggtgcttacaattagcgaagagaatttggcctccgaattcgcaaaaggcaacgtaacaattgcggacagacgcccttcgaatgcaatggacttcgaactgtttgaggagaaggcaaaagagaagcggtcgttgcgtctctcccgtgaccaattggacctgttgaacttgaactacgggtcgaacgacgcgcggttcagcatcacaacaaaatatcagggaactgcttggtgttcttgtcacatttatttgctcaaatggtatgacaaattggtcatctcggatatcgacggcacaatcacaaagagcgacgtgcttggccatgtcattccagcaattggtggcacttgggcccattccggggttgcagagctgtatactggcatcaaaaagaacggatatcaaatggtttatttgtcttcgcgtgccattggacagtcccactacacgaaaacgtacctgcagaacttcgcccaggggtccaggactttgcccgacggacccgtccttctctcgccttcttccgttctgatggcattcagaaaggaggtcattgaacggaaacccgaggagttcaaaatcgcatgtctcaccgacctgaaatcgctgttccccgtaggacagccattctttgccggatttggcaatcgcgaaacggacgttaaatcgtatcttgcggtccaaattcccccggaaaggatcatgattattgacccgcaagggtcgctcagaagggcggacaacaaagcgggtggttacgtgtccgattacccaaccttggccatggacagtgtcgactacgtgttcccgcctcgggtggacatggacggcatcgacattaggacgaaagaggacggcattttgagtgaattcgtcgcatggcgaactgacgctgaacaattcgatgcgctggtggacgcggaattggaacagtacgaagaaaggagcaaacgagcgaaagcaattgtcgcggggacgacggatggacgaggggcggacggaaagaagaaaatgtataggaacggaagacgggcaaagtgatcagagcaaaattatggatgattaattgacgaccataataggcggaatgcgggagaccaaccactcttttgtttggtttatgtaattaactagcctttgtgtcaactgttcaaatggatttgtctcatatcattaaaatttaattgatgaa

SEQ ID NO: 606 - DNA, 817 bp, Heterodera glycines
  genomic DNA sequence=SeqID_320; coding sequence=SeqID_1016
gaattgttggagcaacgggaaaagttggaacgggccgaacagaatttggacaccattcaccacaccactcagcacacacagcgcagcctgaacagcttgaaatcgtggtttggtgggctggtcagaaacaaactttcacgagcgccaaaagggttgggcacggcaaatgccaatgccaacaatcagcagcaacaaccggaacagaccgtgcagcaacaacatcagcagcgtccgctgcatgcccatttggtgcagtcgtctgctgacgaatttgccggggccatcggtggcggaggcggcggtgttcagcccccgcaacagcactcgctgaactcctcgtcacgcgcgtacattcagggcactcgttgggaggcgatggacgacgaaattgacaacaatttggatctgatgagtgcccatttgggccgactgagaacgtttggcgtcgcgctgggcgacgaggtgcaggaccaaaatctgatgttggaccgcattcaaaagaagacggagcgcaacgacggcgtcatccgctcgcaggaggaccaaatgcggaagttgctcggctaatggatgaccaattaacacgcctaattaatgaacgaatgagtaatgtgatggtgttgatctatggcactgtgccgactgaccaattaagacgaaatttgacttttgacgaccccccaaattaattggtattattgataatgatgattgatgatggatgatcaattgtttcgttgattgtcccaatttctctctcttttttctaccgctgccaccgctcactgacctttgtatttaatcggttaaataaata

SEQ ID NO: 607 - DNA, 2079 bp, Heterodera glycines
  genomic DNA sequence=SeqID_321; coding sequence=SeqID_1025
atgggaagcgattctttggagttctccaatatttttcaggaagagatgggaggattcaatgaaggctttcttaaattatcacgccagaatgtgcaattcaagaataaaggcactgggaaagtgttgacaattactgaatcggacattgaccatttgggatggcaaaaactggggaataagcccggcctgaaagtggtgaccaattcaggggtgcaccatcgttttggcggtctcaaagaaaacgactatgaaagggtttccgcttttacgaatgcgaaatggcaaaagactctaaagaagaacgaattgtctctgaaaggatggaattacggtgacgcggaatttgaaggtcaaaatctggttttcaatgtggctgaaaaagtggcgtttgaaattcctctttcaaatgtcatgcgctgtcaaaccgcaaaatcggaagcgatcgtcgaatttcatcctaacgaggaatgccctgtccaattgactgaaatgcgctttcacattccttacgatcctgagaatgaggaccaagatgtagttgaggagtttcgcaaagaagtgctgcgttttgcagaggtggaaagcgaagccggccaagcgattgccactttgtctgacattcttctcgccactccccgcggtcgttacgaaatcaaagtgtttcagaaccatttatcctttcacggaaagtcttacgattacaaagtgccgcttaaaacgataacacgaatgtttttgctaccgcacaaagacggacgccacatgtattttgtattgcacgtgaacccggcggtacggcagggccaaactcgatacccttttcttgtgctcgagtgctcaaaagaggactacattgagctcgaattaggctgcactgaggaacaactcgctcagcaatacaacaacaaattggacatgcacatgaagggttatctgtttgaaataatggctaaaatattccgtgtgattgttaattcgcgcattatcgtccctggcaacttcacgggtgcctcgggcactcccgcaatttcgtgcgccgttcgccagtcgatgggttttctttatccgctggagaagggctttgtgtacgtacacaaaccggcgctttacatgcgttttgaagaagttgacaatgttcacttcgcgcggtcggacgtttctttgcgctctttcgactttgaaattgtgcagaagagtggacagtcgatcatattcagtaacatcggaaaggaagagtataacagtctcttcgactacgtacagacaaagggactgaaaatacgaaatgcgcagagattgggcgagaaagcgtacaaagaggcggacaaatttgctggcagcagtgacgaagagttggacccgtacaaagagaagcttaaggacgacgcacgagagagagcggccgggtcggaaagcgactcggaggacgaggacttcaacgtggagaaagagatgaagaagcgcaaggcggacaaggactcgtcggaggggtcgggctcagaaccggacgaggaatattcggacgatgggacggatgtatccgacgatttgatggggacagataagggaaaggaaaaagagaaagaaggagccaaaaagaggaagaaggacagggaggagggaaaggaagagaagggaaaaaaggaaaagaggaaggaaaaggagggaaagaagggcgagaagaagaaggacccgaacgcaccgaaacgaaatcagtccgcctttttcatctggcaaatcgaaaaccgaccgcagatcaaaaagccgggggacagtgtgacggaaacggcggcaagggccgggcaaatgtggaaggctttgagcgctgaggagaaacagccttacgagcaaaaggcgaaggaggacaaagagcgatacgaacgggagatgagcgaataccaaagcaagaaaaaggaagcaggcgaagggccatcgtccgcgggacagaccagttcccaaaatcagccgaagaagagccaaagcagccccagcaaaaagcccatctcgaaggaatttgtggacagcagcaattcatccgattccgatgaatgtattaacccgaaaaaggatgacaaataa

SEQ ID NO: 608 - DNA, 1090 bp, Heterodera glycines
  genomic DNA sequence=SeqID_322; coding sequence=SeqID_850
gcctttctgaagaaagtcactcgggcgcgtgccaagcgtgagcatttgaagttggagggactgctccgtgccaagcccaccttcagctatgaccatttggtgcgcgaaaggtatccgacttttgcgtccgctctgtgcgacttggacgacgcgctgtgcctttgttttgccttttccgcactaactcagtcgaaaattgcgcggccgcgaacaattggccaatgccgccgggcggtcaccgaattcatgcattttgtgattgaggcgaaggctttgcgaaaggtgttcatctccatcaagggagtgtattatcaggcggagattttaggcgaacgcgtcacttgggtggttggacacgaaagggccgtcggacgcgccaacgaattggacttttcggtgatggccaactttgtcgacttttacctctgcatgctttgcttcgtcaatttccgactttacaaaacgctcggccttttccatccgccgcaattgcgccgccagcaaatgccatcggaaaacgacttttcgtttgaccattcaaatgagcttgacgagcgcgtctattcgctggcgtttccgctcaaacgcaccgacaaaatggacgccgacagttgcggcgaaccgtccatcattgacacatttgcggaggacgacgccgaaggcggtgaatcgctggcggagaaaatgcgtcaagcggaagtgcagaaaacactgtttgccaaatgcaaattcttcctgaaccgggaagtgcccaaggaggcgcttgcctttgtcatccgctccggtgggggcttcgtctgttgggacggatgcgccccgaattcggttgacgaacacagcgaacagatcactcaccaaattgtggacagaaaagtggagaagaccaacattaacagagtgtacgtgcagccccagtgggtgttcgactgtttcaatgcgcggcgcattttaccgccggccaaatacgcgccgatggccacgctgccgccccatctttcgccctttgtcgatgcacaacatttggaagtcggcgccggtgcttacattcccttggagcgcattgaacacgcaaaacaacagaatggaacgg

SEQ ID NO: 609 - DNA, 1177 bp, Heterodera glycines
  genomic DNA sequence=SeqID_323; coding sequence=SeqID_859
acatgatcggaggtctttttgtttataaccacaagggtgaggtgcttatttcaagaatttatcgcgacgacgtgaatcggaatgccgttgacgcctttagagtttcagttatacatgcaaggcaacagattcgttcaccagtgacaaatattgcaaggacttccttttttcacatcaaaaggggaaacgtttggatgtgcgctgttagcagacgaaacattaatgcatcgatggtcttcgaatttctcaatcgttttgcagacacaatgcaatcttattttggaaaactgaatgaggaaaatgtgaaaaacaatttcgtcctcatctacgaaattcttgatgagatccttgattttggttacccccagaataccgacccaggagtattgaaaacatttataacacaacaaggcgtccgaacagcgagtaaagaagaacaggcacaaatcacttctcaagtaacaggacaaattggttggcgccgagaaggcataaaatacagacgcaatgaactctttttggatgtcattgaatatgttaacctcctcatgtcgcagcagggtcaggtgctttcatctcatgttgcgggaaaggtggccatgaagtcttatctcagcggaatgccagaatgtaaatttgggattaatgacaaattgacgatcgaaggcaaaggcaggactggcactgacgacccctctaaaacatcccgcgcttcagttgcaattgatgattgtcaattccaccaatgcgtgaagttgaccaaatttgacaccgaacatgctataagctttatcccaccggatggcgagtacgaattgatgagataccgcaccacgaaagacatccaattgccattcagagtcattcctttagtgcgcgaggtgtcaaggaacaaaatggaagttaaggttgtgatcaaatcgaacttcaagccgtcgttattagcacaaaagattgaggtcatcattccaacgcctccaaatacaagcggagttcagctcatttgtatgaaaggaaaagccaaatacaaggctggcgagaattgcatttgctggaagattaagcgtatgggagggatgaaagagtcgcagatttctgcagaagtcgatttgctgaacaccggaaatgccgagaaaaagaaatggaaccgtccacccgtctcaatgaactttgaggt

SEQ ID NO: 610 - DNA, 1044 bp, Heterodera glycines
  genomic DNA sequence=SeqID_324; coding sequence=SeqID_880
atgaaaattgataaaattggcaattatttacaagatgagagagaaaaagagaagagagcgaaagaagtcaaaaataacaaaaaaaaagagaaaccctccaattttattcgtaattttttatccagattaatgcctgtgatgacgtctgaacatttggctactgattcaaaatgggtggaccgggagcgtgtgatgttgctttgttcacgaggatctttggccagaacacggcatttggtaaatgacttcaaaaggcttatgccgcatgttcatggcgaatccaaatatggaaaaaacggaaaaatggcagaagatttgaacgaaatgtgtgaactggcaaattgcaccacatgtttgtattttgagagtcgcaaaggccgtgacatttatttgtggctctcaaatgttgacggtggaccatctgcgaaatttctcgtttccaatgtgcacacgatgagcgagctgaatatggtcggaaattgcttgaaagggtcgaggccaattctctcctttgacccggaatttgatggaaaatcgcacttgaggctcattaaagaacttctcgtcaacacattcaaaacaccgaatcatcacccgcgaagtcagccgttcattgaccatgtgattaatttcgcagtgaccgaagatggaaatatttggttccgaaattatcaagttgccgaaaataatgaactaatggaaattggcccgcgatttgtgcttcaactgatccgtttgtttgacaattctttttgcggagccgtcctttatgacaacccgaattaccaaacgccaaatgcgatcagaagacaaatcaaattgcaaaaggccgctgaatttaaacaaagacaagggcaaagggaagaggggaaagtcaaagaacggatgatcaaagaagtggaaatggaagacccactgggggaagtgtttgacacggaagaaaaaatggaggaggaagagaaaacggaggaaaaagaggggaagaagaagaagagggtgaacgcagcaaaagcactggagaagagaattctgaagaagaacaaa

SEQ ID NO: 611 - DNA, 1538 bp, Heterodera glycines
  genomic DNA sequence=SeqID_325; coding sequence=SeqID_891
atggtatcgacaacaaatgagcaagatgaagaacaacaaaattggttgatgaaacaagacttgcaaaagctcaatccggaaaaattgacaccgctgacagaagaagtgatcagtcggcaggcaaccataaacattgggacaattggacatgtggcacatggaaagtcaacactcgtcaaagcaatttcgggagtgcatacggtcaaattcaaaaacgaattggaacgaaacatcactatcaaattgggctatgcaaatgcaaagatctttcgttgctccaatatcaaatgtccccggccgcattgctacaggtctgctgggtccagcactcccgaccgtttcccatgtgaacggcccaattgcggtggtgactttgtgtgtgttcgccatgtttctttcgtcgactgtcctggccacgacattctgatggccacgatgcttaatggtgctgctgtcatggatgctgcgcttcttctggtggccggcaatgagccgtgccctcagccgcaaacttcggagcatttggctgctgtggagataatgaagcttaaacaccttctgatcctgcaaaacaagattgaccttatcaacgagtctcaagcaaaggaccagcatgatcagatcaagagttttgtggaaggcactgtcgccgactcggcccccataattccgatttctgcccaacttaaatacaacatcgacgtcatttgtgagtatttgtgtaagaaagtgcccattcctccgcgtgacttctcttctgacgctcgtttgattgttgtccggtcgttcgacgtgaataagcccggctccgaagttgagcatttgaagggaggcgtagcgggcggttcaattttaaaaggcattttgcgagttggccaggaaatcgaagtccgacccggaattgtcactaaaagtgccgatggttctgtgcaatgccgtcccatctactcgcgaatagtttcattgtttgccgaacagaaccagctccagtacgccgtccctggtggccttatcggagtgggcactcaaatcgacccgacaatatgccgcggggaccgtttggttggccatgtccttggcgctgtagggactctgcccgacatttttactgacatcgaagtttcctaccatttgcttcgacgtcttcttggagtgcgcactgaggcagggaaaaaagcggcgaaagtgagcaaacttgccaagggcgaagtgctcatggtgaatattggctctctctccaccggaggtcgtgtaattgcagtcaaaggcgatgcggcaaaaatagcactgactgatccaatttgcactgaaagtaaccaaaatattgcattgagtcgacgcattgaaaagcattggcgtttaattggatggggcaccatcagaagggggacgaccatcgcagtgccccaaccatcgatcggataatttaaaaactattccaattgtaaacggtttttaataatgtgcgtgtttttgcttcctttcatgcatcttatttttgtggaaaggtactttgttgatcaaaatatacccataag

SEQ ID NO: 612 - DNA, 2246 bp, Heterodera glycines
  genomic DNA sequence=SeqID_326; coding sequence=SeqID_920
atgggcgtgctcactttgaacatcgaatgtcgcgagaagggcgtcaaaaagacaatgcaattcgaaccgcgcactttggtgcacgacgcgtgccgactgatcagagacaaattggggcatatgccgggcaatccgaatgattatggcctttttcggctggaggacaacccgacaaaatgtgtttggatggaaaatggtcggacattggaatattatctgatcagaaatggggacactttggagtacaaaaacaaaatccgccccctccgggtgcgcactttggacggaggggcaatcaaaacagtttttgtggacgaatcgcagcccgtttcgcagctgatggtggtgatctgctccaaaatgggcattgccaaccatgaggagtactcattggtaaggggagcatcgccggaggggacggacagcggagcggagaacggaatggccaagggcgaaagggaaaggacgccgtactcaaacggcggaacggacgaagcgcggccgaaacagcgcagcgggttggagcacacgttcatgaacacaatcggacggaagaaggagcggcaaattcagcagctgagggccaaattgcacacggacgccgaaattaattgggtggaccattccaagaccctcagggaacagaacatcggggaggaggaggagctgactctgcgcagaaaattcttcttctcggacacaaatgtggacaccagggacccggtccaactgaatttgctgtacattcaatgccgggacggcgtcttgcgggggcttcatcccgtctcgagggacacggccatcaaattggccgcgctccaatgctacattgaatacggcccttaccgatggaggaccctcgcttttagtgccaaaaatctgttgccgaaagaatatgcgaaggccaaggaattggagaagaatattatccaagagtaccgcgagttgatgtatgaagactcggccgcgcccaaaaagaaatactgcgaattgtgccaatcgttgcccacttacggcgtcactttcttcttggtaaaggagaaattgccaggcaaaaaccgactgataccgcgactgctcggcgtcaacaaagattcggtgatgcgagtggacgaacggaccaaagcggtgctgaaggaatggccgctagaacaggtccgtcgatgggccgcctctttcaaaacgttcactctcgactttggcgactataaagacggatattattcggtgcaaacgctcgagggcgaacgcattggacagctaattggcggatatatcgacatcattctgaagaaaaagcgcattgtggatagtggcggaattgagggagacgaaggggcgacgatggtggaggacattgtcgcgccggccaaagcgactctcctcgcccacagcgatctcgcgccgccttaccccgcccccgaggggtatttgccccacggggcattccgtccgaccgccgaaacaccggctggagctccgcagtacggcggtgtcagtgggatgataatcgcacaagaaattccaaaaggggaacgaattcgctatttggacgcacgagagcgaagtcaaaaggcattggtcggaacgatcgaagcgacaattcgagcggtggaagaagcggaggaggaaatccaaaagccaccgcaaatcgaattgccacagtttggcgaaacgcaacggcactggcgagtggaggtggagaaggaggcggtcagcgaccgactcgccgcgatgggagccgcgacggcggaggttgttcaattgaccgcaattcccgaagaaactttggacacgcgcgttgggcacgcaattgcaacaattggctcgaatattccggaaatgggccgcggggtgcgccaattggccgccattatgccggacgaaagccgtgccggcgatttgatggacgcggcgcgaaaattgtgcaacgcttttggagactttttggagaaggtgcacccggagaagcaggagaaacgcgcgacgattttgtcggctgcgagcagagttggcgaactttcgcacgacatgatcagcacaatgcacgaacagacggaggaggagcgtactttccacgaggaactcaaccgcagggcacgcgcagttgccacgagcacggcacagctggtgcttcaagccaaaacggtgtccgccgaatgtgaggagccggcactgaaggaccaagtgattcacagtgccatgaagacggcatttgccacttccgaattggtcgcgtgcactcg

SEQ ID NO: 613 - DNA, 1188 bp, Heterodera glycines
  genomic DNA sequence=SeqID_327; coding sequence=SeqID_982
atgctcgttgtcatcatccatccagaacaatggaacggcggctccgaccgatgcacaatcggattgctccgacactttgtccaagccggtcataaggtgttctggctgaccacaatgattgacacttattgggcatccgaggatttccacggcgttggcactctgttcgcccatatgcccctccatccgggcgattggtacacacagaacaccgccttggccctttactatctgttctccaagcgtggcatgggctcgcccgatttggtggtggtcgaccattccgcctcgtgcgtccccctgctcaaatggttcttcccgcgctgccgcgtccttttctactgccatttcccccaacaactcgtcactccgtcccgctttttcctctaccgttggtacgcttatctgatgggtttggtggagggtcgtctgttcgaatacgtggacattgtgttggtgaacagcgaattcactggtcgccaatttcgccaagtaatgccaaccgtttcgaatgccaaaatccgcgtcgtttacccgccgtgcgacgtcgactcgctgcgttgcgggtgggtgcgtccgattagtcgtgcggaccgtccgcccaacgaacgataccttttcctgtcaatgaaccgtttttggcctgagaagcggctggaaattattatagaggcggctgctgagttaaaacgccgcgggctgcggccgcgcattcaaatggccggctctgtgatgccgcacattcccgagtctcgaatatactaccaagagttgcaaagtcactgcaaacagttggagctggacgacctgatcgaatttctgcctgacccaactgatgaacgcaagttcgagctgtatcggcagtgcgattctgtgatttacacgccccccaacgaacactttggcatcgtgccaatcgaagcgttggagcagcgacggcccgtcattgtgaacaacagcggagggccagccgagacggtgttggaggacatcacggggacacgaattgccgacacttgcggtgttttgctggccaatgcaatggcatcgcacatgggccgcaaagaatggccccaactcgacaaggacgaactttacgcgaaacagcgcattcgcttcgatgaaaaatttagttggaagggattcggacgacgcgtggacgaagcaattgccgaattattttcggtg

SEQ ID NO: 614 - DNA, 2608 bp, Heterodera glycines
  genomic DNA sequence=SeqID_328; coding sequence=SeqID_985
tgacgaagaaagttgtgcaccacgtgaaggccattgtgcacaagaccagttcaagtgccatacatcgggcatttgtataccaggcacatggaaatgtgatggccaattggactgtgacgatggaagtgatgagccccgagcgacctgtgaggagatgcacagcacatgccccgctggtcatttccggtgcaacaatggacggtgcattttctcgacatggatttgtgatggtgaaaatgattgtggtgacaattctgatgaacaaaacaattgcccgaacagtgcagcaacattcaaatgtccatttgaaacaatttcttgcaaaagtgccccggagcaatgcattccattccatcagctttgtgatggaaaacaacattgcattgatgggtcggatgaaggtggtcgatgctcacgcgatttgtgtgtggctgatcgtgccgggtgccaatacaaatgccacaattcacccgaaggaccaatctgttcatgtccgttgggcgaacagctgatcaacaagacaaaatgtgagccagaaaatgagtgccttgacccaagaacatgttctcaacactgtacggacgagaagcacggtttccggtgcagttgtgatccggcatatgagcttgagccggacaagcggacctgcaaggtgacagaaaaccgtgcggacatgcgtgtgtacgtgtccaacaggaatcgcatttattggtcggacagttcgctggagaattggcgcacttttgctgcacaagtggagaatgcggtggcattggcctgggactcagtggacgaccgtatctactggtccgacatccgggacaaacgcatctacagtgccacccggaacggcaccgacgtgcagacattcatcggcatcgggctggacatcacggagggcattgcggtggactgggtgggccgcaacctgtactgggtggactcctcgttgaacaccatcgaaattgccagcctgcaaaagccgggagttcgtgccgttctgctccatgacgacattgatcagccccgagggttggccgtcgacccgcgcgtggcactgatgttttggaccgactggggccaacacccgcgcattgagcgtgccaacatggacggcacgggccgaaccattttggtgaacacaaaaatttattggcccaactcaattgcgctcgacttcaccacaaatcgtgtgtattttgctgactcaaagctggactacatcgactttgtcaattatgacggaaaaggtcgtacccaagttattgcaaacagcaaatttgttcaacacccacacgcaatgtcaatctttgaggacttcatttactacagcgatcgacgactgcaacgtctgcaactgtatccgaaatacccgaacggcaccaaccaagattatccgtcccacacattctccaaggcacttggcgttgtcactgttcaccccgttttgcagccaaagctgatgacaacaagcgcatgttccgtctcgccaatcccatgctcgcacatttgtgcgcttggcaacaacggcacatacacatgcatttgccctagcggaatggtgctggacacggacaagcaccgctgcgttgctgaccatcgtccgttcctgttgatggtattcaaaacgatgatcaccggcacatcgttggccggcggcgcaaaagacagcacggcaaaacaacgtgccgaaatggccggcattacaccaatcagtggcttacagaatgcgcatgatgccgactttgatgcccaaacacagaaattgttccacctggagcatggcagcatggcaaggctggtcatggccacagtgatctcggatgcacgaatttacaaaagtgggtttcttggaaacaatcgcactcagctgttgacggctcaaattccgaatgacccattttgcatggcgtacgattggaacgggcgcaatttgtacgtcggcaacaaaatttcgcaaactatcgaagttgtgcggacggaaggcgaacagttccgggcggtgatcctgcacaatgatcaaacaccgaccgcggttgcgcaacccattgccattgcggtggattctgatcggggcctgctgttttggcttgaccaaggcaagggcggtgtggccacaaaggtggcacgtgccgacatggacggcggcaacccattggtgttggtgaacatcgacctggccgagctggaccacctggcgctggacacggtcaaccaccgggtgtacttcacggaggccaaagctggaagaatcaccagcgtgtcgtatgaaggacaggacaagcactatttgctgaacgatccggcaaaacagccgcgtgccattgccttcttcaacaaccgcattttctactccgactcggcatttgacaaaatatttgccggcgaatttgttggcgatgagcaaccgcccgaattttccgaattccgtgccaatgttgaacagttgaacaacctgaaaatcatccaccccagcacggaaaagcatccttgccatgaaaacaacggtaactgtgatcagctctgcattcctggacagcacaaaaaattcacatgcttgtgcggtaccagtttcacgctggacgaggacaacaaatgcaaggtgttt

SEQ ID NO: 615 - DNA, 1218 bp, Heterodera glycines
  genomic DNA sequence=SeqID_329; coding sequence=SeqID_1007
atgtccgctgtttctccgtcttccgttgtccatttgggccttccccgtccggtcgatgcgtcccaacttttctctttggaacgccatttcctccccctgggcaaatgcggcggtcaccccgcgtggcttaaccccgccaccattccgcaaagtgcagaattggcatgccaagtttgcggctctccgatggcatttctgctgcaagtttattgtcccgacgaaccctcccacgcattccatcgcaccattttcattttcgtctgtcggaaagggaattgttcaaaaataaatgccaccccaaatttcgccgcctttcgttgccaattgtcccgtgaaaatgcttttttctccgctgagtcggccctttgtccgtccgttgtcggcgaagtgtccgaccctttcttcgacccctcccttttcgcgcgcctttgcgtggtctgcggttgtcgcgccgccagccgatgcgcgcgctgtgcccggcggtggtattgcggcagagagcaccaaataattgattggaatacggcacataaaggcaaatgcgaacagaagtcgacagaaaatggggcgacggcgaaagacggcgacgagagggacggcttcaccctcaaagagtttggcatcgaattggaggcggaggaggaggaaaaaagtggggacggagaagagaacgaaggggacgaagaatcggaggaggaaagcgaaagtgaagaagagggggaggaggaggagaacagacggaaaatggccgaatttgagaaattcggaattgttaagaaaatggcggaagcgaacggagtgagtgcccgcgacgtggacggattggaagagagtcgccgcgacggcgccttcgcccgcttcagcgcggcgctcgcccttcgccccgagcaaatcctccgctaccgccgcgcgggtgtccctttgctcgccacggaccattcgcccggtccaccgtccgttgtgcccgcgtgcgaacgatgcggcgaaccgcgacaattcgaaatgcaattgatgcctaatttggtggcactgatggaattggactcggtgggacaaagcgtcgattgggccacgcttttggtgtacacttgcggagacagctgcccgggggaagaatacgcgagggaattcgtgttcaagcaggactttgtcatcccagcagaaacggaggaaaacggagcaaaaacgaaagagcggagaaataagaaaaagtgttga

SEQ ID NO: 616 - DNA, 3536 bp, Heterodera glycines
  genomic DNA sequence=SeqID_330; coding sequence=SeqID_856
tatttcatcgtcgaagtgaacgcgcggctgtcccgctcctccgcgttggccagcaaagccaccggctacccactggcatacatcgcggccaaactcgcgttaggcgagtctttggtcacgctgcgcaacaccgtcacgcgggacaccaccgcgtgctttgagccatcattggattactgtgttgtgaaggtcccgcgctgggacttggccaagttcgcggacgtcaacagaaagattggttcctcaatgaaatcggtgggtgaagtgatggccatcggtcgttcatttgaagaagcgttgcaaaaagcgtttcgaatggtcaacgaccacaacgatggcttttccccgcacattttcaaggagaaagtcactgaaaaggacctttgggacccaacggacaagcgaatgcaggcggttgcacgagcactgtacaccaacgacgaatttgtgcactttttgcaccaatgtacacgcattgacaaatggtttttgtaccgtatgaaaacaattgtggacatgtaccgtacgctggagggccaggaaatggaatatgtttcgccggatttgctcctccgagccaaacaattgggcttttcggacgcccaaattggcacatgcattggccgaaatgaggatgagatccgtaaactgcgccatctccattcaattgtgccgatggtgaagcgcattgacacggtggcagcggaatggccggcaaagaccaattatttgtatttgacatacaacggggcagaacacgacattgagtttgagcagaaaaagagcaacagtgtcattgtgctcggctcgggcgtttatcgcatcggatcatcggtggagtttgatgcttgcgctgtcggttgtgtgcaggagttgaagcggttgggcttcaaaaccgtgatgatcaattgcaacccggagacggtgtccaccgactacgatatgtgtgacagactgtactttgaagaaatttcgctcgaggttgtgtccggcatttacgaaaatgagcatcccaacggcatcattttggcattcggtggccaagcggccaacaacattgcgctgtcgcttcagttggcatcgccaaatctgacggtgccaatcaaagtgttcggcacaccgcccaaatttgtggacgaggcggaagaccgcttccagttcagtcgggcacttgacgagctggacatttcgcagcccaaatggaaaaatgccaaatcggtggaggaagcggtcggccaatgcgctgccgaagtgggcggctatccgtgcctgattcggccttcctacgtgttgagcggagccgcgatgaaagtagcgcacaatgaggaggacttgagcaattttctctctgaagctgcgttggtggcacgtgacaagccggtggttgtgtccaaattcattgaaaatgccaaagaaattgatgtcgatgcggtggcaattgggggccgtgtgttggtcagtgccatctctgaacatgttgagaatgcgggcattcattcgggtgatgccacactgataacaccgccccaagacctgaacgccttcaccactcgaaaaattcacgaaattattcgtcacattgcgcgacgtttcaacgtcaccggaccgttcaatttgcaactgatcgcaaaggatgacaatttgttcgtcattgaatgcaatttgcgagtgtcacgcagtttcccgttcatctccaaaacgttggacatcgattttgtggcgttggcaactcgggcaatgatgtggacgcaagagccaaccaaattcatccaatccttcacccgtcctgaacagtccaacaacaaagtgggagtcaaagtcccccaattttcattttctcgtctcaccggtgctgatgttgttatgggggtggaaatgctgtccaccggcgaggttgcttgtttcggccgcacacggagagaggcctatctgaaggcactcctatccaccgggttccaattgccaaaacgggtcatttttctctccattggctacaaacaacgggccgaaatgttggagagtgtgcgcatgttggaccgacttggcttcacactgtacggcagcaaaggcaccgccgattattacgcctccgaaaacataaagattaagaatttggaatggccatttgaggagaaggacaattaccatgtgtacggtgccaaaatgaatacggtggccgaatttgtggagaagaaaatcatcgatttcatgatcattttgccaatccgaggcagcggcgcgtaccgtcccggcgcataccgtacccacggctacaacacccggcggatggcaattgacaacggcatcccgttgatcacggacatcaagtgtgccaagctgttcattacggtaatgtcatggatgagccgtttgcctccgatggacgccagcgttgactgtctgtccgccgagtcgttggtccgtctgccgggcctcatcgatgtgcatgtgcacatgcgcgagccaggcggcgagcacaaagagacgtgggaaagcgggacacgggcagctgttgccggaggcgttacgatggtgctcgccatgcccaacactcagccaccgctcgtcgatgaacaaagctttgccatcgttgaacaattggctgcccgtgctgcactctgtgactacgctttgtacatgggagcaaccgagcaaaatgtggcacttggtccaactcttggaccgaaatgtgcgggtttaaaaatgtacttgaacgaaacctttgccgcgctccgtctcagttctgttgaacaatggatggaacacctgcaccatttccctgcccatcgcccaattgttgtgcacgcggaaggccaaacactggcagccctcctcttcgccgcccgcctgtgcgagcgcagtgtgcacgtcgcgcacgtggcacgtgcggaggaaattgcactgatccgtgccgcgcgccgaaacggccagcctggcgtgacgtgcgaggtgtgcccgcatcatttgttcttcacggctgacgacttgccggagggcatgcgcgaagtgcggccccggctggccaccgcgcggacggactgcgaagcgttgtggcgacacattgacgacattgactgtttcgcgactgaccacgccccccatacacgggcggaaaaatgttcggacaatccgccgcctggcttccctggcattgaattcatgctcccattactgctccaagcggtggcggacggtcggctgaccatgcagcaactcgttgaaaaactgcatgacaatccgcgacgaatttttggcctacccgagcagcccgacacttacattgaggtggaaatgaacgaagtgtggacaatccctgagagcggtggctggagcaaagcagggtggacaccgtttgctgggcttcaagcgcgtggccgcgtgtgcaccgtggtcatccgtggccagcgcgtgtatgacgagggccaattcctggttgggcccggctttggccacaacgtgcgattgttgcccggcgccatggcggccaccgcctcaaatttgccatcgccgtcgccagcagctgaattgacggcagc

SEQ ID NO: 617 - DNA, 1549 bp, Heterodera glycines
  genomic DNA sequence=SeqID_331; coding sequence=SeqID_876
ctgtcgtggtccgcatgtccgggacactggcaaagttaaggcgattgccgtcaccaaatcgtcgtccgcccattgggagggcaatgtgaacgcggagccgttgcaacgcgtctacggcatttccttcccggataccaaacagttgaagcaatggcgcatttggcaggaggaggcggccaagcgggaccaccgcaaattgggccgcgaccaggaactgttcatgttccacccgctgagtccgggcactgccttttggtacccgaaggggacgcacatttacaacacactgctcgagttcatgcgacgcgaataccgacgccggggtttccaggaggtaatttctccgaatatttataacgcaaagctgtgggagcagtccgggcattggcaccattatgcggagaatatgttccggttcgaaattgagaaggagcagttcggactgaagccgatgaactgtcctggacactgtctgatgttcgactacaaaccgcacgcctacaacgaattacccatccgttatgccgacttcggtgtactccaccgcaacgaaatgagcggcgctttgtccggtctgacgcgcgtccgtcgctttcagcaggacgacgcccatattttttgccggaaggaccaaatattgtcggagatttcgggctgtttggattttctgaattttgtctacgtggaagtgttcggcttttccttccgtctccatctgagcacgcggcctgaagagggctatttgggcgacttggccacttgggaggcggcagagacacagctgaagcaggcattggacaacagcggactcaaatgggagctgaacccgggcgacggagcattctatgggccaaagattgacattcaaatcaaagatgcgttgggcagacattggcaatgtgccaccatccaattggacttccaactgccccaacgcttcgacctttcctattacgatgagaacaaagagcgtcttcgtccggtgatgatccatcgtgcaatttacggttcaatcgaacgaatggtggcaattttggcggaaaattgtggagggaaatggcctttttggctgtcgcctcgtcaggcaatgattatcgttgtgcaccattcggtgagtgactacgcgagcaaagtgttccgccgcattttcgacgcgggcttcgaggtggaatttgacgaggacagcccggacacgctgaacaaacgcattcgcaatgcccaactcgcccagttcaacttcattttggtgatcgggcaacaggagaagaacaacggaacagtgaatgtgcgcaccagggacaatcaggtacgcggtgagattgctgtcgatgcgctcatccaaaagttccaaattttccgcgacacttttgcccaagacacagaaagtgcaggatcttttgaaggcccgaaggaacaaaaagaaattttggatgacaaaaaatgaacaatggcattgcaatttcattttcgacgggtttttgttgttaacaaattgtgaaatgttccatctggttttttgtttgtttgttaattacaacttgtgagccca

SEQ ID NO: 618 - DNA, 1139 bp, Heterodera glycines
  genomic DNA sequence=SeqID_332; coding sequence=SeqID_924
cacaatcttatctacctagttattttttcatttgatcaactacacgattaaaagcgtcaatcatgggcaagggattccaaaattttatgtccaagaaggacttccatccaagtgcatggtggaacttaaaaaggaaatgggaagctgagcaaaagaatgacttggagaaaagaagacaggatgaattgcgtgtccaatatgagaaggagcaagaaattctcaacaataaggcacttcttggtgacgaaaaagcgaggttgggcctttctttcatgtacgatgcgcccgctggcattaacaaaaagaaggaggaagggccggaaccgaaattcgaatggcaaaggaaatacaatgcaccgcgtgaagaatgggcgaaaggaaatgaactcatccaggaccaacctttcggaattcaggtgcgaaacgttcgctgtgtcaaatgtcgcgcgtggggtcatttgaacacggaccgcgaatgcccactgtatggtatgagtggaaatgctgaagaccatggctatgcaaataatccctccgatatcattcgtgatttaaatgtcgaaaagaaaacaaagactgtctctgatgtcacgaccaatgagcagattgatataaaaccgaaaattgaggtgcgcaaaagctacgaagagaagaaaaagaagcgacaccattactcatcggaagaagaggaagaggggacggaagaaaagaagccggaaccgatcgatcaggaacaattgctggtgaacatgcgtgaggagcacaatttgaagttcaagaccggcattctgattggtcttcgagcggacgaacacataaaaaaaatgtcagcgatggttggaggaggagaggaaaaaacttttgaggcttttctgaaaggactggatgagaaaaaacgaagaaaattaatgaaaaaaatcatgaagactgaagtgagcgatgactccgatatcgagaaggacaaaaaacagcgaaggaagcaaaagaaggaggaaaagcgcaaggcggacaaaaaacacaaacatcgcaggtcgtcgagtcgggagaccagcagaaagcggaaggaggggaagcaccaccgccactgaaaaggggaagcggactcattcttcggattgccgccatttgtataataaaat

SEQ ID NO: 619 - DNA, 1131 bp, Heterodera glycines
  genomic DNA sequence=SeqID_333; coding sequence=SeqID_957
attccgttcagctaccgtatgcgctacttggatctgatcgtgaacccggaagtgcgtgacaagttcgtgacgcgcgcaaaaattatcacatttttgcgcaaatatttggacgcgctcggctttcttgaagtcgaaactccgatcatgaacccaatcgctggcggtgcgactgcgaaaccgttcaccacgcaccacaacgacttggacatgaagctgtacttgcgcgtggcgcccgagctgtaccacaagatgctcgttgtcggtggcattgaccgagtgtacgaaattggccgcctcttccgcaatgaatgcattgaccaaacgcacaaccccgagttcacctcctgcgaattttacatggcatttgccgactacgaggacctgatgcgcatcactgaggatttgttgtctaaaatggtccactccatctttggcacccacaaattgacgtaccatcccaacggcactgacaaagagccggtctatgaactcgactttacgcctccattcaaacgcatcaacatttatgacgaattgagcacaatccttggtgttcaattgcccgacgctgacaagctggacacgcctgaggcacgcgacttttttgaccgtatcgccactgaacacggcgtggactgtacacagccgcgcagctgtgctcgcctgttggacaagctgatcggcgagttcatcgagcccaaactgatcaaccccacctttttgactgggcatcctcaaattatgtctccgttggccaaatggcatcgctctcggcccggcctcaccgagcgctttgagctgttcgcatgcaccaaagaattgtgcaacgcttacaccgaactgaatgacccgctgcgtcagcgtgaactgtttgaacagcaggcgaaagctcgtgaggctggcgatgacgaggcccaggcggtggatgagaatttctgcaccgcgttggagtacgggttgccaccaaccgccggctggggcatgggcattgaccggctgaccatgatgctcaccgacagtcacaacatcaaagaggcaaaaattatttttgaaaatgaaaaatttgtcaaaaaaaattttatagaaattttgcaaaaaaaaaaaaaaaattatgtaggctttgaattttaa

SEQ ID NO: 620 - DNA, 509 bp, Heterodera glycines
  genomic DNA sequence=SeqID_334; coding sequence=SeqID_973
gatagtatttttgtaatcaaaaataaggcaacattcacaatggtgcgaatgaatgttttagccgacgctttaaagtcaattaacaatgctgaaaagcgtggcaagagacaggtgatcatccgaccgtcttcaaaggtgatcatccgtttcctcacggtcatgatgaaacacggctacattggcgaattcgaaattgttgatgaccatcgtgccggcaaaattgtggtgaatctcactggacggatcaacaaatgccaagtgatcagtcctcgtttcgacattcgaatggccgacttggagaaatggaccagcaatttacttccatcgcgtcagttcggttttttggtgctcaccacttcggctggcattatggaccacgaggaggcacgtagaaaacacgtgggagggaaaattctcggtttctttttctgatgtgaccgacgtttgttgtttaagaaaatgtctttgttcgttattgctgttgttggttggataaaaagatgttaaaa

SEQ ID NO: 621 - DNA, 522 bp, Heterodera glycines
  genomic DNA sequence=SeqID_335; coding sequence=SeqID_993
ctcaatttttatttttggaattccaagagccaacggtcagtaagcgcgatgaagcttgtccgctttttgatgaaattgtcccatgagtctgtgaccatcgagctgaagaacggcacacaagtgagcggtgctattcagggcgtcgacgtggccatgaacattcatttgcgctcggtaaaaatgacagtgcgtggacgagagcaaatcagtttggacacactctccatcagaggaaacaacattcgctatattgttcttccggattctttgccattggacactttgctcatcgatgacgagccgcgcaagaagcccactcaacgccgatttggtggccgtggaggacgcggtgggccgcgcggacgtggacgaggccgcggagggcctccacgcggcggcggcgggggacgacgctgatgatggaccacaatgggagaagggatcagtgtctattgttgttgttcatttcaaaccactggctgaacatctcatttatttttctgatataaaatggggttactc

SEQ ID NO: 622 - DNA, 593 bp, Heterodera glycines
  genomic DNA sequence=SeqID_375; coding sequence=SeqID_939
gtcctaccaaaaatagacattaattaacacaaaaattaacgacagcaccaaatctctgttataataagcattttgagtgcaaaatggccggtatcgcagcaggaagactgacggaggagcggaaagcctggcgcaaagaccatccattcggtttcatcgcacgacagtgcaaaaaggaggacggcacattggacctgtacaattggatctgtgccattcccgggcccaagtcgaccatttgggaaggtggtctgtacaaattgcgcatgatcttcaaggacgacttcccatccacgccgccaaaatgccgttttgagccgcctctcttccacccgaatgtttatccgtccgggacggtctgcttgagtctgttagacgagaacaaagactggaaaccgtccatcactgtgaagcagttgctgctcggcatccaggaactgctggtgtcgcccaacccggaggacccggcacaggcggaggcgtaccaaatttatgtgcaaaatcggcccgagtatgagcgtcgagtgcgcaaacaggcccaacagttctcggaggaccaggtgctgaagcagttgttgacggacgacagctga

SEQ ID NO: 623 - DNA, 1113 bp, Heterodera glycines
  genomic DNA sequence=SeqID_485; coding sequence=SeqID_962
atgcggccaccggttgacgaggattatcgcccgatccgcgtacttggccaaggcgcgtacggcgaagtttggttggtgaccagcaaagaaaatgagagagagcagttcgccatgaaaaaaattcccgttaaagcgacggaggagggaattccgcagagtgtcgtcagagaggtcgcttctctcgtcgcactcaaacagatgaaacacccaaatattctcaggctccacgacgcattcattcgccgaaagggcggcaccatcagtttgaacatcgtctgcgaaaagtgcgactgggacttgtgcgactttttgcgaaaaattccgaaaaatatgtgcgacgcgcagtgcaaatattttgcacgtcaaataatgacgggcattgatttccttcatgccaacagtattattcaccgtgaccttaagcctcaaaacattttggtgaacaaagaccacactttgcggatcgccgatttcggactgtctcggaactacggtctgcatgccaccttcaccaccgaggtggtcaccctgtggtaccgtagccctgagctgctgctccagtgcaagtacggtactgcggtcgatctttggtccgccggttgcattttggcggagctgtacacgcgcgacgcgctcttcagaggggatacggaggcggagcaattgcgcatcatttttgaaaaactcggcactccgtccgtctctgtttggcccgccgatgcaattgtccctcattctttctacgccgaaaactctccgcacataacacctccgtttgccaatcagatgccccaatatttgcccgcctccggtgttgagttgctcacggcaattttgcaatttaatccgcacgaacggccgactgcggttgaatgtctgcagcacaaatactttgtctgatcactgatcgcgggaaatgttcatttccgctttgttttccgcccatcgcttactaattaatgatttgactttatcccccattgatgaccgatcacagccaatggccttgctttcatttttttttagttttgccatacatttaatcacacatttttaaaccaaaaattttgtaaagctatttgatttgtaatattaaattctctgtattatgaa

SEQ ID NO: 624 - DNA, 556 bp, Heterodera glycines
  genomic DNA sequence=SeqID_376; coding sequence=SeqID_991
cagcagtccaaaaacaaatttcaccagcaacaccagcaatgatttaccaccgatttgttgagattggccgtgtcgtttacattgccaaggggaaggaccaaggcaaattggcagtcattgtgaatgtcatcgacggtaacaaggttttattggacggcccctcctcgggtgtgcctcgcggtgtttggaatttcaaagacttgcagttgacaaaattcaccctcccactgcgtatcggccaacgtacgaaaggagtgcgcgaggcttatgaaactgccaaaatcaacgagttatggcaaggcactgagtgggcaaagcgcattgatcggaaacagaagcgtgccgggctcaacgacttcgagcgcttcaaagtgttcaaagccaaacagcacccgaaacccgtttggtccgcgttgagatggctaaactgaaaaagatttcgaagccgacagcgaagtaaatgactgaatttggcctgatcatattttgaacacacaaatgccgtcttttttgttgatgaaattatttgttggagttaaattgttttttaattcaa

SEQ ID NO: 625 - DNA, 658 bp, Heterodera glycines
  genomic DNA sequence=SeqID_377; coding sequence=SeqID_873
gaaggttttgtctgttccaaaagccaaaaaatcaaaaaagcattcgttgacaaaatgggcatttccgacaacgatgtccaaaagcagcttcgccatatgatggcatttattgagcaggaagctaacgaaaaagcagaagaaatcgacgcaaaagcggaggaggagtttaacattgagaaggggaaattggtgcaacagcaaaggcagaaaatcatggaatattacgagaagaaagagaagcaagtggagctgcagcgcaagattcagaggtcgaatatgcaaaatcagagtcggttgaaatgtttgaaggcgagggacgaccatttgaaaaatgtgttggaggaggcacgcgccaatctcagcaaaatttcggcggacagagagcgctatccggccattctcaaaggacttttgcttcagggccttttccaattgctcgaaagcaaagttgtgttgcgatgccgcaagaaagacgaggaaatggtggcgaggattttgcccgaatgtttggaggaatttcagcggacggtgaaaattgacaatgagtactttttgtccccggaaagtgcgggcggcgtcgaattgttggccaaagacggcaaaatccgcgtctcgtccactttggaagcgcgtctcgacctcattgccgacaaagtca

SEQ ID NO: 626 - DNA, 574 bp, Heterodera glycines
  genomic DNA sequence=SeqID_486; coding sequence=SeqID_989
atttacctttttttgtttcacagaagcgccccttcaaaacacttcgctgtccgtgccaaattcgacttgcgccgccttcgactacttctccctcttcctcccccagcaggacttcttccactcctttggcgatgggtcggcctcttccctggccggcgaagttttgttctactggttattcgtcctcttctgccaaaacttccgccgcttcgacttcgtcttcggcggcggcaaaatcgcaagaccgaaaaaggccgtacctgtgcccgacttgcgactcgcgattcggttccaaaatggaattggaagagcatcagaactcgcacaccggattgaaaccgttccaatgcgatgtctgtcagtcgcggttcaatcgacgctccactctttggaaccataagcgaattcacagcgacgcgaagccgttcaaatgcacagtgtgccaaatgcaattcaaatggaaaaattcgttgaaatgccataaagaaatgcatttgcgaaagaacgaattgagtcaggggacaatgccggacacggactcgcagcttctcacttatgcgacggccgcaaaaaa

SEQ ID NO: 627 - DNA, 1543 bp, Heterodera glycines
  genomic DNA sequence=SeqID_378; coding sequence=SeqID_930
atgcgtcgtgacaaaaaagacgatgaatcggccgccgggaacccttacgaccacttggacaaggccactgttgtccaagagacgcgtgccttcaacgagacgccggtgaatgcacgcaaatgtcggcccattctgtgcaaattgctgtacttgctgcagcacggggagaccattggcaagacggaggccaccgacacattttttgccatcaccaaactgtggcaggccaaggacatgacgctgcgcatgttggtctacttgtccatcaaagagttgtgccaaatgtccagcgatgtgatcattgtgaccagcagtctgacaaaggacatgaccggccgtgaggacgtgtaccgagcgcccgcaatccgtgcgctttgccgtattctgaacgacaccggcatgctccaggctatcgagcgctacatgaagcaggcgattgtggacaaaacggcttcggtgtcctccgccgctttggtctcatcgctccatttgatgcgcaaaagccccgaggtcgtccgccgttgggccaacgaagtgcaggaggcggtgtccgccgaaaatcacatggtccaattccacgccctttctttgctcgttcaaatccgtgccaacgaccgactggccattctgaagatggtccaaaagttcagcaagtccggactgcgctccccgctggcgttgtgccaacttgtccgtgtggcggcccgcctcatcgcggccgaggcggaggagcacgcgctgggcgtggacggcggcggcagcgccgagtcgcgctccgccttcaccttcatcgagagttgcctgcgcaacaaacacgagatggtcgtctacgaggccgcctctgccattgtgcggttgccgcgcattagcagtggtgaattggcttcggctgtcagtgtgcttcagcttttcctctcctcgccaaagccgacgctgcgttttgcggccgtccgaacgttgaaccgaatttccatggactaccctcaggcggtgatttcgtgcaacgtggacctggagcagttgatcacggatagcaatcgttccattgccactttggccatcaccacgctgttgaagacgggtgccgaggcgagcgtggaacggctgatgaagcagattggcacttttgtcagcgagatcagcgacgaattcaagattgtcgtcatcgaggctatccgttcgctgtgccatcgctacccgcgcaaacacgccacactgatgaactttttggcctcaatgctgcgcgacgagggcggtttcgactacaaaaaggccattgtggacaccatcatcaccatcgtggaggacaaccccagtgccaaggacttgggcctgtcccatctttgcgagtttattgaggactgtgaacacgccgcattggccacccgtgtgctgcatttgctcggccgtgaaggaccgaccacggcgaacccgtcccgctacattcggttcatctacaaccgcgtcattttggagagcactcaggtccgtgccgccgctgtcactgcgctggccaaattcggcgcggagtgtggcgcagctg

SEQ ID NO: 628 - DNA, 3131 bp, Heterodera glycines
  genomic DNA sequence=SeqID_379; coding sequence=SeqID_926
atgttgattacgacatatgtgttcaagatttctgtcagtgaagaggaaaacgaagaagagcaggttgaggaagaggacgacttcgacgagaacgaattggcactgaacaaacctaaaacaaagaagaagcgcagagttagggtggcgactgcgcgcgattttatccaagatgatgtcgaagtcgacgacgacgatgaagacgaggatgactacgatgctggggcggacggcgatgatttgtttggagtggacccgaatgaacgcgcagaagctgaacgttttctacgagaacaggaaaagatgaaagagaaacgccgcaacaaatacgcgttcagagacatgaccgaggaggaaatggagcggtacttccaggaaagacatgcagcacaagtggcgacacaccagggcgacatggacgaggacgcatatgacgacatcactcagaacggactgttgccaagcacgaaagacccgaatttgtggattgtaaagtgtcgactgggcgaggaaaagacgacctgtcttcgtttaatgcgcaaatacttgacttttgtcaacaccgacgagcctctccaaattaaatctgtcattgtcaaagagggcctcaaggggatgatctacattgaagcgtttaaaatggcccacgtggccaaagcaattgaagggatttcggcgctgaaccaattcaaaatcacgatggtcccaataaaagaaatgtccgatactctccgcgttgtcaagaatattccaactttaaagcccggtgcatatgtccgtttgagcaagactctttacaaagacgacctcgcgcaagttgattgggtggatatatcacaaaatcgagtcaacctcaaactcatcccccgcattgattacacgcgcttaaggggggctcttcggtcacaagacgacagaattatgaagaaaaaacgccgtccattgcctgctccattcgatttggaccgtataaaatcaatcggtggtgaagtgacaaacgatggcgacttttacattttcgaaggtggccattatcgcagaggctttctttacaaatcttttccaatgaatgctattgaagtcgacattactcatccaacccttacggagttggagcggttccaagattccaccgacgacttaaaaaaagaactggagaacactcacctaagggagaagcgccatagttttgctcctggtgataacgtcgaagttatggacggtgaactggtgaatctccgtggcaaaattcaaagcattgatgggcagaaagttgtcatccttcccgagcatgaggatttaaatgaacccttgactttgaatgcgagtgaattgcggaagtattttaaacctggtgaccatgttcgagtgattgccggtcgttacgagggtgacacgggtctgattgtacgagttgaggacaacgtagtcatcatgttgtctgatcttaccatgggagagatgaaaattttgcccaaagatgtacaactttgtgctgaggttgcgactggtgttgaacggatgggccaatatcagtaccaagacctggtgatgctggataaagaaacagttggagtaatcgttcgtttggaacgcgaaaatgtggaagttttgagtatgcatggcaaaatacttcgtgttaaccctcaaacgattgaatgcaaaaagaattcgcggttcgtcaaggcacttgattctcaaaagaatacaatccaagcgggagatacggtcaaagttgttgagggcttcctggcgcgaaagaaggaaactgaagaagaacgtcagggcgagatcaagcatcttttcagaaattgggccttcgttttttcacgtaaatatccacaaaacgggggaatgtttgtttgcaaagcgcggaatttggcattgattggtggaagcaaagcgtcggagtcacaaatcaacactactattttggataacagtcaacttatgagtcctcgtcctaatccgctcgaaagtcctcgcaccattcacggcggaatgactccccattccgggtcaagtgttgttggtgcacaatctgtccgtggcgatcatggttttaaagcaccaagtgtggtcgggagcatcgcaacatcagcaaccggagttggtcggcaacatgtacgtcggaacatggaaataatgggcaaaactgtgcgcgttctggctggtccaatgaagggttacattggaattgtgaaagatgcaacggaatcgactgtcaaggtggaactgcacaccatgccaaaaacggtcaattttgacatcaacaaagtgatggaggttggtggtgccgtcccgagggaattgatggacactgctggcgcaatgactccgggaacggccaccattggcgggcgaactccgatgtacggaggagcgcagacgccaatgtacggtggagcagcaacgcctatgcacgactcattcggtgctcgtactcctcattacggctctatgaccccggcttacgacggcagtcgaacgccttcgcaccaaccatcttcgtcttgggaccctgctttggccaatacgccggctcattcaactgctcattttgacaatgaatttgacacaatgggatttggcggaggagcatcaacgccggcaggttctgtgagaagccgacttgggggagcgaatactccaatgggccaaatgacaccgcgagatatgttcggcgattattcttcaagcccttaccccaacccaagcacaaatgccgattccgaaattcccactggttcatggtgtatggtcgacctgtgcgtcaatgttcttccgacgtgtggaaaggaccaacttctcggtttagaaggctcaatacggtcaattagagagggcgaatgttgtttgtatttcgaggagcttgacgatgacttcactattgagcacgaacatgtggtgcccattcgaccggcaagtggagaccaggctaaggtcatttatgggcatgatcgtggggtgtctggctctttaatcaccacggaaggggaggatggtgtgctgcaggggccgaacggggcaaagctttattcgatgtccgttctttgtaaacttgtttgatttgaatttgataatccgattttattgttcaaatatatttggaaattaaattattgtgccagcga

SEQ ID NO: 629 - DNA, 3426 bp, Heterodera glycines
  genomic DNA sequence=SeqID_380; coding sequence=SeqID_871
atgtacatcaaagaagtgaatatcactggttttcgcagttacaaagagttgacaacagttcgcaatttttcacccaaacacaatgttgttgtgggccgaaatgggagcggcaaaagcaacttttttactgcaattcaatttgtgctgagcaacgatttttcctcattgactctgcaggacaaaaatgcctttttgcatgagggggtcggaagcagagctccaattgcaaaggtcgaaattgtctttgacaacacggacagacgaataccaactgacagtgacgaagttcggataatgcgacaggtcggccagaagaaggaccaatttttcatcgacaacaaaccagtgacacggactgagattgtcaatctgatggaatctgccggattttcgcgctcaaatccctattacattgtcaagcaggggaaaatcactgaattagcaaccgcgtctgatccgtacagacttaagctcattaaggaggtggccgggacacgcgtttttgatgagaaaaaggatgaaagcaccaaaatattgcatgaaactcagacgaaaattgagaagagtgttcaattgctcggttatattaatgaacggttgaaaaaattggaggaggagaaagaggacttgaaggagtaccaaaagtgggacaaaatgcgaagggcaattgagtacacaatttacgatttggaaatcaaagaggcgaggagcaaaaacgagaaactgacttcgcatagagagcgaataaacgcacagcaaaacgaagtggagacgaagctgatccaagccaaaatgtcaatccaagaggcggagatgcaaatccgtcgattggagacgcattacaaaggcgtgaaggaagagcgtgccaccctgctcaaggagcagacggaccttatggagcgcaagacgcagttggagttggccattagggacttggccgaagacgtagaccgtgagagaagcgggcgcgaaattgcggaacattcgctgcaacaactgaaacgcgacatcgcggagaaggagggccaattggaacagttgcagccccaatttgaacagttgctagaggaggagagtcagctgggctcggacattcgcattggcgagcaaaagtgtcgcgaattgtatgccaagcagggccatcgtgaacagttcaaaacggtggaggaaagggacagacatttgcgcaaagaaatccattggatagaacggcgtattgacgagacggagcaccaaattacagagatagacgaatccatcgtggaggatgggaaggagcacaagcgactgcgagccgaaattcatgatttggaacaaattttgcgcgaaaaatcgacacgaatggacacattaaacgcagaagagaaacagaggaaggcggaattggacagagcaatgaacgcacggatggaaaacgcacgacaggaaaaggacgtgcgggaaagactcacattggtacaatacgaaatgcagcagagcgagcaagaactacgaagattgacctcaaaagcagtgctaaacggcattaacagtgtgaatcaagtgctggaggaaatgagacagaacggaaacggacaaaacattgttgacggatattttggccgtgtgattgacttgttcgaatgcgaaagtcagcacaacaaagcggttgaagtgactgccgagtcgcgcctcttttaccacgtggtcagcgacgaccgcgtggcgatgaaattattggagcgtatcaaccaacgagggctccccggggaagtgaacttttatccgcttaatcgtgtgcttgtgaaagatcgccgcccggtttctgacgcggatgcaagtcccatcctggaccatcttcaatacgacccgaactttgagcccgtttttcgctcaatctttggtaattgtgtgttcgtccgtgatcttgcggcaggttctcgggttgcgaaacaagaacgatttgactgtgttactcttgacggtgatcaagtgagtcgtcgtggaccaatgacgggcggatacattgacagaaaacgttcaaagattgacttggcaaagaaattgcgcaattttgaacgggaaaggataaatttggaggaacaagcggatttgttgtcgttgagtgtgtcagatagtcttaaagaagtggaacggattaggctggagatttccaaattggccatggacattcaaatgttgagcaaagagcacaaagcccttctggagaaaaagagatcagtttctgagttgctcagccaacattcgctaaatttggagccgaagaaaagtcaaaaaacagttttgcgaaatcgaattagggaattggaggcgcatcggaaattggtacaagaccaattgggtactgagcttcagtcccaactgagtagcgaagaaagggacgaattggacggagtggaggatgaaatcaaagcgaagaaggagaacatggacaaactgatgcggcagcgaatggaagtggaaaatcgcatccaaacgctcaaaaatcagttgcagtcaaaccttttgcggaagcgcgaaaatctgaacgccaaaattgaatcgatcactgtcgaattggatttggacttgggtaaatacgacacggagaaggaggaattgggcaatgcattggatgctcaccaggaggagagtcgggaactgaacgaacaattggaagaatttgcgaagaatgccgaaatatattgcacaaaaattgccaacattcagtcaaaaagggaggaatgtttgaggaaaattacggacattggttctttgccgacggacacagcgatgggcaaatacgacacgatgggactgaaacagctggacaagaagctgacggaatgcatgaacgagttgaagaagtacgaaaacgtcaacaaaaaggcgctggaccaattcatgcgtgcttccactcaaaaagaggagctcaccaaacgagtggaggagctgcaaaacaatgaaaagacgatccaagacttactttccgtactggaaaaccgacgttttgaaacccttcaattgacttttaaacaagtggcaaagaatttcgaggacgtcttcaaaaaattgattccgcaagggacggccaatttggtgatgcaaaaggtggacccgtccatgatttccgcgttgtcgggtggtcagaagacactcgttgccttggcgcttattttcgccattcaaaaatgtgacccggcccctttctatttgttcgatgagatcgatgcggcattagaccaagagcaccgacgtgccgtcgccgaaatgatccacgaactgtccgaaattgctcaattcatcacaactaccttccgtgccgaactgttggaacatgccgagaaattttacggtgtccgttttagggacaaaatgtcgtacattgatgacataagtcaacaacaagcgcaagactttgtgcaggatgatcagacacactcctga

SEQ ID NO: 630 - DNA, 561 bp, Heterodera glycines
  genomic DNA sequence=SeqID_487; coding sequence=SeqID_997
tacatataaccatatcaaatggctacttacaatcccaactatgaatccattgggcaggcctttgtccaacacttttacaccaaatttgatgtgcccgatggtccgactcgcaccgtcggccttcatgatttgtatgatgctgaacactcttttatgacttttgaggggaaccaagtgaaaggtcgacaggccattttggacaaatatggagcgctacctttccgaacgattcaacatgggattacaaagactgacagtcagccgcttccggatgggtcaattttggtgacggtgattggtcagcttaagaccgacgatgacccagtgaattcattcaaccactgcttcattctgagaccaaattcttccgggggatttttcatttcgaatgaagtgttccgtcttgttttgcattgaagtgctgaagccgttctctcgtggacatttgcaacctgttgttgttctttttcctctacaatttccattgattgcgcagtttgatttgtttcgcctttgtttcagcttttgccctcaatatgactcggataaactggtgttcta

SEQ ID NO: 631 - DNA, 381 bp, Heterodera glycines
  genomic DNA sequence=SeqID_381; coding sequence=SeqID_1021
gagggcgtaactttgccggatttttacccattgacaaaatccgaagagcgcgaattgaagcgaattcggcgcaaaatccgaaataaaatgtcggcacagacgagcagaagaaaaaaacaggattacattgaggccctgcaggaacgcattttcatgagcgacagcgaaaacagagaattgaaaaagcaaatcgaagtgatggcggcggaaaacagacagcttgcggcacaactgcgcaacatgcaggcttccattggacaatcgtcaaagcgcaatgcccagacaggcacttgcctggctgtccttttgctttccgtctgtttaattgtgacgccaaatagtcgacaccttggcatgagaagcaacagcagagagggagag

SEQ ID NO: 632 - DNA, 2037 bp, Heterodera glycines
  genomic DNA sequence=SeqID_382; coding sequence=SeqID_911
atggagaaagtgcaatttgggaaggagctcatggaggagtgtcctgaaattgctgccaaagtgcaagagagggacaaattgaagtaccaactgaacatcctgaagagggcgaatgccgtgccaacagagggacaccaaaccgaaaagaaattggcaacggatgggaataaagtcgccaataatcggacagttccaaatgggccgagtggcagtgcgcatttgcaaatcgaagactttggcgattcaatcatcgaacgactgagcgatgttttcgcaaaggccgtccaaaatgcttacccaactcttggcatggatccttcgattatacgagtcaaagaagcgaacaacccgaagtttggcgactaccaattcgaaatggtcatgcaaatttcacggcgccttctcagcgaacaaagcgtcaaggagccgcccccggtggtggccaagaaaattgtggctgcgctggagcaaatcgaattggtcgaaaagtaccaactcgtcaatgcctatattaatgtatacatcagccgtaaacatttgggaaaacgaattgccgaaatctctagaaagggtttttcgcttcctaaaattgccaagaaacatgtgattgttgactattcgtcgcctaacattgccaagcaaatgcatgtgggccatttgcgttcgacgattattggcgaggcaattgcacgtcttttggaatgctttggatttacggtcctccgtttgaatcacatcggagactggggcactcagttcggaatgctaattgcccatctgaagaaatgctttcccaattatctgaatgaaacgccgcctatccaagacttgcaagagttttacaagcaatcgaaagtgaaatttgacaacgacccgcagttcaaatccgaagcctaccaatgtgtggtcgcactgcaaaactttgagccggacacagtgaaggcgtggaaaatgatctgtgacgttagccgaaaggactttgcaacaatttacgagcgtttgggcatcactgaccttgtcgagcgtggcgagtccttctaccagtcgcgcatgcagtcgttgatccaggagttgaaacagactcaactcctcgtcgaagacgacggaaggaagcttttcttccctcacgagtgcaacattccgctgacggtggtcaaaagtgacggcggtttcacctacgacaccagcgacttggccacactgaagcagcgactgtctgaggaacgggccgattggattctttacgttgtcgaccgtggccaatccgaacatttggagaacgttttcgctaccggaaagcagctgaagtggtttgatgcggcacaaaaacgcgtggaacatgtccaattcggattggtgctgggcgaggacaggaaaaagttcaaaacgcgttccggcgaaaatgtcaaactgacggaattgctggacgaaggcgtacgccgagcggaggaaaaattgcgcacaaaaggcaaagaaggagagttcacaccgcaagagtttagagaagttgccgagtcggtcgcttacggatgcattcgttacgcggacatggcccagtcccggaccggtgactatgtgttctcatttgacaggatgcttgacgaccgaggcaacactgctgtgtatttgctatacgcttatgcacgcattcgttcaattgctcgaaatgcccaagtcactcgggatgccattaattccttcattaacggattgccttctgacgacggagtgtttttggaccatccacgagaagtcaaattagcaaagcaaatcctgaagttctccgacgttcttttgtccgttctggaaagtttgcaactcaacaaaatatgtgactacgtttacgagttggcgacggtgtttcacgacttttacggcgaatgttacgtcgtaagcaaattgccgaccgaaggggaaagtggacaggcggtgaccaccaaagtcaatttcaacagattggtgctttgtgaggtaacggctgacattatgcaacggtgctttaatgtccttggaattcgcgcactcgagcgcatgtga

SEQ ID NO: 633 - DNA, 512 bp, Heterodera glycines
  misc_feature (463)..(463): n is a, c, g, or t
  genomic DNA sequence=SeqID_383; coding sequence=SeqID_1011
atgagcaagaggcgcaaaaaattcgtgaaatgcaaaacgaaatggagaagcaattccagtccggcactgccgtgaccggcaccggcagtccggtgataccgaatccgatgtccctggaggagaagcaattggtggacgcacgttccatttacgttggcaatgtggactacagcgcaacaccggaccaattggaggaacacttccgcggttgcggtgccatcgaacgcgtgaccattctgacagacaaattcactggccatcccaagggtttcgcgtacatccaattcgcggacgtggacgcggtgaacacgtccacctcgttgaacgactcgctgttcctgggccgtcagatcaaggtggtgccgaagcgtaccaatgtgcccgggctgtcctccaccaatcggcccccgcgcggcatgcgcggcggccgtggcagcgggcgcgcgcgtgtgattgtcaagtncatttattcggaaaggcgctcgcgcggacgcccgcccaggtggcagaca

SEQ ID NO: 634 - DNA, 1746 bp, Heterodera glycines
  genomic DNA sequence=SeqID_384; coding sequence=SeqID_863
atggagccccccagcgtggcgagcagcgactaccgaagcgccatttcctctcgcccgtacttctcccgccctcggccgttgtcgcccactcgctactcatccgacgggggtggcactcgtgtgctgaagatggtcagcgagtcgtcctccatcagcagtcgccccttgtcgccttatcccgcgtccaccacagccaccgcaattcgggatgcgcgagagcgagaaaagaaggaaatgagcgaactgaacgatcggttggccacttacatagagaaggtacgttttctggaggcacaaaaccgaaaattggcaacggatttggactttttgaacaaacgatggggaaaagacacgtccaatgtgcgcgaaatgtacgagacggacttaagacaagcaaaaaaactgttggaagagacacaacgccaaaaagacgaattggaaaagaaagcgaaagcgatggaggaggaaatggacacactgaagaagaagaatgccaacgcagtgacagcgcacgaaggggacaaaaaactgatggaagaacttttgcagagtctttcctcgttggaagccgaattgacaatgcttaagcgacggctggaaattttggacgaagaccttaaagcattgagacgggaaaaccaacatttgaatggcgaaatgcaaaaagcccggaccgatttggaccaggaaacgctgaaccgaatcgactaccaaaaccaagtgcagactctgctggaggagattgacttcctccgccgtgcgcacgacgccgagattcaagacttgcaggcgatggcctcgcgcgacaccaccggcgaaaaccgcgagtttttccgcaatgaactcgcctcagcgattcgcgaaattcgcaacgattatgacgtgctgaacaaccgaaacagaagcgacatcgagtcgtggtacaaaatgaaagtgcaggagatacagacaatgagtgcgcggcagaacttggagcagaactacgccaaggaggaagtgaagcggctgcgcacgcagctgggcgacatgcgcggaaagttggccgatttggagggacgcaactctctgctggagagacaggccgaggaattggcctaccaagtggaggacgaccaaagggcgtacgaatcggcactgaacgacaaggacgcacagattcggaagctgcgcgacgaagcgcaggcactgatgttggagctgcaaatgttgctggacaccaagcagacattggacgccgaaattgccatttaccgaaaaatgctggagggggaggaggacagatcggggctttatcagctggtggagcaggtggtgaagacgcagaacatccgccgtcaggacgaagctgagtctcagcgcattttgcgcggcgaaaagtcctcccgacaatcgtaccaaaggtcggccaaaggcaatgtgtccattttggagacatcgcccgaggggaaatacgtggtgttggagaacacccaccgatccaaggaagagccaatcggcgaatggaaattgaagaggcgcatcgacggaaaacgcgaaattgtgtactcattccctcaagagtttgtgctgaggcccggaaaaagtgtcaaagtttgggcacaaagagagggaattaatgcgccacccgatcatttggtatttgacggcgaagagtcattcggcacgggctccaacgtgcagactttgctgtacaaccgggacggcgaggaacgcgcttcgctcatccaacggtccagcggccgctga

SEQ ID NO: 635 - DNA, 2302 bp, Heterodera glycines
  genomic DNA sequence=SeqID_385; coding sequence=SeqID_969
catcctcgtgttcgttacgccgtttgcaatgccattggccagatgtgcaccgacttccagcccaccatccaaaagaaatgccatgagcgtattgtgcccgttctcctcgaggccatggccgacatgtccgtcccgcgagtggctgcgcacgcggcggccgcaatggtgaacttttgcgaagattgtcccaagtcaatcatcagtatttatttgccatcgataatggaacgattggagtcagtgctttcacaaactttccagcaaatgatgaccaatggcaaaaaactcgtcttggaacagataatcaccacgatcgcttcggtagctgatgccgcccaggatcacttcgccaaattttacggcaatttgatgccccctctcaaatacatttttgaaaacgccaaagatgacaatttgaagttgttgcgtggcaaaaccatcgaatgcatttcgctcattggaatggcagtcggcgcggaactgttcgagacggacgccgacagcgtaatgcaagtgttgctcagctcgggagtcaaattcgagaacaatgacgacccccaaatctcctacttcatcagcgcgtgggcgcgcatttgcaaaatcctcggcaagggtttcgccaagtatttggacatgattatgccggccgtgctgtccgccgccgacttcaagccgtctgttgcgcttgtggatggcaaggacacggatgacaacgaggactgggattacatgccaatcgacgagaaccgctcgctgggcgttcacacggccggactcgaggacaaagtgactgcgtgcgaaatgttgtgctgtttcgcgcgtgagctgaaggacagttttgccgcttacgtggagcgcgttatgcaactgatgctgccactgctctcctttctgttccacgacggagtccgttctgcggctgccgagtgtcttccgtgtttgttggtctgtgccaaagggtacggggatgagtacgtgcgccaaatgtggtcggtcatcctctccaattacataattgcgattggcaaagagactgatcttgaagttctctgcgaaatgctcaatggaattgcgcaatgtgtggaggactttggagggaatgacgccattgtgacggaccaagatgtggcgaacattttctgcgtaatttaccaacaaatcgaaaactttgacaagcgacgggcggagagggaaaagaagtctaaagaagaggagcatgacgaggaggaccaagagagattagacgaaatcatcgaactcgaaacttcggttttggcccgtgtgtcggacatcatccattaccttttcttgaccaaacgcgaggctgtcatcccccactttgacaaaatggcacaaatattcgctgcccttctcaacccgcgacgccctttccacgacagacagtggggcctttgcatatttgacgatgtcatcgaatttggaggcgaattgagtatgcgctatcagaatattttcttccaaccgatggtcactgctttggccgacaaatatcccgaggttaggcaggcggccgcttacggctgcggaattatgggactgaaggggggacagaattacgcgaaacattgcgcccaaatgcttcagccattaatcaatgccattgagaagaacgggtcgagaagcaccgaagaggacacgcgggcgacggaaaatgcgataagtgcggtggcaaaaatactcaaatacaacgcgacagaagtgaatttcaacgaggttgtgccgcgtttcgtcggttggttgcccatttggaatgacgaggaggaggtgccgtacgtgttcgacttcttctgcgatttggtcgagtctcagcacgacgcagtgcgagaggacccgtctcgtgttttccacattattctaaacgctttttcgcacggtgcttttgaggacgactcggcggaagagatgcgattggtcaaaagtcggatgaagggaataatggcacacattcgtgccaatgaacagttgttcacgcaaattgtacaatcgctacaattgaacactcaccagcgaactgtgctggagcaaattttagcctgaggggggaaagcggtgacaagcgacggaactgatcagagtgatcaatgaaggaatgataagacggacattaacatcggacgaaacggataccaattaaattcaccctttattatgcagatgttgttttgttatcactatcgttatattaattatcaccatacaaatgcgcttttctgtttacgatcctttgcgctttgttatcgttttgaattgtgttagttgtttaactaagaattgttacaaa

SEQ ID NO: 636 - DNA, 2636 bp, Heterodera glycines
  genomic DNA sequence=SeqID_386; coding sequence=SeqID_979
ttggtcgctgccgcgttggattcgctgcgcgaaatttatttcaagcggaacatttcggcggaacagcagcgcgacgcggcactgctctcgctggtggcccatcccaagcaaatgctttacgcggcacagaccggcacaatcgcatgcgaatacctttcactggacaccatggaccagtggatcattttcggtctgacggtgtgccatcggttgctggtggacccggcacattcggccaaccttggcccgctgtaccaacgggcagttcagcactgtttggtggttcatttgttccgtgacgagtgcattgttgtccaaccgttggtgcacaccgtgttggagcacatcaagcagcagcagcaacacaaccaccaatcgcaacagcagcaccaacaacagtacggcatggtcaagcagttggtgggcgagctgaaagatggtgtgcacacgctgcacgcggctggccacctgcatgcccatcgacggcactttttgcggatggcactgcgcgagctgtgcctgctgattggcgaccagcccgggctgcttgggcccaagtgtctattcgtttggatgggcttggcctacgcccgggacgaggtgctgtggctgttgcggcacagcgaactgtggcctcagctgatgcaagccgcattctccagcaaaaaggcgatggccaggagcgggttggccaccattgtggtggacaaatttctgcccgaactgctcttctacatgtgcgaactgcgcaacttggtgctgaaacatgccgacatcattgcccattaccatgccgaatacgttgctggctacgacgcaccattgttggctgaacagctccaccagctcagtgccgatggtgctgaactgtccgactacgaggcgctgctcctccgtgcatgtgccgacgcgttggaaagcgtcaaaggcatggcatggattggacattataattccgagaacaatagtccatggaaattttgtccagtcgatggcattgtggtggactcgcgtgctgtccgtctcgactggttccgcttccaggccaacagcagcgtgagccggtccgccttcaaactgcacacccatgccaatttggcggtggcgctgaacaccgccattttccacctgaagcaaattgacgacttgcacgcgttgctgggcgagaccagcgacctcagtatttattgtttccatgcccatttgttcgatgcccatcttcgccatgcgctcgactttcccgtccagtcccgcttctccattgcttttgcgcacattgccacaaactttgagaatgcgttgcacgaaatgtgcccggaagagcgggaccttgtcattgagaaaggactaaaaacgtgcaacagcgcgttggacgagctgtccaagaaggtcatcgaagtgtttggcaaactgtgcacggacaaacaccaaatggagttgaaccaatcgccgcacacatgcgcacgcattttggccgccacttacaaactgttggcagcagctgaaaatgacggtgggcacatttttgtgccccgtgaattcctctaccaaaacttggaacggcatctgaagacgtcgctgagcaacacaaccaccgccaattgtcctatgtcaccgcatcctcggcgcccgtccgaaatgctggcatttctctgtgcccaaatgcacgcgctgcaggacttggacacatttttggcctatgacattgtgtgtctgttccgcgacgcgatgctccaacaatcgcagcgggaggacgcccatgggcaggagacattggccgaagtgtactcaaaatggtatttggaggtgctgttgcgcaaggcgagcaccggacagttgctgtactcggaccatttgcaagcatttgtgaccagtgaacagccgcagcaacagcagacgaccgaaagttacacggacccgcgggaattgcgcgcgcttgcccaactgatcggcccttacggcatcaaggcgatggaggagcggctggtgtggcaaattgcaagccaaatcacggagctgttcaagctggtcagggagaacagggagacactgcacgcggcacgcgtcaactttgacaagccggcaaaactgcgagaagtgccctccgtctgtacagcttcaacatgtgcgtcgaccgcaacggcggcaccgtccgccatcgaatcgctcctccaacgggttatcatcatcggcgagatcatcgcctttcgggacctgttgtttggcgcactgaacgacgtgttgcgccagcgttgtccgttcctgatcagctcgctcggctcactgatcgattcggcggcagatgaactgcagaaaattaacattggcgaagcgtgcgctgccagcgggttcaagttggacgtggacttggcattggtcaacgcatgcaaacagcaggcgaacaacaacggactgaacgatcactacaacattgcctgtctgctgattgtgttcattgccattgcgttgccaaaattggcacagtctccgcactcatttttccgtgcctcactgatggtgacaaaaaacaattcccacaccataccgttggctgtgaacacgttggtcggtgcgctgttctttctgcaccagcgcggcgatacgggcgatcggatgcgcgagtttttggcggtaat

SEQ ID NO: 637 - DNA, 362 bp, Heterodera glycines
  genomic DNA sequence=SeqID_488; coding sequence=SeqID_831
cgctgattgccaaagtgaggccgtccagctacgggcaacggcgcaactactccagcattgacatttcggcggagaaatggttgatgcactacgacgccgactcgttggccaaactcgagaacccaccgtcactggcggacggaatcaatcgcgaattggagagggacattcgctatttgggctgtgaactgatacaatcgggtgccattctgttacggttgagtcaaacatcagctgccaccgcacaaattctcttccaacgttattactacctcaaatcatttgtgcgctacaatttcgagcacatggtccaagcttgtctgctgttggcaagtaaaattgaagaagaacctcgaaaaccg

SEQ ID NO: 638 - DNA, 1947 bp, Heterodera glycines
  genomic DNA sequence=SeqID_387; coding sequence=SeqID_960
ccagctaaagctaatgcaattggtattgacctcggcacgacgtattcgtgtgttggagtcttccagcacggaaaggtggagatcatcgcgaacgaccaaggcaaccgcaccacgccgtcctatgtcgcgttcaccgacaccgaacgtttgatcggcgatgcggccaagaaccaggtggcgatgaacccatccaacaccgtgttcgacgccaaacgtctcatcggacgcaagttcgacgacccggcggtgcagtcggacatgaagcactggccgttcaaagtggtgcagggagagggtgctcgtccgaaagtgatggtggaagtcaaaggcgaggacaaagcgttcttccctgaggaggtttcgtccatggtgcttatcaagatgaaggagacggccgaggccttccttggccagactgtcacggatgcggtggtcacagtgcccgcttacttcaacgactcgcagcgtcaggccaccaaggacgcggggaccatcgccgggctgaacgtgttgcgcatcatcaacgagccgacagccgccgcgattgcctacggcttggacaagaaggggcagggtgagcgccatgtgctcattttcgacttgggcggtggcactttcgacgtgtccatccttaccatcgaggacggcatcttcgaggtgaaatcgaccgccggtgacactcatctcggtggcgaggacttcgacaatcgaatggtcaaccactttgtcgcggagttcaagcgcaagcacaagaaggacctcagttcgaaccctcgtgcgttgcgtcgtttgcgtacggcctgcgagcgcgccaagcgcactctgtccggttccacccaggccagcatcgaaattgactctctcttcgacggcatcgacttctacaccaacatcacgcgcgcccgcttcgaggagctttgcgccgaccttttccgcaacaccatggaccctgtggagaaggctttgcgcgacgcgaagatggacaagtcccagatccacgacattgtgttggtcggcggctcgactcgaattccgaaggtgcagaagcttctctccgactttttctccggcaaggagctgaacaaaagcatcaacccggacgaggcggtggcctacggagcggctgtccaggcggccattctttccggcgacaagtcggaaactgacttgctgctgcttgacgttgcccctctctccctgggcattgaaacggccggcggcgtgatgacttcactcatcaagcgcaacacgaccattccgacaaagacgtcgcagacattcaccacctattcggacaatcagcctggtgtgctgattcaggtctacgaaggcgagcgcgcgatgaccaaggacaacaacctgctgggcaagttcgagctcagcggcattccgccggcgccacgaggagtgcctcaaatcgaagtcactttcgacatcgacgccaacggcattttgaacgtgtcggcccaggacaagtctaccgggaaacagaacaagatcaccatcaccaacgacaaaggccgcctttccaaggaggaaattgagcgcatggtgcaggaggcggagaagttttccaaggaggacgaggtgcagcgtgaccgtgtgtctgccaagaacgccttggagtcctactgcttcaacatcaagcagacaatggaggactcaaataagctgaaggacaagatcagcgaggacgacaagaagaaggtgctggagaagtgcggtgaggtgctggcatggctcgacgccaaccaggcggcagagaaggaggaatttgagcaccagcagaaggaactcgaagggatctgtaatcccatcatcaccaagctctaccaagccggcggcgcaatgcccggcggtccaatgcctggcggagggatgcccggaggtggcggcgctgctggtgcgggaggagccggtggaccgaccatcgaggaagtggactaa

SEQ ID NO: 639 - DNA, 1212 bp, Heterodera glycines
  genomic DNA sequence=SeqID_388; coding sequence=SeqID_983
ggtatatggtcgatgaatcgggcgcctcgctgacactgcgcgtgttggagcacaaacagtttgtgcgcttcgtcaacatttgggcgcgcggcttttggaccattggccgggcggaggacggacgtctgtttgtgtgcggcctcaacaattttggacagcttggcgtgccgccccaatcgccggcgcaccgcaagtccgccgctgggaccagcgacgaagatgacggtggaatcggtccgcccaagccaaagtcgccggccaccatcgccgctggccaagaggagtccaacaaggtggcactgctcacttgcgccaccgcgtttccggccgaaaaacggtggacccatgtggcgggcgtgcagcatgtgatctgtcggagtggggacgacagccaaatttatgggattggcaagaacacggacaacgcgttgggcctcgacacgtggcagggcaaccatgacgaggagcactggcgctatgacacactgcagcacatcccattgccggacggagtgaacaccgtggccggcgtggacgcaacgctgggcgccaccatattttggacggatgatggtcgagtgttcggtttcggctgcgacacggttggccaactcgggctgggcatcaaggaagaggatgagaaggtggtgtcgaagccgcgtcagatcacttcggcacatttggacggatatcgagtgttgggcgtgtccattgccgacaatcatgcgctttttctcgccgcgtcgattgaccaacaaccgccgctgtcatcagcttcaccaccaccaccaccacaacagcagaaggcccagcagcagaaacaactgcagaccaacggcaacggaatattggaaacaccgattgatggcaaagcttgattgattgatggatggatggatgatttttattttttgttttgatttggatcatcacaaatcattttttgtgtctgctgcccttctctaatttgtttgtcgtctcattttgtttattgttgctctctctctctctctctctcttcccccctctctctctcccctctccacactatgcgcactgcattgattggctttgtttgtctcgatttgtttggcttttcttctctctctctctctctcccgcttctcctcctgttgcttgcttttatcttcccttccttcatccctccctcactggtcaaaggcaaagcgtacaataaattaaatccaatta

SEQ ID NO: 640 - DNA, 651 bp, Heterodera glycines
  genomic DNA sequence=SeqID_341; coding sequence=SeqID_919
atgtctgcgcagcgcacacgcccggggaacggaggagcgcccacgaaaacttgtcaattcaagttggttctgctgggcgaaagtgcggttggcaaatcgtcgctggtgttgcggttcgtcaagggtcagttccacgagtaccaagaatccaccatcggcgccgcctttctcacccaaacaatttgcctggacgacgcgacggtcaaattcgaaatttgggacaccgcgggccaagagcgctaccactcgttggcaccgatgtactaccgcggggcccaggcggccatcgtcgtctacgacatcaccaaccaggaatcgtttgcgaaggcgaggaattgggtgcgcgagttgcagcggcaggccagcccgaacattgtgattgcgttggccggcaacaaggcggacttggccgccaaacgcatggtggagtacgaggaggcacaagcgtatgcggaggacaacggactgttgttcatggagaccagtgccaagtcgtcgatgaatgtcaacgacattttccttgccattgccaaaaaactgccaaagacggagggcggcggcggtccgtcgggccacggacgcagcggcgtggacatctccgcggcggaggcggcggcacagcagcggcgcggcacgtgctgttccaagtga

SEQ ID NO: 641 - DNA, 2103 bp, Heterodera glycines
  genomic DNA sequence=SeqID_389; coding sequence=SeqID_980
ttttcttgtacgttaaatggggtgccggaatcacacgatcttttggagaagtgtcggctgccatttggtcttcacttacagccattccgtgatttgaggggattgaaagtcttgcagacagtcatcacgcggtgcagatattgcaggacatatatcaacccttttgtgtttttaatggacgcccgtcattggaaatgcaatttgtgctatcgcgcaaatgaaatgcctgaggatttcgcatgggaccctcaaacgaaaacttttggcgacccatctagaagacccgaactccaagaaaccactattgaatacattgcaccatctgaatacatgcttcgtcctcctcaacctccgatttatttgtttgtttttgacgtcggttccgcagcaatcgattgcggttacctcaacacttttgcagaacaactttcgctggacattgacaaattgcctggccaggaaagggctttcattggctttatcggtttcgattccgctttacattttttccaattcgatgaaaacgagagagagccgaggcatattattgaatttgatgttgaagaaagttttgcgcctgtgttctctggactttttgttgaacttaatgttttcaaagagatcatcaaaaaatttatatacaacataccatcaatttttgaacgttctatgtcatcctcaaattgtctcggttctgcacttacagttgcaaaaaatttaattaacgaaatcggtggacggataactgtttttaccgcatctatgccaaatctcggaattggtgctctgaaatgtttggaattcaacactgcaaaaaagatcgcatttacacctcaaattgacttttacaaaagtttggctctcgaatgtactggaaaacaaattgccattgaccttttcgttgtcggatgtcaaaacgtagatcttcgaacattatctgatatgtctcggttcagcagtggcaccgtgtaccatttccctgaatatcatttccttcgggaccaagtcgaagtcaaacggttccaaatgattttacgacgttactttattcgaaagcttggtcttgaggccgtgttgaggatacgttgctcgaggggactttctcttcacactttttatggaaatttcttcgtccgttccactgatttgctcgccttgcccaatgtgagtcccgattcggccatgggcgttcaaattaaacacgacgaagtgatcacagccagtcaagtgtgtttccaagcagctttgctgtacacctcgacgaaaggtgaccgtcgtattcgcgtccacacactttgtctccccgtgctcacacaagctgcacatgtattttcttcgctggacattaactcgtcaatatcgctactttcaaagatgggttatgatagagctttgcaaggcgctagtttatcagactgtcgtgaggcactaataaatgccgttgtcgatccgaccgtctgttatcagcgatcacatggtcaagttggttccatgttgcgcatgcctcctgaaggtggtcttcaatacatgcccatttacatacttggattgttaaaaaatagggcgttttcggattctctgcaaagggtcaccatcgatgaacgtgtggcaacttttctgcttttcaaaaatgctccgttggaagttctcttacttgagttgtgcccagctctttacgcttttcaccaaattctttactgcgaaccgaatcagtttcccgaccgtcttcctcctacttatgagcatatctcccaaaatggcatttatttgctcgacattggcacatttgtctatgtgtacgttggctctgccttaaatgtctgtattttgcgttctctttttggcaccgattcgttcgctaaattggattcggatgtaataattgaaattgacacttcgcaaagcaaacatttgcatgcctttcttcgccatttacaagaacagagagggaatatgtatgctccagctaaaattataaaggatgacagtccaaggcgggaggcatttacgcgacggctcatccaggatcggtcggattcttcacattcttacaacgaatttatgcaattcctccaacgagaagtcagcaaagccagtaaatga

SEQ ID NO: 642 - DNA, 1239 bp, Heterodera glycines
  genomic DNA sequence=SeqID_390; coding sequence=SeqID_847
aggggagatgttgacactgttgttatcgagaaattcgtcccacttttggtcgatctggaagaagagggtcaacttgcacccgtcgtcgatgttgagagtggcacccacatgatttggattcgtttcaataacatttatgttgttgctgtgtcccggtgcaataccaacgtgtcgttagtgcaaacattcttatacaaattggttgctgtttttgccgaatatttcaaggatgttgaggaggaatcaattcgtgacaattttgtgatcatctacgagctcttggacgaaatgatggattttggctatccgcaaatcaccgaaggacgaatattgcgcgagtacataactcaggaaggacacaaattggaggccgcgcaacagccgcgtcccccgatggcggtgaccaacgccgtctcgtggaggtccgaaggtgtgagacataggaaaaatgaggtattccttgacgtgatcgaatcattgaaccttctggcaagtggcgccggtacagtgttgcaaagtgaaattgtcggttccgtcaaaatgcgtgtttttctcaccggaatgcccgaattgcgcctgggtttgaatgacaaagtattttcttttaattcaattcaatttagtaatttaggggggagaagcaaagccgtcgaattggaagacataaaattccatcaatgcgtgaggctttcgcgttttgaaaatgatcgtacgataagttttattccgcctgacggggaattcgaactgatgagttacagattgagcacaattgtcaaaccactcatttgggtcgaagcggtaattgagaaattttcgcacagtcgtgttgaatatatggtcaaagccaaaagtcagttcaagcgacgttcgacagcgaataatgtcgaaattgtcgtgccggcccccagttattcggacagtccgcgcttcaaaacggccatcggaaattgccgttaccaaccggaagacaattcttttgtgtggaatatcaaaaatttccccggagggaaggaatatttaatgcgcgctcactttaaacttccgtccgttctcagcgaagaagttgaggcgaagcgtccgatcaaagtgcgctttgaaattccatatttcaccacatcgggcattcaagtgcgatacctcaaaatcatcgagaaaagcggctaccaggcactgccatgggtgcgatacatcacgcagagcggggactattccctacgattgaattcggtgacctga

SEQ ID NO: 643 - DNA, 345 bp, Heterodera glycines
  genomic DNA sequence=SeqID_391; coding sequence=SeqID_940
gaatggtcggatacccaaatgtgggcaaaagtatgacaatcaatcgactgctcggcaccaaaaaaacggcggtgtcctcgacgccgggcaaaacgaaacatttccaaacactgatcattgacgaggggttggttttatgtgactgtcctggccttgtgatgccgcagtttggcattagcgatgccgacatgattttgaatggcattttgccaattgcccacatgcgcgactatttcggacccatccaattgctgtgcgaacgcgtgccccgccaatacttccaacaacgctactccgtcctgttgcccaagagcattgggtctttgaacgggcacgacctgttga

SEQ ID NO: 644 - DNA, 731 bp, Heterodera glycines
  genomic DNA sequence=SeqID_489; coding sequence=SeqID_922
ctttagaaaatcatattaaactaaaaatgggacgtcgtcccgctcgttgctatcgctacattaagaacaagccttatcccaagtctcgcttttgtcgcggtgtccctgacccgaagattcgcatttttgacttgggtaggaaacgcgcaactgttgacgagtttccatgctgtgtgcacatgatatcgaatgaaagggaacatttgtcgtctgaggctctcgaagctgctcgaatttgtgcgaacaaatacatggtgaagaattgcgggaaggacggcttccacatgcgcgtccgaatccacccgttccatgtgattcgcatcaacaaaatgttgtcctgcgctggtgctgaccgtcttcagacgggaatgcgcggcgcctttgggaaaccccaagggttggtggcgcgtgtcggcatcggtgatatgctgatgtcggttcgtgtccgtgaccagcatcaagcccacgctcttgaagcattccgtcgagcaaagttcaaattccccggccgtcaatacatcgtcatttcgcgcaaatggggcttcaccccttttgaccgcgaagtttacgagaagcaccgcaaggaagggcgagtcattccggacggagtcaactgccgattcctcaagcaacacggaccattgacggaatggctcaaaaatccaatctgatcaattgtacgacggatatattcccttttatatgctttgttgattaaattgttggatcta

SEQ ID NO: 645 - DNA, 1651 bp, Heterodera glycines
  genomic DNA sequence=SeqID_342; coding sequence=SeqID_846
cttttctgattttggctaaaatgactacgacagcgcctattgcgacagaagagggtgaggacagtttgtaccctatcgctgtgcttattgatgagcttcgtaacgaagatgttcagcttcgtctcaactcaatccgtaaattgtcgacgattgctttggcattgggcgttgaacgaacgcgcaaagaattgattcaattccttacagacaccatttatgacgaggatgaagttctattggcattggccgaacaattggggaatttcactccgttggttggcggacctgagtatgtgcactgtttgctgccgccacttgaaaatttggcgaacattgaggagactgtcgtgcgtgacaaagcggtggaatcgttgcaaaaaatagcagaaaaacacagtgcagctcaactcgaggaatatttcattccgatggttctgcgattgtcagctggtgattggtttacttcgcgcacctccgcttgcggattgttcagcgtggcatacgctcgtgccaatcctgctcaaaaaactgaattacgtgccgcattccggtgcctctgtcgcgacgatacaccgatggttcgccgtgctgccgcatccaaattgggcgactttgccaaagtgcaggaggaggactatttgaaaaatgaaatcacccaaatgtttgaggacttggccaaggacgaacaagactctgttcgactgctttcagttgaggctggcattgtgatcgttggtctgttgtccgaagactcggcaaaattggcccaagtgaaaccgatcgctgtttcgttggtgcaggacaaatcctggcgtgttcgttatatggcagctgataaaattgttcaaattcagcaagcattcggtaccaaaattggcattgaagaaattgtcggatggtacaccggacttttgaaggactgcgagggcgaagtacgcgatgcagcggcagagaaactacaatcattctgtgctgctctgtcggaggaaggccgaaaaaagggaatcattgaagaaattttgccagtgattcgaccactaacaactgacgcgaatcagcatgtcaaaattgcgttggctcaggttgtgatgggattggcgcctctgctcggcaaccaatgcaccattgagcatttgttgcctatttttttgtcaatgcttcgtgatgatacacccgaagttcgcttgaacatcatttcttcattggaaaaggtcagcgatgttattggtgcagatgagctccaatactcacttttgcccgccatcatcgacttagcacaagatggaaagtggcgagttcgcttggccatcgtggaatacatgccgttgcttgccaaacaacttggccagaaattttttgacgagaaattgcttaaactgtgcatgaattggttgacggatcacgtttatgccattcgcgaggctgccacaaacattttgaaggaattagcgcagaaattcggtgccgaatgggccgtcactatggttttgccccgtgtgattgaacttgcttctgacagcaactatctgcgtcggatgacttgtctcttctgtttcaacactttgtgtgaagcattgaacaacgacgcaattatgaaggaacttttcccaacgataaaagcgctttgccatgatcaggtgtcaaacgtgcg

SEQ ID NO: 646 - DNA, 1754 bp, Heterodera glycines
  genomic DNA sequence=SeqID_343; coding sequence=SeqID_829
atggcgctttcaattccaaagtcagggtattcccgctttatgaaggagggggccatgcacttcaaagggttggaagaagcagtgaaaagaaatattgaagcttgcatgcaacttgcacttcagacgcgttctgcttatggaccaaatgggatgaacaaaatggtgatcaatcgtttggagaaacttttcgtcaccaacgacgccgtttcgattctcaatgaactcgaagtgcagcatccggcagcccgaattttggtgatggctgcacaaatgcaggaaaagcaaattggcgacaacactaacactgtggtcattttggctgcatcgtttctggagcacgcactgcaattgcttgacatgggaatcaccgcagtagaaattgcgtcgggttacgaattcgcgcttcaaaaagtcgaggagctcttgccgggattggttgtttccactgctgaggatttatatgacattgtcaaagttcgatcctatctcaaatcgtcgcttatctcaaaacaaacggaccattacgagttaatttctgatcttgttgcgaaagcttgtgttcaaataatgccaaaaaacaataccactgcgttcaatgtcgataacattcgaatctgcaaaattcttggcgccggagtggccagttcgtacgtgacaaatggaatgctttttcgccgtggtgctgaaggcgaagttaaaggcgcgtcaaatgcgcgtgtggtcgttttcgcgtgtccatttgaccttacgcaaaccgaaacaaaggggactattttgatgaacacggcggatgatttgttgcaattcagcaggacagaggagtccgaagtggaagcccaagtgaaaagtctttcggatgtcggcgttaatgttgtggtcgctgccggcaaatttggagacctttacgtgcattttttgaacaaatatggaattatggccgtaagattgacttcgaaattcgatttgcgaagactttgccgaactttgggtgcccaggcgcaggcgcgcatttgtgcaccgtcagaagaagcaattggccattgtgacgaagtgtttcttaaggaaattggcgacactcaggttgtggttttcgataagaaaagcgaagttgggaaagttgccacaattgttgtccgtgggtcttcccagtcgttggtggatgacattgagagggcaatcgacgacgcggtgaacacttacaaagcgctgactcgagacaacaaactgttgccgggtgctggtgcaactgaagtggaattaagccaccaaattgaaattattggcgagaaggaatcgggacttcgacaatatgcgatcaaaaaatacgctactgctttggacattttgccaaaacaattggccgaaaatgcagggcttaagccaactgaaacactcaccgatttacacgcagcgcaccaaaaggggtcgaaatgggagggagtggacgcggtcagtggaaagttgtgcaacgcgatggaagcgggcattttcgacctttactccgggaaatcgttggcattaaaattggcgacgaacgcggccatttctgtgctgaagattgatcagataatcatggccaaaccgatgggcggcataaagccaagggcacccaaagggcaggacgacgacgacgatgacactgggatggcttaatcagcacagtcacagaactcattgccgagtttttgctttaagaaagtattgttgctgcttcatttttgttaattttaatacgtaaatacactttcagtaat

SEQ ID NO: 647 - DNA, 857 bp, Heterodera glycines
  genomic DNA sequence=SeqID_344; coding sequence=SeqID_841
gtttgaatagcgaccgaatatgctcaggaaaaccataaaaacacttcaaccgatatataacgccagaacagcattccgttttcagaccggaggttatgctgcgcctggtactgaagcacaagcacaggaagtaaaaaaacagacaagcacaaaatacgtgattgatgaacaaaagcgggagaagctgactctcttcggtcaatatgtagccgcatgtatgcccaaattcgtccagcaagttcagtttgctggtggggatgaattggaagttctgatccacccaactggtgtcctgcccgttatggccttcctcaaagggcatcactcggcccaattcacaaattttattttcgcttgtggcttggacgttcctacgcttcggacatacactgacgaagttgctccaatcgattccatcactccagtcttttccggtgctgaatggtatgaacgtgaaatctacgacatgtacggggtttggttcaacaaccacccagacttaagacgtattttgaccgattacgggtttgaaggtcatccccagcgaaaagacttcccattgtccggatacgtcgaactgcgttgggaccacgagctgaaccgagtgatttatgagccaaccgaaatgacacaagagttccggaagtttgacttgaacacaccgtgggaggttttccctgcatttcgtgacgaatcgataacctccggatacaatgtcattcaaaaggcaggcaaaattgaggccaaaaagcttgatgatgcttccaaaaaaccgtaatttgtatcaatataatagaaaccaagttattagaaactcattgtcagtttaaatacaatgattaaaaagtataaacgaa

SEQ ID NO: 648 - DNA, 1742 bp, Heterodera glycines
  genomic DNA sequence=SeqID_345; coding sequence=SeqID_837
gaataaccatcatccaactgtaaatggaaatggctttggcttgaccaatgggacacatttcgctgatgacttttctgagtccattaaagacgttggtattattggcatcgaactttactttccaaaatcctacgtgaaccaagaagaccttgaaaaatttgacaatgttacatcaaataaatacgtgctgggacttggccaacaagaaatgtgcttttgccatgagaatgaagatgtttgttcactttcgctgactgttgcagctgcactgatggacaattacaaggtcaatccaaaggacattggctttctcgcggttggcaccgaaacattggtcgacaaaagcaaaagtgtgaagtcagtgttaatggatttgtttgccgattcgggcaacatggacttggagggcgccgacgagaaaaacgcgtgtttcggtgggacccaggcgttgtttcatgccgtcgattggatgtacgctaattacgcaacagaaaaacgccttgccatcgttgtctgtgctgatgtggcagtttattcggctgggcccgcccgatgtacgggcggtgccggtgcagtggcctttctgattggaccaaatgcaccgattgcacttgaacgtggccttagggcatgccattctcaaaatgtttacgacttttacaagccaattggaggcgttagcacgcaattcccacgagtggacgggccaaacagtgtggagacctatttgaacgccgttgacatgtgttacgggcgattttgtgagaaatggaacaagaaattctgcacagggcccccttgctctctttcggattttgtcgctgtcattttccactcgccgtacgctcgtctcacccaaaaagccttttcttggctgtccttcgtcgactttaaacggggaatgatggacgatggtgtcacagctgatgatgatgatgtgtctgattgggatcaactcagcgcatacaaatcgaaatcactccatgagatttttgcggtggaacgcacaaaaactcgctcggacggcgatcgatttactgacaaaattttgcggatgagttcgcggacagcggatgccaaactgaatccatttttggagtttagtcgacgcattgggaacatgtacacgccgtcggtatatgctcagctgatcaacgtctttctgaacactgaactttccgataaatcgaacgggaaacggatcctcatattttcttatggcagcggttgtatcgccgcaatgtactcacttcgtttcaatttgtacacggaaaaactgatggctgcctacggcgcaattaaacaaagcgcgaaaaaggcacacgcgcgattggaccagcggatccgacacagccccaagcagtttacagccgcattggagagaacggagcaaattgtcgctggaggggatacttacatcgaaactcccgatgatggcaaacgcagtgatggcattccaatgtttgccgggaccttttatttgcgagaaatcgactcaaaacagagacgcttttatggccaaattgatgatgccaatgagtgatgacagaaagggaagaaaaaacgcaatattcgacgaaatcccatgacattcccttcccttaaggatggcgtcggtccttaataattttattgtcccatcactttccaattgtccccgccttccgtccatttttaatttctatagatgacaaattattttttataattttatctcatgaagctcagttaaattttgtgat

SEQ ID NO: 649 - DNA, 663 bp, Heterodera glycines
  genomic DNA sequence=SeqID_392; coding sequence=SeqID_938
gtttgattattcctgatttatttttttgcggatggggcaactattctcttatttcaagtctttgtttggtcatcgggaaatgcgaatactaatattgggcctcgacggtgctggcaaaacgaccattctttacaggctgcaggtgggcgaagtggtgacgacaattccgaccattggctttaatgtggagcaggtgacttacaaaaacttgaaattccaagtttgggatttgggcggccaaacgtcgatccggccctattggcgctgttactactccaacaccgatgcaatcatttacgtggtggattctgcggacagagaccgagttgggatttcaaaacaagaattggtgtcaatgctggaggaggaggagctgaagaacgcgatcctcatggtgctggccaacaaacaggacatccatggctgtctgtccctggcggaagttcacaaggcgttgggcttggaggcgatacgaaacaggacattccaaatcttcaaaacctcagcgaccaaaggcgacggactggacgaagcaatggaatttcttgctgcttctcttcaatctgccaaatgatcagaccaatgcataattatttccaattattgtattacagatttttacgttctcaatttatttattttttgcttggtaaatacaatgtc

SEQ ID NO: 650 - DNA, 999 bp, Heterodera glycines
  genomic DNA sequence=SeqID_393; coding sequence=SeqID_879
atggccgaatacgatttgattaagcgccttattccctttttcgacttgcatcttgtcattccgttgttggaatacatcgaacagcaaaagatttatgacgaggaatccttcaaaaaagtgcatttggccgttcttcagaagacgaatatggtcgacagtctcatcgaagggtggggcaaagacgagcgccttttggagcagtttcaggcgaagaagcagcaggtgttggaggagagagaacggctcaaggatatgtgcgactcggcagcagaaattttggaccacaaggacgtgaaggaaatgacggagagcacaacgcgggacagagaggggaataacaaagtgttggagtacatcggagaacgcttcgggttcacaatggagatgcttgacagtctgtacaaatacggaaaatttttgtacgaatgcggaaattatttggccgcctccacttatttggacttttatcggaatttgatcccccaacacgaccccaactatttgaatgcccaatacgggaagttggcgtccgaaatactgctccaaagttgggaccacgccaaggacgacctgaacagactgcgcgcctacgtcgactcggagccgtttggctccgaattggaactgctgcagcaccgggcctggattctgcattggtccctttacattcacttcaattacccgaagggccgggacgaagtgatcgacctttgtctgaaccagcagccctatctgaacaccattcagattctctgtccccatttgttgcgctatttggccgtttctgttattaccagcaaaaacaaacagaaagcgagcctcaaagacttggtcaaaaccatcgaagtggtaagcgggggagaatattgtcacaacaattggaattgggatgtctttatttgccattttcgggttttgcaacataaaatgttctaaaaaaccaaagaaacaacttgtattgtaacatatgtgagtggttttaccctttctcatttgcag

SEQ ID NO: 651 - DNA, 900 bp, Heterodera glycines
  genomic DNA sequence=SeqID_394; coding sequence=SeqID_864
ttttataaaacttggcaaaactcttattaattgccgttaaagattgatttgaagaatggctgccatgaatcctgaatatgactatctcttcaaattgctgttgatcggcgattctggtgttggcaagtcgtgtctgttgcttaggtttgcggatgacacctacacagagtcgtacatttcgaccatcggcgttgatttcaaaattcgcaccattgagcttgaggggaagacgattaaacttcagattgaacgcttccgcacgattacgtccagttattatcgcggagcacacggaatcattgttgtttacgacattacagaccaggactccttcaacaacgtcaagcaatggctccaggaaatcgaccgatacgcatcggagagtgtgaataaacttcttgtcgggaataaatgcgatttgaccaccaaacgtgcgatagagacgaatgttgccaaggagtatgccgaccaattgaacattccattccttgagacttctgccaaaaactccactaatgttgaacaggcgttcatcacaatggccactgaaatcaaaaatcgcatgggccctcttcaacaggccggtggcaatgcgtccgccgtgcgcattggtccgtctcagccggtgcgggacaaaaaaacgggcggatgttgctgagttagccaacggaggacagcgcagggtggacaaaacaaagttgtgagaatgtgcgtgaaagtgatttaatttccggcggacgaatgtttgtgcggcgttcgttcccccccccccccccccatttcgtctcttttctttcgtccatttgtatgcctatgcatcaattatcaatggatgataatcagtgggaacttttgacacatgctttttgtattggtttataagtaaaagtttaatgatta

SEQ ID NO: 652 - DNA, 275 bp, Heterodera glycines
  genomic DNA sequence=SeqID_395; coding sequence=SeqID_998
tccaacaaaccgccgcctcagaaacgacaatattcctccaccagcaaaaacttttgcgacttgtgcaacaaagaggtgtgcaacaagtacttcctgaggacgcacatgctgaaaatgcacaacataatcatagacgagaacaaacagctgatagcgaacattgacacggtggacaaagaacggaagggcgaggtgaagttcaggtgtgacatttgccataccagcatgaacacgcgagaggagctgaagttgcacaagagggagtcgcatggaat

SEQ ID NO: 653 - DNA, 355 bp, Heterodera glycines
  genomic DNA sequence=SeqID_490; coding sequence=SeqID_869
atgagttcagaatcggacgaacagagtgccgatgttaacggactctgttcgcaatcgcttcgatcagatgaaaaagtgtgtcccgacccggacacaattaaaatgtttattggccaaattccgaaggcgtgggacgagttgcaactgaaggaatactttgaggagttcggtccgatttatcagctgagtgtgctgcgggacaaagagacggcctccagccgtggctgttgcttcgtcacttattatcaccggaaggatgcgatcagtgcccaaaatgagcttcacaatgtgcgcactttccccggactcagtcacccgattcaaatgaaaccggcggatgtcgaaaacaaaaacg

SEQ ID NO: 654 - DNA, 2678 bp, Heterodera glycines
  genomic DNA sequence=SeqID_396; coding sequence=SeqID_981
gtgggtgccgcggattcggaaaacgcattatgaattgcccagaggatctgattgtgggtggaattcgaagggacgcccagggcgttcaaatccgacacgccgaggcttttcagacggtttttttggttgcttctgctggcgatgtttaccaacgattaattcgctccaaaaatcacagaatggaaaagttcggcgtctcctttacccaggctcatgccggtgctattattgcggcatggcaacgaaatttcaccaaaagtatttacgaccacacattgaataaacctgcccagggaattcgcgtggtgcatccgctggcctcaacttccatccaggacatgttggagcagttcagcgaattccaattcttcgtcatcttcatcggctacgtgcttatgattatttacgctggttggtcccaagtgcattggcaggggtggtggttttcggtcaagtcgagttgtctgttggccattatcggtgtgctggtgatcactttggcatcggttgccggcctcggcttgtccaccgccatgaatattcacttcaacgcggccaccacgcaaattgtgccttttcttacactcggacttggcatcgacgacatgtttcttctgctgcacaactacaacgatgtgctggaagctgtccgacaaaaagaggtggcggtgttgctcaaagagactggcatgtccgtgctgatcacttccatcaacaatatcctcgcctttctcaccggttgcattttgccaatccccgcgttgcgttctttctgtggtcaggtggccattctgctcacctccaacgtcctctgcattattcttctcttccccgcgttcattgcgttggatttgcgtcgacgtaaagcgggccatcgcgacatgagcttctgcagcagtcgcaaccaattggtgaagaccgactccacggtgaccacccattcctccgaaattgacctgcaacagatgagtgcggctgtgccggtcacttcttcagcaacaaagtcgttgcacaaatggtacacattggtcgggtttctccacggctattacattccgttgctcaggcggccaattgctaagactgtcgttctgttggtgtgtgctgcgatgttcttgttcggttgcttcggtctttactattcgcgcattggactcgaattggccgatgttttgccggagcatacggcgccagcggcctttttgaaggcgcgcgagcgatacttcagcttttaccctatgtttattgtgccgaaaggccccatggtggattatgcgaatcagcaacacaaattggagcagttacggagggacatcggtcggtctaattttgtcatcaaagtggacggggagccagaacaatggtggatgatgtttatgcgcacttggcttcactctctccaatcctctttggaccgtgctgctaaaattggcatttttcctgacgacgatctcaagaaaatggcggctgacgcgttggcacgcaatttcacactttcagacgactttctattggctagaaagttgctttgttctgctggacaacggtttaactgcacggaaatgcgcggtgctaaattgattgaggacggacggatcaacccacgagggttttacaattatttgactgcttggttctaccaagacaatatgatgtattacgtgtcccaagcggcctttttcccgacgcctttgccttggcatttttctgccgctgatgaaagcgttgtgccgcccgccgatccgcttctctactcgcaaattcccttttacatgaatggcctcaccgatacgcagtcaattgtccaaatgatcaaagaaatccgtgccatttgcgaccggtacagtgcggacggtcttcctgtttacccttccggcattccattcacattttgggagcagtacctgaagctgactttttatttggtgtccgcgattttgattattggagttgctgttttgttggtcatttcgattataattttcaacccttgggcagctgcaatggtggcgataatcgttgttaccatgacggttgagttggccggcttcatgggcgtattcggcgtcaaaatgaacccaatttcggcagttacgcttatcactgcagttggcattggcgtcgaattcactgctcacgtcgtcttggcttttttgacctcgcttggctcgagggatgagcgtatggtcgcgtgcttggaacacatgttcatccccgtcatccatggcggactgtccactttgctgggcattgtgatgttggcattctccgaattcgacttcgtcgtcaaatacttctttgtcgtgatgaccgcattggtcatcatcggcctcatcaatgggttggctttgctgcctgttttactttcactaattggaccaccgtgcgagatcactcctgtaaatggtagcaatttgttgccgtgtccggcgtctgaacggtatcggcccgaagacagtccgaactgcttcaccaccccttcgtccacccatcatcaacagtcggacgagcaaaagagacgacgagggtgtaaacggatgttagcggtggacgactcatcgtcggcatcgtccactgaagacggtgctggtgcaccagcattcagcaaatctgacgaagatggtgaacaccaaaagcagcagcaatcggtagactgggacaacacagtgactaattaa

SEQ ID NO: 655 - DNA, 1310 bp, Heterodera glycines
  genomic DNA sequence=SeqID_397; coding sequence=SeqID_947
atgggcaaaaaaacgaaaatcgggaagcagcggaaggacaagttctacttcttggccaaagaagcgggcttccgctcacgtgccgcttttaaattgctgcagcttaacaaacgcttcgaattccttcagcgctgtcgtgccctcgtcgacttatgcgctgcgcctggcggttggctgcaagtggccgagcagcaaatgccagtctcttccctgaggattggagttgatcttgtgcccatgaaaccgatcaaaaattgcatcactttgcagggagacataatcgaagaaaagactcggcatgcggtgcgcaaagagttgggcacttgggaggcggattgtgtgttgcacgacggcgcaccgaatattggaaccaattgggcgcacgatgcattccagcagaattgtttgacactttccgcgcttcgtttggccacccaagtcttgcgcaagggcggatttttcgtgactaaaatttttcgatcagccgactcgcaatgtttgattggtgtctttgaaaaattgttcagaaaagtccatgtttggaaaccgtccgcttctcggctcgaatctgctgaaatttttgttgtttgtgaacaatactcgaagcctgacaaagttccatcggaattgttggattctaaaaaagtgttctctgaccaaacggatggaggcgagcgcaaggctaaagcacttggctacggaaacgacgcgttgcttggccaacacagcggactgggcgcaaccgaatttgtaacgtccaaaaatgcgcttcaattgcttagccgggcctcggaattggtgctcgactcagaaagagtgctgaacagtgaacacacgacgaatgaaatcaaagaatgtttgaaagacattaaagtttgtggacctgccgaactgagaagcattttaaaatggcgtaagaaattggttgacgaacagaaaaaggaggaaaaagcgtctaaagaaagtgtaaaatcggctgaagaaatggtggagggtgatactggcgaggagttggaggaaaatactgaattcaaagagttggaagagatcgacgatctgatcagaacagcaaaagccgaagaaaaggcaacgctgaaaaaacgaaagagaaaactgttgaaggcaaagcgcaacttggaagaacggaagaaactgaagatggtccacgagggggacgagccgacgataggcgaggatttggagctgttttctttaaaaacggtgaaaaggttagcggaacgtgcggcaaaagcggtgaagggaattaaagaagaggaggaggaaaaagagagcaatgatgaggatgacga

SEQ ID NO: 656 - DNA, 583 bp, Heterodera glycines
  genomic DNA sequence=SeqID_398; coding sequence=SeqID_862
ggctcagatggcttcggccgcgccgcccctcggcccttctttggggcagcgaggcgtaaacgtggcgaacttctgcaaggagtttaacaatttgacttcgactattcgatttggtacaaatttgcctgtgtctatccacgtcaaaccggacagaacttacgaaattgacattagcactccgaccaccgagtggcttctgcaacaagcggcggggatacgacgtaaccggcaggaggaaggagaaatcgtcggaatgatttcggtgaaacacgtatacgaaattgccaaagtcaaatctcaagacaaatctctcattggagtgccgttaaaaaaaatttgtcaattggtcattgagagagcggattcgattggcatcaaagtgcaaaatgaagatttagacccggaagaatataggaaattcctggaacatcgtcaggaagttgtgcaaagacaattggaggaaatagcgaagcaagaagaggccaaactggccagaacatgatcggattttgattcattgttttctttttctcttcagcttatgaatgaacgtcaagttgtgtaattacactcattcgttcgc

SEQ ID NO: 657 - DNA, 1185 bp, Heterodera glycines
  genomic DNA sequence=SeqID_346; coding sequence=SeqID_844
cagctgttggctcgtgtgttggacaagaacaaacgcgttcaggaagcggcttgttcagcctttgctacattcgaagaggaggcaggccatgaattagtgccttatatgcccgagatactcggcactcttgtggaggcgttcaaaagatatcaggccaaaaatttgctgattttgtacgacgcggtgggcacattggcggacagtgtgggcggcaacctggcagagccaccatatgccgaaatgatcatggacccgttgatgtccaaatgggcccagttgcgcgacgacgacaaggagctgttcccgctgttggagtgcatttcgtcggtggccaccgcactgcacaccgccttctacccctactgcgagccgaccaattattcctttttaaaagaccgagaagctcaacacgatcagccggagaaggactttctgatcgttgcgctcgacctgctctcggagttggccgaagcgttgcgcgattacattgacccgttggtggcccaaagcaacatcatccagctggtgtacatttgtgcacaggacaccaccaacgaagtgcggcaaagcacctttgcactgctcggcgacctcgtcaaggcgtgctatgcacatttgcagcagaacatccatcaattcatcccaattctggcacagaatttgaacccggattttgtgtccgtgtgcaacaacgccatttgggccctcggcgaaatctccatgaaaattggggaccaaatgcggcagtacgtgcccattctgttgccccagctgatccacgtgatgaacagggataagccgccgaagacactgctcgagaacactgccattacgctgggccgattcggcattcactgctctgccgaggtgtcgccctttctcgccgactttgtccgcccctggtgcatgtcgttgcgcaatgtgcgcgacaatgaggagaaggagtcggcattccgtggcatttgtctgatggtcaattgcaacccgcagggcgtcgccgccgcgttcattttcctctgcgacgcgatcgcctcgtggcagacgcccagcgaagagctgcgcttcatgttcggcaggattatttacgccttcaagtcacaagtgggagaggagaattggaacaattttgtcgctcaaattccggaaccgttgaagcaaaggctgggcacacagtaccaattgtga

SEQ ID NO: 658 - DNA, 1097 bp, Heterodera glycines
  misc_feature (21)..(21): n is a, c, g, or t
  genomic DNA sequence=SeqID_399; coding sequence=SeqID_921
gtcttttctttccgatgtctngaattggtaatttcgaaataagaaatgtgtctaaagtcgaacgtatcggtgcacattcccatatcactggtctcggcttaaaggcaaatttcgaaccaatttttatttccgatggaatggtcggacaatgtgcggcacggaaggcagccggattgattgttcgcatgattaaagatggacaaattgcgggcagagctttgctaattgttggcgagccggggacgggcaaaacggcggtggccatgggaatttcgaagtcaattggcggcgatacgcccttcatttccatttcggccagtgaagtgttttccatggatctgagtaaacccgaagcattgactcagtcattccgaaaggcaattggagttcgaatcaaagaggagactgaggtcctttgcggtgaggtcgtacaactcgaaattgaccgtccccagtcgggtgccgggccacgagttgggaaattgactctgaaaacaacggacatggaagcaatttacgacattggaaacaaaatgactgaatccgtcatcaaagagcgaatcacggccggcgacgtcatccaaattgacaaggcaaccggtaagatttcgaaaattgggcggtcgcttgcccggtcaaaggatttcgacgcacttgggccccaggacaaattggtcgcctgtccgtcgggggaaattcagtcccgcgtggaaacggttaacacaatttcattgcacgacattgatgtgatcaattcgcgttcctccgggtatttggcggttttttcgggcgatacgggcgaaattaaaagcgaagtgagggagcaaattgacaaaaaggtgatggaatggcgggaggaaaacaaagcgcaaataatcccgggtgttctgttcgtcgacgaagtgcacatgttcgacctcgagtgcttctccttcatcaaccgttacatcgaatcggacctttcgcccattttggtgatggccaccaaccgcggcattgtgaacattcgtggcacttccgttgagtctccccacggtgtgcctttggacttattggaccgcagccttatcatcaggacgtcgagttacaaagaaaat

SEQ ID NO: 659 - DNA, 1077 bp, Heterodera glycines
  genomic DNA sequence=SeqID_347; coding sequence=SeqID_894
gctgagcgtgagcgtttgctgcaggcggagcgcgaatacatcacacgacgggtgctgaaaattgtggaactgaaggagacggtctgtgccggtggagatcaaggatttgtggtgattaatcaaaagggcattgatccgccgtcgttggatttgttggcacagcacggcattttggccctgcgacgtgccaagcgtcggaacatggaacggctgcagttggcctgcggtggcgaggcggtcaattcggtggacgacctgacgcccgatgtgctcggctgggcaggcagtgtttatgagcatgtgctgggcgaggacaaatacacttttgtggaggagtgcaaaagtcccaagtcggtcactttgctgctcaaagggcccaacaagcacagcatcacgcagctgaaggacgccatttatgacggacagcgggcggttgccaatgcgttgaaagacggtgccgttttgcccggcgccggtgcatttgaaattgcgggatattgtgcactgaaaaagcttgccgacaatgtgaaagggcgtgccaaactcggtgttttggtgccgtaattctttctttctttcttaatccctttcaattattgtcatcattctcattcccaggcttttgctgaggctttgctggttattccgaaaactttggcggtcaatgccggattcgacgcccaggaggtgagggaaaaggcttttaaaaaaattatttatttactcctttcaattgccaggccattgtcaagctggtggagacgttcagtgctgctggtgagctggtcggattggacctggagagcggagagccgtgtgttcctcaggtgtgtcatcagaaatgggcggggacaaatgtgtcgtgccacaaaaaatgaacactttcattcattctcttcccccgtttagagcgtttgggacaatgtgtgcgtgaagcaggcgagtctgaacgcctgtcagaacatcgcctccaatctgctggaggtggacgaggtgatgcgtgccggcatgcgcgacttgaaggggggacagtgaaaatgaacggaacggaaatgaaggagcaacaccaataaatca

SEQ ID NO: 660 - DNA, 1353 bp, Heterodera glycines
  genomic DNA sequence=SeqID_348; coding sequence=SeqID_915
atgaaatttccattggctttcttttctctgtgtttatttgcatttgctgaagtggcagccgaccgggtcctccttcttatagacaatcccacaattcgggaatcgcactccgtcttcatcaaatccctcgaagagcgtggccactccgttattattgccatggctgatgacccaaacctttcgcttatcaaatttggcaaatttctctacgaccatttgatcattttcgcaccttcggtggatgactttggtgggaatataaatgttgacgagatcaccaaattcattgacggtggcgggaatgttctcgtcgctgcagacaaaaatttgggcgatgcgattcgcgaccttgcagcggaagtgggctttgagttcggggaggaccaatcgatggtcattgaccaccacaactacgacactgttttggacgatgggtcgcacacgaccattgccgtgcccaacgcacaactgatcaaagcgccccttatcactggcgaaagtgcgcttttggctcccgtcctttaccgcggcattgcgctggtcgcggatgaactgggccctttgcaaatgattttgatgaccgcttcatccaccgcgtactcacataaccccaacaaaacggttgaagagcgtccttcggctgttggcaagtcgacaattcttttgggagctttgcaggcccggaacaatgcccgtgtcattttgtccgggtctttggactttttttcgaacaaattttttactgcgacggtgaaccaagcggggggccacactgccaacgtaaaaagtgggaatcagcaattggctgcgtccgtcctcaaatggttgctcaaagagtccggagttttgcgcataaaatcagtgaaacatcacactgttggccaaaagtccccgcccgccgagtacacaattatggactatgtgcgatatgaaattggcattgaggaattgcagaacggaaaatgggtgcccttccaaggcaaagatgttcagttggaatttgttcgaattgacccatttgtgcgcgtcactctgaaaaacaacaatggcaaattctcagctgaattcaaaatccccgacgtttacggcgtgtacaaatttttggtggattaccaccgaatcggatacactcatttgactgacgttcagcaggtctctgtccgaccattgaaacacacgcaatacgaacggttcagtcgctgcgcttacccttattatgtgtccgcattttcaatgatggttggggtggtgctcttctccttcgtcttcctctacttcaaagagtcgcccccgcaaagttcgtcctccgccgccccttccgccaaaggcctccaaaaggcaaaggcttcgtaa

SEQ ID NO: 661 - DNA, 1353 bp, Heterodera glycines
  genomic DNA sequence=SeqID_400; coding sequence=SeqID_889
ggaatggcacttaatttggaaactgacaacgttggtgtggtcgtctttggaaatgataaagtgatcaaggaaggtgacgtggtaaagcgaacaggttcaattgtcgatgtcggcgttggcgaggctttgcttggacgtgtcgttgacgcgttgggcaatcccatcgacggaaaaggtccaatcaatgtcagcaaacgctctcgtgttgaagtcaaagcgccgggaatcattccgcgtgttggtgtgcgagagccaatgttgacgggggtaaaggcggtagactcattagtgcccattggccgtggacagcgtgaattgatcatcggagaccgtcagactgggaaaactgccattgccatcgacaccataatcaatcaaaagcgtttcaactcaagcacagaagaaaagaagaaattgtactgcatttacgttgccattggccagaagcgatcgacggtggcacaaattgtgaaacgactcactgacacggacgcaatgaagtacacaatcatcgtttccgccactgcttcggatgctgcgccgctgcagtttttggccccctattctggcgccgccatgggcgagttttttcgcgataacggcaaacacgcgttgattatctacgacgatctctccaaacaagcggtcgcttaccgtcaaatgtctctgctgttgcgccgtccacccggtcgtgaagcttacccaggtgatgtcttctacctccactcgcgtctgctcgaacgtgcggccaaaatgaatgagactcatggcggcggctcaatgaccgctctgccgatcattgagacacaggcaggggatgtgtccgcctacattcctacaaacgttatctccatcaccgatggccaaatcttccttgaaaccgagttgttctacaagggagttcgtcctgcgattaacgttgggctttccgtgtcacgtgtgggttccgcagcacagacaaagtcgatgaagcaggtcgccggttcgatgaagctcgagcttgctcaataccgcgaagtggcagcctttgcccagttcggatccgacttggatgcctccacgcagcagttgttgaaccgaggagttcgtcttactgagctgctcaagcagggtcagtacgtgccgatggcgattgaggagcaagtggcggttatctacgccggcgtgaagggacatttggacaaaatcgacccgtctcaaatcacgcgcttcgagcgtgaattccttgcgcacattcgagcgcatgagcaggaattgctgaaggtcatccgagaagaaggccaactcacaaccgcgactgacgaaaaactcaagaatttggtgacttccttcttgggaggtttcaaggcttag

SEQ ID NO: 662 - DNA, 2644 bp, Heterodera glycines
  genomic DNA sequence=SeqID_349; coding sequence=SeqID_898
atgtctgatccagttccggacaaaagaatcaacaagaaaaagttggagaatatcgaacgacttcggcgtaaaaatgaaacgaaaatatcaaaaaataaatcaaaaaaacttgcccaacttgctgaacgaaagaaaataaagcaaacgcgtgaatcattgttcgaaatgttgcaacaatatcagcttgacgaagggaacatgaatttactaacttccattgcaagtagccaaaaagaagcaggcaatcaaaaacacaaaattgaagttgtgaaaaagctgagatgcgtttccggtgaaaaattgaaaaatatcagagcaacatcgaaacaactcaatcacattgaaacggacagcagttcttgtgaagaggactttagtgggaatggtgaacagcaacaacctgggaaaagcatagaacgaatgccaaagttgacgcatcaaattgaaacttgtttgctggcaggaaataacgcgcggactgcacagaatctcccaattgacaaaaacgaacaaagatatgaggctgcgtcaaaacaaaataaacagcatgccaaaggacaattgcaatgctccaacgccctttctcgcatcaaaggacgccaaattattgttccacgggacgaaaacattgaaaagaagagacgacaattaccaattaatgctgaggaacagccaattgttgaggcaatcaacgaatatcccgtggtcataatttgcggcgagactggttccgggaaaactacgcaaataccccaatttttgtatgaggctggctacacctccaatggacacttaattggagtgaccgaaccaaggcgtattgctgcgataagtatggcatcgcgagttggccacgagttggacaacgaaaaattggcatcataccagatcagacatgaagggaatcgaagtgaagagacaaaaatactatttatgacggacggagtactcttgaaagagttgcagacggactttacactttcgcgttactcagtcgttgtcattgatgaggcgcacgaacgttccatttatagtgacgttttaattgggcttttgtcaaggatttgtgcgctcagaatgaaacgcggttatcctttaaaactgattatcatgtcggcaacactgaaacttcaggattttcttcgacaaagacttttttccatcagtcaaccaaaagttgtcagtgtccaagctcgtcagtttccagttacaatttattttgaacggcgcactccaacaaattatttggaagcaacattcaaaaaagtgtgtaaaatccacgaggaatacccagcgggtggcatccttgcgttcgtcacaggtcaacgtgaagtcacacatttggtcaaattgctagaaaacaaatacacaaaaatatctgcatcaaaattactgagaaaagagaaaatgaaaaagtgtcggaagaaagagacaaaagaggaggaggaagagggactactgcttgacaacgacgagttcggaacttcggatatggaccttgaagatgaggcgtggcaaaataccttttttgggtctgacgatgaatcacttaatgcttcgcaatcgttcaaaaagtaccctcctctgctggccatccctctctattctctcctaccagtgaatttgcagaagaaaattttcaacgaaccgccagatgacgggtctagggtgtgtgtagtttctacaaatgttgcagaaacttcgttgacgattccaaatgtccgttacgtcatcgattctgggcgggaaaagaagagggaatatgacccgattacgggagtttctcggtttgtggtcggatggtgttcaaaggcgtctgcagaccaaagatccggtcgtgccggacgagttcagtccggatacgcattcagattgtattcttcggctgtttacgaagatatgcgcgatcattctactcctgagatccttaataaaccgatcgaccaattgattcttatgttgaaagcaatgaatttcacgaaaatcgacaattttcctttcccgactcctccaagattggaccaaatcaaatcttctgagctgagactttctcacataggggcgcttagagttcaagaagggctttataccatcacacaacttggacaatcacttgcgcagctgcctctcactccttcttttgcgaaggtcgtcatcagttcaattcgtggcggacttcttccttttgccgtcactttggtgtcggctctctccgttcgtgaaccattattgttcatttcaagcacaaaagaggacggaacggaagagagacgaaaaagaatgtccgaagtgattaagcaaagatttctttggtgtgctgttggcgaggctcgactctttggtgatttgacagtaattctgaacactgttggtgctgctgactatgaggaagagaacgctcacgcaatcgaagccctaggacttcgccctaaggccctaaaggaaatcaacaaacagagacatcagctgacgcttcttctgaacaaatccgattctggtggagaagttgcccgagaagttcagaatggatgcaccctcccaagaacaactgaggagattaaggcatataatggtgaaatgccatccggataaattggcaaagaaagttcagtcattggatgcaccaaagggcgcatataaaaca

SEQ ID NO: 663 - DNA, 1684 bp, Heterodera glycines
  genomic DNA sequence=SeqID_401; coding sequence=SeqID_936
acctgggccagatggcctcaaaggcatggatgggctgcccggctttcctggctccaaaggcgaaacgggagcaccaggccgagacggacttccgggaatgccgggcgagaagggcgatgccggtttcccgggcgcaccgggccaagacggtctgcctggcataccaggacccaagggcatctcaggcttccccggcacgcctggagcaccgggccaatctgttggtggggtgaagggcgagccaggcttccccggaattccgggcagagacggcacgccagggccgatggggccaaagggcgaatcgggctttccgggactgcctggaatacctggacaaaagggcgaagatggaatgccaggatttcctggacagaagggcgagcctggaataccaggaattccgggaaaacgcggcgaagacggactgcccggaccggcagggtttccaggcccagttggaatgccgggcgagaagggtgacacatgtgtgccgggtgcacctggcctgcccggattacctggtttcccaggccctaaaggcgaagtcggcctcccaggcttcccgggccaaaagggcgagcctggcttttctggccagtctggactgcccggtttgccaggtgccaagggcgactccggcctgccaggattgcccggactgcagggaatgcccggccctgttggaccacctgggcctgagggtttgcctggtgcggaaccgcttcgtcaaggaggtcaaaagggattgccgggaccgccgggagtgcccggactgcgcggagagaagggacagcccgggctggacggactaccgggcccatcaggcattcccggcacaacgggacaaaagggcgagtccggctaccctggtcaacccggctttcccggcgagaagggcattcaaggcttgcccggccttcccgggctggagggcatgccaggatcgtctggtccgccaggtctacctggcttgccaggcccagccggaccaagcttcagagacggttttatcattgtcacccactcacaaactgctcaagtaccgcaatgtccacaagacacaacaaaactgtgggacggatattcactgctgtatttggaagggaacgaaaaggcccacaaccaagacttgggtcatgccggctcatgtttggcccgcttctccacaatgccattcctgttttgtgatttcaacgatgtttgcaattacgcttcgcgcaacgacaaatcgtattggcttgccacgggagaagctcttccaatgatgccggtcaatgagcaacaaattgaaccgtacatttcgcgttgtgccgtttgtgaagcaccgtcaaatgttatggccgtccattcccaatccattcaaattccaagttgcccggccggatggagctcattgtggattggttattcgtttgcaatgcacaccggtgctggcgcggaaggaggcggacaatcgttgagctctcccggctcttgcctggaagatttccgaacaactccgttcattgagtgcaatggtgcccggggatcatgccatttcttcgccaacaaattcagtttctggctgacaaccattgaggaccagcaacagtttactatcccacaaagtcaaacactgaaggcgggcaatcaacgttctcggatttcgcgctgccaagtttgtaccaaaacaactcgataa

SEQ ID NO: 664 - DNA, 741 bp, Heterodera glycines
  genomic DNA sequence=SeqID_402; coding sequence=SeqID_1010
caatgaattgtggcaccgttttaaggttgtcaacttcaacggacaacatcacttcagtgtcacgccagcactacagcatacaccgcaggaggagaagacagaaccagcgaactcgtcgccaaccatcgcgaacttcttcactttcgtctatgacggaaacttcgatggcattggaagtgattactgtgacgcttaacatgaacacggtgaattttttgggcatttccattgttggtcagtcgtgtcctcgcggcgacagtgcggttgctttggacggtcgtattgagccgggggatatgattttgcaggtgaatgacatatccttcgagaacttcaagaacgaccaggcagtcgaagtgctcaaaagggcactaacagtcgctaaaagcttcgatgccaaccgaacgaattatttttcggtgccatcgcgtgagccggtcagaccgattgacacccacgcgtgggttcagcacaccaacgcagtcaggggcatgaccagcactcttaactccggcctcgacattcgcgatcgaacgtggctgaaaatccccattcccaggtcttttctcggtagtgctctcatcgattggcttattggaaatgtcgatggattggacgaccgaaaggaggcgaggaaatacgcctcggggctgctgaaggacaaattcattgcacatgtggtcaacaaggtcaccttcacggaacaatgttattacatttttggggaacaaagcgcaggtg

SEQ ID NO: 665 - DNA, 1265 bp, Heterodera glycines
  genomic DNA sequence=SeqID_403; coding sequence=SeqID_995
atttgttgttgccgaccgaaatgccatttcgcgaccgaacggcggaattcagaacagtggcaaagtcatgtcagcttcgacagcagccaaatggatatatgggaaagagcgaacgagaaaaaatcgttaattcttcaattcagttcaaccaattggccaagcgcattggtcgggatttaagtatgacatgtgccaaaatggagaaattggcacaattggccaagaaaaaatcattgttcgatgacagagctggggaagttgaagaactttcacaaattatcaaacaggacatcacgggcctcaacaaacaaatcgccaatttgcagcaattggccactcaccgcacttccggcggctcttccgtttcgttgcggcaggagcaacaaagccaaaaccactccaagttggttgtggttgggttgcagtcgaagctcgccaacattagcaaaaacttccaaaatgtgctggagattcgaacagagaatttgaagttcaaaagagagagacgagaaaagttcagtcagtcggcggcaattccttcgaatttgcccccttcgacaagcaatggacaaatgggttcgcttcttctgcacgatgaaatggcgtccgcttccagcggttcttcgacctttgcgttggacatggataaattggagcaacagcgggtgcaggaacagaccactttactgctcgacgataccgagcagttccaccaatcccggttcaacgccatggaaagcattgaaagcagcatctctgagctgggcacgattttccgccagttggccactctcgtctcggaacaaggcgaaatgatcacgagaattgactcaaatgtggaggagagcagcctcaacgtggaggcagcacaccacgagttgctcaagtatttcaacaacatttcccgcaaccgttggctgattatcaaagtgttcggcgttctgatggcattctttgtgttctttgtgattttcctcacctgatcggctgataaactcagttctgcggagattccttcacattgtcatcataatcactcacagaattttattctcttaaacagcagtcaaatcattgaccaaatattcctaacttattacccattctttattgtgttaattgttggtcatcattaggtctttctgaaaatcgctttgtgacggttccattcgcccgttccttcttctgtttaaactcttccactcctctttagtccatgtgatagctttgcgactcttccgcttctgaataaattattttatgta

SEQ ID NO: 666 - DNA, 266 bp, Heterodera glycines
  genomic DNA sequence=SeqID_496; coding sequence=SeqID_1004
tacgatttattcacccatttcattttttgccagatttgtcgactggttcagctaccatttgtcaaactttgagtatcgttggtcatggagtgattggattgaatgtgtcgagttggattcattgcatccaaagcgcatttttgtacgtgaagtcattgaaaagtgtttgcgcttttcataccacaaaaaattggtcgaatttttgccctcagaattggcgccgatcattccgggcgagctgaacatcatttacattcttgacgacc

SEQ ID NO: 667 - DNA, 1582 bp, Heterodera glycines
  genomic DNA sequence=SeqID_350; coding sequence=SeqID_1000
gttacatttaattaattattttggttcggatggtttctgtggtcgctgggagagtgcatcttttgccgcgcaccgcctcttttggcaaatcgtttctttcatcggatgcgactaaaaagcctgataagacttcctttggcaatttgaacgactctgatcggattttcactaatctttacggtcgacatgactatcgcctcaaaggcgctttggcgaggggcgattggttcaaaacaaaggaaattattctgaagggtcccaaatggattctcggcgaaattagcacttccgggctgcgcggccgaggcggggccggctttcccagcggaatgaagtggggcttcatgggtaaaccgttcgacggtcggcccaaatatttggtggtcaatgcagacgagggcgagcccggcacatgcaaagatagagagataatgagacacgaccctcacaaattgatcgaaggttgtcttatcgcgggcgttgcaatgggcgcgagagccgcttacatttacatccgaggcgaattttacaacgaggcgtgcattctgcaagaatcaattcacgaagcttacaaagcgggttacattggaaaggactgtcttggcaccggctacaacttcgacattttcgtccatcgcggagcgggcgcttatatctgtggggaggaaacggcactcattgagtcgttggaagggaagcagggaaagccccggctgaagccgccatttcccgcggacatcggattgttcggctgtcctacgaccgtaacaaatgttgaaactgtcgctgttgctcccgcaatttgtcgccgcggtggcgcatggtttgccagttttggcagggaaagaaaccgcgggacaaagttgtattgcatctccggccatgtcaatgatccgaccaccgttgaggaggaaatgtccatcccattgcgcgatttgatcgaaaggcacagtggtggagtgatcggtggttgggacaaccttttggccatcattcctggcggttcatctgtcccattgttaccgaagagcatttgtgacgatgttctaatggatttcgatgcgcttgtccaagtgaattcggggcttggcacagcggcggtcattgttatgaacaaacagtgtgacgttgtcaaatgcattgcgcgtcttgccgagttttacaaacacgaaagttgtggacagtgcacgccttgccgggaggggtgcaattggctgaacaaaataatgtggcgcttcgtccagggcaaaggagtgcccagcgaaattgacatgctgtgggaactgacaaagcaaatagaggggcacaccatttgcgctttgggagacgcagctgcttggccagtacagggactgatccgacattttcgtcctgaattggagaggcgcatggcgaaatatgcggagagtcatcccgaaataaaggaaactttagcgaccgcataaaaacctttgttcatttgcttggattaggtgaatttttgctatgtttgtacagagtaaaaaatgatggataggctcataaataattatttattcgcttaattagttgttccgttttaattaatgaactcattgcgcaa

SEQ ID NO: 668 - DNA, 1184 bp, Heterodera glycines
  genomic DNA sequence=SeqID_351; coding sequence=SeqID_832
atgggaagacccgaattttctccacgcggtggcggcggacgaggaggtgagaagagaaatcgcaaaggtttccgaggccgtggcggtggtggtgaccgtgggggcagaggcggtggtggtcgaggcttccgtgggggcggtggtggtggcggttttcgtcagagcaacggggagggaggcggcggtggcggagggtttaagggtggtcgaggaggcagtccacgcggtggtggtggcggtcggggaggcggtggttcgccgcgcggacgcggtggctcgccacgtggacgcggcggttcaccccgcgggggtggcgccggcggaggcatgcgcgggggacgcaaggtcattgtggagccgcaccggatcagaggcattttcatcgtcaagggcaaggaggacgcgctgtgcacgctgaacatggtgccgggcgagtcggtgtacggcgagaagcgcatctcctcccagcagaccgaaaatgcgctcgagtaccgggtgtggaacccgttccgctccaaactggccgccgccgtcatggccggcattgaggacacgcacatttacccgggtgcccgtgtgctttatcttggcgccgcttccggcacttccgtttcccatgtgtccgacatcgttggacccgaaggcatggtctatgcagttgagttttcacatcgcagtggacgtgacctgctcggcatggccaagaagcggcccaacgtggtgccaattgtggacgacgcacggcacccgcacaaatactccatgatgattggcattgtggacacaattttctcggacgtggcacagccggaccaggcacggattgtggcacacaatgcgcacaaatttctgaagaacaacggccatgtggtcatctccatcaaggcgaactgtgtggacagcacggcggagccggaggcggtgtttgccggcgaagtgaacaaattgcgcgaggagcagttcaaacccattgagcaggtaacactcgagccgtacgaacgtgaccacgcggtggtggtggccgagtaccgagccgccaaaaagaaggtcaagaaggaaaaaatggaggaggagtaaaggggggcggaggacgtcaaaatgcgttaatggtggatcctcactttttgttatttgttgtttttttcttgttttgcacgccgatatttaaaaaaatttcacatttg

SEQ ID NO: 669 - DNA, 835 bp, Heterodera glycines
  genomic DNA sequence=SeqID_404; coding sequence=SeqID_1019
ccctactttgtgaagatgcccaactttctgaacgtcgtgtcaaaaaaatttgacccggaaacgtacgaggacgaagtggaggaggacgacgcgctggacgaggagggacggcgaacgcggctcaaagtcaaaatggaaaacacaattcggtggcgcattgcgcgcgacagtcagggggaggagaagcgcgaaagcaatgccaaaattgtgcgatggtcggacggcagcatgtccctctatttgggcaaagagatcttcgagattgagaagcagcggctgatggacaacaaccatttgtacacgcgccaagggaccgcgctgcaggcgcaagcgctgttccgtgaaaaactcattttccgcccgcattccaccgaaacgatgacccatcgcaaaatgacgatgaacatggcggagaagacgaacaaagcgcagaaggtcaaagtgttggcgcaagttggcgacaaccccgaggcagaacgaagggaactcatccggacggaggaggaaaagctgcgggccgcggcgcagttgacagacatggcccccaatgggcaaaaacactcccatttattttttccaaaaaattgccgaaaagaatcaaatatttgtaaaaaaataggagccaacacacaacacaaacagcagcagacatcagcctcaacagaagaagaaaattgtcatcgatgaggacgacgaatgacaatggcacagaacagcgaagggagtgacaatcggcgatttccccaaatgggggagggttttttggcagaagtcgaaaaaatgtcaaaatatggttttttgtgctcaaaactttatgattaaaaaacgcggccag

SEQ ID NO: 670 - DNA, 386 bp, Heterodera glycines
  genomic DNA sequence=SeqID_491; coding sequence=SeqID_976
caacaaatgcacaaccaattccttccgcttgcgactgcgttgtcgtacatccgtcagtaccattcgccttccgtttatggcaaatcggatgaactgttgcagctgcgcattgagctgaacatgaccaccgaaaaagcgaccaaattcgtgtcagattcgcgtcaattggttgtccttccgcatccttttcaacactctgaaaagcgtaccattttggcatttgccggcaccaaagaagcgcaacaggaagtgatgctaaacggagcggacattgcaattgggccggaaatggtcaaaaagattctcaagggtcagttcaacatggacgactacgacttttgcattgcccacacggacatggccaagcacattctgccacttcgcgg

SEQ ID NO: 671 - DNA, 1357 bp, Heterodera glycines
  genomic DNA sequence=SeqID_405; coding sequence=SeqID_901
tttaagcatcgttttcaatattatggcaacttccgaagcacccaattatgcattgtatgaacatgcagtgggttacacactattcaagatcaaggaatatgaagacattggtcaaatacaaccagaggtgcaaagtgcgatgacagatgctcagcgttttcaaacgattgtccaagttcatgcatttgacccattcagaaacactgaggcggcgcttgaaaatgcgaataacattgcggaagggattatccacgttgatttgctgaactttttggaggctaatctaccgaaaaaaaagaaaaaggttctgcttggagttggtgatcagcgtttgtcagcttctctagtagaggcattaccaggtattcgtgttgctttcaatggcgtcgtgcaggaattgcttcggggcattcggatgcattttcgcgtgttggccaaggatttgccacatgcacaactcggaaaggcacaactttcattgggccatagctattcgagatccaaggtgaaatttgacgtccatcgtgtcgataacatggtgatacagtcaattgcactgcttgaccagctggacaaagacatcaacttgttcggcatgcgcatcaaggaatggtacgcttaccactttccagagttgattaaaatagtgccggaattatacaaatacgtgtgttgtgcaaccgcaattatgaatcgagaaaaaatggatgaagcggtggaaacgaaacaagaaaaatttaaagagattctggaagatgaacaaaaggcagctgaagtcattgaagcggctcggacatcgatgggaatggaaatttcggaaatggatttgcacaacatcgaactgttcgcaaaacgggtggcatcgctttctgagtatagacagcgtttacaccaatacatcaaggatcgcatggattcgtgtgctccgtctttgtcttcattaattggagaacaggtcggtgctcgactgatctctcacgcgggaagtctcacaaaccttgccaaatatcccgcgtcgacaatccaaattttgggcgcagaaaaagcactcttccgagcactgaagacgaaatcaaatacgccgaaatatggtcttttgttccattcgactttcattggacgcgctcaggccaaacacaaaggtcgtatcagtcgtttcttggccaataaatgcagcttggcctctcgcatcgactgtttctctgatgttcctgtgccctctttcggcgaagcattgcgtcagcaggtggaagagcgtttagtttattacgaaaaaggagtcattccgaagaagaatcttgatgtaatgcatggagctgttgaggaggcgacagtcgaagttgaaaaggtgtcttaa

SEQ ID NO: 672 - DNA, 1284 bp, Heterodera glycines
  genomic DNA sequence=SeqID_406; coding sequence=SeqID_937
tttaaggaatcaattgtcgatgtttatgggcttgtggcgcgcacccctcagccggtcactgcttgcactcaaagcgatgttgagattaaagtgcacaaatttttcattgtctcgcaagcagagcctcggcttccgcttcaacttgaagacgcggttcggcccgacaacgaccaagaggaattggccgtagtcaaattggacactcgtttggacaacagagtgctcgacttgcgaacgcaaacgagtcaggcaattttccgtttgcagggcggagtttgcgacgcctttcgcaagattttgtcctctcgcggtttcatggaaattcacactcccaaaatcatttctgctgccagtgaaggcggtgcaaacgtttttgaggtttcttacttcaaaggccatgcttttctggctcagtcgcctcaactttacaaacaaatggcaattgctggggactttggccgcgtgtttaccattggctccgtttttcgggctgaagacagtaatacgcatcgtcatttgaccgagtttattggccttgatcttgagatggctttcaatttccattaccacgaagttcttcaaactattgctgagatgttcattgacctgttcaaatatttgcaatgcaattacattgctgaaattgaagcagtccgtcggcaatacccagccgagccgtttctctttacacaaagtccactcgttttgcaataccccgaagcggtggccatgttaaagaaagctggtgttgagcagggagatgaagaagacttgagcactccaaatgaaaaacttttgggcagattggtgcgtgagaaatatcaaacggatttctatgttctggacaaatacccattggctgtccgccctttctatacaatgcccgacccaaatgacaccaaatattccaatagttacgacatgttcatgagaggcgaagaaatcatttccggtgcccagcgtgttcacgactcggcaatgctcaccgaacgtgccaaactgcacgggatagacattgagaagattcagtcatacatagacgccttcagatttggatgcccaccacatgcggggggaggaattggtttggaacgcgtgacgatgcttttccttgggttgcccaacgtgcgtttggccagtctttttccgcgcgacccgaaaagaataacgccatagaaggaagtgagagtttaagcgactttactgttgttttgcaaatattcattcatataagttgttttacaggaaattgtttttgaacaaaaaataaatattgttctggtc

SEQ ID NO: 673 - DNA, 1722 bp, Heterodera glycines
  genomic DNA sequence=SeqID_407; coding sequence=SeqID_907
gaagtgcctttcatcgtacagaataacgtcacaaaacggacttacaccaaaggcatttttctcggcaagggcggcttcgcacggtgctatgagttgacggacaaccaaacgaagaaaatctatgcgggcaaagtcgtgtccaaaacactgctggtgaagaaacatcagcgagacaagatggctcaggaaatccaaatccatcaagcgctcgcccacccgcacgtcgtcaagatggaagggttcttcgaggatgatgacaatgtttacattctgttggagttgtgttcgcggcgctctctcatggaacttcacaagcgcagaaaggcagtcaccgagccggaagcgcgctatttcactttccaaatcgtcgaagcctgcaaatatttgcatgggaagaaaatcatccaccgtgacttgaagcttggcaacctttttctgaattcggaaatgcagctgaagatcggcgactttggcctggccacggtggtggactacgacggggagcgcaagaagacgctttgcggcacgcccaattacatcgcacccgaaatgctggacaagaaagggcactcgtacgaagtggacatttgggcgatcggctgcattctctacacacttttggtggggaagccgccatttgagacggaaactttgaaggacacgtacaatcgcatcaaggccaaccagtacaccattccgcccaaaataggcaaagacgcggcttccctcatcactcgtctgctggcgccggacccagcgaggcgaccgcgggtcaccgaaattctcaacttccaattcttcacggacggctttttgcccaaagtgttgccgagttcatgtctgaccatggctcccaagttcaacatgcatagaactaacattttctcactattagttggaccatgtccccagtcctcgtgccgccaaaggccccgctttcactggacatgcgccgctagcctccgtccccgagacgaaagtgcctccgcaggcggtggcggtaaagcaggacgtggcatcggcgagaacaacgatgtgccggccgatttctacttgtccgatttgtacgcgcagctgtgctctctgctgaatacaaatcccgagcggttcagcgaagcggacaaagtctcagacgagatcgaagatccgagggcgcaacccttcttttgggtgtctcggtgggtcgactactcggacaagtacggactgggctaccagctgtgtgataacagtgtcggggtgctgttcaacgacaacaccaaagtcattttggacgcggctgggaatcagttgcaatacaccgagcggaacaacaccgaacacttttacggggccaacaaatacccgcaggcgctggagaagaagatcactctgctcaagttcttccggtcgtacatgaacgagcatctgatgaaggcgggcgccaacattaagatgcgggacggcgacgagttggcgcggctgccctgcctgaacacgtggttccggacaaagtcggcgattgtcttgcatctgagcaacggcactctgcagatcaacttcttccaggatcactccaaattgattgtgtgtccgctgatgagtgccgccacatacatagaccagcagaagaatgtctttacctgcaaattccaatatttggagaaatacggatgtcctaaagatttgtgtcagagactcaaatacactaaggtaattcgcttgatgaaaactattgaataa

SEQ ID NO: 674 - DNA, 2044 bp, Heterodera glycines
  genomic DNA sequence=SeqID_408; coding sequence=SeqID_1005
aaaatgttttcgcaacaatcgccgcccactttcccacctgtgccgcaacagccccaggcttttccttccatgccgcaacaacaacaacaacaacaacagggtttccctcccatgccgcaacagccccaggcttttcctcccgtgccgcaacaacaaaccgcctttccatccatgccgcaacaacagcaacaggcttttccacctacttttccttccgtgccgcaacaccaacaacaggcttttccacccatgccgcaacagcaagccgtgccgcaacaacaacagaattttcctccaatgccgcaacaagacgcttttactcaaatgccgcaacaaccgcccacttttccacctgtgtcgcagcagcaacaggcttttcctcccatgccgcaacaacaacagcaggcttttcctcccatgccgcaacaacaacagcaggcttttcctcccatgccgcaacaacaacaacagggtttccctcccatgccgcaacaacaacaacaacagggtttccctcccatgccgcaacagccccaggcttttccttccatgccgcaacagcctcaggctttttcggttggattttacggtccaagtaatttggcttccgtttgctatgactaaaaacagattccggtctctaagttcccgagacttttgctttagcctaaaaagccctttttggatgtacggaccgcaaacatcgagccgcaaaataaatgggaatttaaaaaaaatgttttttttaaagcagggcagcgcttttccacctggccaaccgccacagccgcaacgacagcgtcttgacccggacatgatgccaagccttgttcaagtggctgaggatgaccagagcacgcgttccggactgtttccgaccggctttccgcaagcggaaagcccaccgcttgtcagcacggaaatcatcgcacaggaccaagggaatgccaatccgaaattcatgcgctcaacactgtatgccgtgccgcaaagccaggacatggtcaaggccacccaactgcccctgtcgttggccatctgtccgtttgccaagctgcaccagtccgagtatccgccaccggtgatcgatttgggtgaaattgggccggtccggtgccagcgttgcaaggcgtacatgtgcccgttcatggagttcattgacggaggccgcaaatttcggtgtccattctgccgtgccagcacaccagtggaggatggttattttgcgcatttggatcacaccggacgacgcactgacattcagcatcggcccgagctgtacctgggctcctacgagtttgtggccaccaaacagtactgcaaaaatggcacgccgcccaagcagccggcatacattttcatgctggacgtgtcctacaacgcggtgcgcaccgggctggtcgagctgttctgccgcaacatcaaagacatgctcagggagttgccgagaaatttccgcgccggcgcctcctccatgcgcattgggctggccacctatgaccagacggtgcacttctacaacctgagccagcccggtcgggccgaaatgctggtggtcagcgacattgcggaagtgtttgtcccgttcgtggacggcttcttggtcgagtttgaacaggccgagaatgcgctcaccgtttgcttgcgcgagattgtgaacaattttgcgcacacacgcatcaccgaaactgcgctgggcccgaccatccaggcggggctggacgcgttgcgcagcgcggaccgggccggcaaactgttcattttccacacgtcgttgcccgtgctggacggtgcgccgggccagctgaagaaccgggaggagcgcaagctgttgggcacggacaaggagaagaccatgctgacgccgtccatcgacttctacgccaagctgggcgaggagtgcgtgaagtggggctgtgccgtcgacttgtttctgttccccaacgcttttgtggacgtggcaaacattgcgccggcggtgaccaccaccggcggcatcatctacaaataccaatactttgacgtgcgtttttgcaatatttaa

SEQ ID NO: 675 - DNA, 766 bp, Heterodera glycines
  genomic DNA sequence=SeqID_409; coding sequence=SeqID_904
catgaaaccaacaatcgatttgaagcaggacatttccaagtacaaggaacgcttccaaaaacttcatcataaaagagaagagtcaagaaaaataaaccacgaacacgtcgtggaggaggatcgacgtctgaagttgcccaacaattttgaggcaaagcgaaaacgacaagaatgggagttggaggagcttgtggcaagaaaggaagcggaggagcgtggcgaagattatgacagaataaaggcactgggaacgcaagcagacatcgccgacaaaatggaagcggcaaaacgaagaaaagcaaaccccgacacgggatttgcgagttatgaagcgatgtcaattcggcaatacgaaagaatgaccaatgggataaagccggacatggaatcttaccaaaagatgaaaggagtcgtcggagaagatcaattctacgcaagtgcaaatacgttgatccaaggctcgcattatcccaccgacaaggcactcgataaactttcggaggatgttcataaccagatgaagaaacgtgaccagtaccaccgccgtcggatgttcgaccctgatgccccgattgacttcatcaacgaacgcaacagaaaattcaaccacaaattggagcgctattacggcaaatatacggcagatattaaagaagatttggagagagggacggccatttaaaagaatagtgaaagcgaaagtattgacattgaaattggattaaatcacagataatctttgaaattggattaaatcgcagataaa

SEQ ID NO: 676 - DNA, 468 bp, Heterodera glycines
  genomic DNA sequence=SeqID_410; coding sequence=SeqID_954
catatgacggaggaggaaaggcgcaattacttacgaatgaacccaaaaatcatcaccaaccaacagaacaagggcaaatacaaattcctgcagaagtattaccatcgtggtgcctattttctggacaaagaggacgatgtgctgaggcgtaactttgccgaggcaacgggcgaagacgtttttgacaagtcggtgttgccgaaagtgatgcaggtgaaaaatttcggcaaagcgagtcgctccaaatggacccatttgacggcggaggacacaacggaccaccagggagtgtgggcaacgccgaccccactgagtgctaaatttgtggcaaaacacgcggcggggatgaaaaatgtattcgaaaagccatcagcaaaaaaacgaaagattggtggggattgaatgactctgtgcttaattaaatgataaatttggcatttaaacggatggataaaatttgaaaaaaaa

SEQ ID NO: 677 - DNA, 721 bp, Heterodera glycines
  genomic DNA sequence=SeqID_411; coding sequence=SeqID_943
ttttccattaaaaaaataaaatggtgcgcacattgaaattccatgagaaaaagttgctgaagaaagtggacttcatcaattggccggccgagttggacaacagtcttcatgagaacaaaatcatgcgccgttaccatgtggagaagcgcgagcactacacactgtacaacaaactgtccagagagatccgagaaatggccaaacgcatccgcgagttggacgacaaaaacccgaacaagttggtgttggcacggatgctgctcggcaagctgttcgacatgggcgtgattccgaccgcggacacgctcgagcgatgtgacaaagtgacggcatcgtccttttgccgccgtcgcctccctgtcgtttgccacaaaatgcaaatggcaccgacggttaggaagtccagccaactggtggagcagggccatgtccgtgttggtgtcgaaatggtcactgatccggcctttttggtcacgcgaaaccaatcggatcacatcacatggacgcgggaatcgaaggtccgaagacatctcagcacttacaacaacgaattggatgactttgaggggtgttgatttgaagaagccaatgaaataaaaatacatgaaaaagacgcatataaaccatttttttttgtttcactgcaatttgtttgttttgttttttgctttttattgttgttgaactgttttctcatggacggtaaaactaaggaaccata

SEQ ID NO: 678 - DNA, 518 bp, Heterodera glycines
  genomic DNA sequence=SeqID_497; coding sequence=SeqID_895
tttgaaaaagcctatgctttttaccgtaaaaagaatgacacggccgctcttggagtgatcagaaaattggatggttccgtgccgcgtgtgatggaattgaaggcgcaaattctgtaccgaatggaacaataccaagaagctcttgaattgttcaagaagttaatccgaactcacagcgacgaatttgacgacattcgacgagcgaatctcatcgcagtcaaagcgcgacttcagtcccaaggcgactcgcaagaattggacttggccaacttggagtccttcgagactatgtacaatacgtcgtgccatatgatcgcatgtcaaaagtttgacgacgccctccgactgctcgaaaagacggccgttgaatgtgaacggtcattgaacgcggacggccttggcaaagaggaaattcagcaggaaatggcaccaattttggcacagaaagcgttcacattacaaaaattggaccaaaagaaagaggcactaaaattatatcaaaatgtgctgaaaaccaa

SEQ ID NO: 679 - DNA, 570 bp, Heterodera glycines
  genomic DNA sequence=SeqID_498; coding sequence=SeqID_1008
atgagtggcaccgataggttgccaagtatttctgcaaatgaatcattttcgattgattctgatgttgccagacgtttttgtcaggaaaacagagaaattgttcagatttgtgcgttgttggcgtacaacaaaacatatatcgaattgttggatgaattaattgccaaagctgacgaggccgtaagacataacagagatgcgcaaaaggtggtcaaggataagctgcttcgtcctgataacaagccgggaaaacgtcgacggagaaaggatttcggactgcactaccgatacccatacttcagagatgccagtggaatggtaccagcacaaaacatggagtctttggagttgtctcgcgtctgttctttcaacccactgacggaagaagaaaaaaagtgtcagttcattaagaagcttattattgtttttgccgggcccgtccgggctcaacttattgttacacttaaattaattaattttaaagggacagaaaaagagttgagggggttgcgagaagccgtggcgcagtcgctcaatgaacaacaaataataaaattggatgccaagtga

SEQ ID NO: 680 - DNA, 819 bp, Heterodera glycines
  genomic DNA sequence=SeqID_412; coding sequence=SeqID_874
cctttgcgatgaaagtcatcaacgagtttggctatcgtcaagatgcccgaacacccagccaaatccgcaacattgtctatcaaatgggagtttactcacacgcggacggctccgcttacattgagcaaggcgagacgaaggtcctttgtgcggtttacggtccgcacgaatgtcgcttccgatcacgagccaaagaagacgaggccattgtcatttgccagtacagtcaggcaactttttcggttcctgacagaagaaacaggccgcgtggcgatcgtcgaggcaattccttttcccaccttttggagagggctttcgaatcagtcattttcacacatttatatcctcgaagtcaaattgatatattcttcgaactccttgaggctgacggtgccaatttggccgcctgtgttaatgtcgccagtttggcactggctgatgccggcattcccctgcggggactgctgtccgccgtcgaatgtggtagtgctgatgggttgccttgtgcggatttgagttctcgtgaacatagtgaattggtaccacgcctcacaatggccaccgttggaggtaaagacgaaattgttcttatggacatgaaaaacctactccacaaaaatcatttgccgtctttgttacaaatgggcgtcaatgcgtgtgcccaagtacacatttgtctggagacagctgtttttagacatgtcgaagcatcgcatcggaaaaacacagaaagtggaaaacaaaattcgcttttgaacagaattgttgaaggtcgctaatcacagatttaatttgttggattaataaattcatattttt

SEQ ID NO: 681 - DNA, 806 bp, Heterodera glycines
  genomic DNA sequence=SeqID_352; coding sequence=SeqID_1020
attttcagaaaaattacattttaagcggtggtgtcgacaaaacaattgcttttattagatttgatgctgatacccaacggagaacttttttggggcattcgtctaaaatttctaaagtccacctacaccaaaacttagagacatttgtctctggctcatttgattcaaaggtcaaaatctggagcactgaacaacccaatgcacttcatacaattgctattcatggaaaagccgtcacagacgtatccctgcatccgactggcgattacgtgctctgttcctcagaagactcacactggtcgtttattgatctccacgctggacgtccactggtcaaatctaatgatgatttgctgggcatttgctgtggtcaaattcaccccgacggactcatctttggaactggaggaaaaaatgccatcgtcaaaatttggaacatcaaagagcagaccagcttggtccagttcgagggtcacaaggaggcggtgggggccatttctttttccgaaaacggatattatttggctaccgggtcaacggacggcgaagtgaaaatttgggatttgcggaatcaaaaaactgtaacctgttttgcgccttacgatattaactgcctcacgttcgaccagtccggcaaatatttggcaatcggaggagagagtgtcaaagtttatggagtcgaagaatggaagcaaattttggaaatgaaagcccatacccaggaaattacgggggttgcattttcggaagatgcaagaatggtcatttcgtcaagtcttgacggaaatatttccacctttttttaa

SEQ ID NO: 682 - DNA, 480 bp, Heterodera glycines
  genomic DNA sequence=SeqID_353; coding sequence=SeqID_952
ttcgaatccttaactcaaacaacaaaatataatttcgactttttggttcaagttttagaattagcgcttttttatcattttttaaaattaattttttccattttccaccccctccctaaaaaaaccgaaaattcagtggtcatggccggcattgtggccatctacgggctggtggtggcggtgataatttccggccggctggaggcggccgggcccggctacaccatcgaccgcgggttcagccagttcgctgccggcctcgtgtgcggtctgtgtggactgggcgccggctacgccatcggcgtggtgggcgacgcgggcgtgcgcggcctgtcgcagcagccgcgcttgtttgtcggcatgattctgatgctgatattctcggaggtgcggcgcagggacggtcccaggattttggcttggggggggggagtacctccgcccgggcgacgaccttttttgcggcagttttcccaataa

SEQ ID NO: 683 - DNA, 689 bp, Heterodera glycines
  genomic DNA sequence=SeqID_413; coding sequence=SeqID_974
atggataatgaaacttctttgatggatcagcaacaaaaaagatatgacaggcaaattcgcctttggggcgatgatggtcaattgtcaatccaacaagcgcgtgtttgtgtgtttggctccaactcattggctgcagaaacgctcaagagtctcgtccttgctggcatcggttctttccatataattgacaaggcgttggtggaccacgctgattttgggcagaacttttttgttgaagagggttctttgggttcgagccgtgccgaatgtctcgtcaaggctttgaaggaattaaaccattctgtgcacggtcagcatcatccaatttctttcggggaattcaaacgacaggacttccaaatgcttctgcaattttcgctggtgattggcaccagtctaactgctaacgaagcgcgtcagctggaccaatttctttttgagcatgccattccttttgtatatgccaacgtttgtggaatgatgggtcatttgcgactgtcctttcgggaacattacatttttgaaaatcatgcagaaaatgctgcttatgacttgcggttggacttcccatttcccgaactgcttcaattggccaatgaaactaacctcgaatcgatgacccatgagcagcactcacacactccctttttgcttctttatcttaaagcgattgacatatggcgaaaaag

SEQ ID NO: 684 - DNA, 1383 bp, Heterodera glycines
  genomic DNA sequence=SeqID_414; coding sequence=SeqID_830
atggaacaagaacaacaacaaaatgttcatcacagtgggcgcgaagtgcgtcagatgttcatcgactttttcgtcaaggaaaaggcccacaaatattaccattcctcttccgtgattccccacgaggatccgactctgttgttcaccaatgccgggatgaatcaatttaagcccattttccaagagactgtcgacccgaacagtgacatggccaagctgaagcgtgcggtcaacacacagaaatgcataagggcgggtgggaagcacaacgacttggacgacgtggggaaggacgtgtaccaccacacctttttcgaaatgctcggcaattggtccttcggcgattatttcaagagggaaatttgtacatgggcttaccagttcctaacagaatggttgcatatttcgtccgaacgcctttacgtctctttttttggcggcgatttggccaataatttgttgccggacgaagagtgtcgccaaatatggttggacatcggtgttcctagtgaacacattcttccctttggaatgaaagacaacttttgggagatgggcgagacgggcccttgcggtccgtgttccgaaattcattatgaccgaattggtggcagagatgcggcccatctggtgaacgccgatgacccaatggtggtggaaatttggaatttggtcttcattcagttcaaccgggaggagggcggagtgttgaaatcgttgcccaacaaacacatcgattgtggtctcggctttgaacgtctcgtcgctgtggcgcagcaaaagacttccaactacgacaccgatttgttcaccccaatttttagcgcaattcaggaggggaccggagcccgcgagtacactggcaaagttggttccgaggacgtcgacggtgtggacatggcttaccgggtggtcgcagatcacattcgcactttgaccatcgcactgagtgacggggggtcgcctgactcgaccggaaggggttatgtccttcgtcgcattttgcgccgcggagttcgctacgcaactgagaaattgggggccaagcccggcttcttcgcctcgcttgttcccgtggtcatcgacattttaggcgacacttttcccgagcttcgaaaggacccaagctcagccatggaaattatcaatgaggaggaggcacaatttctgaagacgcttcgtcggggccacgttctgtttgagaaagcggtcaatgctttgccttcgggcaataaaactttccccgggagcatcgcgtggcgcctctacgacacttacggatttccgattgatctcacccaacttatggccgaagagaagggactcactgttcagatggacgagtacgaggacagcaaaaagaaggccagaggaaaaaaataa

SEQ ID NO: 685 - DNA, 2542 bp, Heterodera glycines
  genomic DNA sequence=SeqID_415; coding sequence=SeqID_883
atggcgcaagagccgcccttgcaaattgtgattcccagattggatgatgataaaccgttggtgcgtcgaccgacgcctcaggcacaaccggcggctccagcggtgccggctgaactacgcgtgtccaatcgggaggaggacgcgcagaacatcgaaccgtcaatgagtggcaaacaaatagtcgggttgatcattccaccgcccgacattcgaacaattgtggacaaaacggcgcttttcgtggctcgcaacggattggaatttgagatgaaaatcaaagagcgcgaggcttccaacatgcgtttcaactttctcaaccctaccgacccatactttgcctactatcgcaacaaggtcaatgaatttgagacgggcgttgcatcggcggacactcagtccaaagtgaagttgccggaggctgtccgtgagcatgtgcagcgggccgaatttattccgcggctgccgcccaaaccgttcgaattctgtgccgatcctttgacgctaaacgcattcgatttggatctcatccatttgaccgctttgtttgtggcgcggaacggccgtcaatttctcactcagctgatgaaccgtgaggtgcgaaacttccagtttgatttcttaaagcctcaacactccaacttccaatacttcaccaagctggtcgagcagtatacgaaggtgctgatcccgccaaaaacgattgtggatgatttacgtgcttcggtcactcaacacaaaatcttggaggacgtgcgttaccgcgtcggttgggaccgccaccaaaaagcgctgaaggaccgcgaggaccaagcggtggagaaggagcgcattgcgtacaatcaaatcgactggcacgaatttgtcgttgtccaaacggtggactttcagcccagcgaaacactaaatttgccgcccctgtgcacgccaaaggatgtcggggcacgaattctgttgcaacaacgtacggaagcggccaaagcggcggctgagagtgtggcgatggatgtcgagtcggacgaggagggcggcgccgagtcgggtgacgaggaaacggccaaagaacgagccgcaatcgaagcggcggaggatgcggctggcgaactgcaccaacgcttgaacatcggggcggagaagcaacacaccggctcaacgctgacgcaaccggcacccgcggcgccgaccgccggcagcgtaatcatccgcgactacgaccctaaaaaatcgcgtggtggtccggtgtccaaaactgcggctgcctccacggagaagtacataatttcgccgctgacaaacgaacgcattcctgcagacaaactgcacgagcatgtgcgttacaacaccgttgacccacagttcaaagagcaacgagaccgtgaacaaatggatcgccaggacgaagacttagtgatggcgcccggggcagaaattagtcgaaatattgccaaattggccgaacgtcgaacagacattttcggtattggtgaaaagggagccgaacaaacaatcatcggcaaaaagttgggggaggaggaacggcaaatgccgcgttcggacccgaagaccatttgggacggacaattgtcgacgattgatgctaccactcgcgcagcgcaacagagtgtttcgttagagcagcaaatcagcgaaatccagcgacagcatgggtatttgccgaacccagccgcagaacgaatggtgccgtcgatgccgcccccgacttcgacaccctcacaacaattcggcggtggacaaccgccgacttcacattcaatggctccacctcagcgccctccgcctcatcagtccaccggtggcattgcgtccaatgtgcagaaaattgtgccggttccccaacagccgccgcaaatgtctattccaccacagcaccagcaacaacaacaaatgcgtcctccgcagcaaatgccaccgcaatttatgcagccgccgggcggtcgtccgcatatgccacctccgcctcatatgggcatgccaccgcacggcgttatgggcgcaatgccaccgcacatgcaaccgggaatgcctcctcctggcatgatgcgtccaccgcatggctctttcatgcttcctcctccgccccccggcgcctctgttggcgatgagccgccaaacaaacgcccgcgcgaagaaacgctggaaccggaagaacgttggcttcaaaaggtccacggtcaaatcgctgtgcaaatcgctacgccgcaaaatgatgaatggaacctgaaggggaacacagtacaaattcagttggacatcagttcatcggtcactgcgttaaaatcgttaatccaagagcagatcggagttcctgcaaccaaacaaaaattagtctacgagggcattttcatgaaggacagtcagagtttggcctactacaattttatgccgaatgcttcagtgcaacttcagttgaaagaacgcggaggacgaaaaaaatgaaatgtttttttgggaagtgatcacagaatgatgaatgaattggattactttattggcacatttatttgtttgaactttaaatttattg

SEQ ID NO: 686 - DNA, 924 bp, Heterodera glycines
  genomic DNA sequence=SeqID_416; coding sequence=SeqID_853
atgaagccagacttaaaagaccgggactttatgtacaaattaattgttggccaactcttttacgatggtcatcaacaattggcactgaacttggcacaaacgcttggcctttcgctacgaccgcctcctccatctgacaaactttttcgtcttgtggcaatagctaaacaatttgtggaagatcccgagtctaaagaacgggagacaatcttgcagtctgctgggcttgacttggaattcgatgctgatgttgtcccgacaagccctgaaccaagtttgtacgaaactgtgtacctcaccacacacaaggccccgtgtcgggcggctgctttctctccagatggagctcttgtcgccacggcctccaatgattgttcaattaaaattttggatgtcgataaaatcatttccaggattgacgtgactctgagtgagtccggccccgacgcccatcacccggtcattcggaccctttatgaccacctcgatgaagtcacttgcgttgctttccatccccgcgagtccgtcctcctttcgggcagcaacgattttacgctgaaaatgttcgattattcaaaaactgcggttaaaagggcaatgaaaacgatcacggaggtcgagccgatcactgcggtcagttttcatccgagcggagagttttttctatgcgcaactcggcatccgaccttgcgtctttatagtgccgaaacacagcaatgctttgtttctccaataccgaaggaccaacattctgattccattacggatgtgtgctattcggaaaatgcgcgaatgtttgtcacgggaagtcgtgatgggaatgtaaaagtttgggacggagtttccaatcgatgcattgagacttttacccgcgcgcatgacggagccccgatttgcagtgctcagttcactcgtaatggaaag

SEQ ID NO: 687 - DNA, 678 bp, Heterodera glycines
  genomic DNA sequence=SeqID_354; coding sequence=SeqID_1001
atgagtctattcggcaaaatttttggtggaaaaaaacaagaggcagctccatcgacacaagaagtattgcagaagctgcaagagagggaagacatgtttcaaaagaagcaggaatttctggaaaagaaaatcgaaacagaaattgccacggcacgtgcgcaagcggcaaataaaagggtcgcgttgcaggcactgaggcgaaaaaagggctatgaaaagcaattggaacacattgcaggagtgctgaacaccatccaccaccaaaagaccgcgctggagaacgcgtccatgaactctgatgtgcttggagtgataggcgaatcagcaaaagcgttgaaaaaggcgcacaatgaaatggacgcggacaaagtccacgatatgatggaagaaattgcggagcaacaggaagtaggaaacgaaatcgcaactgccatcagcaacccagtgggacttcagaacgatattgacgatgaagaactgctcaaagaacttgaggagatggaagaggaggatctgagtggcaaattgctcgacgcgggtattgtgccggcacatagtgtgccaagtgttgcagacaaattgccaagcgcaccgaaagagttgccaaaaaagacggtggccaagaagcaacaggaggatgaggaccttgccgaattggaagcgtgggcaaatgcgtga

SEQ ID NO: 688 - DNA, 1383 bp, Heterodera glycines
  genomic DNA sequence=SeqID_355; coding sequence=SeqID_835
atgtcaatagcgcccacttacaaagtgcacaagccaaatgtgcccattctcatggaggacatttttggctgggttcgcgagggaaattcgttccaagtgcgcgtttggttggacgactctgagcacgatttgaatgttggggatgaccatgccttttcgctgctccactgggcctccaaggagggccacgtgtccatcgtggaaatgctgctgtcccgcggcgcacgtgtcaatgccaccaacatgggcgacgacacggcactgcacttggccgcagcgcatggccatcgccaaattgtggtgaagctgctattgcgaaaagcggaggtgaacgtgcagaatgagcatgggatgaccccgctgcactacgcctgcttttggggctacgaacaaatttgtgaggatttgatccgttccggtgcgcttaccacaatgtgcaacaagcgcgggctcaccccgttggatgtgtgccaaccacaaattgcgttgagcaatggacagaatccgcagcagaagatccaatacagcggcgacgcgtggcaaaacacaaaaacatttcgttcacgcgacgcgacgtggtcacgatacaccggcgttgacctccaatcgttggcgctgaccaaacaaattgcgcagtcgcattccggcattttgtaccgcggcaaatggcagaacaacgacattgtggcacgggtgctcaatgtgccgaatgtgacggagcgaatatcgcgcgattttgccaccgaatttttgcaactaagaatattcgccagtgccttcgtcaaccccgtgttggccgtggtcaaccaaccgccccaactgattgtcatcagccaattcatgcctttcggctcgctttacaatgtgctacatgagcagtcatctgtggtcatcgaccaccaccaggccattcgttttgcgctggacctcgcccgtggcatgtccttcctgcactccttggaccagcccgtcctgcgatattatctgagctcaaagcacgtgctcatcgacgaggatttgtccgccaaaatttccatggccgacacaaagttctccttccaggaggtcggccgattgtattcgcccgcttggatggcgcccgaggcattgcaaaggtcgcctgaatcgctgaacactcgtgcctcggatatgtggagctttggcattttgctctgggagctgaacacacgcgaagttcccttctcggatctgtcgcccatggaaattgggatgaaaattgcgctggagggactgcgagtgaccattccgccgggcatttcgcgaaatatgttccgactgatcaacatttgcctgaacgaagacccgggcaggcggccgaactttgaccaaatcataccaattcttgagaaaatgggccactga

SEQ ID NO: 689 - DNA, 830 bp, Heterodera glycines
  genomic DNA sequence=SeqID_356; coding sequence=SeqID_884
gaaaattttctctttgcttctctctcctctgtttttcatttccttaaaagcggcaatgaccagtcgaattttgagctgcaatttgcgaaggtacttctccaagatgaaccaacacatcgagttcggcacaacgaagagcgcttcgtccgacaaacaatcgccgccttcccctacaaacaatcaaacgcaacacgagggaatgagtcaggaatgtcgggagcaaatcgagcagatggaaaagctgaagagcgacaacgaaatgctgaccgacaaatacaaaagaacacttgcggacatggaaaacttgcggaagagaacgcagcggcaaattgaggaggcaaaactttttgcaattcagccattttgcaaggatttgctggaggtggctgatgtgcttgacttggcgttgaattcgttggaaaaaatgaaaacggaggacggtgccgcctccttggacagtggagtgaacaaagggatcaaaatgacgaaggaagtgttgctgaagacgttcaaaaagcatgggcttgtaccggttcaacccgaaggacagaagttcgacccgaatttgcacgaagcggtgtatgaaataccgaaggaccagtcagataggcctgccggtcacattgcgcatgtgttgaacattgggtacagtttgcacgaccgtccgattcgaccagccaaagtgggcgttgtgaagatggaatgatggccaatgtcagcgtcattttgtgtctacgtgcctttgttcaccattttattttgttatgtgcgatccgtcgctattctttcaacttacatatattgttttagcaataaattttgaatatcaa

SEQ ID NO: 690 - DNA, 1225 bp, Heterodera glycines
  genomic DNA sequence=SeqID_357; coding sequence=SeqID_1022
aaatgcttcttaaatttttaaattaattttacgcagaaaccacaaaactgcaccattgcccggaaatccaatatttattcaaaaaaataatcgttttcaatttgattttaccaattttcaatgggtagagcacgtagaaaaaaggggaaaactgccagaagagctcggcaaggattgcttggatttacacgaattgcaagagaaggaaagaagccaaaacaatttgagaagagagtcaatcaaagactggacagaaaagacgatgttcgaacggaggaaattttgcgtgaaaatattgccggacaaaagacccaagaggagccgagaacgccgcatgcatttgtaattcactcggcaggagtgggacgatatgtgcgacagttggagatggacttacggcgggtgatgagtccgaacacttcgaaggcattgcgggtgctgaaacgcaacaaactgaaagactttgtcgtgcattcgcaatttttgggcgtctctcatctgatcatcctctcgagaacagaactttccacgcatttgcgcattattcgaaacccgcaaggcccaactttgcacttcagagttgaaaaatattcgttggcacgcgacgtgctctccgtgcagaagagaccggtcatctacgaagaactgttccaacacgcgcctttggtggtgatgaatgggttttccagtgaagacggcagcaaaaaacatttacaattggtgcagacggtggtgcagaatatgttcccttccatcgacgtggacagagtgaaactcgcgtccattcgtcgcactttgctattaaactacgacacagaggacggactgatggagttcagacaatactccataaagtcagtgcccgcgggcgtttctcgttcggccaaaaaactgatgcagagcaaagtgccagacctgtccaagtacaaagacatcagtgacttcatgctcaaaccggagcagttgagtgacagcgaatttgaaggcgaacagacggaattggagctcacgcaggatattggcggacggggcaaaaaacgaggacagcaaaccaaattgaggttgatggaaattggaccacggatgacattacgtttgatgaaaattgaggaaggcgtcaacgcgggcactgctctttggacacactcttcaacataacatcagattcatattccaaacacgtttattttgtttttatgcatgtgcgagaaccgtttgatcaaac

SEQ ID NO: 691 - DNA, 584 bp, Heterodera glycines
  genomic DNA sequence=SeqID_358; coding sequence=SeqID_851
cagcggacggaactttcagcactcaggcggaatggctactcgaaacggacggaaccgcacttctgagagtgctaagcgagccggacgtcgatttcattcgtacacacagcaatgacatttgtgaaatcttcgaggtgttgggcattgaagctgtccgcaaggcgattgagcgtgagatgaaccaagtgatttcctttgatggatcatacgtcaattaccgtcacttggctttgctttgtgaagtgatgacggcgagagggtatctgatggcaattaccagacatgggatcaacagacaggaggttggagctttaatgcgatgctcatttgaagaaacggttgacattttaatggaagcggcagttcacgctgaaactgacccggttaaaggagtttctgaaaacattatgcttggacagatggctaaggcaggtactgggtgttttgacctcgtgctagactccgacaaatgcaaattggcaatggatattcccgattttattatggcgaagtcagctggcggtctttttggtggtggaatgtcgccaccagggtttgctaataaacggattgatttgttttaa

SEQ ID NO: 692 - DNA, 1668 bp, Heterodera glycines
  genomic DNA sequence=SeqID_417; coding sequence=SeqID_927
atggatgatttgacaacgacggaattgaaatggcgaccagcagaaagagctaatgatgacagcttaccactaaaacctcttaccgatattgagagacaaatgaatgaaattcgtacagaattatttatggcaagacaggaggaggaagcgataatatcacggatcaaagatgaatttcggcaaacgcagaaacgtctgttcgatcaatcagttgctcgcattaatgccgaatttgaaagagtcgggtccaatgctcgtcaattggccaattcgcttgattctgtctctgccttggctcaaaatatttcctgtcgagttgtcgcgttggatcttggaaaaagccgtgttgtggagtgtttgcaaagagtgaacgacttaaaagaccttggaacctgtgcattcggcgtgcaggaggcattgcgagctgaaaaatacgaagaggcagcacaacatattcaccgtttccttacgcttgacacggccgttttcaaaatgggcgaccatcgggagagcaaagatgctggatattccgtgaaaaattcttatgaaatccttagaaatgcgaccagtgaattaaagcgcatcatcgaacaacgttttgacgaggcgcagtcctccggcgacgtggcatcgatggaacgctttttcaaactttttcctctgatcaacgaacacaacagcggactgcagcggtttgggactcatctttgtggtcaaattgaggcacttggtgaccagaattttcgtattatgcaggccggtgggactgacgacaaacgcaaaaacgtactttatgcggacactttgacaatgcttttcgagggcgttgcacgtatcattgagctgcatcagccgataatcgaaaatttctatggcccagaaaaattactgttgctgattgagctgattcagcccgaatgtgacaaacagtgcgtccgagtgttgaacacgttcatccaacgaagacattttgaggagaaagctcagcagcaaaattctaacgcaaccatcgatgccattgagctggacttactgctttctgaagtgactttgatgcacacccgtgccgaactattttggcgctttctccgtcggcgactagaaaaaggtgcaacagaacgccatatggatgagtcaacagatggatttgacgaagacgagcaacaacggagagaccatattgaaaagctacgcaagcagcgagaggaacacgcgatcaaattagacgcggtactgaaccgatcgggacttagcacgaaaatgcaggaactgatgggcaaatttgtactcgtcgaacaattttatatgacgcaatctgtgaggaaagccattgacatggacagcatcgaggagggcgcgctgaccagcactctgttggacgacgtctttttcattgtccgcaaaagtattcgccgttctatcagttcgtcgtcggttgactgtgtctgtgcaatgcttaataatggcgcaacgcttttggagacggatttcctcaaatacattagtgcgcctattaagtccggctatccgtccacgggttggagtgccgaaagtgcttatcaaacagcacaaaatgtgatgcaaggaaaaggcgaagttgtcgggggtttggaaaagcaacggagtgctttcataacagcactgaacaacttgcgatcatcaattgat

SEQ ID NO: 693 - DNA, 1211 bp, Heterodera glycines
  genomic DNA sequence=SeqID_418; coding sequence=SeqID_899
atgagtttgtttggttcgtccatcggcacttcttcgccttttggcagcaagccgagtggtggtctctttggcgctgcgaacaccgcagttgtgcagcccagcacttcgaccacaacgcagcaggacatcgaggttccacaagctcccgatgacactgtgcaggcaatgaaattcaatccgctggtggccgggtctcccatttttttggctgctggttcctgggacaacacctgtcgcatttggcaggtcaatgaaaatggaatggttgaaccgaaggcaatgcaaaatgttggagcgcccattctttcgctggattggtcggaggacggctcaaaaatattcatcgctggtgcagacaaacaagcgttcgcctgggatttaggctcaaaccaaatggctgttgttggcacgcacaatgagccagtgcgaagttgccattggatagcgacaccccaatattcgtgtctaatgacgggaagttgggaccggacgctgcgtttttgggacatgcgccaattgcccacccaaaactccctggcaaccatccaactgcctgaacgcgtgtactgctccgacatggttttcccgctgatggtcgttgctttggccgacagacacatcaaaatgtataagttggacggaacaccctctgaaattcaagacgtggaatctcagttgaagtttcagagtcgttgcattgcgattttcaaagacaaaatgacgggacagcccaatggattcgctcttggctccaccgaaggacgagtggcgattcaatgtttgcagccaaaggacccgaaggacaatttcactttcaaatgccatcggtcagccgaactcatcaacaattaccaggagatttacccggtcaatgacgtcgcttttcatccgacccaccaaacattggccacagcgggcgcagacggaaaatattccttttgggacaaagacgcgcggacgaaattgaagggttccgatgccttgccaatgccaatcacaaaatgcgccattcattcgggtggaaacataatggcctatgcgatcggttatgattggagcaagggcttcgaatacagcacggcgaataatgtgacgaaaatctttctgcacgggtgtgacgaggagatgaaaccaaagccgaagaagtgatctccgtgagtgaccgttttttaatgttctctcaattgtttttttataaattttttacactt

SEQ ID NO: 694 - DNA, 2232 bp, Heterodera glycines
  genomic DNA sequence=SeqID_419; coding sequence=SeqID_914
atgccattgcgtttggatgtaaaacggcgattgctggcgagatccgatcgcgttaaatcggtggatttacatctcaatgagccttggatgttgatttcactttacaatggctttgtgcacatatggaattatgactcacaacagctcatcaagtcatttgaggtttgtgatctgcccgtgcgtgctgcaaaattcattgtgcgcaaaaattggatcgccactggttctgatgacatgcagttgcgcattttcaattataacacgttggaacgtgtacatcaaatggaagcgcattccgattatctccgatcccttgccgttcacccaacccaaccatttttgctgacttcatccgacgacatgctgatcaaactatgggattgggaagacaaatggaagctgaagcaaacatttgaaggacacacacattacgtgatgcaattggtgataaatccaaaagacaacaatacctttgccactgcatctctggacaaaacaatcaaagtttggcagttcggaagctcagtgcccaattttacgcttgagggtcatgaaaaaggggtcaattgcgtcgattattatcacggaggtgagaagccctacttaatttcgggtgcggacgaccggctaatcaaaatttgggactaccaaaacaaaacttgtgttgtcacgttggatggtcattcccacaacgtgtccgccgtgtgtttccaccccgaattgcccattatcatcaccgggtccgaggattcgaccgtgcgcatttggcatgtgaacacaaacagacttgaaacaacgctcaattatggtttggagcgtgtttggtgtgtcatggcccagcgcggctccaacacattggcaattggctacgacgaaggctcagttgtcatcgcacttggtcgagaggaaccggccgtatcaatggatcccagtggcaaagtgatttgggcacggcacagcgaaatacaactggcaaacttgaaaaccatcgaagagcagacgcttgaaaacattcaggacggggagcgattgtcattggctatcaaagacatgggatccacggaaatatatccgcaaaaagtgcagcactcaccaaacggacgctttgtcgttgtatgtggtgatggcgagtacattatctacaccgcaaccgcattgcggaacaaatcctttgggtcgagtttcgattttgcatgggcaaacgatgccaacttttacgctgtccaggagaattcgcagctgatcaaattgttcaagaatttcacggaacttctccaaatccgacccgatgtgatggttgagggcattggcggtggtcatttgctcgctgcgcgctctgccggttctctgcttttttacgattggagcactggacatttgatacgccgtatagaaattgcatccaaaaaagtgtattggagtgaaaatggagaaatggttgcgatctgtggcgaccaatcactttacatcctaaaatacaactctgaggcggtaacaaatgcaaatgtggcggacatcggacccgatggcatcgaggatgccttcgaagtgatcggcgaattgggagagtcggtgaaaaccggcttttggattgggcactgttttatctttacgacgactctgaaccggctcagctattacgtgggaggggaactggtcaccatcgcgcacaccgacagacccctttatttgctcggttatttgtcaaaagagaaccgggtgttcgcttgtgacaaggaccacaacattgtctcgttcaaacttttgttgtctgtcttggagtaccaaacggcggtgatgtgcaaggattttgacacggccgatcaaattttaaaaatcattcccgaaaatctacacacacgggtggcacaatttcttgagaagcagggatttaaaaaacaagcactggcgattagcaaagatcctcagcatcggtttgagttagccttgtcacttggtgatttgcccgccgcttatgaaatggccaagcaagcggacagtgaggaaaaatggaaacaattggcacatgcggcgacaatcaaatctgagctccgtttggcaggtgaatgccttgctaaggccaacgatttcgggggccttcttctgctcgcttcctgcgccggttcgaatcgtttggtaaattatttacgcgttttcatgcggttcttcatttctcaatcatttacaagttcatttttgctgccggtttaagcaagaatttcattaataaat

SEQ ID NO: 695 - DNA, 3079 bp, Heterodera glycines
  misc_feature (3053)..(3053): n is a, c, g, or t
  genomic DNA sequence=SeqID_420; coding sequence=SeqID_840
ccaatcaaagcatgtgctgacaaactggttgagggaaattgaacaatttggcaatccgccagtgtttggctaccaaagcagcgaagaaatgtcaaaaaacgggacagaattagcgaaacaggaggaggaagtggaccaaatcattaaggacaagagcaagggcaaaaagagcaaggctttggcgaaaactgtggctgccaaattccaatggcaaattatgcaatcgttgggcctcaacgacgcagaaattgccgagttttccaaatccgagcattggctgacctatttcccgcccaagtgtatggcggacctgcgcaaaatgggccttgcggtggactggcgacgtgccttcatcaccacagaggcaaatgcctatttcgactcattcgtgcagtggcaattccgaaagttgcgctcagaaaatctcatccaattcggcaaaaggtacaccatttactctcccaaggatggccagccgtgtatggaccacgaccgttccaccggcgaaggggtcggcccgcaagagtacactttgatcaaaatgcagattctggagcccaaacccaaagttctgtccaatgtctctgcttccaatggtaagccaatgtttttggtggccgccactctccgccccgaaacgatgtacggccaaacgaattgcttcatccatcccgacatcacttactccgtgttttttgtgggtacaaacgaccaagagattttcatcgcaacggaaagggccgctcggaacatggcttaccagggcatgacggcggagaacggaaaaattcgctttgtgcccggcgtggaaagagtgaagggcgcggaattgattggctgtgcgttgaaggcgccgttgacgagttttgagcgtatttacgcactaccaatgctaacgatcaaagacgacaaaggcactggcattgtgaccagcgttccgtccgacgcacccgacgactttgccgcactgatggacctgaagaaaaagaagcctttgcgcgagaagtacggcatccttgacgagatggtgatgccatttgagcccatcccaatcctcgagattcccgagtatggtcgtcttgccgctgtgcacatgtgcgaaaagttgggcatcaacagccaaaacgatcgactgaaattggaagaggcgaagaaggagctgtacctaaagggcttttaccagggggtgatgttggtcggcaattaccgggaccagaagacggaggtggtcaagaagctgatccaagccgacatgatccgggatgggcaggcgtgcaaatatgtcgaacctgagaagaaagtgatctctcggtcgggcgacgaatgtgtggtggcattgtgcgaccaatggtaccttaactacggggacccggcatggaaagaagcgactcgcaaatgtttggcttcgcttaacactttttcggatgaagtgcggcgcaactttgagcacaccatcgaatggctgcatgaatacgcttgttctcgctcgtttggacttggcactaaacttccatgggacccacaatatttgatcgagtcgctttccgacagtaccatttacaacgcttattacactgtttcgcatttgctgcaaaatgatatttacggtgctgaaacgggtgaactcggcattttaccacctcaactgactgacgctgtttgggattacatattcatgggtaatttatatgattcgactaaaatgccaattgaagaagcaaaactgaagagaatgaggcacgagtttgagtattggtaccccgtcgatatgagggtttccggcaaagatttgatccaaaatcatctcacttattacattttcaaccacgtggcaatttggcgtaaacagccgcagttttggccgcagggaattcgtgcaaatggacatttgttgttgaacaatgaaaagatgtcaaaaaatactggcaattttcttacgctttttgatgcaattgaacttttttctgccgatggaatgcgattcactttggctgacgccggagacggaatcgaagatgccaatttcatgtacgaaatggctgatgcgggcattctccgcttgtacgcctttctctcgtgggcttcagaaatggtcgaagcatgtgccaagggcgaattgcgcaaggacggcatcgagacttttgcggacaaaatattcaacaatgaaatgaaccgtctcattttggttaccggcgaccattttgagcgtactcttttcaaggaagcactgaagaccggctttttcgagtatcagttggcccgtgacaattatcggcagctctgcgggagtgaccaggcaatgagtgccgtgttggtgttacgcttcatcgaaacacaagcgattattctttcgccgatttgtcctcatgtttctgaacgtgcctgggaattgttgggaaagcccggccttctcgtgaccgatgctcgctggcccgtcactgctcctgccattccgttgctcgtcgaccagagcaacttcatccacaacaccgtgcacgagtttcggctaaggcgcgacgcgaagctgtgcccgaagaaaaaggacccgaaaaagcaattgcaacctccgaagtcggcaacaatttacatcgcaaaacgctatccgtcatggaggggaaaactcatcttggaattgggacaaatgtacacggtcaacaacggcactcttccggacaaccgaacactgctcgaaaagctgagcaaaccagaatccgcggaagagaagaaggagcgcatgtcgttcgtacagatgttccgcgatcgcattgctcagcgtggcatttttgcggtgacgtcggaagaggaattcgaccagaaggcagcgctcagccaaatcagcgactttttgctctcgactttacaactggaggaggtgaaattcgctgattcggccaacgctccctccgatgtcatccgaaattcgtgctgtcccggcgcaccgttaataatgtacgactttgttgagacaacaaacaattagggctttggttgacaattgaatgtttttgttgattaatttggcttgtaaaaatgcgtaagtacccaaatgatgnagacatacaccgagctttatttgttg

SEQ ID NO: 696 - DNA, 1301 bp, Heterodera glycines
  genomic DNA sequence=SeqID_421; coding sequence=SeqID_1013
atgtggacgcttaagaacctcggcgacagtttcatagtgaaacgcatcggtcggcgtccgattgttctcggggcgttccatcgaccgcccgaagagcaaaatgtgcggggtcatttcgctgtacttcaatttctcggcgacgttcgtcaaacgcacgcgttgttctgtgttagcgaaggaaaagacagcaaaaaggtgcttagtgaggcgcacatcgaacgcattcaccagggaaagagggcggccaacgacatttgcgcgtggggcggacatttggcggagtgccaattggcggacggaacggcggagagcattcgtgaccattccattgaggtgccattggaaaagcctttgcactttgggcccaaaaagttccctttggtcgtttgcgtggcaccaatgtatacgtacaccgaatggcaaattatggtgacgggcatcgaagtttggctggcattgggcgcctccaaaatggttttcccaattcaatccgcttcggcagacacaattcaaattctgacggagtatcagcgcattggcattgtccatttgcgcgtgtggcccaaatggccggtgctttccgatgcgaatcccaacggattggtcctttcccgaggcattgaagagtctcacgtcaactgtctgcactttgtcaagccgttcgccgaaatggtggtcataacggacatcgacgacatgttgatgccattggacccaatgaaagttcggccgggaataaacgtggacatactcaaggatctgttccatcagcatccaaatgccggctctttgctcttcgaacatcgcgatgtccaattcgttctccccgacccatccactcaaaacactttgcgcagtttcaatttcgaattcctcgcccactccaaatggaagacgagttgcaaagtgtggcggatgaaaacgcgcgtggcggtcaatgcgagtcgcgtggacacagtgaacatgcacgaatcgggcatccatcggtttggcttcgtccaggtccgtgtgccgtgccgacaagcgcacttttatcacctgcgccactcctacaaaaacattgccatcaacgagtggcccattgacatgtcaaaactccgccaaatgctcaacgaacggtggcatttccgtgccgagtccaatttttcttcagaaatgcaatcgaaaatgttggcacgctcgtcggtggaaagctttgaagattttgacaagtgcatgagtgccatcaatgaggagcactggcgactgcgcgtgtcgcgctgtctgacaccccacgtgtgcttctctcgcctggccaagtt

SEQ ID NO: 697 - DNA, 1409 bp, Heterodera glycines
  genomic DNA sequence=SeqID_422; coding sequence=SeqID_875
acgagtaagcaatgggcaaggaaaagatccatatcaatattgtggtgatcggtcacgtcgattccggcaaatcgactaccactggccatctcatctacaaatgtggtggaattgacaaacgtaccatcgagaaattcgagaaggaggctcaggaaatgggcaagggatcatttaagtacgcttgggtgcttgacaagctgaaagccgaacgcgagcgtggtatcactatcgacatcgctttgtggaaattcgagacaagcaagtactatgtcaccattattgacgctcctggccatcgcgacttcattaaaaacatgatcacagggacttctcaagctgactgcgctgtgctggtggttgcttgtggaacgggagagtttgaagctggaatttcgaaaaacggccaaacgcgtgagcacgctttgcttgcgcagactttgggggtcaagcagctcatcgtcgcttgcaacaagatggacaccactgaaccgccattcgccgaggcccgttacacggaagtgatgactgaagtgtccaacttcatcaagaagatcggttacaacccagccaccgttccattcgtcccaatctctggcttcaatggcgacaacatgttggagccgtctgacaggatgccgtggtttaaggggtgggcgatcgagcgcaaagatggcaatgcatctggcaaaactctgctcgaggctcttgactccattcttccgccgcaaagaccaactgacaagccattgcgtttgcctctccaggatgtgtataagattggaggtattgggacagtgccggttggccgtgtcgagactggtgttctcaagcctggaatggtggtcacttttgctccgcaaggcatttccactgaagtcaaatcagtggaaatgcaccacgagtccttgccagaagcgcttccaggagacaatgtgggcttcaacgtgaaaaacatctctgtgaaggacattcgccgtggttcggtcgcgtccgactcgaagaacgacccggcaaaggagaccaagagcttcacagctcaagtcatcatcatgaaccacccgggtcagatcgctgctggttatactcccgtgttggactgtcacaccgcgcacatcgcgtgcaaattcgccgaactcaaggagaaggttgaccgtcggtctggaaagaaagtggaggacaacccgaaggcgctgaaaaccggcgatgctgggatcgtcgatttgattccaaccaagccgatgtgtgtggaggcattcacggactacgctccgcttggtcgtttcgccgttcgtgacatgaggcaaaccgtcgctgtcggtgtgatcaaggcggtggagaagactgaaggcggtggaaaggttaccaagtcggcgcagaaggctgctgcccctggtgggaagaagaaatga

SEQ ID NO: 698 - DNA, 1532 bp, Heterodera glycines
  genomic DNA sequence=SeqID_423; coding sequence=SeqID_959
gctggccgtttcgccgtttgttttggcatttgtgcctatccatccctcttcgtcagggcgacgtgctgctgcgcgtgaacgaagtcgacctgcaaaattccacccacgcgcaagcggcacaaaccctcaaggccatccccaattactccgaagttcaattagtgctccaacatctgccccaggagtatcagagattcgaggagaaactggaacgtgcccgtgccgaaatggcccaactccagcaaaatccacaacagccgccctatttgccacccgatgcgatgccccctccgcagcagataatgccaatgcccatccgacaggacttttacgtgagagccctcttcgacaacgacccctcccgcggggatgcggtgctgccgcaccgttccctcgcctttcggtacggcgacattttgcatgtgacgagtgtggcggacgacgactggtggactgcgcgaagggtcgccgaaaatggggacgaaggccccgagggaatcattccgtccaagaaaagggtggagaagcgcgagagacagcggcgcaaacaggtgaacttcaacgctggcagtcaaagtttgggcagaaacgcgtcagtgagtgccggcggattcggcggcggcggattggacggccgacgcggttctcgcagccaactttccttttctcgcaaatttcccttcgttaaatcgactgagaaactgaacgaatatccctcggacggaggcgaaacaggcggcggcactatcgcagatgagccaattcattcatacgttacggtagaactgcgaacagttaattacgttcgcccggtcattgtgctcggggctttgaaggatcgcataaatgacgaattggtcagtcgacaccccgacagattcagcagctgtgtgccacatacttctcgcccaccgcgggaaggcgaagtgcacggacgcaattattatttcgttacgaaggccgaaatggagagggacgtgaagagcaaccttttcattgaagcgggccaattccaaaacaatttgtacgggacgagcgtagcggcggtgatggaagtggccgaatctggaaggcattgcattttggacgtttccggcaatgcgatacggcgactgcaaaacacagcccatatttatccagtttcggttttcgttaagccgcttaattaccaacaattacgagaatgggactctttgctcagtgaagaagatgccctgaagcaatttgaacggtgtcaacgccaagaacaaaacttcggggatttgttcaccggaatggtcaccggacattcgcccgacgatattttcgctcgcgtaattcacataataaacgaacagtcgcgacccgaagtttggattccgacgaatgaacagttgccttgagagccaaagaaaatgccaaaggacgcaaacaattccaaaaagaattcataattcacttatcgttttgaaatttatccgtttcattcagtgccgtcagttgtgctaaagcaaatttgccaaccttcgtttataaacttgctcataaattta

SEQ ID NO: 699 - DNA, 1381 bp, Heterodera glycines
  genomic DNA sequence=SeqID_424; coding sequence=SeqID_987
ctccactcatttttcctccgtcggattgatcaccactgaccgatcagtgccaacgatggaaaatgaaagtcaaggtgcgcatttaatggaccaattggacagtgtcatcccttcgctggtcaatccttccgagtgccaaagtgagaaggatttggcattgtttcggcaacttttccgccaatttttggaggatccgcacaaagtgaattggcaggaaatacaaccaatggcaaaggaaaagcaaatgccatacgaacatttgccgaaggtggagggatcggaggagagaagggcaattttggaacgaattgcggtgataaaactgaacggaggattgggcactacaatgggctgttccgggcccaaatcgctggtccaactgcgtgacggactcacctttttggacttcgccctgcagcagcaccgcattctgttgaactgcgccgacttgcgctcccccgttccgcttctgttgatgaactctttcaacaccgatgcgcaaaccaaagccttcctctgggcacaaaatgccaattctgtcgctgctgtcaaatgcttttgccagtcgaagtgtccccgaatatttgccgattctcttcgtccggtgcccaactcgtgggatgaccgtgccgaagaaggttggtacccgcctggccatggcaatgctttccatgctttggatcagtgcggaatgctcgacgaacttttggcgaacggaagggacttggcatttttcgccaacattgacaacacaataattgcggacggaaaggccgattatgtgatggaaatgacggaacggacacaagcggacgtgaagggtggcacattggtggaattggacgggggaaagcgtctgatgcatttggaatgtccgcaagtgccgtcggatcggttggacgaattctgttccctgcggacgttcaagatgttcaacactaacaacatttgggtgaatcttcgcgtggtcaaaaagcgattggacaaattcaaaatggaaattctcgccaatgaaaagcgtttatcagacggtcaacgcgtcgtgcaattggagcaatccattggcggtgccattcgaaactttcccggccgcgcatgggcaatttacgtttcacgacaacgctttttaccggtcaaatccactcgtgatctgttccgcgtccgttcttctgatttattcgaattctgggccgattcttttgtgctgcgacagcgtgtctctctgctgccaaatgtgtgcctttctgatcacttctcttcacttatagactttgaacggcgaattcctcaaattccaaaaatggaaaaagtgaaaagcgtccgtttggagggcgatgtttggctgggcaaaagcataacgatgagggtatttaatagttaa

SEQ ID NO: 700 - DNA, 788 bp, Heterodera glycines
  genomic DNA sequence=SeqID_425; coding sequence=SeqID_1006
gcaattcgagtgctacaaatagttcgaaatggtaactgcggaagataccgttaaaacaaaggaagaagaccccaaaaaaacgacaacggacgacggatcgagttcagaggaagaagtgcccgagctcgaagagggcgacgttactgaagagcagaaaaaagttgctgaggcggccggactcagtgagcaggttgccgaaaagggctccaaacaatcgcgttctgaaaagaaggctcgtaaactattcagcaaacttggcctcaagcaagtgcacggcgtttcgcgcgtatgcatccgtaaatcgaagagcattttgttcgtcatcaacaagccggacgtgtacaaaagtccgggctccgacacatacgtcgtttttggcgaggcaaaaattgaagatttggcacaacacgctcaaatcactgacgtggagaatttgaaaccgccctcaatcattcgcgatgttcgcaaccgaatcacaccggcggaggaggaaagcgatggcgaagaggctgatgctactggaattgaagaaaaggatattgagttggtgatgtcgcaagcaaatgtttctcgaaacaaagctatcaaagcattgaaaaaggctgacaatgatttggtgaacgctattatggcattgacaatgtaggaggaagccagaggaattcagagaaaacttattgttgaccttcgaatttttgcttcaatatttttcctacgggaatccagttcttttaccattgctgattatgttactttacgaattttgcttataaaaattaaaaagcgta

SEQ ID NO: 701 - DNA, 652 bp, Heterodera glycines
  genomic DNA sequence=SeqID_426; coding sequence=SeqID_893
gaagaagtacttcttttgctccaaggaccaggcgacacgcgcaatttctcagtcgtggagacagccgaagaacggggaggacgcgttggagttccagcacaaattctaccgcgaactttacccaaaaatcactgctgacattcggcaaattgagcagaattggcgcgagggacgacatcgattggagcgcatcaattgccaatcggagaatagcaaaggtgtctactgtctccaatacgacgacgaaaagatcatctcgggactgcgcgacaacacaatcaaaatttggtcccggcccagcctcggctgtgtgcaaacactgagcgggcacaccggctccgtgctgtgcctgcagtacgacaaccagatgatcgccagtggcagcagtgacgcgacagtcagaatatgggacgtgaacacgggtgagcaactgaagacgctggtccaccattgtgaagctgttctccacctgagatttcaggacggcatgctggtcacatgctccaaggaccggtccatcgcggtttgggacatggcatcgcctcgtgacattgaagtgcgtcgggtgctcgttggccaccgggcggcggtcaacgtggtggactttgatcacaaatacattgtgtcggccagcggtgatcggacaataaag

SEQ ID NO: 702 - DNA, 361 bp, Heterodera glycines
  genomic DNA sequence=SeqID_492; coding sequence=SeqID_909
tgttgatttggttttcactaattggttgttgatgtacttggctgatcaggaagcggtacaatttgttgccaatgctcttcaatggcttcggcctgacggttatctccatttgcgcgagtcgtgctcagaaccttcgacaaaaaaatctgctgatcactcaaccaccacaaccactaccagcacttcatcatcctcatcctcgtcgttgcacaacaattcgaagccaaatccgacccgttaccgcttctcatccgcctacatccaactgttgcgctccctccggcacacggacgtgcaaagcggaacccagtggcgcttcgatgtgcagtgggcgtgctcagtcggcgtgtacattgaggtg

SEQ ID NO: 703 - DNA, 470 bp, Heterodera glycines
  genomic DNA sequence=SeqID_493; coding sequence=SeqID_949
atgagaatcaaaaaaatagagattgagggcttcaagtcatattcacagcatgaagcagtcagagatttggatcccgaatttaatgccattaccggactcaacggttctgggaaatcgaacattttggatgccatatgcttcctgcttggcatcacaaacctcgcccaggtccgagtgcattccctcaacgagttggtgtacaagcaaggccaggccggcatcagccgagcaactgttacgatcacttttgacaacgacgtcccgcccgataaacagcctgctggctacaacaaatataaggaaattgtcgtgagacggcaggtgattctaccaaatcaacggcacttctgccacaaaccaacgtgtgtccgatatgtttcgccaagtcggcataaacgtgaacaacccgcactttcttatcatgcaaggacgcatcacaaaagtgctgaacatgaagccgatggaggtca

SEQ ID NO: 704 - DNA, 652 bp, Heterodera glycines
  genomic DNA sequence=SeqID_427; coding sequence=SeqID_885
attttaggtaatttcaagcacattatttttggaaagcttatttgatttatccatcaacagctgcaaaatgcagacgattagcaagaacaacaagatgatggcgcacctcaactacaaaatgaaggtgatcgtccaggattcacgcgtttttatcggatacttcaaagcattcgataaacacatgaacataattctggccgactgtgaagagatgcgccgcattaagcccaaacaaggagctaagaagtcaaacgtcgaggaggaaaagcgcattcttggcctggtgttgctgcgaggggacaaaatcatctccatttcggtggaaggaccgcctcaaaaggaggattctggtgtgcagttgccaaaggctggcggactcggtgggcctggacaaggacgaggtgccggtcgaggaatgccgatgggtgtggtgccgccaatgggagctgttcctccgggtttgcagggcgccgttcgtggaattggtggtcctggaatgggtgggcccatgcagcccggatacatgcaagggatgccgcagggaatgccgccacgtccattttgatgctcgattttgttttctttgttcgaccattatttgttttcttacttttacacaatgatctgtttgtttgataaataagttatcgaa

SEQ ID NO: 705 - DNA, 540 bp, Heterodera glycines
  genomic DNA sequence=SeqID_494; coding sequence=SeqID_1003
gagcaatactccctttttcccaaatcttacaaatgaacatgaatcaacttttggttggccgttcgctgttcccaaaaatcatccgccctttctcgcacaccaaaccccttgccaagtctgaggctgacccggatgattacggctacttcccggacccaattgaacactcgtggggtttggagaggaaaatgctcatcgctcgtctgaagggtgacgaccgctatgagccgaaggtatatttccgcgctgaacataccacccgggactatccgaatttggtgccggtccatttgcaggacaaagtcgtcgggtgcctttgcgagccggacgcggagtacgtgaactattggcatattaggaaaggccagatgaagcgatgcgagtgcggacattggtttaagggcgtgcaggccgaccctgacagtttcgcctgaatgcgatggatacgaattggctttgaagtgataggagatcatataaaatgatcagttattttaatagtatttctaagttggttggataaatgtaaagcatagtttc

SEQ ID NO: 706 - DNA, 2134 bp, Heterodera glycines
  genomic DNA sequence=SeqID_428; coding sequence=SeqID_877
gttttagacaaatttgtttgttttgttgaatttccaaatgctgcttattttaaagaattgttttggtcggcttcatgttatttgtcatcaacttacgcgcagaaattttcgtcttcttttgcatcgacgaaaggaattttccgtattccattaaacttcctgtccacaaaacgaatgaataaatgttttagaaaccgattttcttcagcgtcggtcagccaaagtcttctttcactggtggaaatgcatcgggcggtagcggcggaatgcctcctaacccttttcagggcatgtcaaactggcagaaaatggctgttgcagctgctgtgattgtcggactgcaatacttcatcaatcggctcgcttacacagaaatatcatggaaacagttctacacggactttttggaaaagaacaatgttgaacgcctcgaagttattgacaataaatgggtccgtgtcattaccagggagccaacgcagaccgttttttacttcaacatcggaagcgtagacacttttgagcgcagtttaacccaggcacagcaacatttgggcatggagacgagtcagcagcaggtgccggtgttgtacaaaagcgaaacggacatagtcggaatgattccccatatggttaactttcttatcacgggcatcttcctgttttacatgttcagaatgtttcgagggttcggaggaaaaaagcccggccaacgtggcggcggcggaggttttccggggatgggcaatctcttcggtgttgggcagtcgactgcacgggtcatcaacagagaggacgtgaaaacggcgtttgcggatgtggcggggtgtgaagaggcgaaaatcgaaatcatggaatttgtcaactttctgaagaaccccgcacaatacaaagcactgggcgcaaaaattcccaagggtgctcttctgactggccctccgggcactggtaaaactcttctcgccaaagcaactgctggcgaagcaaatgtgccatttatcactgtgtccggttccgagtttttggagatgttcgtcggtgttgggcctagccgagttcgggacatgtttgaaatggcgcggaaaaaggcaccatgcattctgttcattgacgaaattgacgctgttggacggaaacggggcggaaagggcgccatgggaggccactccgagcaggagaacacactgaatcaattgctggtcgaaatggacgggttttcaactgatgaatcgaacgttgtggtcatcgctgccacaaaccgcgtggacattctcgaccccgcgttgatgcgtccgggccgatttgatcgacaaatattcatccccgttcccgacatcaaaggccgtgcttccatcttccgcgttcatttgacaccaatcaaaacaaccttggacaaaatcgagctttcccgcaaacttgctgcgcacacgcccggattttccggcgcagacattgccaatgtttgcaatgaatcggcactaattgcggcccgagatgcacacgatgaggtgacttccaaggactttgagaatgccatcgagcgggtcatcgccgggatggagaagaaaagtcaggtcctgcagccggacgagaagaaaacggtggcgtaccacgaggcgggccatgccgtggccgggtggtttttggagtttgccgacccattgttaaaggtgtcaatcattccgcgtggaaagggcctcggctacgcgcaatatatgcccaaggatcaatacctttactcgaaggagcagctgctggacagaatgtgcatgactttgggtggcagagtgtcagaggaaattttcttcgggcgaattaccactggcgcccaagacgatttacggaagatcacacagatcgcctactctcaggtggtcaaattcggaatgagcgagaaagtcggtccggtgtccttcgacactccggagcctggcgaaatggcattcgataagccctattcggaggctaccgctcagctgattgaccaggaggtgcgcgacatggtcagcgcggcactgcggcgaacgcgcgaacttttgatgtcgaaggtggaacagatcgaacgggttgctcttcgactgttggagaaggaaatcttggcaagggaggacatgatcgagttagccacacgttt

SEQ ID NO: 707 - DNA, 606 bp, Heterodera glycines
  genomic DNA sequence=SeqID_495; coding sequence=SeqID_942
atgacaactccgtcgagacgccgtttaatgcgcgattttaagaagttacaggatgatccccctgccggagtttgcggagcaccgacagaggaatcgatcatgcgctgggaagcagtcatttttggacctcaggacacaccatttgaagacggaactttcaaattgacactcgaatttactgaagaataccctaacaagccaccaaccgtcaaatttgtgtcgaaaatgttccatccaaatgtttacgccgatggaagtatttgtctggatattttacagaaccaatggtcaccaacttatgatgtggctgcaattttgacctccatccaatcactgctggacgaacccaacccgaacagtcctgcaaactcattagcagcgcagctttatcaggagaatcgacgtgaatacgaaaaaagggttcaggcaattgtcgagcagtcatggatgtctttttcggatggaaattcagaagaaaggaacgcggcgggtacatcaaatgtcgtggacacgggtagaggaacaaatccaacgaatgaaaatgcaccggtggagaacgaaagcagcagcgaaactcccaatgatggcagtaacatggacgagtga

SEQ ID NO: 708 - DNA, 1113 bp, Heterodera glycines
  genomic DNA sequence=SeqID_429; coding sequence=SeqID_845
attctgttgccaaattcgtgtctcgacaatttgatgcgtcgcaacattcagtacccgatgctcttcaaattgactaatgtcggcccggcccttcagaggggcacccatgccggtgtgctggagtttctggcggaagaaggccgctgctatttaccttcctggatgatggcccaactcgctctgagggagggcgacctcatcaccgtggagtacaaagcgctcccgaatgccacttacgccaagttcaagccgatgtccaccgacttttacaacatttcaaatccccgtgccatgctcgaggtcgaactgcgcaagttttcctgtctgaccaaaggcgatgtcatcgcagtgcagtacaacgaacaagtgtacgaattccaagtgaaggcactgaagccggaaaatgcggtgaccatcgtcgagtgtgacataaacattgaatttgacgctgcggaaggctacgtggagccgaacagaacgcatcaacaacggaatgagatggtcgcagcggaggaagagcagcagtcgcatccacccaacgtgttcaaaccgttctccgggtcagggtttcgtgtcgatgggaagaagccgcgatcggtctcaacaagttcacagcaggaggcgacgagcagctcatcctcttcggcatcttccgggcgacagccttcctctgggattgcttcgactgcgtccactgcgcgtgacgctttggaggcaattgctgtggacgaaaattacatccctggggagttgcgttttgtgcgtcgtccgtacaaaagcaaggcacaaagggacaaagaggcgcgcgaaaaggacaacggagggacgatgaagccattcggaggcgaagggaacacaatccgaccgacgcgaggcggacaatgaacgggggatggacaaaagaatgacttgtggagaaaaagactattgacgaacggatgagtaatgataaaagtccttttgacggttgcattggcatctaaaacaataaatgattttggatctatccgatctatacaattgtcccgtaaaaataatattggtgaatgttatatttaaaaatgttgccgaaatgcatgctaaattcatcaaataaatttgggacaaattgaa

SEQ ID NO: 709 - DNA, 600 bp, Heterodera glycines
  genomic DNA sequence=SeqID_359; coding sequence=SeqID_996
atgcaggacaatgagccattgatgcgagcgttgagtaagttgatccacatgaacaagcccgacttggtgttgtttgttggcgaagctttggtcggaaacgaggcggttgaccagctggtcaagttcaaccaggcgttggccgacaattccgccgtcggggagcaggcacggctgatcgacggcattgtgctgaccaaattcgacaccattgacgacaaagttggcgccgccatttcgatgacttacatcacgggacagcccatcgtttttgttggcaccggtcaaacttaccacgacttgcgcactctgaacgcgaacgctgtcgtgaacattctgttgaagtgaccgatttgttttgaagcgctttcttttcggactgtcatgaacaaacccattttaccgttgaaaattgtggtgacgtgttaaattccatttattattagtttattattaaacattttacaattagcaggaaatgattcctaaaattggtgttaaattgatgttattcactgttctgatttggttgcttcttatttttccggcatttgtaattcgcttgaaggcatttttctcattgtaccataaataccatctcat

SEQ ID NO: 710 - DNA, 1074 bp, Heterodera glycines
  genomic DNA sequence=SeqID_430; coding sequence=SeqID_858
ctgaagtatttttttgttataatgatcaacaaccacgtcaatggggcgaatgacgtcgacatggaaaggaccgaaaacgaaagttttggtgaacttaaccagcgactgattgcgcttaaagcggagaagaacaacaaagagagcgccactttggcggtcaaagtgttggccttttttgtcaactgcgacaacctcagtgctgcccaggattttgtggaggcgttgaagaatttgcccgagtcggcttccaacagcgattgggcccggtggttttattatttgggacgcatcgaagcgttgaagggcaccgacgccgagacgtacaaagcggcagagaaacattttgaggtcgcacttcgaaaggccccacaaaacggcgccgtcggcttcaaacaggaagtgaacaaatgggtcgtgctggtcaaattgctcatcggcgaaatccccgagcgcagtctcttccgcacggccgaacttcgccacgtgttggcgccgtatttgctgctgacccaaactgtacgccttggcgacgtggccggctttgaccagacgaagcgcgagcacgggcccatctttgtgaaggaccgcaccgctgcgcttgtcgagcgcatccatcagagcgtcattcggaccgcaattcgcaaaatttcgacgacatattcgcgcatttacgtgtccgacgtggccaccaaattgaattcgaccgagcaggaggcgcatcgcgagttggtcaaggcgatcaaagagggcattgttcgtgctcagttggtcgccggcgacccgttggcgggcgggcggcactacgtcaaatttgggaccaccgatgaccaatatcgcggggttgagccccgcagggaattcgacgcgcgggtcaacgaactgttggagctgtaccaccaggcggtgaaggcactgcggtacccggacatgcgcaacccggaggtggagaccattgacgagcagcgcaggcgtgaacagttggctctcgaaatggcagcagcggaagaggaggatgatgacgatttttgaccaagacgatgtttttgtttcacaaaaattttttatatgctgcga

SEQ ID NO: 711 - DNA, 1488 bp, Heterodera glycines
  genomic DNA sequence=SeqID_499; coding sequence=SeqID_843
atggagcagctggaaattcaacctggcactttctccgagggtacaattgcctgctgtgactgtggcactccgatagcgccgaacccggccaacatgtgcttgggctgtgttcgcgcgagggctgacatcaccgaagggattcccaagcaatgtccacttcaatcgtgccgcaactgcgaacggtttttcgtgcctcccaacgcatggaatgcggcaaagcccgagtccaaggagttgatggctctttgcttggcccgtctgaagccggcgatggccaaagtgcggctggtggacgctgcgtttgtgtggaccgaaccgcactcaaaacgtgtcaaagtgaagctgaccatccaaaaggaggtgttctcccgtgccgtgctgcagcagtcgatggtcgtcgaatttgtgcttctcaaccagatgtgcgatgactgccgccgtttcgaggccaaagactattggcgcgcgtgtgtgcaggtgcggcagagatgcgactacaaaaagacacttttctatttggagcaattgttaatcaaacacaatgcgcaggcccaggcaagtggcataaagccggtgcccaccggcatcgactttttcttcgcccggcagcaagaggcacgcaaattggtggatttcatcagctcggccttgccttccaaattccatcagtcccagcaattggttacgcatgacgtgcgcagcaatttctacgattacaagcacactttctgtgtggacattgtgccgatcacgaaggacgcgctcatttgtctgccgcgcactttggcccaatccttcgcaaacattggccaattcgtcctctgtcttcgcgtcaccgacgttgtctcactgatcaacccgcaaacattgcaattgtacgagctcaacgctaccacctattggaagaaccctttcgacattttggttcatcctaaatcgcttgtcgagttttttgtggtcgacgtggaggaggtcgacgacccttacgccgttctcccacacggtcatgggtccgtgtccacaaagcaccgactggccgatgtttgggtggtgcgcagtgaccaagtcggacattccgatgccaaatccgtttgttgccgttctcatcttggccatctgctcaatgccggcgacaccacgaatttgaacaatcggacatttgacgcggtgaaagaggaaaatgtgccggatgtggttttgatcagaaaagcgtacgatcggagtcgccgactgcgcaagagacagtggcgactgaagagactgctcgaccaggaagagactgccagcgtggagagggagttcaatgaattcatggacgacattgaggaggatccggcattgcgcgaacggatcaacatttacaagaagggaggcggaaagcacgaaggcggggaggaggagcacattgacggagcgccgacactcgcggaaatgttggacgatttggagctggacgatgtcgaaatgcgggaggaggaagaggggtag

SEQ ID NO: 712 - DNA, 651 bp, Heterodera glycines
  genomic DNA sequence=SeqID_360; coding sequence=SeqID_999
aacaatgatgttgagcggacatggaaaaattacaaggaggagcagctgaagaatggcttgctcgattggcaagactacagaaatttgatttacggaaaaccgcaggagggccaggagatttcaccggaatacgtcaaaatgattgagcgagacgaacgtcggtggaaggtggctgactacaattcggacggtaaaatggaccgcacggaatacggctgtttcatgcacccggaggactgtgaccatatgagagacattgtggtgcaggaaaccgtcgaagacattgacaaggacaaggacggtttcgtggacatggccgagtacatcggtgacatgtacagaccagacgattatccggaactgaagggcaaagagccggaatgggtggagtcggaacgggaaatgttcagggagcaccgggacaaggacaaggacggcaaattaaacaaggacgaaatgcgcgactgggtaatgccgttgaactttgaccatgccgacgcggaagccaaacatttaattcatattgctgacgaaaacaaagatggcaaattgtcaccggaagaaatactcacccattacgacacattcgtcggctcacaggccaccgactacggcgaacagttgcaaaagcatgacccggccgacctctga

SEQ ID NO: 713 - DNA, 388 bp, Heterodera glycines
  genomic DNA sequence=SeqID_431; coding sequence=SeqID_852
taagattctaaaaataaatattaaatcgccatgacgaaaaagagacgcaacaacggacgcaacaaaaagggacgcggccacgtgcagcccatccgttgcaccaactgcggccgctcatgtccaaaggacaaagccatcaaaaagtttgtcgtccgcaatattgtcgaggcggcagccgtccgcgacatcactgacgcgtcggtttacgatcaatacgcactgccgaaactctatcacaaattgcactattgtgtctcgtgtgccattcacagcaaagtcgtgcgcaatcgttcgcgtgaagcgcgtaaggaccgaaacccaccgccacgttttggccaacggtctgccgtcgatcgtccgcaacgtccggggggagcggcccctggag

SEQ ID NO: 714 - DNA, 413 bp, Heterodera glycines
  genomic DNA sequence=SeqID_432; coding sequence=SeqID_882
gtgttattgaaaaattattattacaaaggaaaaatggctgacgcagctgctcaagaacaaaaaaagaaacgcacttttcgtaaatttgtctatcgcggagttgacttagaacagcttctggaaatgaacgagaagcaattcaaccaaatgattcccgcccgtcaacgtcggaagatgaaccgcggattgaaccgaaagcacaaatctttgctcgttcgtctgcgtaaggcaaaactcaattgtcccgagctgatgaaaccggagtgcgtgaagactcatttgcgtgatatgatcgtgctgccggagatggtcggctgtgtggttggcattcacagtgggaaggcatacaatcagacccaaattcaaacaaaaaagtcgaaactcaaatttttcgaattccatttagtctaaaa

SEQ ID NO: 715 - DNA, 2834 bp, Heterodera glycines
  genomic DNA sequence=SeqID_433; coding sequence=SeqID_934
atttgagtcggactttctgatcgcttcttcggtgggcagtgaagaggactttgttgctgcgttgggcccctcccttgacgaatgttctgttttgggaataatctcaagagcggatgcgctaaggtatatgaccgcaaaggttcgaattgaacaaacggtgagacggaaaacctttggcggtgcttccgcaactgtccgaacttcacaagagcatgacgtcctcgatttcctcgccaattcgatgatttgtcacattcaatcgtccggtggaaatatgaaaatgaaggcggtcttcctgggcttgatgatcagacggctaatcgaagcggagaagggcgtttgcgaggcggacgatcgcgatttttacggaaacaaacgcattgagttggctggatctttgctttctctgttattcgaggaccttttcaaaaggttcaactccgaattgaaacgaattgccgacagtcacctcaaccgaaatatggccgctccgctggacatcgtacgacacatgcgccaagatttgataacaaatggtcttgtcaatgctcttgccactgggaattggacaattaggcgttttaaaatggaacggcatggcgtcacgcaagttttgtcacggttgtcttacatcagtgtgttgggaatgatgacgaggatcaattcgacgttcgaaaagacacgcaaagtgtcagggccacgttccctgcagtcttcgcaatggggaatgatttgtcccgccgatacgcccgagggcgaatcttgcggtttggtcaagaatttatcgttgctcagtcacataaccacggacagcgacgaagcgcccattttgcaacttctctacaatttcggtgtccaagacgttcgtccgttgaaatttagcgtcgttcatgaaagacgttatcacatcgttttcctcaatggttccattgtcggaattactgatgacgttgaaaaaatcattggcacggtgcgactgatgcgccgaagagggcatttgggtgcctttgtctcggtcagtttcaacacgtccacaaatgcgctgtatttggccagcgacgggggccgactctgtcgtccgtatgtcatcgttgaaaatggtcgtccatgtctcacgcagtcccaaattcaggaagtccgagacggtcagaaaacctttgaccatcttttggcggagggatgcatcgagtttttggacgtgaacgagttgaacagtacgcgcatcgctgtctatgagcaccaaattttgccgcagaccacccacttggagatcgaacccttttcgttgctcggcgtcgtctcgggactgatcccttacccacaccacaatcagagtccccgcaacacttaccaatgcgcaatgggcaaacaggcgatgggcaccatcggatacaatcagcagaagcgaattgattcgctgatgtatctgctcgtttaccctcaaaagcctttggtgaaaaccaaaacaattgaattgtcaaacttcgaaaagctccccgctggtcaaaatgcgattgtggcggtgatgtctttcagcggctacgacatcgaagacgcattggtactgaacaaagcgtcgttggaccggggttttggacgctgtttggtctaccgatttgccaagggcaccgcgcgaaagtacgccaatcaaacgtacgacaaaatcatgggaccgtcgctggacgcgacgacgcgcaagccgattgcgaaacatgccgttttggaccaggacggcattgtttttgttggggcgaagattatgccgagacatgtgctcatcaacaaatccatgcccataatgcaatccgaaatgcttcccgctggcaatgtcgccgggttcaaccacaattttgagacaaaggacgtgtcaattccctaccgcggctcaatgaatgccgtggcggagcgcgtgctattgacctgcaacgacgaggagcaatacttggccaaagtgttgatagcgcaatgccgaagacccgagttgggtgacaaattcagcagtcgacacggccagaaaggcgtttgcggactgatctcgccccaggaggacatgccatttgatcacaacggcactgtgcccgatttgatcatgaacccacacggttatccgagcagaatgacagtgggaaaactgatggaattgttgagtggcaaaaatgcgctgatgggcccgtgccaaaagtggcggttgcattacggcacagccttcggaggggaccaagtggaaactgtcagcaaacaattagccgcccacgggtacaacttccttggcaaggacatgctcacgtcgggcagcacgggacagcaaatggccgcctatgtctattttggcccaatttactaccagaaactgaagcacatggtcatggacaaaatgcacgcgcgagcgaaggggccccgcgctgttctgactcgacagcccaccgaagggagggccagggacggcggacttcgacttggcgaaatggaaagggactgtctgatagcgtatggcgcgtcgatgctgctgatggaacggctaatgatctcctccgatcaattcagtatggatgtttgtgccgagtgcggtttgatcggctacttgggatggtgccaaaattgcaagtcatccgccgccatggcaaagattaaaatcccttacgcgtgcaaattgctgtttcaagagttgcaagggatgaacattgtgccacggctaaagacagcaaaatacaccgacggactgtgaagagattgatatttttattataatttgcattttacacaaataattgttgttgattgttatcgtgcaaataattatttgcatatttatttataataaatggaatcaatta

SEQ ID NO: 716 - DNA, 743 bp, Heterodera glycines
  genomic DNA sequence=SeqID_434; coding sequence=SeqID_956
gggagccaaaaggcaacaaattttgcgttttggtggctgtagggcaaaaggttacgcctctaatctatcgactcgaccacggaaaaccaacgccacaactcattggcaagatcgaaccggccaacggactgaacacggcgatgtgggccccgcagggcggttgggtggtggtgatgggggtgaacacgtccagcggaattgtgagcttcatcgacgcgacgggggcagaggcgaacaaagctaaaacgattgagcatacttcactcagtcagggttcttgggacccgaccgggcgatactttgccacgtgcactttcgcgggaaagagtcgctatgagacgggctatcgcattcactcgttccaaggacgtgagctgcgacgtaaggcggtagacgccctgctgcgattcaaatggcgtccgcggccacccgtttcattgtccgagcaaaaagtgcgggagactcgcaaatcgttgaagcaattgtcagcgaagtttgaggaggaggacaaaagggaaatgctcaaagtgtcgaaggaaataattgaacagcgcaaaaaggcattggaactcttctcgaacattcgcgtcgctgctgctaaaacatacgaagaagaacgggaaaaacggactgagctcagaggtggcattgaccaggaaattggcgagaaggacctcgttgaagaaacaataacagtggcactaaacacggagaaggagaaaatcagagacgagagcaaatag

SEQ ID NO: 717 - DNA, 942 bp, Heterodera glycines
  genomic DNA sequence=SeqID_500; coding sequence=SeqID_900
atggagccgaacaaatatgaaaagcaaaagggatttgctgctgaagcacaaaaattggaggaggacattgaccgatttatggaggcattggcggagaggggaaagaatgttcgttcctccaacagtgaaaaaaaatttgactttgaaaaatggtgcgaagaaattgataaacatcctgcatttgcacgcgatttgaaaccgaccgaagacggacaatattcaatggaaatgcaagcaatacaagcaatgaaatacgacgaggacaacccaacggaatgtgccaatgcgtacaaagaggagggaaatcggcactttgagaagagaaattatcggtgggcgattgatgcgtacacaaagggtatcaaattgcgttgttccgatgttcgtcttaactctgttcttttcgctaatcgttccgctgcccaccggcggttaggcaatgttcggtcggcgttcaaagattgtttttttgcgcgacgctttgatgcagaaaatttgaaggttctgcccatgggagcaattcgccgtggcgccgaatgtcttttggaattgggcgaagcggccaaatgcatcgcatggattgagacgaaggcgaacgaaggtggcacaatctcaccgaaagcgcatgtggatgaacagcttgaaaagacgaggaaaaaagcggaggcaatgagggcggaggaggacagagacgcgagaagagagagggcaacgcattcgatggttcgactggtggacgagggcaccaaaagtgcgcgactgatttggccgcttctgttgcaatacccggaaaagggacagaccgattttgtgtccgaatgtgcggaagacattccgttggccgaggcatttgaggaggtttatacgaggcagcatttggagcaaaatgaactgaaagcgtccggcggagaaaaagacatttatcattttgggaaggggtga

SEQ ID NO: 718 - DNA, 610 bp, Heterodera glycines
  genomic DNA sequence=SeqID_435; coding sequence=SeqID_903
cattccttgatggttcgtcatgtgactgcctcctgctttcgtgcgccatggccttttgaaaaaaagggctcaactggatggcggaagaatgggccggttgttattgaatcgcacaaatggcccggtcaacaaaaggaattccccgagctctcgccaaaatttctaggagcaaactttaaacagctatggagatacaccggagtggcgcccacaggatttaatgaccccaaaactgacgattttgttcatgttcccgaaatggtgcccgaattggtcgtgccggacctagcaaatttcgagctgaagccatacgtctcttacaaaacagatgcaaaaattgaagaaaggctacgcaattttgacaaaaaattgacaaaattcggtgggaatgagaaagcagcgattgccaattccaaagagacggaactatggcctcctccgccaatcgacgcgagaattctcttcgactttttctacgctgaaaaaattcgtcaggcatttgaaaaagggaagaagtaaaaaaagattagcagacgatggaccaaagcagacgattgacgccttatttttctctgttttattctccctttgataaacaatgattagctaa

SEQ ID NO: 719 - DNA, 1418 bp, Heterodera glycines
  genomic DNA sequence=SeqID_436; coding sequence=SeqID_854
atggcagcagcggaatttgctcgtaagcttcagctcatccaggcggcatcgaccagttcatcggctgtaagagatccattcgaagcaaagcatcacaaataccaattttggaacacacaacccgtcccaaaattaagtaggcggattgcattaaccgaaaacaattacattgatcctccgcttgatgtttcgaccataaaaaaagatccgtattcattgttggaaaagtttatttggtctgacattgatctcaacgcggatgaacaattggatgagctgtacattcttttgaccgagaattatgttgaggacgacgcgaatatgtttcgcttcgattatgggaaaaattttctgaaatgggcactgatgccacacggttggcagcaacaatggcattgtggggtaagggccgttacttccggaaaattggtggcatttatcgctgctgttcctgccacaattcgaatttatgacaaaaccgtcaaatctgtcgaaataaatttcctttgtgtgcacaaaaagctgcgaaccaaaagactggcgccagtgctaatcaaagaaatcacccgacgagtcaatttgtttgggatttttcaagcgactttcaccgctgggattttcattcctaagccagtgggcatttgccggtattggcaccggtcattgaacccgaaaaagctcgtcgagtcaagtttttcgcatattggcaaaaatatgacgcttcctcgtatgataaaattgtataaactgcccgaaaacaccgagtctcaattgacgctactcaacagagattctgccaaaagcgccttcgaattgctcagcggatatttgaccaaattcgacttggtccccatcttcaccatcgaagagttcgaacatttcttcctgccccgcgatgatgtcatttacacttatatgattcagaacaacggagaggtcaccgacttggtcagcttctacagccttccctccacagtgatgcaccattcccaccacaaaagcataaaggcggcttattctttctacaatgtcgccgggagtgttccgctcagccaccttttgaacgatgcgttgattttggcaagaaatgttcgtttttttctttttgtttccgttcgtttgggtatatccaaatttgtttcacaatcagcttggctttgacgtattcaatgctttggatttgatggaaaacaagggaattctggaggatctcaaatttggcatcggagatggcaatttgcaatattacctatacaattggaaatgccccgacattccttctgatcggattgggttggttcttcagtgatcggacaagtcgaatttaattaagcaacccggatgaattcgaacaattttttactagcagttttactcttcgaattgttgccattttaaaaaatattttatgctttaca

SEQ ID NO: 720 - DNA, 839 bp, Heterodera glycines
  genomic DNA sequence=SeqID_437; coding sequence=SeqID_912
ttttagtgaaaattttacagcaattataaatatggacacaaccatggaacaaccggctgaagatgttgaggacgtacagttggatttggggaagaaaaagaagaagaaaaaggcgaagaccacagaactcaaattgtcagaagatgagcatgaggaggaaaaggaagtcactgcactcgccgaaggcgttggccgtacaaatttgctcgacgcaaaaaaccccgacgcgtggacggactacaactacgacgagatgctggacatggtcttcaacatcatgcgggagaagaacccagaaatttccggcaagaaaaagacatttgtgatgaaaccgccggaggtgcaaagggcgggcagcaaaaagacggcgttcacaaatttcactgaaatttgtcggctgctgaagcgtgacccgaagcatgtgctgcaatttcttatggccgagctgggaacgacgggctcaattgacggcaatcagtgtttaattgtcaagggcaagttccaacagaaacactttgagaatgtgctgcgcggttacatcaatgaatacgtccgctgtcacacgtgccgctcctcggacaccgagttgaccaaggatgtgtcccgcctgttcttcatccaatgcaaacggtgcgggagtcgtttcgcggtgtcctccataaagtcaggctacacggcaatggtgggcaaacgggcggcactccgtcgggcggccgaagcgacggcgggcaaatgaatggcaaaaagcgaatgtggatgggaaaggaaagagacttcttccttttgttgtttccttttttgtcatgtaatttaacgcatcaaaatccgtaatattacct

SEQ ID NO: 721 - DNA, 906 bp, Heterodera glycines
  genomic DNA sequence=SeqID_438; coding sequence=SeqID_946
atgggttttgttaaagtggtgaaaaatcgcgcttatttcaaacgttttcaacccaaatttaaacggcgtcgtcaaggcaaaacggattactacgcacgtaagcgcttgacagtgcaagacaagaacaagtacaacacgccgaagtatcgtctcattgtgcgcttcacaaacaaggacatcattgcacagattgccttttcgcgcatcgttggcgacatggttgtctgttctgcgtacgggcacgagttgcccaaatatgggataaaggttggactgacaaactatgccgcagcttacgctaccggacttttgttggcacgtcgccacctgaacaaattgaaattggacagcgtttataaaggcaaagaaaatgtggacggagaggactttgacgttgagcaggaaggggacaatccgaacccgttcacatgtgtgctggacactgggctcgcccgcacaaccaccggcgcaaaactgttcggagtcatgaaaggagttgcggacggtggcattcacgtgcctcatagtgagactcgtttctttggctatgacccggaagagaaaaagtacagcgcagaagcccacagagaccgcatttttgggaaacacgtggctgactacatggcccacctgaaggaagaggacgaggaagcgtacaagcgtcagttctcccagttcatcaagaatggcatcgagtcgggaacgttggaagaaatgtataagaaagcgcacgaggccatccgcgcggatccgtccttcacgaaaaaggaaccaaagaagccaaaggagcaaaaacattggaacaaaaagaagtacacactgaccgagcgcaaacaccgtgtggccaaccgaaaggcgtatctgttgcatctgaaaaaccagcaggaggcagcgttggaaggctga

SEQ ID NO: 722 - DNA, 557 bp, Heterodera glycines
  genomic DNA sequence=SeqID_439; coding sequence=SeqID_925
aacacacatgagacggcgcgtgccatcaaacatatgccgttgaagcgtgccatccgctttctggagaatgtacgggagaagaaggagattgtgccgttccgccacttcaacggcggcgtgggacgcaaagcgcaggcgcaagcgtggggcacaacacagggacgttggccgaaaaagtccgccgagttccttctccaacttctcagaaatgcggagagtaatgccgaggtgaagggcctggacgtcgaccatttggtcattgaccacatcgtcgtgcaagcggccgccaaaatgcgtcggcgcacttaccgcgcgcacgggcgcatcaatccgtacatgagttcgccgtgtcacatcgaagtgattctgaccgagaaaaaggacgtcgttgcgaagccggccggcgcattggtcaaagtgaagaaagagtcgaagaagaagcagcgacggcaattggcacgtggcgaattctgagtgacccgaggacatccccgaaccacactctctttgtgcggcttgttttgttatttggtggcgataaaatttgttgaacctta

SEQ ID NO: 723 - DNA, 1053 bp, Heterodera glycines
  genomic DNA sequence=SeqID_440; coding sequence=SeqID_990
gattgtcactgcccaattccaattgaaaagaatggacgagccgcttctgcaggaaaacccaaatcgttttgtcattttccccatcaaataccatgacatatggcaattttacaagaaggcagttgcttcattttggacagttgaggaggttgatttgtcaaaggatatttccgattggaaaagcttaactgataatgaacgattttttatttctcgagtacttgcattcttcgcagcttctgatgggattgtcaacgaaaatttagtggagcgctttgctcaagaagttcaagttccagaggctcgctgtttttatggtttccaaatagccattgaaaacattcattctgaaatgtattcgctgttgattaactcttacgttaaggattcggatgaacgtgctaagctttttaatgccattttcgagttcgaatttatcaaaaagaaggccgactgggcccttcgttggatcgcaagttccgacgcttcttttgcggagagactcgttgcatttgctgcggttgaggggattttcttctcggggagttttgctgcaattttttggcttaaaaaacgaggccttttgcccggtctgacgcacagcaacgaattaatttcgcgtgacgaaggcttacaccgtgactttgcctgtcttctctacacccacctcaaaaacacgccacccaaagaacgcatctacgaaatcatctcggacgcggtaaaaattgaacaggaatacctaaccgacgcacttcctgtctatatgatcggcatgaattccgatttgatgtgtcaatacattgagttcgtcgctgaccatttgctggttgaactaggctatgacaagaaatacaatgtcctcaatccgttcgacttcatggagaatctgtcgatacagggcaagaccaatttttttgagaagcgagtgtcggagtaccaaaagatgggagttatttcaacagaagagcagcgtgaattccgtcttgacgctgatttttgagtgttttaaattaatttgatattgtaacttctcaccgatactcatcctattgg

SEQ ID NO: 724 - DNA, 483 bp, Heterodera glycines
  genomic DNA sequence=SeqID_441; coding sequence=SeqID_1023
gtgtgcgaaatttgcgacttggcacagttgaccgaccgcgagcagtaccgggtgcatttgcagtccgcacatcgtcaactgttggggaagaacaacgcggaaatggccagcggtgcaccgttggcgtgctcacgctgcagagaccgtttctggacatacgaaggtttggaacggcatttggtcatggtccatgggctcgtcactgccgatttgttggcaaaagcgcagcgcaaggcggactcgggacggtgtaagctgtgcagcaagcagtacgccttcaacattttgcaacatttggtctccgatcaccagattaaactttgctcagcagaaataatgtacagctgtgatgtgtgctcataccgttgcacctcctaccaaaagttggaacggcatttggagacggaacatccgaacaccggggccaacaagcaacagcagcaacatcaacaacagcagcagcagcagcagcagcaacgctag

SEQ ID NO: 725 - DNA, 1480 bp, Heterodera glycines
  genomic DNA sequence=SeqID_442; coding sequence=SeqID_868
ttcctttttattttctggtccaaatgtcttctaagccggcatacaaagttgctgacatttctttggccgactttgggcggagggaaattacaattgcggagaatgaaatgcccggactgatggccatgcgggcaaagttcggtgcgcaaaagccattgaaaggtgcgcggattgccggctgtttgcacatgactgtccaaacggcggtgcttatcgaaacgctgttggaactcggcgccgaagtccaatggtcgtcctgcaacattttctccacccaagaccacgccgccgctgcgattgccaagcgtggcgtgcccgtctacgcgtggaagggcgagacggacgaggagtacgaatggtgcattgagcagacgctgattttcccggacggaaagccgctgaatatgattttggacgacggaggcgacctgaccaaccttgtgcaccaccaacacgccgaacttctgcccggcatcatcggactgtccgaggagaccacgacgggggtgcacaatttggccaaaatgttggcggccggactgctgaaaacggcggccatcaacgtgaatgactcggtgaccaagtccaagtttgacaatatgtacggcatccgcgaatcgttgccggacggaatcaaaagggcgaccgatgtgatgttggcgggcaaagtcgccgtcgtctgcggctacggcgacgtgggaaaaggttcggccgcggggctgcgcaattttggcgcgcgagtgatcgtcacagaaatcgacccaatcaacgcccttcaggcggccatggagggttaccaagtgagtacgctggacgaagttgctgacattgctcaactcgtggtcaccaccaccggctgcaagaacattgtgaggggtgaacacatcgaacggcttccggaggatgccatcgtttgcaatgttgggcatttcgactgcgaaattaacgttacctatatgaacgagaattgcgtgtccatggagcaggtgaagccccaggtggaccgctatttgatgcgcagcggtcggcacgtcattctgttggccgagggccgactggtcaatttgggctgtgccaccggacattcgtccttcgtcatgtccgctagtttcaccaaccaagtgatcgcccagctcgaattgtacacgaaatacggcactccggacgcttacaaaacgggactgtaccttttgccgaaacagttggacgaggaggtggcacggctgcacctggacaagttgggcgccaagctgaccaaattgagcaaggaccaagccgaatatttgggcattccccaagagggaccattcaaaccaggccattaccgttattgaaaagcagcggatggaaggagaaaagcggaaagaagacctttctatttgtcaatttcactttttgcaattttttttttgtaatcattggcatgttgacacgacattttgttggtttgccgttgtgggttcgtaaatcggttttgtta

SEQ ID NO: 726 - DNA, 3153 bp, Heterodera glycines
  genomic DNA sequence=SeqID_361; coding sequence=SeqID_975
atgaaccgttcgactggcgaagcacagaaagcagcttctgacattttggcccgcttcaaagaaagcgcagattcttggacaaaagttgacacaattttggaattcagtgacttgctcgagacgaaatactttggtttgcaaattttggagcatctgatccaaacacgatggaaggctttgccaagggatcaatgcgaagggatcaaaggttacattgtcaacatgattttggacatcagtgcggaccccgaaaaaagtgaacgaatgaaactgttgcttcagaaacttaacctcgtcttggtgcagatcgtgaaacatgagtggccacgtctttggccaactttcatcagtgacattgttgggtccagtcgaaatggacagtctctgtgcatgaacaacatggccattcttcgtctgctcagcgaagaagtctttgactttgggaccggccttacctcgtcgagggctatacagttgaagcagcaattttgtgggcagtttgaagaagtgtaccgactttgttatgagattttggagaattctgacaatgctcagctcgtatatgctactctgtacacattgcatggttttttggattggatccctgttggatatgtgtttgaaaacaacctaattgatctcatcattaaacagtttttaccatttcctgcctttcgttcgatcgctgttcaatgtttggttgaggtgtcgtccatcagcatcgatgacaatccgcaatacggcggcaaattggtctttttgctcaggaaggtcatcgaaattatatcggaacaacttccactttcctttgacattgccacttcctacgcaaatggaactaacgaagaccaaaaatttgtgtcaaatttcgcccaattgcttagcactttcttcaaagaacattctgcattggtcgaaataacctttcctcatccggacgaagaacaaaaagctgtcaagcaagcacatttgatggcgttgaagtatttgttgaagatcagcagcgaagtcgaagacatcgaagtgttcaaaatttgtttggattattggaattggctttgcatggaactgtttcgagaatctccatttgaacaatctgaacattcgatcatcgacgctctgaagcgctataaccggcaagaatcgcccaagcggaagctgtacatcgaagtgctctcagaacttcgcctgctgatgattagcagaatggccaaacccgaagaagtcattgtcgttgtcaacgagaacaatgaggcagtcagggaacttgtgaaggacacggactccgttgtgctctacaaaacgatgcgggaaacacttgtgttgctgacccatttggactaccgagacactgagttgaaaatgacggaaaaacttcaaaatcaagttaatggcagtgagtggtcctggaagaatttgaacacgctgtgctgggcaatcggctcaattagcggtgcgatgcatgaagacgacgagaagcgatttttggtcacagtcattcgcgatttgcttggtttgtgtgaacaaaagcgtggcaaagacaacaaagcggtgattgcctccaacataatgtacgtcgtgggccaatacccgcgtttccttcgctgtcattggaagttcctgaaaactgtgatcaacaaactgtttgaattcatgcacgagtcgcacgaaggtgtccaggacatggcctgtgacacattcatcaagattgtcatcaagtgcaaatcgcattttatctcgattcaaggcggtgaaacaatgccatttattgacgaaattctgcagaatttgaacagcattatctgcgatttgtctcacccacaagttcacgtgttctatgaagcggttgggcacataatttacgcttgtacgagtcgcgaggttcaagaggacctcatcgaccgcttgatgactttgcccaattccatctggagcgaagcaattgaccatgccagtcgggatgtgaacatcctttctgaccaagacgtgctacgaaatttagcacacattttgaaaactaatgtggccgcctgcaaatcaattggagctccattcttcagccagctaaaacgaattttgaatgacatgttgagcgtgtaccaagtgatttccggaaacctgaacaaagctgtgaacgagcagggcgaacaggcgctgaaatggccgttggtgaagcaaatgcgaattgtgaagaaggagattctgacccttctgtccacttggatttcgcgtgcttttgagccccgtctggtcatcgagaatgtgattaagcctctgttcagcaccgttctcgtcgattatgaaatgaatattccgcaagcgcgagaaccgaaagtgctttccctcctttcgattaccattgtgtctctgaaggaggacgcgtcggcacaggtccccgctattctcgacgcggtgttcacgtgcactctcgaaatgatcaacaaagatatggaagccttcccggaacaccgcacgaatttcttccaactgctgaaggccatcaaccaacactgcttcgacgtgctgatcactcttcccgacgaagtttttggcctgctcatccaagccatcgtttgggcagtgaaacacacaatgagaaatgttgcggaaaatggcattgacattctccgcgagcttttgaccaaagtctcaacaatgacggacaaagcgcaggcacaagccttttacaaaaagcactttatggtgatcatggaacatgtccttggcgttgtcaccgattacaaccaagtgaactttgttgggctgacgaatctggctgaaagcgtttgtctgttattccaagcagcagaaacaattattgaagtgccactgaatccgacaaatcccagccaaccaaacatggaatttgtttacgaggctattgccactttattcaccactcatttcaaaaatttgacagagccgcaaattcgagtcacagtcaaagggttcttcagctttaaccgcacagttacaaagatgcgtgaacacatccgagacttcctcgtccagatcagggaagaagccggcgacgacactgcggaccttttcttggaagagaaagaggctgagatccagcgcattcaatcgttaaaacaagcgattcccggggttagaaatccgaacgaattgttggaggaggacatggtctga

SEQ ID NO: 727 - DNA, 884 bp, Heterodera glycines
  genomic DNA sequence=SeqID_443; coding sequence=SeqID_906
gataatgagcaatcttcgtctgcaaaagcgcttggctgcttcggtgttgaaatgtggtaaaggaaagatttggctcgacccaaatgaagtcaacgagatttcgaatgctaattctcgtcaaaatgttcgacgtcttgtcaaagacggtctcattatccgcaagccggggaaagtccattcacgttatcgcgctcgtgaacgtttggaagcacgcagaaagggccgtcacatggggttcggcaagcgtcatggtactcgcaatgcgcgtatgccagagaaagtgatttggatgcgtcgaatgcgtgtgcttcgtcatttattgaagcgttatcgtgatgctaaaaaaatcgacaaacacctttaccatgagctctacctcaaagcaaaaggaaatgcgttcaagaacaagcgcaacctcatggaatacatctttaagaaaaaaaccgaaaaccaacgttctaaacagcttgcagaacaggccgaggcacgtcgcaacaagaacaaggaaacccgcaaacgtcgcgaggagcgtttggttcagaagcgaaaggaacttttgcacaaaatttcggagagcgagaaagagaagacacctcagcccctagtgacaaagccagccgagaaagagcaaccgaagccacaacctgtcgctgcacggaccgctgataaggaacagcccaagacacaacctgccgcggtaaaaactgcagagaaggagcagccgaagtcaaaaacggaaactgtgggcaaaagggaaactgttggtcccaagaaaaagaaaggaggcaagtaaatgacaacaagcggacgatcggatttgagacaatcgatcgcattcattgttttgccacatcatatttgttgaagaattgttattattcaaa

SEQ ID NO: 728 - DNA, 1466 bp, Heterodera glycines
  genomic DNA sequence=SeqID_362; coding sequence=SeqID_896
aagaaagagtcggctggtgactccgatgccattccggaaggacaaatcaaatcacttgcagaactgaaaatggatgacatcaaagaaatgaaaatttcgcaaattaaaacagtcaagggaatggtggacgaagaagtcagacggaccaaactcagaatggaaacgcttgagggggacagaaatgagcatttggccaaaattgggaatttgctgcataattcggtgcccatcagtgacaatgaagacgaaaatcgagtcgaacggacatttggcgactgcgcaagcagaaaaagttattctcatgttgacctcgtggtgatgtgcgacggatttgacggagagagaggcaccaatgtggcgggaggacgaggctattttctgaaaggaccgttggtgttccttgaacaagcgctcatcgcattggcattgcaaatgctcaacaaaaagggcttcacgccgctttacacgcccttttttatgcgcaaagacgtaatgcaggaggtggcacaactcagccaattcgacgaagagctttacaaggtgaccaccgcaaaaaagacggacgcagccaatgaagacggctctcccgacgagaaatatctaatcgcaacttctgagcagccaatcgccgcctttcatcgtgacgaatggcttaacccatcggatttgccaatcaaatatgccggaatgtccacctgttttcggcaggaggtcggaagccatgggagagacacccgcgggattttccgtgtgcaccaattcgagaagatcgaacaatttgtcatctgttcaccatttgacaacgaatcgtggaagcacatggacgaaatgattggcaatgctgaagagttttgcaaagtgctcggccttccctaccgaattgtggccattgtttcggccgaactgaacaacgcggcggcaaagaaattggacctcgaggcgtggttcccgggcagcggtgcatttcgggagctggtttcatgctccaactgtacagattaccagtcgagacggttacgaatacggtacggacagacgaagaaaatggacggagaggtcaattatgtgcacatgctgaacgcaacaatgtgtgccaccacgcgagtgatctgtgccattctggagaacaatcagacggaggatggcattgtcgtgccggaacccctgcggccgtttatgccatcgcaatattcgcaacgaattccctttgtaaagccggcgccaattgagcaggaaaaagtgcagaaaaagaagaaatagtctcgcagacgctgatattcggaggcattctttgctttggcatttgttgacccatttttatttataagtgaatttgttaattgatggcaatggctttacaactttcgctgtttgttttttgttggtttattcattcattcgtttgtttcgaaaatggcatcagtttcattttgattgggtttagtcaaataaataaatgcatgatt

SEQ ID NO: 729 - DNA, 1303 bp, Heterodera glycines
  genomic DNA sequence=SeqID_444; coding sequence=SeqID_986
aaggtgtggaatttgaatggttgagacagcggaacaacctgctaaaaaggaagacgagaagatggaaaccgccgaagatgagatcgatgctgaaattttgcaaatgtctacggaccaaattcgggagcggtcgctgttgctcgacaacgaaattcgcataatgcgcagtgaaattcagcgcattagtcacagtatgcaaacactcaaagagaagacaaaggaaaacaacgaaaggatcaaaatcaacaaaactcttccctatttggtctcaaatgtcattgaacttttggatcttgaagagcaacaggaagaggaaggagcaaacattgaccttgatgcccacaaaacaaagtgtgccgtcatcaaaacatccacgcgtgccacttactttctgcccgttgttggtcttgtggacccggaagaaatgaaaccgtccgatttggttggcgttaacaaggactcttatctcatcctggaaaaactgccacccgagtacgactcacgcgtgaaggccatggaagtggacgagcgtccgaaagaaacgtactcagacattggcggatgcgatagtcaaatcagagaattggttgaagcaattgttcttccgatgactaaaaaagatctcttcataaacattggcattcagccgcctaagggcgttcttatgtatggaccaccaggtacgggtaaaacgatgttggcacgtgccgttgccgctcaaaccaagtccacttttctgaagctggctggtccgcaacttgtccaaatgttcatcggagacggcgccaaattggttcgagatgcttttgcactggccaaagagaaagcaccgtccattattttcattgacgaattggacgcaattgggacaaaacgattcagttcggagaaggccggcgatagggaagtgcagcgaacgatgttggaattgcttaaccaactcgacggcttccagccaaatgacgacataaaagttattgctgcgacaaaccgtgtcgatgtgctcgacccggctctgctccgttccggcagattggaccgcaaaattgaactgccagcgccaaacgagaaggcccgggcgcacatcgtccgcattcactcccggaatatgaacgttgataaggatgttaatttcgatgagttggcacgttgtaccgacgattttaatggtgctcaatgcaaagctgtttgtgtggaggcgggtatgatcgcgcttcgtcgtgaatctcacatcattctgcacgaagattttatggacgctgtgcaagccaagaagaaaacgagtctgaattattatgcctga

SEQ ID NO: 730 - DNA, 2208 bp, Heterodera glycines
  genomic DNA sequence=SeqID_445; coding sequence=SeqID_842
atgatggaagttgacgaccctcctaatattcaaactccaagttccaaaccgatggaaattgaacgtgaaattgagcatctccctcaagcccaagcgaccaaagatgaaactgagcaactcccccaagtccaagggaccaaaggaattgaatccgatgatattgcatacgaggaggacatcatacgaaaccctggccttctccgaccctgggaacgttacattgagcacaaagtgaagaccaaggctgaccctaagcaagtgcggctagtgtttgaaagagcgctgaaactgttcaatcggagctacaaactctggtacaattacctgaagtaccgccgcaaaacgattgcgcacaaaccgccgacagacattgcttatgcgcatttgagtgacgcttacgaacgatgcctcgtttttctcaacaagatgcctcgcatttggatcgactattgcatgttgatgattcgtcgtggccaaataacggaaacgcgtcgcgtgttcgaccgtgccattcgtgcacttccaataacccaacatatgcgcatttggcccctgtatattgactttgccacacgacacaacgttcccgagacagccattcgcgtgtaccgtcgctttctgaaggtataccccggcgggcgagaagactttgtggagtatttgaaaagtatcgacaaattggacgaagcggcacaacagttggtcatcttggtgaacgaagacagaccgatcagcgagaagggcaagactggccaccagctttggactgagctgtgtgatttgatctccaaaaacccaaataaaattttcacgcttcgcgtcgagccgatcattcgccaagggatcggccgttacactgaccaagtgggcggactttggctggcactcgctgagtattatattcgaatgccgaactttgagaaggctcgtgacatcttcgaagaagcattgggtgtggtgaagacagtccgcgacttcacccaattgtttgacgcctattcaaaattcatggaacgactgacctcactgaaaatggacgcgttgtcctccgcccggccaacccaagttgatgagcgcgagttggagttggaattggttatgacacgctttgagcatctgatgaaccgacggccattgcttctgaacagtgtgttgctgcgccaaaacccgcataatgtgcacgaatgggtgaaccgagtgcaaatttacgagggcgaccccgaaaatcaaattgcaactttcgaaaaagcggtggctaccgtggacccgaagcaacaagtcggccgactcggtcagctgtggattgagtttggcaagctgtacgaaaagttagacaaattggacgaggcacggaaggtgttcgacagagcggtgcaggcaaattttgttcgtgtggacgaattggcccaagtatggtgtgaatatgccgagatggagcttcggcacagcaattacgaattggcaactgctttgcttcgtcgtgccactacgcctccaccagtgcgtcgtgacagttactttgatgattcggccaaagtgcagaaccgcgtgttccgatccctgaagttgtggtcgttgtacgccgacattgaagagtcgatgggctcactggaaagttgcaaggcaatttatgagcggatgttggagttgcgaattgcaacaccacaaatcgtgataaattatgcactgtttttggaggacaaccaatactttgaggatgctttcaaggcgttcgagaagggaattgggcttttccggtggccgctcgtatttgacatttggaacgtttatctgaccaaattcatccaacgatatggtggcaaaaagctggaaagagctcgcgatttgtttgagcaatgcttggacaaatgcccacccaaatatgccaaaaatatttatctgctttacgcaaaactggaggaagagcatggattggcacggcactcaatggatatttacaatcgggcaaccggagcagtcgaaaaggaagaaatgcatctgatctacaatgtgtatgtcaaaaaagcgatgcaattttacggcatcaccaaaacgcggccaatttttgagtcggccattgaacgtttgcctgaggagcgttctcgggagataagtgtacgctatgctcaaatggagcggaatttgggtgaaatcgatcgcgcccgagccatttatgcgcattgtgccgaaatttgtgacccccgggtc

SEQ ID NO: 731 - DNA, 972 bp, Heterodera glycines
  genomic DNA sequence=SeqID_446; coding sequence=SeqID_944
ttgaagaattcacagatcacatgacgcggattgtatcaaatgtaaaagactccaaattgggcaaagatgcgattcagcagctaaaggtggcaacagaaactgccgaaagagttgctcaacaagttggcgaaatgcaggcgtataagcaagtgtcttatatggccaaggaaatcgaccgattggccgatgttcgaatgtataaaaggccaggtttgttaatatttaaatgtcaacgggatgcaacgggaattgaacttcacaaagagtcgcgttggtacgcgggatggaagacattcacagagtccaactcctattacaacaaaattattgactggaaaacacgcattgacgaaagcgagaatattttcgtccgaactgttcgtggtaccttcgaacgtgtccaactcgcatttgaatccaaagacaatgtgtcggaagtgctaacgcaaatatccaaaatcgaccccgaattcgacaagtcggaatggctccgtttttgcgaaaaagaaatgatcccgaacattcttgaatcaacttaccaaatgaacttcgaaatccttcgtgattggtgttacgagaaagcgttcaatttaatcgcaaattctatcaaagaatacgaaaagattggcttcaacacgagggattctcgcattatcgatgttagcaaagtggagttggtcacggggaatatgaccgaccaagggccgactttggtcatccaattccaagtattcatgacaaatgtggtgaagaacagcgaggggaaaattgtccaaggtgaccctgaaaaagcggttcgagtgagacacatttgggtaatatgccgagacatggaggagttcaacccggcaacagcttggaaactgcttgagctgcacatgataaaggaggatttatttgtttagcgccgaacgtcaaaaacattttaatttaaatttatttgatttgttccgacaataaaaaacgtcatta

SEQ ID NO: 732 - DNA, 1716 bp, Heterodera glycines
  genomic DNA sequence=SeqID_447; coding sequence=SeqID_887
tttttgcgcgtttctgtgtcatcaaaagaaggacaaaagcaatgggaaaagccatctaaatcggcgatgaaaaaggcaatttcgcgtttggaagaagaacgacgtaaacgggaaaaagcaacaaattccgcggcagcgaaattaacggaagaggcaaagtcagtcgcagaacagcaacaagaaatggcacgagaaaaacgtttggaagaagcaaagaaaatgcaagttaaattggacgaatccttgcccgaagcgaagcgaaccaaaattcgcgaatgtccggcactgtgtggccagcgggtgaaagtgttcgcattcgtccatcggatgagacagcaaaggaaaaacttgatgttcctcgtccttcgcgatggctccggcttcctccagtgcgttctcaacggcactctctgtcaaaccttcgaagcgttgacactgactactgaaagttctgtttgcgtgtttggccaaatcaacaaattgcccattggaaaagttgcgcccggcggcatcgaattgacggccgatttttgggaacttatccacggatcaccgcccggaggggttgacaatgtgctgaacgtggaggccaacgtggacgtgaagttggacaaccgccatttggtggtgcgtggagagaattgctcagccattctacgaattcgcgccgctgtgacacgcgcaatgcgtgaacatttccatgaagctaaatacatggaagtgtgtccaccaactttggtgcagacacaggtcgaaggtggctctacccttttctccctgaatttcttcggcgagtccgctttcctcactcagtcttctcagctttacctcgaaacgtgcattgcctcgttgggcgattgttattgcatttcgcagtcttaccgcgctgaaaagtcgcgcacgcggcgccatttggccgaatattcgcacgtggaggctgagtttccatttatcaccttcgaagatttgatggtgcgcattgaggaaatgacatgtgacacagtcaacagagtgatggccgacccggaaatacgcgaacttatccagcagcagtggcaaaaggattcccaatatgagttcgtcgctcccaaacggccttttcttcggatgacttatgcggaggcaattgaatggcttcaaaagaatgaagtgatgaacgaagaggggaaacccttccaattcggcgaggatattcccgaaggccctgagcgatttatgaccgacacaattggacagccaattcttctcaatcgctttccgcatggaattaaggctttttatatgtcacgttgtgcagatcaaccggaattgaccgaatctgtggatttgctaatgccgggcgttggcgagatagtcggaggatcgatgaggatttggaaggaggacgaactgcttggggccttccaaaaagccgacatcgatcccaagccatactactggtacgtggaccagcggaaatacggaggttgcccccacggaggttttggacttggtctggagcggttcgtatgctggttggccaatcagcatcatatccgtgatgtgtgtctcttccctcggtacatcgggcggtgtgcgccgtagcttttttccgtctttgaaaaggaccaaaaacgaacccatacgaatatgggtattgttcatttttggcgttaaaacaaatgtatcttctaaattgtgcattttttttgttgttattgcataaagggataaaac

SEQ ID NO: 733 - DNA, 1780 bp, Heterodera glycines
  genomic DNA sequence=SeqID_448; coding sequence=SeqID_866
atggacccctaccttcaagaattaataaacaaatggttatgctgggacaagaatgaaacgactcgaacagaaattgaacgactcgtaaaagagaataatgtgcacgaattgcgacttcggatggttgggaaattgtcttttgggacggcaggagttcgaacgcacatggaggcgggctttgccagactgaacgaattgaccatcatccaactgtcccatggaatggcacggcatttgacaagtgaaatgggcgaagatggcaaaaagaaaggcgttgtgattggcttcgatggccgacatcagagcaaacgttttgccgaattggctgccaatgttttcgtgctgaacggactgtccgcctttctcttttccgccgtcgtccccacccctgtcgtttcgtttgccgtcgtttctttgggttgtgctgcgggcatcatgatcaccgcttctcacaatccgaaggaggacaacggcttcaaggcttattgggccaacggtgctcaaattctgagcccacacgacacggaaatttgtcgaattgtcgcggaggagtcaaagcccgaagaagcctattgggacacggtccaactcggcacaagtgcctttctccactcggccgactcggttttggagaaatattttgccggggagagtgccatttgctgccatcacaagtcgctcaaccaaacttcgtccctccgtctcacttattccgctttccatggcgtcggctccaaattcgtccgccgaatgttcgctgagtttggctttccctcggagaacatttcgtacgttaaggaacaagacgagcccgacgccgactttggcactgttccattccccaaccccgaggaagggcaccgggtcctcaaactgtgcattgagactgcaaatgccaatgactcgactttgctcctcgtcaatgacccggacgccgaccgactccaattggcggagaaagaggcaaacggagagtggcgcgtgttcagtggcaatgagatgggcattctgctgacgtggtgggcgtggaccaattggcgtgccgccaacccaacggcggactcttcgcgggtgttcgtcctccattcggccgtctcttcccaaatggtcgccacaatggccaaaaaggagggcttcaaagcggcgcattcgttgacgggcttcaaatacataggcaatttggcacacaaattgcggtcggaaggcaacaccgttattgccgcctgggaggagtccattgggtttactcccggcacaacgctggacaaagacggcgtttcttccgccgcggtctttgctgaaatggccaattggctgcgcacccaaaagggcgtttcgctgcgtgaacagctcttccgcctcttctccatctacggctttcacctccaacgcaattcgtattggggggtcaaatcgacggaagtgacgaagaaattatttgcggaccttcgctccgattatcccgaaacgattgggcagaatttcgatgtgaaatttgtgcgcgacttgacgacgggttatgacaacgctcaaccggatgacagggccattctgccgctgagcacctcctccgaaatggtgacgttcactttggtcgacggaagtgcggtgacactgcgggcgagcggaacggagccgaaagtgaaatattacatcgaactgcgcaccgaaccgggcaaagaagaaaaggatctgagttcgatgcttgagcagctcgaccaattggaatccgacgtggtagaagtctcctccagccgaccaaatacggactgatcagtcg

SEQ ID NO: 734 - DNA, 1691 bp, Heterodera glycines
  genomic DNA sequence=SeqID_449; coding sequence=SeqID_932
ctgcaatatcaacgggaattggaactgctggagaaagaaaacaaaaacctcaaacaacgccttttgctaaaagacgcgggcgaattgaagcgacagaagaaaatcaaacgttcgttgatcgaattgtactccgaaatgctcgacattctcatcgaattcgactcctcctacggaactgcggacaattgccgcgtgtcgtcgttgtcggtgaccaatcggccggcaaaacgtcagtgctcgaaatgattgcccaagcgaggatattcccacggggcagcggagaaatgatgacacgagcaccggtcaaagtgactctcagcgaaggcccttatcacatggcccaatttcgggacagcaatcgcgaatttgacctgacaaatgcgtccgaattggagcagttgcgcaatgaaattgaactaagaatgcgcaattcggtgcgggatggaaaaacggtgtccaacgaagtcatttctttgactgtaaaaggtccgtctttgccccgaatggttcttgtcgatttgcccggagtgatttcgactgttaccacagacatggccagggagacgaaggaggacatcgcgaagatgtgcaagcagcacatggagaatccaaacgccataattctttgcatccaagatggttcagtggacgcagaacgaagcaatgtgaccgatttggtgaccaacgtcgacccggacggtcagcgcacgattttggtgctgacaaaggttgatttggcggagaaaaacttgagcaacccgcatcggataaagaagatcctcgacgggaaactatttccgatgaaagcgctcggctatttcggcgttgtcaccggcatggacaagcgggacgcgagcattgcggagatccgcaaatacgaggaggacttcttcgagagttccaaactctttagggatggcgttttgaaggccacccaaatgacgacgcggaatatgtcattggcggtttcggactgtttttggcggatggttcgcgaatccatcgaagcgcaggcggacgctttccgcgccaatcgcttcaatttggagacggaatggaaaaacacttttgcgcaccaacgcgacttgaccagggacgaactcttcgacaaagcccgtggcgaagtgctcgacgaagtggtcaatttaccctattttaaggttgaaagtacaagttctttcaacactgtggtggacattaaactgaaacattgggcggaaaaggaattggccaaccgatcagtgcaggtcggatgggaaacactttcacaaatctttcggcgtcaagtgagcggcgaggaaaggggcggacagacgctgaagtccaatcggacgcacggcagccaaaaatcgccggatggtggaaatttgttgaaagcactgaaggctgcggtggtcagtgccgtgttggagcagcacagatgggattcaaaagcgttggattatttgcgtgttatccaattgaatgccgtcgctgaccaagtggtgcccgaccgaagggcgtgggaccaatcgtgcgctttccttgccaacgcggcctctgaccgaattcgtgaacttaaaaagacattggaagaatctcgcggtccttcgggatggtcacgttggtttggttggggttcgccgacgcctgagcaactcgtcaaccaaacggttcaagacgaacttcgagctttgctcgtcaataatccg

SEQ ID NO: 735 - DNA, 486 bp, Heterodera glycines
  genomic DNA sequence=SeqID_450; coding sequence=SeqID_860
tgcgtcagatcaacaacggcgtattcgtcaagttgaacaaagcgacaatccagatgttgcgcattgctgacccgtacattgcgtggggctacccgagtcagaagatcattcgccagttggtgtacaagcgtggttatgccaaggagagtgggcagcgcattccgatcacggacaatgccattgttgagcgaaacatgggcaaatcggacgtgatctgtgtggaggacatgattcaccagatttggacagtcgggccccacttcaagcaagtgaccaactttttgtggcccttcaaactcagcaaccccgtgggcgggttcaagaagaagtccaaccattttgtggagggaggcgactacggaaaccgcgaggaccaaatcaacaaattgcttgaaaaaatgatctaatttcggaaacaattgcgatgagttgatgtgcagcggacggcacgcttttgttgttgttattttacagataaactttttt

SEQ ID NO: 736 - DNA, 911 bp, Heterodera glycines
  genomic DNA sequence=SeqID_451; coding sequence=SeqID_928
ttaaggtcaataatttcgctttctttgtttgagcttactatttccgcataatggacgaggaacaacttttggattatgaggaagaacaagaagagactcaggaacaacaatcaaaaaatgatgcagcaacaaacggagatgcaacaaagaaaattaaaggtaattatgcgagcattcacagcagcggattccgagatttgatgctccgtccggagttacttcgtgcgataattgattgtggatttgagcacccttctgaagtgcagcatgagtgtattccacaagctattcttggaatggacattgtctgtcaggcgaaatcgggaatgggtaaaactgcagtgtttgtgcttgccactttgcaacaactgacaccgactgatggcacggtctctgttctcgtcatgtgtcacactcgtgaactcgcctttcaaatttcgaaagaatatgagcggttcagcaagtacatgccaggagtgaaggtttctgtgttttttggtggtatgccgattaagaaagatgaggaggtcctggccaaaaacactccgcacattgttgttgggacgccgggtcgccttttagcactgggacgcactggacatctgaagcttaaaggagtcaaattcttcgtgctggatgagtgtgacaaaatgattggggatgctgacatgcgtcacgacgtacaagaaatcttcaaaatgacgccgcaggagaagcaagttatgatgttcagtgcaactttgcctcgggagctgcgcgttgtctgcaagaagttcatgcaggaagtgagtagttcggttccttctttgctgcggttagcctcttcgaatcggcggtgttcggataggccttgtttttgcataaattcttctcaacaattgcccgttcgttgtctattcaatgagccatga

SEQ ID NO: 737 - DNA, 453 bp, Heterodera glycines
  genomic DNA sequence=SeqID_452; coding sequence=SeqID_888
atggttgaagtgttcgactctctcagcaaactttacgcggattatcaacgcacaacggcaaagaagttgaagatcatcgatgcttacatggtctacattttcttaaccggtgtcttccaatttgtctattgtttgctcgtcggcactttcccttttaacgcgttccttgccggattcatctccaccgtggcctgttttgtgcttgccggttgtttgcgcatccaagtgaacccggaaaacaaggtcgaattccccaacatttctcccgagagggcctttgccgatttcatcttcgcccatgtaattctccatttggtggtcgtcaactttatcggataaaccaatgtgaaaggatgggaatataaaagtcattctaaatttaactgaccgtttattcgtttttctgttaatttattttcgtttaataatgttttgcataaatgggtttcgttg

SEQ ID NO: 738 - DNA, 664 bp, Heterodera glycines
  genomic DNA sequence=SeqID_453; coding sequence=SeqID_933
gatcaattttctgtttaaacataacgaaaaatgaagctgattgaatccagcgacatcgtcaaattcccagacaatgtcacattcgcgctcaacaaccgtgttgtgactgtgaagggaccgcgcggtacgctcaagcgcgactttcgccacttaaacattgaaattatgcgagaaaacccgaagctgctccgtgtgcggaaatggtttggcatccgcaaagagttggcagccattcgcacagtgtgctcacacattgaaaacatgatcaaaggtgtgactgttggatttcggtacaaaatgcgctcagtctacgcgcattttccgattaacatcacgcttcaggagaacaacaccgtcgtcgagattcgaaacttcttgggcgagaaatttgtgcgccgtgtcggactaccgcaaggcgttagcgctgtaatgtcgaccaaacagaaggacgagttgatcattgacggtaccgacatccaaaaagtgtcccaggccgctgctcgcatccaacagtcgacgaccgtcaaaaacaaggacattcggaaattcctggacggcatttatgtgtcggagaaggtggccattgccgatgaatgagcacacaaagataaaaacccattgttaccccttttttgttggtcaaatggataaagaaatgttgtta

SEQ ID NO: 739 - DNA, 1011 bp, Heterodera glycines
  genomic DNA sequence=SeqID_454; coding sequence=SeqID_972
ctttttttaaaaaatggctaacaaaatgaagaaaaagaagaaaaatgctgttgctactacaactgctggaccccaaaaggatggaggcaaattcaagcagaaagggatcaaattcaacacggaaaagggccaacacattctgaagaatcccggcgtggtccatgccatcgttgagaagtccgctgtcaagggcactgacactgtgctcgaggttggcccaggcaccggcaatttgtccatgaaattgttggaccgtgccggccgtctgattgcctacgaattggaccctaaaatggtggcagagctgcagaaacgtgtggtcggaacacccgtccaatacaaattgcgtatcattgctggcgatgtgatcaaagcagccgagtggcctccgtttgatgtgtgcgtctccaatttgccctaccaaatttcatcaccgtttatttttcgactattgctccaacggccattgcccaggtacgccgtgctgatgctgcagaaggaattcgccgatcgactgttggccaagccgggcagtaaggtgtattgtcggctgtccgtttctgttcaattattggccaccgttgagcatctgatgcgtgtgaagcgttccgaatttgtgccacctccaaaggtggactcggccgtcattcgcattcagccgcgcaatccgccgccggccatcaattacaaggaatgggatggaatgttgcgcattgcgtttatgcgcaaaaacaaaacactgtcggcgctgttcaagcagaagcaggtggtcgatgtgttgcgcaaaaattacgcagtcgtttgcggcacgaggggaaaggaagtgccaactgatttttgcatgacctcacacattgaacgggtgttggaagaagcacaatttgccaagcggcgtgcccggacaatgtcaattgaagactttttggcactaatgttaacatttaacaaggcggacattcatttttgttgattgtggtggttatttgtttccttgtttcgttttcacaaaaa

SEQ ID NO: 740 - DNA, 1302 bp, Heterodera glycines
  genomic DNA sequence=SeqID_363; coding sequence=SeqID_941
atggcgaaaaacaatatcaacattaaccgtggcgttcaagaccctttttatcgttacaaaatgcctcgcattttggcaaaagttgaaggcaagggcaacggaataaagactgttattgcgaacatgcccgaaattgcaaaggcactgtcccgtccaccgacctatccgacaaaatattttggctgtgagctgggagcgcagactaactttgacctgaagaatgagcgttatattgtcaatggggaacacgatgccaacaaactccaggatattttagacggatttatcagaaaatttgtgctttgtccgagctgtgacaacccggagactgtgctgaccgtaaagcgtcaagtgatcaatggaaagtgtaaggcttgtggacacgcttttattgtggatccaaaacagaagctgtcgacattcattctgaaaaatccaccgcctcctgacaacatagagagcgaaaaggaagtgaaaagcgacggcggattgccagctgaggagagtaacgatgtaccagtagtcgacaactcgggtggctgtgatgccgggtcgaacggcgaagatgacgaggattgggcgcctgaacccgttgaagacgaggaaaaactttcgggacaaatcggcaaattggtcattgacaaggacttggacaaatctgtggatgagcgccttgacttgttgcatcagttcttcctcaaggcggtcaagaacaacacgattcaggacagcaagatgatgttaaacgaagctgaacgtctggaacttaaatcgaaggcaccgctgttgctggccgatgttttgttcgacaccaatgtcatcactcagatcaaacaacatcgcaatctgctgctccgcttttgcttgaaggacgagaaggcgcagcgcatccttttgggaggcattgaacaacttgtgcaaaacaacaaggacattctcatgtcgaagactgcccacatcataaaagcgctttatgacaacgacatttgcgaggaggacgtcattttagcttgggggagcaagccgagcaagaaatttgcggataaggaagtggtgaaagagatgatcaaagttgcccagcccgtgcttaaatggctcaaggaggcggaagaagggtcggacgagtcggaggacgacgatttggacgttgcatttgacgatcgaagccgcaacattgggatgacagtggaggtggaaaagggagcaaaggatggggtcacccgtgtacagaacggccaaattgcaaccaatggcaaaatggacgatgggaatgcagacgacattgacattgacaatatctga

SEQ ID NO: 741 - DNA, 1032 bp, Heterodera glycines
  genomic DNA sequence=SeqID_455; coding sequence=SeqID_965
accggcagaacattcttccgcgcgccgggcttggaagcgccggatgagaacagtggcgacttccccacaaatgcgttggtctgtcctgattgtggcttcagttgttcttcgaaattccattacaactcacaccgcaacacgcacagcacgcaccaatgcccaatttgcaagtttgagactcgcacggaagggcgtctaaagaagcacatgttgcagtcgcacaagcgagagcaaaggcttgctgcaggcattaacatccaatcgccgcccccgacaccaacgacactcaagcagaattcgccaccttctaacggcgatttaacggcgggagacaattccaacgggacactcgccttagagtccattcagtctatgctcaccaataccaattctgttgccttctccaactccaccgacgccctccttaagatatgcactgatgttattgcgaacaatggtcccaacaaaaaaatgctcaattcgtcgccgcaggtgggggacttcggccacattccgcttgaacagctgagggccctgacggaaaggcacaccgccctgctgaatacatcgacagcaggcacactgaacatcgcagagttacagattgggccagaagcggtaagcagcgcaaagcaaaccgaaaaagagacacgcaaaagcgcatcggggaagccgaagcagtacaaatgcaagacatgtcagaacatcagccgcagtaaagaggagcaatgggcacacgcacgcctgcatatacccaagcaaaagcagttgacttgcgaactttgtgactttgtgacagaatacaagcaccacttggagtaccactaccgtaaccacaacggacagaaaccttttaagtgctccatttgtgattacacttgtgtcaacaagtcaatgctgaattcccacatgaagtcgcacactcctgtctaccagttccgctgccaggactgcacttatcagaccaaatattgccatagtctgaagatgcatctgaagaagtacagccacaaaagagcgcctgggcccagc

SEQ ID NO: 742 - DNA, 1622 bp, Heterodera glycines
  genomic DNA sequence=SeqID_364; coding sequence=SeqID_861
atattaccttcgcctatccaaaacgaaggaaaggatgaatgggcaaatgttgtcacgcgtgacccctggttcaaaggccacgagaatgccgcatcaaaaacagttgccatcaaagaaccaccgccctatgggcaccgcaaaggatttgtgccacgtacgcctgaagactttggcgatggcggtgcctttccggagattcacatcgcgcaatttccacttggcatgggaatggaacgcgcagtcggaagaaacaaagacaaaacggtggcactgcaatttgacgaggagggaaagttgcgatttgacgaaattgcacgcattgggcacggaaaagacaaaattgtccattctcgcctttcggacatgaagtcaaaaataattgacgaggaggacgaatcctttcacaagccgaccgaagacgaagtcgaacagaccactgaagcgacgcggatggcactggagaaaatcacaacggcaaagattgccgccgctttgcccgttcaacacgccaaaaagacggcgcctgcccaatacattcgctacacgcccagccaacagtcgggcctaaacgcgggcggcgcccaacagagaatcattcggctggtggaggagcaaaaggacccgatggaaccgccacgttttcagatcaatcagaaaatccctcgggcgccgccctctccgccggcgccggtgatgcattcgccgacgagaaaagtaagcgcaaaggaacaggccgactggaaaattccgccttgcatttccaactggaaaaaccccaaagggtacaccgtggcattggacaagcgattggcggcggatgggcgcggattgcaacaagtgcacatcaatgaaaactttgccaaaatggcggaggcgttgagcatcgcggaaagaaaggcgcgggaggcggtggagacgcgcgctcagatggagcgacgcattgcgcagaacaaaaagacggagcaggaaaagcgaatgcgcgagttggcacagaatgccaggtgaaagaaaccaattaaaaaaaatgatgacaccaacgcattggaggaggcgaaggagcgcgaaatgatccgacgggatcgcattgaggaccatcgacgggaccggaacatcgcccgctcgagaccggacaaattggagaaactgaagcgagacaaggagcgcgacgtcagcgagaaaattgcacttggactgcccgactcacgcgcacgcgaaagtggcgaaacacaattcgactcacgccttttcaaccaaaccgggggtctcgacagcggcggcatcgatgacgaaacgtacgccgcctacgataagccatggcgtccccaggatggcattcagcagcacatctaccgaccccgaaaggacattgacagcagcatttatggcgccgatttggatcgaattatcagcaccaatcggtttgtgcctgacaaaggcttttccggagcggatggagccggcaaggagggtggacaacgaagcggaccggttcaggtgcgtgaggaggaggacattttcggcctgggcgaactgctccaaaccacgtcatcctcagccaagcgaaaagcgacggaatcggaggaattgccaagcggcatcaaaaagagtcggagatgaactga

SEQ ID NO: 743 - DNA, 606 bp, Heterodera glycines
  genomic DNA sequence=SeqID_456; coding sequence=SeqID_836
atgaaggttttcggccttatggtattgtcgaaggattcatcgacggcgaaagttcgtttgttgaaaggggcttttgagttgaacagcttcagttttttcacaaggaaaaatgtgcaggaatttatgcaatttactgccaaattaattgcggagagatcggcgacaccaagccgaagttcagtgaaagagggcgaatatttcatccactgtatggtgcgacaagacaatttagtcggtgtttgtataacggacgaacagtatcaatctcgggtcgctttcactctgctcaacaaagtgttgtctgactttgccgaacgaattctcgaattggaatggaaacggatgagcggcgagtccgactgttcttatagcgaattgcctggatttctcacccggtggcagaacccacgtgaggcggacgcactcacccgagttcaggacgaagtggaggagacgaaggcggtgctgcacacgacgatgcaagcggtgctggagagaggcgagaagttggacgatctgatcaaagccagcgaaaatctgtcggatcagagcaaaatgttctacacgcaagcgaggaaaatgaacaaatgttgcagctacacctag

SEQ ID NO: 744 - DNA, 717 bp, Heterodera glycines
  genomic DNA sequence=SeqID_457; coding sequence=SeqID_872
ttttagcgaatactctttattcattataatgcaaatctttgtcaagaccctcaccggcaagacgatcaccctcgaagttgaggcgagcgacaccatcgagaatgtgaaggcgaagatccaggacaaggagggcatcccaccggaccaacagcgtctcatcttcgctggaaagcagctggaggatggccgaaccctcgcggactacaacatccagaaggagtctactctccatcttgtcctgcgtcttcgtggaggaatgcagatctttgtgaagactctcaccggcaagacgatcaccctcgaagttgaggcgagcgacaccatcgagaatgtgaaggcgaagatccaggacaaggagggcatcccaccggaccaacagcgtctcatcttcgctggaaagcagctggaggacggtcgaaccctcgcggactacaacatccagaaggagtctactctccatcttgtcctgcgtcttcgtggaggaatgcagatctttgtgaagactctcaccggcaagacgatcactctcgaagttgaggcgagcgacaccatcgagaatgtgaaggcgaagatccaggacaaggagggcatcccaccggaccaacagcgtctcatcttcgctggaaagcagctggaggacggtcgaaccctcgcggactacaacatccagaaggagtctactctccatcttgtcctgcgtcttcgtggaggaaagaa

SEQ ID NO: 745 - DNA, 1396 bp, Heterodera glycines
  genomic DNA sequence=SeqID_458; coding sequence=SeqID_945
gaagataaacgatcaggaaagtatttgcggtgaaattgtggctcaagaaagtggcgaaaacactgcaaatcaacagaatcagactcaacagaatacaaccttcgaggaattgggggtcaatgatgaactttgcaatgcatgtgagagcctcggatggactaagccaatgcctattcagcaaaaagtgatccctttggctctaaaaggccgcgacataattggattagcagaaacaggttcggggaagactggtgcgtttgctctgccaattcttcaagctttgatggattctccgcagcatctttttgcacttatattggctccaaccagagaactcgcttttcaaattagtgaacaatttgaagcccttggggccacaattggacttaatgtttgtacaattgttggcggcatcgatatgacatcacagacactttctttggcaaaacgtcctcacattatcgttgcaactcccggccgtctcgtcgatcatttggaaaataccaaagggttcgatctgcgcactgtcaaatttcttgtattggatgaagctgatcgaatcttaaacatggattttgaagtggaacttgacaaaattttgaaagtattgccaaaggctcgtaaaacttatcttttctcggcgacaatgacccaaaaggtgtccaaattagaaagagcgcatctcaaaaaaccagagagaattgaactttcgacgaagtaccaaacggtgagcactctcatccaaaatatgctgttcatcccgttcaagtacaaggaggcttatttggtttatttactcaacgaaaaggcgggcaatactgccattgtgttcgtcagtacgtgcgcaagtgcggtcaaattgtcgttgctgctgcgacatttgggctttggtgcgatttcccttcacggacagatgtcacagccgaagcgtttgggggctttgcataagtttaagaaaaaggacagaccaatcctcgtttgtacggacgtggcatcacgagggcttgacataccaaatgttgacatggtcatcaattacgacgttcctcaaagctcgaaagactacgttcacagagtcggacgaactgcgagagcgggaaagtccggaattgcgctcactatagtaactcagtacgacgtggaggtgtaccaaaaggttgaaaattcgattgggaaacgacttgatgttttcgagataacccacgaagatgtggaaagagtctccgaagctggcagaattgctgcaaatgtgagagtatttaaatttaaatattcatcgtatttgagtttgtttagcggtataaagaaatgtttgaaagaaaagggtataaaagaggaattggggacgaaggagacgaattggaaccagcgcgaaagcatcaaaaagcgacagtga

SEQ ID NO: 746 - DNA, 924 bp, Heterodera glycines
  genomic DNA sequence=SeqID_459; coding sequence=SeqID_951
atggaagttgttgactcaatgtcagttcaaattccaaagtccagtggcgccaaaatcgaagtaataaatgacccgcaatgtattgcacgcgtagcggcgcacagtcacgtcaaagggttggggcttaacgtagaaaccggcgaagctctgcaaaaagcttgcggatttataggccaatgcgaagcgagagaagcagccggcattgtgatggagctggtcagacagaagaaaatggccggcagagcggttttactcgcaggccctccggggacaggaaagacagcaattgcaatggcacttgcgcaggaacttggcgacaaagtgccgtttgtgccggtggttgggtcggaagtgttttccagcgaagtgaagaaaacggaggtgctaatggaacacttcagaagggccatcggtgtacgcatcaaagaagtgaaggaagtgtttgagggcgaagtggtcgatttggcgccggtggaggccgaccatccgatcggaggctttgggaagacgatttcgcatgttaattgcgttctgaaaacgacaaaagggtcgcgcgaattacgtttggatccgaccatttacgactcactgctgaagcaaaaagtgacaccgggagacatcatttacatcgaggcgggctcggggactgtcaaaaggatgggccggtcggacattttcgccaacgaattcgacttagacgctgacgaatttgtgccaatgccgaagggagacgtgcacaaacagaaggaaattgtccaatatgtgagtttgcacgacttcgacaacgcaaatgcgtcgcctcagggcaaaacgggcgattttatctcaatgctttcaaaatttatgaagccgaaaaaaacagaaatatcagagaaactccgaagcgaagtgaacaaagtcgtaaaccaactcattgaatcggtg

SEQ ID NO: 747 - DNA, 3843 bp, Heterodera glycines
  genomic DNA sequence=SeqID_339; coding sequence=SeqID_1002
cagctccgagtggacagccgcgaaatgtgcgcgtctcttcgattaccgccacgcgggcggaattgctgtggaatgaaattgactgtgaacttcgccacgggcgcatcctcggctacgactacgaattggacgatttggggggagagggacagaatacttcgggacagtcgagcacacaccgagtgtctctggacggactgaccccgtggactgagtaccgagcacgcgtgcgcggcaaaaacagccggggcgagggacccttctctgagtacgttcggttccgaaccctcccggccgcccctccgcctcctaccgatttgcgagaggagcaacaattggcccacgccttggaaatttcttttctgccgccgtatccgcccaacggcattctcgaccaataccgtatccggtggactgtgcacggcaagttcaactaccgagagcagcgagtgcccgcctttgagttggagtgttccgactcgcgaatgcgtggccgcctctgctaccgaatcagcggattggagccggagcaggagtatgagattcaggcggcggcacacaccgaacgcggcgattggtcggattggtcggagccacttgtgaccaagacgacggagcaagacattccggtgctggaacatccgctggagttggaatttgccaagtcaacgagcattggcgtcagatggcgcgggttggaggaaaacctggccgagcacatcaccgggtacgcgttggagtacaagtcggagacggacaccgactggaaggaatggaacggcgtggtacggcaccgggcgcggcagcctgactaccgagcgcatgtcaaaggattgaccgagtccacggaatacttcttccgcctgagggtggtcggcaaaggggacaagcggggagggccagggcccgagctgaaggcgatgaccaaatgcggaaagcctgaagagcctccgggcaatgtgcacattgagccggtcgactttcaacaagtgcgcgtcagttgggagcctccggacgaattgacgtggaaatgcgactccgtagagttggtgcttcactactcgaacggaacgggggcaccgcgaacgcaaacattcgccgtcgacggaccacgcgaggctttgttcgattccgtgccaggcacgcgatgggaggccaaaatgctcacgcaaagcgttgagccgggcgaggagcctcagcgctccaagtggagtccgcgcgcggttctgctcacgcgctcgtcgccaaccgaaatcttcttgaaagtgacgccgcgagatgaccccacgcaggcggacgccttctgggatttgccggcggattacgaggattggccatggggcgtggacttgcagtatcggctgaccaggctgggcagttgtcggaagctgtccaaagcggacacggagccggtgatcatggaaaatgttcaggacaaacaggtccttctcgacaatttgcatcccgggtcggaatacgaagtgaccgtcactctccgacaaccgcccggcgttgaccgccgtgtcgcgcccaaaaaggcagtccaacgcttccaaacggcggatcagccgccgagcggcgcaccgaacaaattgcgagtggagggacgatgggataccaaattggcattcggatgggaaccgccggagtgcttagagcagaacggcgagatcagtcagtacgagtacgagctgaacgggttggacgagtggaaccaggggacacgccagggcgtcagcccacgcacacgcgcagacattggcgaactgttgcccggctcactgtaccgcttcagggtcagagcgttcacttctgccgggcccggaccgtggtcagagccgatcgacgcgcgcacgacgggctccgagttgggaccgcctcgcgacctctcgcccattaagtctctgcagaatgccatccaattggcctggctcccgccccatcccgaaacttctccggtggtcgcttatcgtctccgttacggccccgccgcaggcacttaccggccgcaggaagtgattctgcagggcgacgaactcagctgtgccgactacgagtcgcgcattttgactggcgaacacttgtgcacttcggccacgggtctgaagccggccacgatgtaccgcttcgcggtgcaggcgcagtcttcgtctggcaattggggcccgttcacctcggacagtttcggcaccactgaacccgaactgaaggcggtggaggggggacagttgcgactgatcggcgcagggcacgactttttgcgagtgcggtggacggcaccgccggtgattgttgcgcacatcgaacaatacgagttgcacatccaaccgaccgaacgacttgtccaagcgccacaacggcacgaagtgccggacagtcagacggacttccaattcaaagggttggtgccggtgacagtgtacaacgtaacggtacaaggactggcacagcaggggaagagcctgtggaggattagcgacaacttcgccaccactgacatatccgagccgtccctcgcctggctgtcttcgtggtgttctccgcttaccctggtggaaaagtcggactccatgctgcacgtgacttggactccacctgacgtgtacgagccggagtaccgcgacttgctgacgcattaccgcgttaccattgcaccggtggactctctgacgatgaaggcgggcgggcgcaaaaattacacagtgatggtaccgggcaattccatcaaattcaccgaattgcaaccagataccatatacaacatcaccgtccaaggcggaacggacagcggatacggtgctaccgtatggggctcatgggcaacattgtcgctcggcaaaacgtggattctccggctgaaggaccgcacgccgggctccctgaccgtggagtgggacccggtctggggcattgcgcaccgcggatacatcctgaccgccaaggctatccattccacccatccgcaccttcgcatcggttccatgcgcaccgtcgacgtgccctccaccgccactgagctgaccattcgcggactcgagcccaccagcacgtacaatgtgacgttgcagctaaaggaccaaatggatggcgcgtggtcaatctactcgacgctgcagccgggctgcttccttcccggcgacattcggcactgcgaccagacaccgcacgccacctcaatgagttgggagcccgtgttgggtgcagcggcgacgcattaccaagtgcggtacattcatttgcaccaaattcgcactttgtgggtggaggagccggaaaggcaccgcaaagaattgctgtgccccaaagatccgtgtaataggctttgctatttggtgttcaatctggcaaatcctccggaggaatacgcttttatggtgcgcgcgaaggtcgacggccgatggaacaattggaaattggcgggacggccgacggtggccgaagcgccggaagtgaaggagaattgctgcattgtgccaccgccttaccatgtggataacatcggacaaacagatacccaatggcaatacgcaatcgcaccgtcgcccaccgatcggaacattacgcgttattacgttgtggtggacgaacgtgaccccccgggggacaccaattggactcagctgacggacaaagtgacggcccatcggctgcacatcccttattacgtgacggcgtcgttcagcaccgaaacattggtcggaccgacacacgtgaaaatcggagacggacaagtgatcggaggatatctgaactatccgctgcacaaggacaagaagtacaactacgaagtatacaccaaatggatgatgcacggagatcagccggtgatcgcacgactgagag

SEQ ID NO: 748 - DNA, 2016 bp, Heterodera glycines
  genomic DNA sequence=SeqID_460; coding sequence=SeqID_955
atggtttctccagacgaagttgctgaagagtatagggcagcgctgtcggagctgacacgcaatgacaagactcagatcaatctgctcacaattttggccgaggattatgcgtcatatgccagcgcaattgttgctgtgattgaggaacgtctcttcaagtgtccatcaccgatgaaaatcgtcatgctctatgtgctcgactcgatcgtcaagaacattcccgcgacaagcggcgcctaccgtgacttatttgcgaaaaggattgttgacatgattgtccatgtgttcaaggagggtgatgagaagacgcgagcctccgtctatcgtcttcgctcaacttggtccgaaatttttcgtcaatcttgcctttacgcaatcgacatgaggcttaataggatcgacaaagcctggccgatcctcactccacgaggagttgttcatgtgaatccattgtttttgaacggaaagccacaacagcaggttccatctcagcctgtttcacttccaccacccgtcgtcacttccgtgcctccgcctgtttcacttccaccgcccgtcgtcacttccgtgcctccgcctgtttcacttccaccgcccgtcgtcacttccgtgcctccgcctgtttcacttccaccgcccgtcgtcacttccgtgcctccgcctgtttcacttccaccgcccgtcgccaatcctccgccaatggttcaaaatggaggaccattgttggttgaacaaaagccacctcctctattttttccacgaggaccaatccaacagcaacaacagcatcatattcaaaatgtgacgccgaaattgcccggtgtaccggagaataatcgcatttttgtggatgggaaggcgtatgaggttttttacttagacgacgtggcggccattgagcgcaatggattgccccaccgggtgtccttcgccggtccggaccgcgacgtggtaatcgacgggacggcttatcgaatggcatttgggcagcacaaacaagttctcatcgatggcgacctgcatacattacgttttggcgcaccttctcgcgagctgtttatgggcaattttccgttcaaaggcgccttcggaggtccgccaatcattgcaacgatcaatcaacgaaggcacgaaattcgcctttgtggaccgccgcccgaagtgcgcattgacccggagccgagctacgaactgatgcggtacatgccggcagtgcgacaacaacagccgacgatggtgcaaccgacgaagactgatgggacagagggcgaccgcaagaggaagagagaatcgccgcccatcgacgtttcacgattgttaaagcgtctgaaggagaccggactgcttacacaaccgcccaacgaagcagagcggaaccaacgtaaaaaacaagtggagatagaggcgaatgcggcaccaattccttccaaccatcgcctagacaatatcgagcgcagggcaacgccgatgtccggcctggagcagttcagcatgagatcactgatcatgtcggtgtttggggtgtgtcgctacgattccgtaatcgacgccattcatcgtccacgcgttgtgtgtcagtattgtggaattgcgttccaaaaattatataatgaggcgtatcaacggcacgcggattggcacctgcaaaaaacaattcggatcgagggtggtgctgacaaatctgccgtcgaagacgaaaagggcaccgccgcagtttcgcatcaacatacggcggggaccaatcgggacgcgccttcggaaattgtcgaatcgaaggtaggccagaagcgcatttgccaatttgatgctaacattgcattctcatttcacaggaatgccaagtttgccatgaacaattcgaggagtattgggacgaggaggaggacgtgtggcgccttcggcactgcttactttcggatgggaaggtgtgccaaagagggaaagaatagatgtcattttgttgttttaggcatttcatattttttgcaaagaggacgtcatccaagaggaagctga

SEQ ID NO: 749 - DNA, 2245 bp, Heterodera glycines
  genomic DNA sequence=SeqID_365; coding sequence=SeqID_968
atggcccacctcatccaggacggttttgtcgtcaatgacgcaacatggaaactaggcattttcatcaccgatatgaacatatcgcgagagttattcgttcgcggtgacatgaccatcggtagtctgatgatgcagttggtggggcaaattggcgagactcaggactggagtgaccattacatgtggtggcctgaccgccgtaagtggctgaaacacacgcgaagcacgttggaccaaattggaatcactgcagcgacttacttggaatttacaccgatgcataaacatgccaaggtccaactccccgatttgcagattatcgatgcccgactcgatttttccgtgcccattttgaaggtcacccaaaaaatctgccaagaacttgccatccgtcacccggaagaactgtcgctgaagcgtgatattccgccagatattttgcgaaaaggcgcatctgtcgaatcggaggctcagattcagccatacatgaagccgggcgaggagtccattggacccggcactctccgaacggccaaacccatccgcgcttcaactgtcaacctcactagcgggcgaggctcacctgcactttcgcaggcatctgcaatgggccccggtcacttgtttaacgcttctgaaattggcacactgccgaagatgggaacgattccgcgcggaatgagccccggtccagccgcatatcgcgaagtgcttggacgaacaccggagcccggttactctgaaggaggcggtctcgaatgtgaccagttcgacgaaaatttgataaactcaccgaaaataactccgggtcgtgaaacattcagaccccaaaattatttggagaaagccgcgttgaaccggggatggttggactcatcgaggtcgctgatggaacaaggcatttgcgaaggcgatgttgtgcttcttcgttttaaattcatgcagtttttcgacatgaatctgagatatgaccccgtccgtatcaatcaattgtatgaacaggccaaatggtccgtccttttggaggaggtcgaacacacggaggaggagtcatcattatttgcagcgctgcagttgcaagccgcgcttcagcgaaactctccggaccgcgaatctccggaacgtgacgaggtcgatgtactgcttgatgagttggaacagactttggacaccactgcctcactaagtcgccgtgatttaacatacgtgcctgagttgacagaatatctcaaatatttgaaacctaaaaaattgggttttaacaacttcaagagagcttactttacatttcgagacctttacttgagttattacaacacagctcaagatgcaaatgggcctccacttggtcactattatctcaaaggttgcgaggtcagccaggatttgagcgtctcgcaaggaaagttcaacataaaattgcaagtgccgagcagtgaagggatgtcggaactgatattgaagtgtgacacggagcaacagtttgccaaatggatggccgcttgtcgtttggcatctcgtggaaagacaatggccgattcttcgtacaattcggaggttgaatccattaagaaagtgctgcagatgcaagcaggaagggcagcggcagcgcaaaacggtgcacaaaacaagaagaaatcgcaaccggtgcagctgcccacggatttcaattcggaagagttcgtttgtcagcgatattggaagagatcggggaacaaaagcatgcaacagcgcatttcggatgcccattcaaacgtgaaaacattgagttgcaccgaagcgaagcttcagtacattcgcaattgggaggctctgcccgagcacggccttcactatttcatcgtcaaattcagaaatgggaagaaagctgaactcattgcggtggctcacaataggatgatgaaagtgaacagcgacaacggagaatcatcaaagacatggagattctctgggatgaaaaaatggcacgtgaactgggagataaggcacttaaagatacaattcgacaacgaggatgtcgaattcaaacctttgtcagcggactgcaaggttgttcatgagttcataggcggctacatttttctctcaatgcggagtaaagaccaaaaccaaacactggacgaggaagggttccatcgcctgactggaggatggggatagaaaattttatttgtaaaccacaactgccatttcaatttgtcatagtttctcacatttaaacaaaataaaagcgacaatatgcaaa

SEQ ID NO: 750 - DNA, 1383 bp, Heterodera glycines
  genomic DNA sequence=SeqID_461; coding sequence=SeqID_953
tcattatgagcgggatacgtccaaccgagcgtgtacagtgatcgacgagtgccaattcccgcagctgaacgactgccatccgagtgccgagtgcacggaccttgcccagggctacacctgcaagtgccgaagcggcttccgcgacgtgtccccgtccaaggaaaagccgggtcgtgtctgccgggcaatggtcaatgagtgccaatttgcgcatctcaacgactgccatcagaatgcgcaatgtttggacttggaggacggctatcagtgtaagtgtgaaaacggcttcaaagacgttcgaccggaaaggccgggccgactgtgccaacagatggtcaatgaatgcgcacgtgcggacacaaattcatgcgacaaaaatgctaaatgcgtggacgaagagaatggctaccgttgcgagtgcaagtcgggcttcgcggatgtgtcgccaactccgacgctgcccggccgcgcgtgccggcccatcgtcaacgaatgtgcggagtcgaagctgaacgactgcgaccggttggccaaatgtgtggacatggaggacggctaccggtgcgaatgtccggccaactcgcgcgatatttcgccatcgcccgccttcccgggccgcgtgtgccacatattcgagaacgagtgcctgaccgggaagcacgactgcgacccgcaggcacagtgccacgacaacgagcaggcattcacgtgcgagtgcccggagggcttcaccgaccgatcgcccaacaaacagcaccggccgggccgcgtttgtgtgaagctggtcgacgagtgtaaggaagaccatgacacgtgctctccgaatgccgagtgtcgtgacctggaggagggctacacgtgcgagtgccgtgacggctacgtggaccggtcacccaatttggccgtgcaaccgggccgcgtctgcggagcgccggagacatgccccgcaaaccatgactgcagtgcggccgcggtgtgcgaaccgcagggcggcaacaaatacacatgcacgtgcatccagggatacgttgatcagtcccccgatggattgcaaggccgaatttgtgtgcgcaactcattttgccgtgacccgaagctgaacaattgttcccggaaagctgtatgttatgaggaaggccaaggctaccgatgcgaatgtgcccgaggctatgtggacaagtcgccggacggcacgccaaaaggccgagtttgcgaattgccgccggcgccggcacagccccagcgacacccgtgccaagacgggagccacgactgtcacaccaaggcatcctgccgagctgtcggcgccactgggttcgtctgcgaatgtttgcccggctatgaggacaaatcgccggatccgaagaacaaaggcggaagagt

SEQ ID NO: 751 - DNA, 1158 bp, Heterodera glycines
  genomic DNA sequence=SeqID_462; coding sequence=SeqID_970
atgggcatcaaggatttgtcaaaggtcattgcggatcattcgccgttcgccattaaaaccaacgaaatgaaagcgtatttcggacggcgcatcgcaatcgacgcgtcgatgagtctttaccagtttttgatagcaattcggcaggatggtgctcaattgacaacggaggagggagaaactacgagtcatctcaatggcattttttaccgcaccatacgaatgatggacaacggaattcggcccatttatgtcttcgatgggaaaccaccggagcttaagtcaatcgaattggacaagcgaatggaacggagggcggaggcggagaagcagcacttggaggccacagagaggggcgacaaggcggacattgaccggtttggacgtcggctggtcaaagtgaccaaggagcaaagcgacgaatgcaaacatttgctttctctgatgggcgtgccggtggtggaggcgccttgcgaggccgaggcacaatgtgccgaactcgtacgagcgggaaaagcgtacgccactgccaccgaagacatggacgcattgacttttggttcgaaaattctggtccgccacatgacattcagcgaagcgaagaaaatgccaataaaggagttctctttggaacgcgctctgaaggactgggagataagccacgacgaattcgtggatttgtgcattttgctgggctgcgattattgcgcgacaatcaaaggaattggcccgaaaaaggcgttcgaactcatcaaaaagtacaaaagtattgagacaattctcgagagcattgaccaaaagaagtacgcaccacccgacaattggttgtacaaagaagcgcgacaactttttttgcggccggacactacgccaggagaacaattcgaattcacttgggctgagcctaaagtgccggaattggtggactatttgtgtggtcagaagggatttaacgaggatcgcatccgatcggcgcttgaccgactacaaaaaagtcgaaaaatggcacttcaagggcgaattgattccttctttaaaccgcaagggacagcaaataaagcgatcacagaagagacaaaaaagaaacggaaggcggaggaggaagagaagacgacgacgaataagaagaagagcacagtgaagaagacaaagaaaaaatga

SEQ ID NO: 752 - DNA, 1271 bp, Heterodera glycines
  genomic DNA sequence=SeqID_463; coding sequence=SeqID_870
cctttgcccacctgccgcgaagagtttccccaggagcccatcagcctttgcccgtctgtcgggaggagttttccatcttccgcgacccggccaaatccatggtccatctcctttttcacttcgacgcctcgtcgttcagtggctttttgcgccttcgaaccgccaatgatggaaatggacaacgatgggctgatggggcctgcaccgtccgaagacagagcgaacaaatcaaaactgggactgagaacccatgggacgaagaaaagcgcaatcagattctccaaaccgcacatgtgatggtcgaaagtcacgcatttatggaaaagtgtcctcgtttcgagttgaaccgaacaatccatttgggaggtgaatcattctcgattgaagacctgttgggccaaggcggatttgcgcgtgtttacagggccaattcacgtgaagatggttgcacttatgccatcaagtacgaatccccggcttgcccatgggaagtgtacatttgtagcgcactcaaaagacgcattccatcccaattcgctgcttatctaatggaagtgagagacgcgtacattttcaaaaatgccagtgccattgtttacgaatatttcccaaaagggacacttttggatcttaccaatgtctacaaaaagaacggaacggtggtgggcggtcttcttgctacttttttcggcattcatttggcacgtgcgctgcgccaagtccacgagacggccaacataattcacgcggatgtcaagccggacaacgtcatgctgttgacggctgccttgaatgcacatgattcgctggacaatttgctcaaaacccccgtgctgaagctaatcgactgggggcgatccatcgacatgaaccatttccaaggagtcgaatttcacggaaaagcgggcaccgaaaatttcgattgtgtcgaaatgaagacgggcatgccatggactttccagactgatttctacggtttctgtgccacaatgtacgtgatgatgaatggcgaatatctggtgaccttcaaatactcacaaacggacaaagttgttcccgtgaagcagctgaagaggcgcatggctctgtacgacgtgtggacgcagttgttcgatcagttcctgaacattcccaactgcaaacagctgccaaaatggttaaatacattggaccaaatggaaagccgactggccgaggctgtgaaaacggagcctttggagtggaaaagagcgatcgaacggttcaacgaattcgtcaaacaacgggggtga

SEQ ID NO: 753 - DNA, 621 bp, Heterodera glycines
  genomic DNA sequence=SeqID_464; coding sequence=SeqID_834
aatgttaaggattattcagcggccaaagccttgcacatcagtgacacggataaacgcaaatattttcatctcaatgcacattttgggtacgcctgcggcgctttggagttgggcacttttgcgtctcagcgaattaaaattatttcaaaaccatccaagaagaaacagtcaatgaaaagctccgattgtaaatatttatgtgtcgggaacaaaagcaagattgccctgttcaaccgtttgcgttcccaaacagtgtccacccgttatctgcatgttgatgagaatgcgtttgtggccagctcaacaaaatggggcgcatttcacatcaatgttgttgaccagcccgaatttggtggccaacagtcccagcagcagcagcagcagcacacggtcacctacgggtcggtcattcagttggtggacagccaaacggaaatgcgacttccgttgatgcgaattcgcaaggtggacaaacagcacgtgttgttggaccctgctggacagggcgagccggtcagtcagctgcacaaatgcgccttccaaatggttgacgtggccagcaacggggcggagctgttctacctgtgtttgagccaggacaaaatcatccaattccaggca

SEQ ID NO: 754 - DNA, 1840 bp, Heterodera glycines
  genomic DNA sequence=SeqID_465; coding sequence=SeqID_992
atggaccatcaggcgttgattgacgagctgccggaggtggagaaaatgccagcccaacagcgcatcgctttggcccgtgaacgacgtgaacaacaattgcggttgtgtcagcagcgcgaaggacatttgccgcagcccgccccgcgtcggccgcggctgcggttcagttccgacatcgctctgctggagacaaccgtccgtggcgacgcgcaggaagttgagctgatgctgatggatggtgtcaacccaaactcacacaatgaagatggcctgactccccttcaccagtgtgctattgacaataatgaaagaattgtgcgacttttgcttaggttcggcgccgatgtaaacgccaaagacacggagaattggacacctttgcatgccgccgcttgttgtggttacattgaaattgtcagacttttaatcaaacacagtgccgatctgttggcggtcaatgcagacggaaacatgccttatgacatatgtgacgacgaacagactttggatcttattgaatccgaaatggcgggtcagggcatcacccaggaaatgatcgacgaacgacgtcagttgccggagcgggaaatgctcagcgacatgaaactgctccaccagcaaggcattccactggaccaacggatgccggacgaatccacttacctccatattgccgctgccaacggcttttacgacgtcgccgccttcctcttgcgctgcggtgtgtcgcccgcctcgcgggacaaagactcgtggatgccaatccacgcggcagcctcttggaatcagcctgatttgatcgaattgctctgtgaatatggggctgacatcagtgcgaagacgcgcaacggggagacgccgctggacctaacggaggacccgcaaacgcaattagtcattcggaccattgcacagacggaggcacgaaggaagcgaatcggacactttggagtgcgagatagtcgacgacagtcgagaaagcgaaagaaattcgaatcaccgcaagccgtaccgcctgccgcgaacaccgacttcattcagacagcccggggcgcaattcggcgtcagtcattacgcgatcggagtgggatgacacttgcacggcttgattcacaacgtgaagggtccgacttgattaggagttggagcaaggaggatgtgtccaatgaggaaatgtctgcgcatcatttcggcaacgggggaccgtccacctctcaccagccgacagcaaatcagcaaagacgcgactcgccgcctaaaagaatgcagaaacaatcgcagcaaaagcagaagcaaatgtcgccagacgagtggttgaagaagttggaggccgaatcgggcggccttcgagacgaagaggaggagcaggcggagaaagacgtgctgaaagggagcgccggggagagcatgcggaagggagcgaaagcacagaaaggcaacggggtgattaggagagatcagcaacagcagcagcaacacgatatgaacggaatgaatctgaagggatcactcggtggacagaatcggaggcggaagaagagctgttgctgcattatttgatcacgccttcgccttctccccaatcgcttgttgcccctttttcgcattttggtcatcctttgattcgtgattaaatatatacgtaaattgtatcgcctctttctctatttctatccccaaatggtcattcgttcattcagctcacaattcctaccaaatctgcacatttaaagagtatttctatctgggaaatctgttcattgttacttctttgtttgttttatttagacagcgtacattcttttggaatcgttcgtcgacaaattattaacaatttata

SEQ ID NO: 755 - DNA, 620 bp, Heterodera glycines
  genomic DNA sequence=SeqID_466; coding sequence=SeqID_905
tttagccaagttttaaacaatgccaatcaaagcatccggagaaactttaagaaagtacatcgttgttggacgtaaactcccaactgcaaatgactcaaatccgacactgcatgaaatggttatttttgccagcaaccacgtcgttgctaagtcccgcttctggtacttcactagcatgttgcgtcgtgttaaaaaaacacacggagaaattatttcatgtcaagaggtcttcgagaaaaagcctggctccgtgaagaactttggcatttggctccgctacgattctcgtactggacaccacaacatgtaccgcgagtatcgcgatgtttgtgaagcgggtgctgttacgcagtgctatcgcgacatgggcgctcgtcaccgcgctcaagcggatcgcattcagatcatcaaagtgcaaaccatcagtgtggcggactgcaagcgtgccggggtgaagcaatttcagaactccaagatcaaatttccgcttcctcaccgtgtgaattccaagcgacgcaatatgactcctttcacgacacagcgtccgagaactcattttgtgtagagaaagaaatgagacgacttgtatttccgatttgttgattaaagttgttgtgtta

SEQ ID NO: 756 - DNA, 521 bp, Heterodera glycines
  genomic DNA sequence=SeqID_467; coding sequence=SeqID_1015
ttattgactctgaacattattgtttgtcatcgaaaaagacaaatggcgattagcaagggcactaaaattacgccaaaaggtggtaagggcggcaaaggaaagaagaagaagcttacgctaaagtttgtgatcgaatgcaaaaacccagtggaggatggcatcatgaagactgccacatttgaaacctttcttaacgaacggatcaaagtcggcggaaaaaccaatcaactggcggctaatggtgtcaaagttgaagccacgaagacaaaactggtcgttacatcggagcagccattctccaagcgttacttgaaatatctgacgaagaaatttctgaagcgcaatgctctccgggattggttgcgcgtggtagccagtgccaaggacacttatgagcttcggtacttccaaatcaatcaggaagatgaagatgaaagcgacaatgaagcatgagcgatttgccatttcttttgttgggtcgtattatttgttgcactttttaccagcgataaaaacttgtt

SEQ ID NO: 757 - DNA, 774 bp, Heterodera glycines
  genomic DNA sequence=SeqID_501; coding sequence=SeqID_1014
atggccgcgacttctcttcaacaacagctcaagaggcttaaatcggcacccaccggggctttggcggttgagcgtgattattcttcgcttcttttcaccaaaaaagcggcggctgctttagaccgagacgagttttacaaaattggacttgctgggctctctggcatgaaaaaaattgacaatgcattcgacacttatgcgccagaattgttttggaaggacaagaaacggttcaatagagcgatgctccagaaggatgaggcggagcagttcgaccggcggattgagacatttttgctccgtctcgccgcccatttccatcaccagtgctgtcggcaggtgctcgaatggctcatccataactatcaggttctcgacattcacacatacaatgccgaggcgcttctgctcgcttttctgccttatcacagcgtcaattccttcggtcggctcctccacattctcaaattcaactccactgcttgggattggctgacggaatatcaaagggacgcagcacctattccgatgaatattttatgcagagcatgtcaagtcggtcgttcctatggactcgtttccacactgtcgaacttcgtccaaatggcaattgagcagcttgggtccacatatgccaatgacaaaatgcaaaattattttacttttttggtgtctttgttcggcattttgattgaaaactcgacagctgacggaactgttgatgaccaactccttgccagattgatgccgtttttaagcgttgcattgaagtga

SEQ ID NO: 758 - DNA, 925 bp, Heterodera glycines
  genomic DNA sequence=SeqID_468; coding sequence=SeqID_929
aggcaaagtttagttcatcttgtcatggcaaatcgcacagctcgagacgcacataccataaaaggcacaaatcctcaatatttaattgaaaagatcatccggactcgcatctacgattctctttactggaaggaacagtgttttggactctcagctgaaacagtcgtcgaccgtgccactgaattgcgttacattggtggaatatatgctgggaacataaagccggctcagtttctctgtcttacactcaaattgctccaattgcaacccgacaaagacataataattgaatttataagacaagacgacttcaagtatgtccgtgctttgggtgccatgtatatccgtttggtatttaattccgtcgaagtcttcaaatacttggaaccgctgtacaacgattaccgaaaactgcgttacatgaacagaatgggaaaattcgagttgctatacatggatgaatttgtcgacaatttgttaagagaagaccattattgtgatatacagctgcctcgtctacagaaacggcaagcactcgaagaaaaggaccaactcgagttgtacgcttccgccttggacgaagacttagagcgtctttccaccgactccgaagatgagcaggagacgcggaaagcacggccaaatatcgtttctcggcgccgaagtcgctcgcgcagccgtggccgaagtcggagcaaatcgagagaacggagacgccgatcactttccacggatggtatcaaatcaaccctaaggacaaattgccagttggatttagaccgtcggggaggacgaagtgccgcgaaagacaccgaaagagaaattgaggagaataacgcactgagaaagaaattgggattggcaccattggagcgttaaattgtttatttattcaatcatcaaaaatttgattataaatattaaa

SEQ ID NO: 759 - DNA, 786 bp, Heterodera glycines
  genomic DNA sequence=SeqID_366; coding sequence=SeqID_971
tcgatttccaaatttggaaaaagtaaatttaaaaatggtcgcactccgtgcccaatttgaggcgagcaatgatgtcggagttttctgtaaactcaccaatgcttattgtctggtgggcattgcttcttccgaaaatttttacagtattgtggaggctgagttggccgacgtcatcccggtcatccattgcacagttgcgggctgtcggattgttggccgtgtgacggccggtaatcggcacggactgttggtgccgaacgcgaccacggaccaggaattgcagcacatccgcaacagtttgcctgactcggtccaaattcggagggttgacgaacggttgtcagcgctgggcaatgtaattgcatgcaatgaccacatcgctgttgtccacgcggacataagcaaggaaacggaggcggcgctggccgaagtgctcaaagtggaagtgttccggctcagtctcggcgaaaatgcattggtgggctcttacgcggcgatgacctcaaacggtgcgttggtggcggcaaagacaccgccggaggtgcagcgcgagttcgcctcgctcgcccaagtgccggtggtcgccgggacggtcaaccgcggctcggaactgatcggtgccggctgttgcgtcaacgattggatcgcattcacaggcctcgacacgacttccgccgaactgtccgtgttggagtccatcttcaaattgggagacgcggcaccgagcgcaatttccaccgatttgcgcgacactttgatagaatcgatgctttgaatgacaaattt

SEQ ID NO: 760 - DNA, 392 bp, Heterodera glycines
  genomic DNA sequence=SeqID_469; coding sequence=SeqID_886
aatcgtgtcgccaaaatagacgtggttccatcggccgcttctctgatcatcaaagaactgcgtgaaccgccaagggaccgcaagaaagtcaagaacgtgaagcacagcggcaacctgaccattgaacaagtgatcaacatcgctcgtcagatgcgcccccgttcaatcgcacgaaaattgcaaggcaccgtcaaggaaattttgggcaccgctcaatcggttggctgtaccgtcgatggacaacaccctcacgacattgtggacatgatcagggcgggagagattgaagtgccagaagaatgaacggaccgttgatacgctgagaaagtttggagaaagaatcaaatttgttgttgtgttttggacttttccgttaaatttgatttatttta

SEQ ID NO: 761 - DNA, 491 bp, Heterodera glycines
  genomic DNA sequence=SeqID_470; coding sequence=SeqID_964
atgacgacaacaaaagaagggagcatcaaacgcgagcagttttatgtgcgctattatgttggccacaaaggaaagttcggtcatgaatttctcgagttcgaatttcgcccggacggcaagttgcgctacgcgaacaattccaattacaaaaacgacactttgatccgaaaggaatgctatgtgggcaagtcggttatggacgaattgaagcgtatcattgaagattctgagattatgaatgaggatgatgccaattggcccgaacctgaccgagttggacgtcaggaactcgaaatattgagcgggaatgaccacgtgtcattcactaccagcaaaatcggttgtctcgtcgaagtgaacgacagcaaagatccggtgggactgcgctcgttttactatttggtccaggacttgaagtgtttggtgttctcactcatcggactgcacttcaaaatacgaccaattgcgcaatgatggactaattggtgacg

SEQ ID NO: 762 - DNA, 494 bp, Heterodera glycines
  genomic DNA sequence=SeqID_471; coding sequence=SeqID_902
caacgcttgcacgaatttatggaaggattccgagagattgcgacagaattgcggatcacttatcagatgatcaccatccaaggagatgtatcacttggtaacgttcctccttttatttatttttttactgtttttcatccagaattggttgattcgcttgatccattcgccgaaggcattgccttcaatgttcgtccccccaaaaagtcatggaagcagatcaccaacctttcgggtggtgagaagaccctcgcctctctttcactggtgttcggtttgcacaagtataaaccgactccattatacgtaatggacgaaattgacgcggctttggacttccgaaacgtttccatcatcgccaattatcttctggagcgtactcggaatgcccagtttattgtgatttcattgcgcaatcaaatgtacgaaaaggccaaccgactgatcggcatttacaaagtgcgtgactgcactaagaatgtggtcgtcaatcc

SEQ ID NO: 763 - DNA, 469 bp, Heterodera glycines
  genomic DNA sequence=SeqID_367; coding sequence=SeqID_1012
tccttgcattgatgttggcaatcttttactcattgatgttgagacggacgccgaaggtttggccagtagcaactcagaacggattaacgaacttacaagcaaaaatgcccagcttttgttcaatgaaatatggaaattacccagaaaaattgtgcaagatgcgacttgttctcagcttcccgaatacacttatggccttcctcgtgaaaaacccattccaaaaccgaaagaaccaacgaaatgggagaagttcgcgagggctaaagggataacaaagaagaaagacaggaaagtctgggacaaaacgactcaggaatggaagccgaaatacggatacagacgagccgagaaccaatcgaaggaatggctcattgaaattcccgaccaaaaagcccatacaaagattattttgctgagaaggcggaggaaaagcgggaaaagaataacaagcaggagttgcaacggctga

SEQ ID NO: 764 - DNA, 1191 bp, Heterodera glycines
  genomic DNA sequence=SeqID_340; coding sequence=SeqID_994
ggcactgcgagttattacgcgtcgttgtcaatccgtgcgagggacccggacgcaagagttttgatcataacggacgagcatgaaacaccgtacaaaagaggaccattgtccaaagagctttggtggtttgccgatgaggcgagcattgactcgctgtcccacacaaatccgacgagtagcaccggacggaggcgttacgctttttacgaggcggacggcttttacctgccaccggacaagcttgatgagtgggaacatggcggagttgggctaatacgtggcgcaaaggtcgtcaaggtggacaccgagggaagctttgtgctgttggaagatggacggaagatcgaattcggcaaatgccttatcgcgacagggagtgacgcgtggttgcacacacagcttgaacaccttcctgaactggatgactttgtcacaacacttggaaaggcttccgactttcggaaaatttattccaaagttgacaaaatggctgtcgctgaaaacggcacacaaaatgttattgttgttttgggaggcggtcttttgggcacggaattggcctactcgctgaaccgacggtacgctcgtgaccaggaaaaccctgcgctgaaaattgtgcagctgtgccaagaacccggaattttatccgaaattctgcccgatgctctgagcgattattcaacggatatgctaagataccaaggaattgaagtgctgacggacactcgcattgattcggcatcggttaagggaagggatgagaaaaggcgccgaatttgtctcaacacaactgcagcaacgacaagcgacggtccgaaggaaaggaagcaagttatggccgactttgtaatcattgcgttgggcgccgaaccgaacatcgaattggtggacgaaaagagcagcattaaactggacaaagcgaacggtggcgttatgactgatgagcatttgcgtgtctgtgacaatgtgtgggccgctggcgatgtctgttctttcgtagacccagttctaaaaaggcgacgtcgctgtacccattggcaacacgcacaaatcacgggacggattgccggagaaaatatgacggatggacacaaaacgtacacccatcaggtgattgatacttttggtataagggagcgttcgtctcaatgttcggcccatatgctcatgtctgtggagttggcgacgtaa

SEQ ID NO: 765 - DNA, 624 bp, Heterodera glycines
  genomic DNA sequence=SeqID_472; coding sequence=SeqID_1024
ttcgcaatcaacgtcacttgcccaagaggggcaaaggcgagcggcggatgcatcagagagaggggcggcagcggaaattgggtggtttacacaagcgcattcggatggaagccgagtggcgagcagcggacgcaaattgcgaaggatccgccgcgactcgtccacggagacatcattttggccaaactcaggccgggccaggagatcgaggcgagttgtcattgtgtcaaaggaattggcagagaccacgccaaattttcacccgtcgccaccgcaacgtacagactgctgcctcagatcaaactgaaaaaggacaactttgatgaggagcaggcggcacgactccagtcaagtttttccactggcgtaattggaagggacgaacagacggggagagtttatgtgcgggatgctcgcgctgacacttcgagtcgcaacgtgttcatacacgacgacctgaaagatgcggtggaaatgggcaaaaagaaaacacatttcatttttagcgttgaatcggtcggcgcattgccttctcacaaattggtcattgaagcgtgcaaagtgatgagggaaaaggtggaccatctgagagagcaaatcagctcaagattagaaatgctatga

SEQ ID NO: 766 - DNA, 915 bp, Heterodera glycines
  genomic DNA sequence=SeqID_473; coding sequence=SeqID_867
cgaatttggcgcaataccaaaatccgaagtgactttcgacacgtaatgaatgcggtcgaagaggcgaagaagcgaaaggcggcggaagtgcttcgattaccgaaaagcaacagagaagcaattgcagcagtcgtaagcaatgaaagtgaggaaagcaaaatatcagaaaaagctgcattatttatcacagctggcgatggtgctgattttaccggcaatttaatggtcgccactgttccttcaaagcctcaacaagacaatgcgaatttgcgcgctttacttccttcccgtgccaatttgataaccaagccaaaatggcatgcgccgtggaagctgtacagagtcatctctgggcacacgggatgggtgcgggcggtggacgtggagccgaacaacgaatggttcgccagcggaggagccgatcgcatcatcaagatttgggacttggcaagcggacatttgaaattgtcgttgaccggacacattagtgccgtgagggcagtcaaagtgtcaccacgtcatccgtatctgttcagtgcgggcgaggataaacaggtcaaatgttgggacttggagtacaacaaagtgatacgccattaccacgggcatctgagcgcagtgcaagacttggcacttcacccgacgctggacattttggtaacgtgcgcacgcgactcgacggcgagggtatgggacatgcgaacgaaggctcaaattttctgtttgtccggccactcggacactgttgcgtcggtgatttgccaaggtgtgaatccgcaagtggtcactggaagtcatgactcgaccattcgcctgtgggacttggccaccgggcgcagcatgtgcacgttgaccaaccacaaacaaactgtcagcggccgggaaatacatatgagttataatacctttagatag

SEQ ID NO: 767 - DNA, 866 bp, Heterodera glycines
  genomic DNA sequence=SeqID_474; coding sequence=SeqID_1017
acgaagcaacaaaatatggccatttttgttacgaggacgacaaagaggaagacgaagacccgttcagtttcggcaaaatgatttcggcacaaaagaagggcagcgaggacgacagtgattgacggttgaatatttttgctattgtgctaaaatccatttttgtcagtgcttttacatggtttggtgtttgtttaattaatgcaaatttaaattcgaggcaaaatttcataaatcacattttaattgtttcactgtcttgtccaaaaatttttttgttttgtcttttctgaaaaacaatcacttactctccgccatttcattttcgcaaaacgaacgaataaatcacacatttaacaaaacgtgctcattattttgtttgtaacaatttgtattttcatttgctgattattcaataaaattccatttcattttttcggccttcttgaatatgaatactcctgctgcctatgagccgtttctgttggctgatggagagaaaaaggtggtcattgagaaggacacaaaagtgccgaatgcggcggtgtttacttttaacaaggaggaccacaccctcggaaacctcctcaaacatcagctcctcaaagatccgaaagtgctttttgccggctaccgaaacccccaccccttggaacacaaaattttgctccgtgtccaaacaaatcccgaaacaacgccaatggaagcattgaacaatgccattgaggatttggtggcggagttttcattattggaagagcgatttcgagacgcgataagggaaaaacgagaagaatgagaaattgttcttgtttacggaactgattattttattttatttttcaataaataaataaaagtaaaacaaa

SEQ ID NO: 768 - DNA, 1401 bp, Heterodera glycines
  genomic DNA sequence=SeqID_368; coding sequence=SeqID_890
ggccgaatgctgcacatattcgccggcgaagagaagagagtgcggacgaacggtgcagacgacgacagcacaaacgacggatgccaaagtgcgttccaacgcgaacggaacgaaaaacgcaaggcgaacgacgcggaaggggcgacagaggcggcgacaaacaatcgttgcacttggaacgcgctgtttcttggcactgacgcggtggcggagacattagcggaaaattatgaagtggagaagcgcgatttgctgctggttgacggcaaacagcagaacagtgccgcggtgcgcgtggcaatggccgaggcgcgtttggtgcgcgagacgcgcaaattcctgcttgacaacggcgttcggttggacgcgttcgcccagcggtggcaccttttgagcaatggtggcgacaacgtcgacggcactgaggacggaaccgcaaaaatgagacgttcaaagacgacaattttggtcaaaaatttagacgccacgagggaagggaaaaaggaatggctgcactctctgtttggacgctttggggtcgttaagacggtgctggtgccaccagtgcacggaatcactgcgatcgttgagatggcaaatgcccgtgacgcgaagtgcgcctttgaggcgttggcctactcgaagaaacacactccgagcgggggacgaccgctgtttttggaatgggcgccgtccaacgtttttgacgaggcgcaccccctcagagcaattggacattacggctatcagcaaaagggtcaaactgccgtcctttctgatgacccatcatcagttgggcatcagtccccggcggagacgaaaatggaaaaaacagacagagagagagggggagaagaggaaggcaaattggaggagaaaccgaagaaagaggagaaggaggacgagaagcacaccaaaatactcgtcagaaacgtgcctttccaggcgaatctcaaggagcttacgcagctgttttccgcatttggtgaactcaacttcatccgattaccaaaaaagcctggctccgaaggccaccgcggcttttgtttcgccgaatttctctccgtgagcgacgcgcaccgcgccatggacgcgctggtgcattccacgcatttgtacggtcgacggttggtgttggagtgggccaaaccgagcgaagaaagcgcggaggagaagcgacagcgaacgcaggacagaatggcaatggccgcgggcgttgccggggcgaagaaaaggccgaagatgcgatcattttagagccagtttcaagaattggcactttttaaccgttaattacattaaaatggtccgtccaccttgcgaaaaaatgttgttactgttatcttttggtcatttgtttttataacaatttacacacaaaaagagatcatcaccaattta

SEQ ID NO: 769 - DNA, 759 bp, Heterodera glycines
  genomic DNA sequence=SeqID_369; coding sequence=SeqID_984
aggaggacaacctgttcgagcagttcatcctgtccactcaaattagctactgttactatgccgactcgcatcgcattctgggcaacacctttggcatggctcgtgctgcaagactttgaggcacttacgcccaaccttttggcccgaactgtcgaaacggtggagggcggtggcctcgtcgtgctgctcatccaatcggtcacctcactgaaacagttgttcaccatgagcatggacgtgcacaaacgctaccggacggaggcgcacgcggacgttgtcgggcggttcaacgaacgcttcatcctttcgttggccagctgtgccaactgtgtggtgatggacgactgtctgaacgtgttgcccatttcctcctccgtcctcaacatggccaatttgccgcccgtcgtcgcccagcaaaaaagtgccgcgggcggcgatgtgtcgtcggagttggcacggctccaacagtcgctggccgacacaaaacccatcggcccgttgctgcaccggtgccgcacactgtgccaggccaaggcgctgctccgcctactcgacctggtcaccgacaaaatgtccaactcaatgtgcgcaatcaccgcggcgcgtgggcgcggcaaatcagcggccatgggcctggcggttgcgggcgcggtcggctgcaatttgacgaatatttttgtgacgagtccaacaccggagaatgtgcgcacactgttcgaatttgtgttgcgcggctttgacgccatcggataccaagtg

SEQ ID NO: 770 - DNA, 1323 bp, Heterodera glycines
  genomic DNA sequence=SeqID_475; coding sequence=SeqID_878
atgtccaatttgcccgtttcttctctgattcgtcaacagcacggcggtggtttaggagaggaagatggtatagaaagtgggaaaagaaagtccaaggatgagtacagacgacaaaaggacttggaggagcagcgaaaagccggcacggcgccggcgatggtcgacgtggagacggggagagacataaatccgcacattcccgagttcatcgagaaaacgccctggtatgtgccatcttcaggacccacgctcaagcaccagcggccacatcctgaacgccaaaaacagatgtcatcggttgctgaatggtaccctaagggcactaccgaacgcgtggcattcaaataccgtgacggggcttgtcaaaattgcggtgctttgggacataacagaaaaaattgctttgagaagcctcgattagtcggtgctaaatttacgaactcaaacattgctccggatgaccatgttctgccatccctcgaaatgggatacgacgcgaaaagggaccgatggaacgggtacaacgcggaggattattcattggtggcagctgagtttgaaaaaatggaggaaacgcggaaattgatcagagcggaacagctcaaagaggccggtgaggaggacaaaaaggcggaggaggacgaggacatttacgcggaagacgcgtcggcccccggacagtccgtggacatggactcgcggacgcgaataacagtgcgaaacctgcgcattcgggaggacaccgccaaatatttgtacagtttggacccgaatggagcatattacgaccctaagagcagatcaatgcgagaaaacccttataagaatgttcctgggaaagaggaggaagcggccaaattttctggagaaaatttcgttcgtttcactggcgaagtggcggatgccaatgacgcgcaagtgttcgcatggcaggcgaggtgcaaaggcatcgacgtacactctttggcggaaccgacgcggttggaggcattgaaacgcgaatttgagaagcaaaagggtgcgagaaaggaatcagtgaaaaatgaattgttggagaaatacggcggagaagaacatttggacattttgccacgggaattgttattggcacagaccgaaaaatatgtggagtacaaccgaaaaggaaaagtggtgagaggggacgacagaccgacgatgaaaagccgatacgaagaggacaattatataaacaatcatttgactgtttggggctcttactggcgcgaggggcggtgggggtacgcgtgctgccaccaatttttgaaaaattcgtattgcatcggggaaagcggaattatcgcg

SEQ ID NO: 771 - DNA, 906 bp, Heterodera glycines
  genomic DNA sequence=SeqID_476; coding sequence=SeqID_848
atgttagtgttatttgaaacttctgccggttacgctcttttccggctcgatgatgaaagcattcttcaaaaagtggacgacatttggaaggaattttcaagtggcgataataaagcgcttcaattggtttccttcaaaaagtacaaaacggtcgctgaagctgtgtcaaatgcaacggccttaaatgaaggaaagttggacaaaacattgaaacgcttcctgaaaaaaagcatcatcgatcaaactgagaaattggcggtggacgacacacaaattggcaaaatcattaagaattcgttggatatcaaatgcttacacaatagcgcagtttccgaattgatgcgctcaatccgtgcaaatgtcagcagtttcttgggcgaagaaacagcacatgaaatgaatgcgatgcgattgggtgtcgcccattccatcggccgttacaaagtgaaatttaaccccgagaaaattgacacgatgatcgtccaggctgtttctcttttggatgatttggacaaagaattgaacaattatgtgatgcgttgtcgtgaatggtatgggtggcattttccggagctgggaaagctaattgcggatgctcaagcgtatgcgaagtgcgtgaaagcaattggaatgaaagcgaatgcgcaaaacgccgatttaagcgccattttgcccgaagaattggccgaaaaagtgcgacaggaggccgaaatcagcatgggaacggacatttccgagctggatttgatacacattgtcgagctgtgtgaccagatcgtagaattggcacaatatcgcgcacaattacacgattatttgaagaaccgaatgaatgcacttgcgccaaatctcacagttttgcttggagaattgatcggtgcgcgtcttgtttccaaagcaggttag

SEQ ID NO: 772 - DNA, 6135 bp, Heterodera glycines
  genomic DNA sequence=SeqID_370; coding sequence=SeqID_1026
actgcaaaatgcggcagcggggcgtcgtcggaggccagacaaaatgcgttgtccacgcggcgattgttatgccttagcgagtcgtgcatcatagagagagacccgatcagttacgctgtcatttgtgccagatcactccgaacgattgtttgccttgtccgtgatattaatgacccgcaaaaattcaccattgtttacgaatgtggcgttgagcggacattcagttccaatgaacgggattctatgctggctgcccttttggatggaattcgtggttccggcaattaccaagtccatctcatctcaagccaaaggcatttccgtgcaatgcgaatgcttcaattcggacaaagtttggacgaagattcggaggttcttctgctcaaacatatcatcaatgtgccggctggtctaaaacgtattgacatggttcgacgtttcaatgccaatattccttataatggtctgtatcactcgacccaatctgaggggtttttcaccgacaacaaatcaaagacaattgttgcctgtttggacgctgtcttatctgaacaaattgtcgtagacactaccgaaccgatcattcgcattgaggcccaattggcttgccttcacagactcttcgcctcaaaaacaggctttcaagcattcactacggttgacgggatccgcgagaagctcggttcgctggtcatttcggtgctgaagcggcgctgcgaagcgattgaccatgccacggttgagctgttatgtgcactgatgcagccaatgcatgccaacttcgacttgcgcatcgagcagctgaacaaacaatcacttctctccagccgtgccttcgttgaacatttgcttcaacttgtggtggaacacgtggcaagggggactggtgcgttggtcatcgcctcgatgttggactttctcacattcaccgtatgcgccccgtacagtgagacaaccccgggcgatacgttcgattcgattttggcgatggtcgcacagcggggacgaaccttttacaaacttttccagcatccgtctatgaccattgtgaagggggcggggatggtcatgcgagcgatcatcgaagagtcgggcagagatatcagtcgtcaaatgcaacttttggccctcaccgaaggagcctttctcaaacatttggagttggcccttctttccactggcaaagaccttcgcgttcttaccaacaaacaactcagcggctatttggtggcactttggattgcggaaaaccaagcagcgaaggatttgctgcaacgatgcttgccccgagggctcattgattatttggattcgaatgagcatgtgcctgcctctgcggtggccgaggaacgtgacttgctgactattcgcaataatttggaaatggccaacaattcggagagagagcgtccgtttgcacagcttcaggatcaattcagagtgacgctggaggcaaggctcgactcgttgctgcaacattggaatttggaacagaagctcaactttttacagagcaatcgaattcgtgaggaacaccagcagcagaaaatccagcaaaggccagtcgtgcttcgcaagcgaaggcgactggtcaaagcgactgcaaattggaagttgttttgctatcaatttggccaaaatcacgcccgtgccgatttaatttggaacgaaaagactcgggatgaattccgacaatcaattgagaatgagtggcgccaattgcagcaggaattagaatttattcaacccggaactaccgtatcatggaaccactcggaatttacggtaacttatgactcactattggacgaaattcgaattggtgattattatcttcgctttttattgaccgaagagaacagttcgaacagtgcaacgcccatccatcgccccgaggactttttcaataaaatctaccatcgttttttactttctcaacgtaccgaaatgcgatgcatttgccttcgagcgatggcacttgtctacgaaaggcattgcattagcattggaccgttcgctgacactcgacacattgtggaaatgttggccaaatgcacaaatgttgctgaaagggaccacttcttgttccttattaacaagctttcacttgacaaacaaaatgtacgcgaattgatctccgccaattcgatctcacttttcatcgacattgcagtcttggcccatcttcataccaaccgagcaaaacttcacggccaaacaaatgtgattgaggcaaccaaagatgcggcacattgtgaggagactgagccaaaagaatggtattacaacgaccggcagggccaacgccagggaccgatttcgttcaaaagaatgaagcgtttataccgtgacggtgtgctttttgagaagagtgaaatttgggcagaaggattggacaaatggtgccatttgtcgtcagtttcccaatttcggtggacagtttgttgtgtcggcaatgcaaaactttcatcaattggggacgaagccgtaacagaaggaagggacgatgaaccaacgacactgccgatgggcctttacaacctcactgacctatgctcattgatcctcgacactctcatccaaatgtgcactttcttcccatccagagatgagacagacgctgtcattcgtccaatgcctcgaatcaaaaaagtgctttctgaacccgtgttgctgtaccaattggtgcagttgttgcttacttacgacccgtccattgtgcaacgagttgcaactttggtcaacgatgtcatgcaggacaacccttacatttcgagactgtatttgtcgggcatatttttctttatcttgatgtacaatgggtccaacattttgccggttgctcgcttcctcaaagacactcatttgagacaagcattccgttcaactctttccaagtcggagctcgcctcccgttcggtgctttgcccaatgttgccagaagcaaatattttctacctcgaggaatatggagcggaaaaatatgccgaagtttttctgggagagtttgagaatcccgaatgtatttggaatagtgaaatgcgacggaatatgatcgaaaagattgctcttcatgtgtccgatttttcgtccagactttcttcaaatgttaaggcactttacagatattgtcctattcctcccattgattatccacaactaaaagaagagctgttctgccatttctattaccttcgccatttgactgataatcaccgctttccgaattggcctattcgcgagcctgtcgattttttgcgggcctgtctctccgcctggcatgatgaaatcacgcgcaaaccggcgaaaatgtctgttgagcaggcttgtgaacgcctggggctgtccacgacggattccactggcgggtggaaagacgcatcggcagtgcgccgagcctacttcaaattagcacaaaagtatcacccggacaaaaacccggatggtcgggaacagtttgagcagatcaactacgcctacgaattcctcacatcgacgctggtcagagccaattcctcgtcaacgccagacatgaatcgcatagtgatcatcattcgtgcacaaagcattgtatacaagaggaacttacaagtgctttcgccatacaaatatgccgggtatacccaacttatcaaaaccatcgatctcgagtcgtccgacgacacattgtttgctcgaaccaaggaggacggtggtcaattgctggttgctgccgttgagttatgccattggacgctaaggagttcgtcattgaatgcggagcagttgcgacgggacggagggttagatgctctgtacaaaacatttgagcggtgtgttccgatgattactgctggttcactcgaaagcgaaatgccagtgcaagtttgtactcacgtgtgcaattgttttgccaccgctgcccgttttgatgcgtgccgtgaaaaaattgcagaaatgaaaacgttgttccaaagcatttgccaactgcttagattcgaatctctccatcggttggcttgcgctgcggcggagtgcgtttgtgccttttcagtgtgcacattgttacagacgcaactgtttcaagcgggtgtcatttggcaactcttacctcatctttttcgcttcgattacacgttggacgaaggaggggttgcccattccgagaagacgaaccaccaagcggtacttaaccgactggcccgcaactgttgtgaagcgcttgcctgtttggccggctttcgtccggacacgccggacaatgatggagtacaaaaaagtttgcgtgccatgctaacgccattcatttgccgtcaaatgcaattgtgccgtaatgattttgtgttgaaattactcaacgcaaacaccgaagacccctatctgatttgggacaactccactcgtgctgaactgctcgattttgtggacaaacaaagaaactcacacgagaacgtatttagcgaaatgtttggtgccgaattcaaactgagtatttacgcaacagaattggtggttggcgaaatattcgtgcgtatttacaacgctcaaccggaattcagactgctggaaccaaaacggacgtgcatggactttttggactatctatctaaacatgtggaggaactccttatcggtgaaggcgtcgttcgacctgcggcagtgaagcagaaaccgattaccattggcaccgttaatctaaacggtgcttccgggggtcgctttcctctccaggaacgggttcggatggtgctcgaggcgttgcgtaatgtgctgatgatgaatccaggcattgaattgctgttaattggccacttttccgccatttttgcttttcttcgtgttcattcgctatcagccatccaactgaaggcattgcaaatcatttcgatcgcggccaacaacaaagagtgcgtcagcgacatcgcctgctccattcagctgccacttctgctcactcttctttctaagcttcacaaagcaaccgaagtaattctacgaactctgattgcgttggttatcaatgggacggtggtgaaagatctgttggagtatggtggactcatttatgtcctttgtacatttaccgaatctaatttaacacaaaatggccgaatattatccgctgaactgcttgccaaactccaagcagataaattgactgggccaaaatgggcacgatgtatggcccgctttttgccaagtacctttgccgatgcgttgagagacaatcctggacaagcgattcaaatgtttgatacaaatactgaaaatcccgagctaatttggaacgacactatgcgagatggggttcggcaaattcttcgccgaagtttggacgaactcatcaatgcccagcagaaagacccaaatgccaagtggaattcctccatcattggtgagaatcggtgcgcttttgaggaagtgattagcggagaattgatagtcggtggcattttcttgcgcttattcatcgctaacccttcgtgggcggttcgccacccgcgtcaatttgctacggaattgatagagcgcttgttggaactttggcaattgccccatcaaaagttggaccaggtcagcaaggcactgattctgctggcagcacaccatccgacgaccactgacatgatccctgcacaaggatatctgccacaattttgtcaagcgatgcaatcgaccctcagtgatgatgtggcgcgatctgctctcagagtgcttaaccaactctcagaaaatttgaattgtgcttctgcgttcgctgctgtcccctctcttccaaaagggcttttggtttgcatgcgaatgcagcccgagttggcccgggagtcggcccatgcactcaaaatgctctctcaaagatgtactcctgaaatggcggaacaaatgttgttgagcggaatggtcgatcacttgttgaaaatgttgggcagttcgttaccaggagtaaataatccgtccgctgcaaaagctgaaattgccgacgcactcaaagcttgctcaagagacgcacactttggtgaacgtatcacgcaattgctacaaaaatcgcaaatctgggcacagtaccgagaccaacggcacgacttgtttttgcctaccatcactcaaacacaagccataacggcggtggctcctcttctgttgccgggtatttga

SEQ ID NO: 773 - DNA, 963 bp, Heterodera glycines
  genomic DNA sequence=SeqID_371; coding sequence=SeqID_913
ttaattccttgaagctattaattcgatgtctcaagcggatgccggacgtatcattcacattgggaagcggcgagagcgtgccaaagaggacattgagagccaacgacaaaggcttgaggaagagcggcgaaatttggcggcgagcatcaaagcgaaattcactacaaatattgacgaacaagaagagaaattcaaagaacgaacggttggattggtaacacttgacgaagtgaaggagagacagaacgaaatattttacagtgggccatctttaaaattttcaaacgaagaccgacccaaatttgagaaagccattcaaaaaagagtgctttcgtttggcgcttttgacgacgacgacgacgaggaggacgaggcactgattccaatcaccaaaaagagacacggaatggacccaacggtggacacttcttttctgcctgaccgcgaaagggacgaacaattgcaacgtgagcgcgaacggatcgctaaagaatggcaagaaatgcaggagagggaaaagaatgaggagataaccgtggcattttgctattgggacgggtccagccatcggaaggactcaaaaacaaagaaagggacgacaattgctcaatttctgcagaaggcattggacacatttcgcaaagaattcctcgaattgaaattggcaacagtggataatctgatgttcgtgaaggaggacttaatcatcccgcacttttacacttttcaagacttcatcaaaacgcgtcaaatgggcaaaacgggtccgctgtggcagttcgaagctgttggcgaaattcgcgtgcggcaagatgccgcgttggacattggcgaatcgcacccggtgaaggtcattttgcgcagttggtatgagaaaaacaagcacatttacccggcttcgcgttgggagccatttgtgccggggaaagtgtacaaacggacaattgacgacttatccacgat

SEQ ID NO: 774 - DNA, 1478 bp, Heterodera glycines
  genomic DNA sequence=SeqID_477; coding sequence=SeqID_833
ttagttcttccaactttttatttgaatggcttcttccgaaggtgaagccgatcacaatgttgagctctggaaaatcaagcgtcttataaagtcacttgaaatggccaaaggaaatggtacttcgatgatttccctgatcattccgccaagagaccaaattgctcgtatccagaaaatgcttggagacgaatttggaacagcgtccaacataaagtcgcgagtcaacagactctctgttttgggggcaatcacttcagtccaggcgaggttaaagctttatacaagagtgcccgagaatggattggttgtttattgtggaacgattgtcacagaggacggaaaggaaaagaaagtgaacatcgattttgaacccttcaaagcagtgaacacatcactttatctatgcgacaacaaattccacactgaagcattgaatggcctactcgctgacgacaacaaattcgggtttattgtgatggacggaaacggatcactttttgggactttgcaaggaaatgccagggaggtgctacacaaattctctgtcgaattacctaagaagcatggaaggggagggcaatctgcactgcgatttgcaaggttgcgcatggaaaagcgacacaattacgtcagaaaagtggcggagacggccgttgaaatgttcatcaaaaacgacaaagtcgcggtggtgggcctcgtcctggccggaagtgctgattttaagaatgaactcgcccagtccgacatgtttgaccaacgattacaggcaaaaataatcaaaactgtcgacatatcatacggcggtgaaaacgggttcaaccaagcgatagatttggcagccgatgctttggcggatgttaaattcatcaaggagaagaaactgatcagcgcctttttcgacgagatttcccaagacactaacaaggcaatttacggggtaaaagaaacactgacagcattggaaatgggcgccatcgaaactctgatttgttgggagaatttggatctgataagatacgcattccgaacaaccaatggtgaaaaagtcgttaatctgaagcccgacgagaaggaccggtcgaactttgtggacccggagactggaactgactacgagattgagtccagcacgccattattggaatggctcgctaacaattacaaacgattcggtgcggcacttgaaattgtcaccgacaaatcgcaggaaggagcgcagtttgtacgcggttttggaggacttggaggtgtccttcgttattcggtggacattccgcagttggatgagctcgagaacggagtagacgagatcgacctcagcgagtactgatgtgagaatgggttgtttgttgatcattgtcggtgcgaagcgttcggtcggattgtgcttcattactttgttattcgttgctcgtttaagagtctcgaagaaacgaaaacgattgtcgtatgtaattcattggtttttccatcccttt

SEQ ID NO: 775 - DNA, 600 bp, Heterodera glycines
  genomic DNA sequence=SeqID_478; coding sequence=SeqID_918
ataacatgttgatcgcaaaaaatggacatatcaaattggcggactttggcacgtgtgtgaagatgaacacggatggcctcgtccgatgttcgagtgccgttggcactcccgactacatcagtcccgaggtgctgcgttcacagggcggggagggcgtctacgggagagaggtcgattggtggtctgttggcatttttctatacgaaatgctggtcggcgagactccgttctactccgactctttggtcaacacttactcaaaaattatggaccacgaccgacaattgcaattccccgccgatgtgaggatttccgcacatgccaaagacattattcggaagtttctttctgaaccaaacgaaaggctgggcaaaagtggcattgatccgatcaaaaagcacccgttttttggcaattcgaattggactttcgacaccatccaacacgcaactccgccctttgtgcccgaactcaaaagtgacgacgacacttctcactttgaggatgttgagcaggccgaggcagtcaatcccgacaactttcaaatcccgaaggcttttaccggtaaccaattgccattcatcggattcacttactcca

SEQ ID NO: 776 - DNA, 1110 bp, Heterodera glycines
  genomic DNA sequence=SeqID_479; coding sequence=SeqID_958
atggctgatgacaaaagctgtgacggtgcttcttctgcgttgcctccgtgtttaattgtgcttggaatggccggttctggaaaaagctcatttgtccaaaggttggcgagtcatctccactccaagaaggtgttcccctacttggtcaatctcgacccggcggcagcaaccgttccattcccagcaaacattgacatcagagacactgtaaattacaaaaaggtcatgcaggaatacggcctcggtccaaacggtgccattctgaccagtctgaatttgttttgcactcgcttcaaccaagtgttggacttgttggacagacgaaaggggtccataccatacgccattttcgacaccccgggccaaattgaggtgttcacgtggtccgccagcggcactgtcatcaccgattcattggccgcctcttttccgaccgttgtcgcttatgtgatggatagtgcccgttcgaccaacccgacgactttcatgtccaacatgctctacgcctgctccattctttaccggaccaaattgccatttttcgtcgttttgaacaagtccgacgtggtggaccctgcttttgccgtcgaatggatgagagattttgagcagtttcaaactgcgcttgaccaaagttcgtccagtttcatgaacgacttgacccgctctttgtcccttgtgctcgattcgttctacgaaaatttaaattgggtgtccgtatcggcaaagacgggtcagggctttgataaggttttggagttaattgaaaagtgtcggttggaatattgggaagtgtataagccaatgtgtgaacgagtggcacaagagagagctgctgagacagcgaacgacggcacaaccgacgcaatgccaacggaaaagttggcgaatttggaaataagagaaaatgatgtgccaagtgatgagaagggacaaacggaggaggcgcaaattacagaaacaaatggcgaagaacattcaacggaagaaagtgaagcgcaaaagtgatcagctgctggttgcgcgaccaaaccattttttgttgaaaaatctccacattttttgctgcggaatttcccgcattttcttgagtaaattttgcctctttta

SEQ ID NO: 777 - DNA, 1635 bp, Heterodera glycines
  genomic DNA sequence=SeqID_480; coding sequence=SeqID_1009
atgtttttcagtgctccgaacccaaatggccaatttaccattgtcattccgccaccgaatgtgaccggcactttgcacttgggccacgcactgtccaccgctgttgaggacaccatcgcaagatggcatcgaatgtgcggtcggactgtgctgtttgtgcccggctgtgaccatgcgggaattgccacccaagtggtggtggagaagaagctgaagcgcgagcggggactcagtcggcacgacctcggccgggccgactttgtgaaggaagtgtggaagtggaagaacgaaaaagggcacataatttatgaccaactgaaaaaaatgggcgccggcgtcgattgggaccgagtggtgttcatgatggacccgaaaatcatgcgcgctgttactgaagcatttgtgcgaatgcacgagaagggtgtcatttaccgaagcaaacggctcgtcaattggtcatgcgcattaagttcagccatttcggaaattgagattaccggtcgcactttgctctccgtgccgggccatgccgaaaaggtcgaggtcggcgtgttggtgttgttcgcctacccactggaggaggaagtggtggaggaggacggcagcaaaacccgtgaaattgttgtggctaccacgcggctggagacaatgctcggcgacgtggccattgcagtccatccggaggacgcgcggtacaaacgaatcattggcaaacactgtgttcacccgtttttccccgaccgtcggctgcccataattgccgactcggccgtgctgcccgactttggcaccggtgcggtgaaaatcactccggcccatgaccagaccgacttcgacattggccaacgccacggccttccgctgatcaacatcttcacggaccacggttcttgcgcgccttgctgcggccctttcgcgggaatgcatcgctttagcgcgcggctggcggtgcgtgggcggctgaaggcgatgggactgtaccgggacaccaaggaaaacccgatgcaattgcgcatttgcagtcgttccaaggacatcattgagcccatcataaaatcgcagtggtacgtgcgctcttcagagatggcgaagcgggccaaagcggcggtggtcgacggacgacttcgactcatcccggaataccacgtgaacacgtggaatgcgtggctgaacgacattcgggattcggtgcatcttctcgtcagcttcggtggggtcaccaaatcccggcctcttttatcaccattgacggcaatcattcttcgacaccgccgggaaacaatgaagagcgttgacgacgaagaatcacgaggacgtgctggacacgtggttctccgccggcatcgtggccctttcagtgtggatgggttgggcccgaaacagaacggcggacaggcgccacttttttccccggctctttggctggagaccggacacgacatttcgttcttttgggtggctcggatggtggtcattgtcgcaggcacggtgcgacgggcaaccgccgttttaaggaaggtgcggtgcaataatttcatttttattcctcaccaatataagctgcagagagcaagccgctcgccctttccgccgaattattcttttgaatttccaaaccaattaaaaaaaacttga

SEQ ID NO: 778 - DNA, 1175 bp, Heterodera glycines
  genomic DNA sequence=SeqID_481; coding sequence=SeqID_967
tcacttaaatcttatatttatcaccaattggtcaaggttgaatacacgggtgccgtcgacgacattttctatgctggcacggggctgttgctgttgaagaacgcggactctgtgcaaatgtacgacttgcagcagaagcgtgtgctggccagtgtcaaggcaacaaaggtaaagtacgtcatctggtccaagaacatggaatgcgccgctttgctcagcaaacacaccgttaccctcgtcaccaagagattggaggtgctcggcactgtgcaggagtcgactcgggtgaaaagcggcgcttgggacgcgggcaatgaggcctttctgtacaccacctccaaccacatcaagtacgcgttgaccaccggaggtgaccatggcatcatccgcaccatggatattccgctgtacattttggcggtgcgcggcagccgactgtactgcttgagcagagaggcgtcgcccgtggaattgtccatcgatctgaccgaattccgcttcaagctggcgttgacccatcgtcgttatgatgaggtgttgaacatggtccgcaatgccaatctgctcggccagtccatcatcgcatttctgcaaaagaagggctacccggaggtggcactgcactttgtgaaggacgagaagacgcggttcggactggcgctggagtgtggcaatttgcaagttgcactcgaggcggccaaagtgttggacgacaagaccatttgggtggcgttgggcgaggccgcgctgctgcagggtaaccaccaaatcgtggagatggcctatcagcgaaccaaggactttgagcggctggccttcctctacctgatcacggggaaccgggaaaaattgcagaaaatgttgaaaatcgctcaaatacgcaaggatgtgcacggacagttccaatgcgctttgatgctcggcgacgcgcaagagcgcaccaaagtgctcaaagaacttggccaacttccgctcgcctatttgtcctccgtgactcattcgcttgacgaggatgcggaacagttgcgtgccgagttggaacagcgtcaaattgcggtgccggaaacgaacacaagcgcaactccactgctgccgatgacacctctcaatccgctggtggacaattggccccagctgaccgtctccaccgggccctttgatgcacagcaactgtt

SEQ ID NO: 779 - DNA, 871 bp, Heterodera glycines
  genomic DNA sequence=SeqID_482; coding sequence=SeqID_910
cgaaaagaaggcccagtcgatgctggccgaggcggagaagaaactgcagaaaagcagcggtgtgttaagtttcctcttcagcggttccagcactccctccgatgcggccgaactgttcatcaaagcggccaatcatttcaagttagcaaagaattggaacggtgcagccggcgcatttttgaaggctgctcaactgtacgaccgggacgcaaaacatgacgcggcgatcaactttggcgaggcgggcaactgttttaggaaggttgacctccaaaaagcggtcgagtgctatcagaagggggcggacatttacctggacatgggacgcttcaacatggcggccaaaatgcacacgaccatggccgagctgtacgagtcaacgctgggcgataaggacaaatgcattgagcagtaccaaaaggcggccgacatgtacaaaggggaggagcagcgcagttcggcggccaaatgtctgctcaaagtggcgcactacgcggccgagttggaccagtaccagaaggcgcagctcacttttgaggaggtggccatctacgaggcggacaatccgatgctgaaatacgctgccaaaacccactttttccaggcccttctctgctccttgtgcatcgatttgctggacagtcagcgggcactgaaacgatacgaagaattgagcaattatttcgctgacgcgcgcgagtgccaactggggaagcagataattgaagcgatggagaacggggacccggacggattcaccgaggctgttcaacagttcgacaaaatcagccgtttggaccaatggcacgtcgcaatgttggtgaaggtaaggaagaatgaggcgggggaggaggaggacgatttgcgataa

SEQ ID NO: 780 - DNA, 1016 bp, Heterodera glycines
  genomic DNA sequence=SeqID_483; coding sequence=SeqID_978
agaatacctcatgtttggacgacttcgaccgcataaaaacgctcgggacgggctcatttggccgagtgatgctggtcaagcacaaacaatccggcatttactttgccatgaaaattttggacaaacaaaaagtggtcaaactgaagcaggtcgaacacacactgaacgaaaagcggattttgcaggccatcgactttcccttcctcgtcaatatgcaatattcctttaaagacaacagcaatttgtacatggttttggagttcatcagcggtggcgaaatgttctcccatttgcgacgcattggtcgtttctctgagccacactcgcgcttttatgcggcacaaattgtgctggcgtttgagtatttgcactcattggacctcatctaccgggacttgaagccggagaatttgctgatcgatagcaacggatatttgaagattaccgacttcggattcgcaaaacgggtcaaaggtcggacatggacactttgcggtacgccagaatatttggcgcccgaaatcattcttagcaaggggtacaacaaagcggtggactggtgggcgttgggagtgctcatttacgaaatggccgccggctacccgccattctttgcggatcagcccatccaaatttacgagaaaattgtgtctggaaaggtcaaattcccgtcacatttctccaacgagctgaaggacctgctgaagaacctgctgcaggtcgacctgaccaaaaggtacggcaatttgaagaacggcgtcgccgacatcaaaaaccacaaatggttcgcgtcggtcgattggatttccgtctatcagcgaaagatcactccgcccaatttcaacgcgtccttcagcgccaaatacccggcggaaatgccgcgcgttttcgaggcgctttaccccaaagttagtgggcccgacgacacgcgccattttgtggagcaaatcgacgaagcggacgaacttttgcagtcgcacggcgactcgcagggcgacgcgccggacgcacacgcc

SEQ ID NO: 781 - DNA, 1041 bp, Heterodera glycines
  genomic DNA sequence=SeqID_372; coding sequence=SeqID_935
atgacagatgctgataaaataaacctggacaatataatttcaaggcttcttgaaggttgtttttcaaatttagtaacgaagtactttttaaatttagtgcgtggttctaaaccgggaaagaatgtccagcttacggaaaatgagataaagggtctttgtatgaagtccagagagatctttctgagtcaacctgtacttcttgaactggaggctcctctgaaaatctgcggtgatgtgcatgggcagtattatgatttgttgcggttgtttgagtatggagggtttccgcctgagtcgaattacttgtttttgggtgattatgtggatagaggaaaacaatcacttgaaacaatttgtttgcttcttgcatacaagattaagtaccccgagaacttctttttgttgcgtgggaatcacgagtgtgcttccatcaaccgaatttacgggttttatgacgaatgtttgcggcgctacaacataaaactgtggaagacttttaccgactgctttaattgtttgcctgttgccgcaattattgatgagaagattttttgctgtcatggtggtctttctcccgacctccaatccatggaacaaattcgtcggctcatgcgaccaactgacgttccggatcaggggcttctttgcgatctgctttggtctgacccagacaaggatgtgaccggttggggtgaaaatgatcgtggtgtgtcttttacttttggacctgaagtcgtctctaaattcttgcacaaacatgacctagatttgatttgtcgtgctcatcaagtggtcgaagatggctatgaattctttgcaaagcgtcaattggttacactgttttccgctccaaattactgtggagagtttgacaatgccgggtcaatgatgaccgttgatgagacattgatgtgttcttttcagattctgaagccgtccgacaagaaaggcaaattttcatacactggggctggacagaatcgtccggttacgcctcctcgtgcaactcctgctgaacaaaacaaaaaggcgaagaaatag

SEQ ID NO: 782 - DNA, 948 bp, Heterodera glycines
  genomic DNA sequence=SeqID_373; coding sequence=SeqID_1018
ggaaacattatgactttgcttatcaccggaatccttcgcaaatttgcacttacaaaattcccatttactgcatcaaattcttctttgtcgtcatggtgtaaagctgagagtcccctttcccatctcaatggcgaacaattggaaagcctttttgttgatgaacgcgtccaacgcttgctgctttcgctgaccggccatgacaccgacaaaattttgcgccatcgtcgcatcaaccaaacggagcgcaagcattacgcgttgatgacggacggcatggtgaaggagttcatgtcacgactggaccaacgggcgggcaaatttctgcgaattgtgccgttcaaagagccgcgctcaaaccgaaccgaagtgttggcacgggacgcggaaattgacggatttgacaccgccaaattcgttttcaccgacatttcattcgacgccacagatatggatcgcactgtcgttgtccgggagcaggacggaacgctacgaacggcgttgccggaagaacacgatcggatgaatcggctgttttttgtgcaacccaatcggcctgtcaacgaaccgccgctgtttgcaatgaccgacgaatggttacagaagacgctggaccgtgatgagcatgagtttgtgctggactgggcctgtcatttttacgagccggacgctcccaaatttgttgagctttgtaagtacatttttgaccacacattggaaaatgacaagttggacgtgctgtactccaccagacatttcggcacattggccttctatttggtgatcaacggcaaaatggacaaactattggaattctatgagcagaagaacagaaatgacggcgtagatcaaacgcgacaactttggcagatactttcttgttattgaagttttaattggatttctttctaaatgtgtcgacaattttttgaataaattttgttcattttc

SEQ ID NO: 783 - DNA, 1426 bp, Heterodera glycines
  genomic DNA sequence=SeqID_374; coding sequence=SeqID_966
ctcaaaatgattatcagcagcaaagccgtccaacttttgacttgctacagaaataggatcaccagaaaactacaatattcgactacggagaatgtgccggtgaatgtgcctgagccggtcatttcctcctccaacatggcacagttccgcaagggagcgggcggtcgttccagcttctcgggcaatgtcattacagtttttggcaataccggatttaccggccgaagggtggtcaatcggttggccagacacgcaaatcagctaattttgccgtaccgctgcgattcgtattttctcagagaattgaaagtgccttgtgaccttggtcaagttctgttttttcctttccaattggacgacgatgaaagcattcggaaggcagtcaaatacagcaacgttgtgatcaatatgatcggcacatatgtcgacacaccgaattattccatttatgacgccaatgtggagggtgcgtggagaattgcgcgcatttgtcgggaaatgggcgtggaacggctgatccatgtgagcgcattgaacgcggacccatcgtacaaaacacaattcatcaaaaatggcgcctttctgaaaagcaaaggcatggccgagcaggcggtccgtgccgaattcccaagtgccaccatcattcggccctctgtgatgtacggcgacattgaccgtctcatttataatctgatcacccgttggcgcgttgacccgttcggcaatgtgtacactttcaatgcgggcgaaggcatttacaaaatgccactttttgtcaatgactttgccgacggagtgaacagagtggcgatggactcctcaacagcgggcaaaacctacgaatttgtcgggccgcactgctacgaaatgtgcgagttgttcgacttcatcttcatcaaaggcggcctcgtcgctgacataactagcagataccgtcgtgttggtattccgatttggttccttttcacgtcttttctctgtcattcgtatacgaaaatatatcgtcgtcctggcgttattaattgggagtggttcgatttcatggaagcgacgagtgatgtgctgtcggctggggacacttatcttctgaaggatttgggcgtttcgttgaccgattttgaggatatgggcggctattacgccatgcaaatttcttttcagagaccataccagccaagaatggctgactatccgcagtgtccgctcccccttcgttcgccgcctctttacaaacggaagccgatcacttttaagaagcaaaatatagtcactgagcaaagggcgttcggactttgagcggagaacggacggatgggaaaaagatggataacgatcgctttattcatccattgatccattaggaatgaacacaaacaattaagctgttgcgatgattggtggtgttatcgctgtgtaaaaaaggatt

SEQ ID NO: 784 - DNA, 1318 bp, Heterodera glycines
  genomic DNA sequence=SeqID_484; coding sequence=SeqID_855
cgaattgcagcaaatgtctgtgcctggctctcaacctccgcaacagggtgaggacgccgaggagcggctgatcaacgaggagtacaaaatctggaagaaaaactgcccgttcctttacgacatggtgatgactcatgcgttggaatggcccagtttgaccgtccaatggctgcccgacgtgcaacgacaggagggcgccgactacacaatccatcgcctcattttgggcacgcacacgtcggacgagcagaatcatttggtcatcgccaaactgttactgcccaacgacgacgcacagtttgacgcgtctcgctacgacactgaccgaggcgaatttggtggctttggcacagtgaccggcaaaattgaggtggaaatcaaaatgaaccacgagggcgaggtgaaccgggcccgatacatgccacagaatccggttctgattggcaccaaatcaccctcctcggaggtgtacgtctttgactacacgaagcatccgtccacgccggctgacgtggagtgcaagccgcagttgcgactgcgtggccacaccaaggagggatacggcttatcctggaacaacaatttgcctggtcatttgttgagtgcctccgacgacatgaccgtgtgcctgtgggacattcaagcggcgactgcgaatgccaactttttggacgcaaaatccattttcacagcacacactgcggttgttgaggacgtggcatggcacgttttacatgacacagtctttggttcggtcggcgacgatcacaaactgatggtgtgggacacgcgcacgaacagctccacaaagccaacccatgttgtggaggcacactcggccgaggtgaattgtctctccttcaacccgtactcggaattcattttggccaccggatcggcagacaaaactgttgcgttgtgggaccttcgtaatttgaaattgaagctgcattcatttgaatcgcacagagatgaaatatttcaagtccaatggtcgccccacaatgagaccattttggccagctcgggcaccgatcgccgtctgcacatttgggatctgagcaaaattggcgacgaacagtcgccagaggacgcggaggacggaccaccggaactgttgttcatccatggcgggcacacggccaaaatcagcgacttttcgtggaaccccaacgagccgtgggtgatctgttcagtgtcggaggacaacataatgcagatttggcagatggcggacaacatttacaacgaggaggagttggacccggcgatggtggaaggtgttgcggccgcaagcggcgccggtccgatgggccaa

SEQ ID NO: 785 - DNA, 1485 bp, Heterodera glycines; identical to SEQ ID NO: 543
  genomic DNA sequence=SeqID_504; cDNA sequence=SeqID_543
  peptide sequence=SeqID_1030

SEQ ID NO: 786 - DNA, 3021 bp, Heterodera glycines; identical to SEQ ID NO: 544
  genomic DNA sequence=SeqID_505; cDNA sequence=SeqID_544
  peptide sequence=SeqID_1031

SEQ ID NO: 787 - DNA, 1014 bp, Heterodera glycines; identical to SEQ ID NO: 545
  genomic DNA sequence=SeqID_506; cDNA sequence=SeqID_545
  peptide sequence=SeqID_1032

SEQ ID NO: 788 - DNA, 1685 bp, Heterodera glycines; identical to SEQ ID NO: 558
  genomic DNA sequence=SeqID_542; cDNA sequence=SeqID_558
  peptide sequence=SeqID_1028

SEQ ID NO: 789 - DNA, 1482 bp, Heterodera glycines
  genomic DNA sequence=SeqID_519; cDNA sequence=SeqID_559
  peptide sequence=SeqID_1033
atggttacggaacagaatggcgctacttttgctgttgacgttgaggaaattgcggctgggcatcacgttacgcctgtggacatgacaacagctaccagcaaacttcagcttgaggctgccgaagtgcgaaatccggcgaataaaccgaattggtcatcgtatttgcgctctcaattggtgcctcaaaatgagtacaatttcattattgaattggaaaaggccaaaaacaagcaggagagggacgaagcgttagccaaggacaagacgaattcggcacggagtattatcaatttgatcaccgaagttgcgaaggatcagctgatccgttacgttctcacccttttcgacgaccttttgcaggaggacaaatcccgggtagagattttccatgattatgcaagacggcaaaaacgaactatttggtcgtggttccaagggattttaacgcgaaatgacagtttcattgtcaaccaaatgtctgcaatattctcaaaattggcttgctatggctctgtgcttatggatggacaagaactgcaagcttatttcaatttccttcaacaggaaataaaaaactcggttagcaacgaatacataaatacatcagttcgatgtctacaaatgatgttacgaaaggaaaagtatcgacgaaaattcgttgagtatgacggcgttaaaagcattcttttggcattgaatggtcgtgccaattttcaacttcaataccaactcattttttgcctttggtgccttaccttcgacagtaacatcgctcaatttgtccagggattgggcattatccaaccgttgggcgatattctctccgaatgctcaaaggaaaaagtgattcgtatcattctcgcgaccttccgaaatttgttggagaaaattgacaatagagagatggtgcgcgaatcggcactgcaaatggtccaatgcaaaacgctgaaaacccttgaattgatggacgccaaaaagtttgacgacccggacttggtggacgacattgaatttctgtctgaacgtcttcacgcctcggtgcaggatttgagttcgtttgacgaatactgtgccgaggtccgatcgggcagactccagtggagtccggtgcataaattggagaaattctggcgcgaaaatgcacaacgcttcaatgaaaagaactttgaattgataaaaatactcatcaaaattctcgagaccagcagcgacccattgccgctcagtgttgctgctcatgacattggcgaatacgtccggcattaccatcgcggaaaaacaattgtcgaacaataccaaggcaaacaagcagtgatgaagttgttgagtgcagaggacccaaacgttcggtaccacgctttgttagcaatccaaaagttaatggtgcacaattgggaatatcttggcaagcaaattgaaggactcgaaggggcaaaaggcgctgcgggggaagaagcaaaggaagtgaaaacgcgaacctaa

SEQ ID NO: 790 - DNA, 2697 bp, Heterodera glycines; identical to SEQ ID NO: 550
  genomic DNA sequence=SeqID_511; cDNA sequence=SeqID_550
  peptide sequence=SeqID_1233

SEQ ID NO: 791 - DNA, 3276 bp, Heterodera glycines
  genomic DNA sequence=SeqID_531; cDNA sequence=SeqID_575
  peptide sequence=SeqID_1034
atgggagttccagcctttttccgttggctttcacgaaagtatgtgtcgatcattgttgacgcggtggaacagcgcagaagagaaattgacggagtaaaaatcccaatagatgcaactcaaccaaatgagaattaccaagagtttgacaatctttacttggacatgaacggcattatccatccgtgcacacatccggaagaccgacccgcgccgaagaccgaggaagaaatgttcattttgatcttcgagtatattgaccgcctcttttccatcgttcggccaagaaaacttctctacatggcagttgatggggtcgcccccagagcaaagatgaaccaacagcgaagtcgtcgttttcgagcagcacaagaagcggcggagaagcgcgagctcatcgaaaatgtgcgtaagcggttggagtcggaaggaattccgttgccgccaccgcgaaaggaagaggaacactttgactccaattgcataacacccggcacgccgtttatggcccgtctttctgttgcccttcgctattacgtgcacaaacggatcacctacgacccggcatggcaaaagatccaggttattctttccgatgcgaatgtgccgggtgagggcgaacataaaatcatggactacgtccgacgtcagcgcgcttcgccggcgcatgacccgaacaccgttcactgtctttgtggcgccgatgccgaccttatcatgcttggattggccacccacgagtccaatttcaacataattcgagaagagtttttgccgaatcaaccgaggccgtgcgaactttgcggtcaatacgggcacgaggtcgaacattgtgaagggttggcacgtgccgagaccgggccggaccaagcggacccgttgaagaaggagaagaacttcatcttcatacgtctgccagtgcttcgggaatatttggagcgtgaactttccatgccaaatttgccatttccgttcgatttggagagagccattgatgattgggtcatgatgtgtttttttgtgggcaacgattttctcccccatttgccatcgttagaaatccgtgaaaatgccatcgaccgtctcgtgaagttgtacaaggacatggtttatcaggctggcggctggctcactgaaaacggcatagtgaatatcgaaagagtgaagaagatcatgggcggacttgggaaggttgaggacgaaatattcaaacaaagacagctcaaagaattgcgcttcaaagaatcaaagaaacagcgaaagcagcaacaacggcaggcaatggcaaaaattatgccgtacaatgccaatttgatagcaccaatgccacttggacagcaaaagcgaatgtcgggcgaggaaatgcgcagattggcggcgggagaccgacaggagttcgtcagacttgcggatgtcgccagttcgcacaaattgcagtcgctgttgacgcctgtcgaccgacgaaaggccacggatggcggtgatcggaagcgcaagttggccccaagttcagtcgacagtccgaacggagcaccaccagctaaatcgtttaaggagggagtggctgctgcgtccgtttcctccgaaacggccttgaaaccggagataaaactcgtaactccctctgggaagacggcgcctttggccaagggggcggttggggcactggcatacgactctgacgaggaggaggaagtgctcgacgaaatccgtctatgggaaagtggatggaaggaccgctactacagagccaagttccaagtgtccgagactgaccttgaatttcgcaagaaagtggcatgtgcttatgttgagggactctgctgggtgttgcgttattattatcagggatgtgccagctggaaatggtactacccttaccactacgcgccgtttgcctccgattttgaactgatcgccgatttccaacccgacttcaacatgcccacgaaaccgttcaagccattggagcagttaatgggtgtgtttcctgctgctagcagagctcatattcctgacgggtggcgttggctgatgaccgactcaagttcgccgataattgatttttacccggaaacttttgaaattgatctgaacgggaagaaatatgcttggcaaggcgtcgctctgctgccatttgtcgaggaaaaacgtcttttggatgcacttgactcggtgtacgccactctcacaaccgatgaaattgcgcggaatgccaccggaccagaccgtctttttgtcggcaataaacacaacttgttttcgctcgtttatgaggtgcactcccaaaagacgacaacttcgataaaagatgaactaacaaatgatgacacaaaagaaacaagcgaagggacgcgagaaactgaaggagaagccgaggaaactcaacaggcggaaaatggtgaaagcgaacaaatagcgaaaaccgaagaaacgacggcacaagaggaacaagcgaatgaagaagctatctcaaaacctgaacaggcaccgaaacaggaattcgagactgaaattgaatttgtcgatgacgaagaaaagaaatgggtgcacatcgacgcagtcaaagcgtatgggatgtctggcgaagtgtcttatgacgtcgaagcactcgcttttggtgaggcgcataggtcgctgttcagaaattcgttggagtttggcgacatcaaagagaatacctgcattatggttgagttccgagatccccaattcccaatgcacttcatcttcaaagccaacaggctggacggcatcaaggaattgcctcgtgtgctcaaaccgaacgattgggaccaacgacggcacggctccttccaaccccaaatcggattcagtcgtgacatcccacgtgcaaatctctccatggcgggccatcgtacgctcaaccaccacataaacgacaaccgtcgcagttgtccggcctctcttttctcagtgcaaacatcgccaccagcgcacacacttccatggcacatgagcacaaactcaccacaacaacaacatcaaatgcagtaccaacatcagcaacaatggcagcagggtcaattttacaacgggcaacagcagcagcagcccgtgccgttgttcagttttgggcagatggcaatgcccccgcctccgccgctcccaccgcaaaattggattactagtcacccgccaccacaaatccagtctcacgtgccgtacgggcagcccccacctctaatatcacagccaaggaatactcagcatcaccatcgcagaaacgacaacaacagaacttacaataggaaataa

SEQ ID NO: 792 - DNA, 2175 bp, Heterodera glycines; identical to SEQ ID NO: 580
  genomic DNA sequence=SeqID_535; cDNA sequence=SeqID_580
  peptide sequence=SeqID_1035

SEQ ID NO: 793 - DNA, 1506 bp, Heterodera glycines
  genomic DNA sequence=SeqID_532; cDNA sequence=SeqID_576
  peptide sequence=SeqID_1036
atggcgaaatctgcaattgatgttaatcgcggcatcacagaagaccaaacagctaccataagaaattatttcacacaaccgcacttaatttacaaaactgtcactggagtgcgcgggcctttggtcatattgggcgatgttaaattcccacaatacgctgaaattgtgaaacttacactgcctaatggagaaaaacgcatgggacaagtactcgaagtaacgaaggacaaagctgtcgttcaggtgtttgaaggtacgtcaggtatcgatgcaaaaaacacaatttgcgagttcactggcgatattatgagaacacccgtttccgaggatatgcttggaagaatattcaatggatccggcacacccatcgacaaagggcccaatgttttggcggaggattacttggacatcgatggacagcctatcaacccatggtccagaatttatcccgaagaaatgattcagaccggcatttccgcaattgatgttatgaatagtatcgccaggggacagaaaatcccaattttttctgctgcaggtcttccgcataatgagatcgctgctcaaattgtacgccaagggggcctcgtcaaacagccgaacagaaagaaggaaaatgaggtggagggtgacgacgactttgccattgtgtttgctgcaatgggtgtcaacatggagacagcgcgctttttcaaacaagactttgaagaaaacggttccatggaaaatgtgtgccttttccttaacttggctaatgacccaaccatcgaacggatcatcacaccacgactcgcgctgacttgtgcagaatttctggcttaccaatgccaaaaacacgtcttggttgtgctcactgacatgtcttattacgctgaagcacttcgcgaagtgtccgccgcccgagaggaagtgcccggtcgtcgtggttttcccggttacatgtacactgacttggccagaatatacgaacgtgccgggcgtgttgaaggccgaaaggggtcaatcacacaaattccaattttgtctatgcctaatgacgacatcacccacccaattcccgatttgaccggttacataacggaaggccaaatttatgtggatcgccaacttcacaatcgtcagatttaccctccaataaatgtacttccatcgctgtcgcgtctgatgaaatcggccattggcgagggaatgacccgtgccgatcattcggatgtgtccaaccaactttacgcatgttatgccattggtaaagacgtgcaagcaatgaaagcggtggttggagaggaggcactgtcgtcggatgatttgctctacttggagtttctcacgaaatttgaaaagaatttcatttcacaagggaattatgaaaaccggacggtgttcgactcactcgacattggttggcagctgttgcgcatttttccaagagaaatgttgaagcgaattccagcgaaaacattggataaatattacccaaggggaggcactggggcgaggaacgaatga

SEQ ID NO: 794 - DNA, 942 bp, Heterodera glycines
  genomic DNA sequence=SeqID_520; cDNA sequence=SeqID_560
  peptide sequence=SeqID_1037
atggagcgtttattgcgattgggaggccttagtggtttgggagcaggttcattgaacgcaacaccacacgattcgaaccaagttgacacttcggaaactgtttacatcagttcattggctttattaaaaatgctaaaacatggacgagctggcgtcccgatggaggttatgggtttaatgctaggtgaatttgttgatgattatacggttaacgtgattgatgtctttgcaatgccgcagtctgggacgggagtttctgttgaggccgtcgatccagtctttcaggctaaaatgttggatatgcttaaacaaactggaaggcctgagatggttgttggttggtaccattctcacccgggatttggttgttggctttctggggtcgatataaacactcagcagagttttgaggcgttgtctgacagagcagttgctgttgtagttgacccaattcaatctgtgaagggaaaggttgtcatcgatgcttttcgcacaattaacccacaggcaattgcactaaaccaagaacctcgtcagacaacgagcaacatcggccatttgcaaaagccttcaattcaagcccttatccacgggctaaatcgccattattattccattccaattgcttatcgtacaaacgagaatgagcaacagatgttgcttaacctcaacaaacaaagttggatggactctatgaatttggtaaattacaacgagcattgtacacgaactgagaaggctgttgagcatatgctaaagcttgcaaagctttacaagaaatcattggaagaagaagagaaaatgaccgaagaacaattggctatcaaaaatgttggaaagcaagacccgaagcggcatttaggagagactgtgagccagcttttggccgataatttggtgcagggattggctgcaatgcttgatgtttctgctttccagtaa

SEQ ID NO: 795 - DNA, 2559 bp, Heterodera glycines
  genomic DNA sequence=SeqID_337; cDNA sequence=SeqID_568
  peptide sequence=SeqID_1038
atggtgaactttaccgttgatgaaattcgtgcccttatggatcggaaaaaaaacatccgaaatatgtcggtcattgcccacgttgaccatggcaaatcgacacttaccgactcgctggtgtccaaagctggcattatcgctggtgcaaaggctggtgagacgcgcttcactgacacacgcaaggacgagcaggaacgttgcatcaccatcaaatctactgccatttcgatgttctttgaactcgaacgcaaagacttggagttcgtcaaaggcgaaagccaagcagacattgagcaggtcgacgggaagagccaaaagtacaacggtttcttgatcaatctgatcgactcgcctggccacgtggacttctccagcgaagttactgctgcgttgcgcgtcactgacggtgctttggtggtggtcgactgtgtgtcaggtgtttgcgtgcaaactgagacggtgttgcgtcaagcaattgccgagcgtatcaaaccggtgttgttcatgaacaagatggaccgtgcgctgctcgaacttcagcttggccaggaggaattgttccagacattccagcgcattgtggagaacatcaacgtgatcattgccacttacggagatgatgatggaccgatgggtccgatccaagtggacccgtccattggcaatgtcggctttggctctggacttcatggttgggctttcacattgaagcagtttgcggagatgtacgctgacaagtttggagtccagattgacaaattgatgaaaaatctgtggggcgatcgcttcttcaacatgaagaccaagaaatggaccaacaaccaagagcccgagaccaagcgaggcttctgccaatttgtgttggacccgatcttcaaagtgttcgacgctgtgatgaacatcaaaaaggacgaagtggcgaagttggtggagaagctgaacatcaaactgaccttggaagagaaggaacaggagggcaagccattgctgaaaacgatgatgcgcaaatggttgccagccggtgacactatgcttcagatgattgtcatgcatttgccatcgccagtcacggcgcaaagataccgcatggaaatgctatacgaagggccgcatgacgacgaggcggcggttgcaatgaaaaactgcgaccccaacgggccactgatgatgtacatctcgaagatggtgccaacctctgacaaagggcgcttctacgctttcggtcgcgtgtttgcgggcagagtcgccactgggatgaaagcgcgtatccaagggccaaattatgtggtcggcaaaaaggaggacctctacgagaagaccatccaacgcacaattctaatgatgggccgttacattgaaccgattgaggacattccggccggaaacattgccggactggtcggcgttgatcagtacctggtcaagggtgggaccatcaccacctacaaagacgcacacaacatgcgcgtgatgaaattctccgtgtcgcccgttgtccgtgtggcggtcgagccaaagaatgcgggcgatttgcccaagctggtcgaaggattgaagcgtttggccaagtcggacccgatggtccaatgcattttcgaggagtccggtgaacacatcattgccggcgcgggcgaactgcacttggagatctgcttgaaggacttggaggaggaccatgcttgcattccgctcaagaagtctgatccggtggtgtcctaccgtgagacggtcaccgaagaatccgaaattgtgtgcctgtccaaatcgcccaacaaacacaaccgtctgttctgcaaagctaggccgttgcctgatggactgccggaagccattgaacgcggcgacgtcaacccgacggacgacccgaaaaatcgtgccaaaatactcaccgagaaattcgaaatggacgcgaccgactcgcgcaaaatttggtgtttcggaccagagggcactggtgccaatttgctgattgacgtgacaaagggtgtgcagtacttgaacgaaattaaggattcggtagtggccggcttccaatgggcaaccaaggagggcgtgctctgcgatgagaacatgcgcggtgttcgtttcgacatccacgacgtcacactgcacgccgatgccattcaccgtggcggtggtcaaatcattccgacggcgcgtcgtgttttctacgcttcggtgttgacggcaaaacctcgtctgcttgagcctgtctatctcgtggagatccaatgtcccgaagcggctgttggtggcatttacggagtgctgaaccgtcgccgtggtgtcgtctttgaggagagtcaaattgccggcacaccgatgttcattgtcaaggcacatttgcccgtcaacgaatcattcggattcactgctgatttgcgttccaacactggtggtcaagcatttccgcaatgtgtgttcgaccattggcaagttcttcccggcgatccgtttgatggcacttctcgtcctggtcaagtggtcactgagacgcgaaaacgaaagggattgaaggagggcattccatcgcttgacaatttctatgacaaattgtaa

SEQ ID NO: 796 - DNA, 692 bp, Heterodera glycines
  genomic DNA sequence=SeqID_521; cDNA sequence=SeqID_561
  peptide sequence=SeqID_1039
atggagcgttatgatcgtgcaattacgattttttctccggatggcagactttttcaagttgactatgcgcaagaagcagtgaagaagggctcaacagcggttgccgtgaaaggaaaaaattgtgttgtaattggagtcgaaaaaaaatctatcccgactctgcaagacgaacgtaccattcgtaaaatacatgcattggattcgcatgtgatggtcgcattcgccggactcagcgccgatgcacgcgtccttatcgaccgtgctcgagttgaatgcgaaaattacaaattgacgcttgaggaccgcgtatctgtcatgcatatctctcgcatcatagctgatataaaacagagatacactcaaaccactggccgtcggccttttggaatttcaatgcttgtcggaggcttcgattctgatgggacccctcatcttttcaagacggaaccgtccggagtttactacgaattgttggccggttcaatagggcgaaatgaaaagattgtgaaggagtatctggagaaagaatacggcaacgacaacacagctgatgaggagtctacgcttaaactgatgctcaagtctttagccccagtggtccaatcgggggcgcagaatatcgaaattgcggtgctcaaatgggtggatggcaccaatggggagcctgggtattgtgagcagcaaattttaaa

SEQ ID NO: 797 - DNA, 756 bp, Heterodera glycines
  genomic DNA sequence=SeqID_525; cDNA sequence=SeqID_569
  peptide sequence=SeqID_1040
atgtttctgacccgcagcgaatacgacaggggagtgaacactttttccccggagggccgtctgttccaagtggaatatgccatcgaaactgtcaagcttggttccacaagcatcggaattcacaccaaagaaggcgttcttttggctgcggaaaggcgttcaatgagcaaattggtggtggacgactcaatgagcaaaatttcggaagttgagaagcacattgccgtcgcctcggccggtctcatcgcagattcacgcacttgggtcgaacacgcgcgggtggaggctcaacacttttggtttacttacggtggcaaaattcgggtggaagacattactcaaaaggtctcaagattggcactgcattttggggacgacgactcaactatcagtctcggccgtccgtttggagtttctatgctttttgccggcattgatcacacgggtgcgcatctcttccatttggacccgtccgggacgtacattaaatgtttggccaaggccatcggtgccggctccgatgcagcggaacaaacgctgcaagagcactgtaaaaactgcgacaaaaaaatggaaatggccgaggcaaaacaagtcgcactgaacacactcaaacagctgatggaagagaaaatcaattccaaaaatgtggaaattgttatgattaagccgcagacggacaaggaaggcaaaacgttgggcaaaattgtgtggttagaggaatcggagttgcaagaaatcatttcgcgattgtag

SEQ ID NO: 798 - DNA, 1302 bp, Heterodera glycines; identical to SEQ ID NO: 562
  genomic DNA sequence=SeqID_522; cDNA sequence=SeqID_562
  peptide sequence=SeqID_1041

SEQ ID NO: 799 - DNA, 1713 bp, Heterodera glycines
  genomic DNA sequence=SeqID_536; cDNA sequence=SeqID_581
  peptide sequence=SeqID_1042
atggatttgttaaaatcttacgacggctcttcatcatcggacaatgaacaagaattggcagatataccttcttcgtccaatcacaacaaattgctcgctttgaaaatcccatccatcaacttaacacccaacgtgattgaacaacgcgccattcaacaggttgcggttgtggatccaaaaaccaaagagttgtatcacaatccgcgcttcgacgaattgtttaaaccagagagcggcccacaaaatccgtttaaaagtgaacatcaacgagcagaaaagaacacactgaccggctatgtggagccagcgcatttcaacgccttccattttgagcgttcacttcgctcctacgatacgcttggctatgcggataatccaacggcagacacaaccagcgcaaagttcgttggtgacgttggacaagcgcaagaaaaggccggcgagtcgctttttgaatcagtaaaaactggcggacagaagcgaaagagagtgataaattacgacgcatcaaacgttgacggatatacgggaccgtgggcaaggtttgaggacgagaagacaattgctcgaccggacccagaattgcagaaggaaatggacgaaattgtgcggaaacggaaactgaaaagtcgtgctggccgaagagcggccatcgcggaattgcatttggcagaagagagcaccaaattgcacataaaagatgacactgactatttgggccgttcctttatggaaccgccgaaatacacgggcaccaatctgcgcgaggactttgtgcccgaccgctgtttcccgcccacaaaacaagcacacacctacagcagtcacaccaaaccggtgaccgccatccgatggtttcctcgtagtgcgcacatgtttatctcttgttccatggacggaaaagtcaaattgtgggaagtgtacggcaaccgtaagttgatccgcacatacactggacacaaagtgcccgtgaaggacatttattttaacaacaccggcactgaatttctaagtgccgcttatgacaattacatcaaattgtgggacactgaaaccggtcaggtgaaaaaccgctacacaattggaggccatcgggcgtatgtggtcaaattcaacccggacgatgataaacaaaacattttcatggccggaatgtccaacaaaaagatcatccaatgggacacgcgaactggcgaaatcgaacaagaatacgaccgtcatttgggtccagtgaactcgatcacctttttcgacaaaaaccgtcgtttcgtttctacttcggacgataaatctcttcgcatttgggaatttggcattcccgtggatacaaaactgattcaacatgctggactacattccattccttcaatgactagggcaccaaatgaaaaatggatcgttgggcagtccatggacaatcgaattgtccttttccaaatcgtcgatgacaagttgcgattcgctcgtaaaaaggccttccgtggtcacaatacagcagggtacgcctgctcaactgatttttcgccagagatgagttttctcgcttccggtgatgcggacggtaaaatcacaatgtgggactggcgcacacacaaaattgtctccacatggaaggcacatgataatgtgtgcatttcaacactgtggcatccgcacgagaaatcgcggatgatttcttgcggatgggacaatgtaatcaaaatgtgggtctga

SEQ ID NO: 800 - DNA, 951 bp, Heterodera glycines
  genomic DNA sequence=SeqID_512; cDNA sequence=SeqID_551
  peptide sequence=SeqID_1043
atgtcttttcttgtcacattagccggctatttgacaattgccatttttctccagaaactcttccgctctctgtacaatgtggttttcccctatttgttcgctgttcctcagaatatcaaggtgctcgcgggtgccgagtgggcagtggtcaccggcagcactgacggcattggcaaggcatacgcgctcgagttggccaagaaaaacttcaacgtggtgctcatctcacgctccatggacaaactgaacgcagtggcggaggaaatcaaacagaaatatcccaatgtggaagtgaagtgcatctcattcgacttcaccaacgcaaacctgaaggactacgagcagacaattttctcccaactttccaacattgaagttggaatgctcgtgaacaatgtcgggatgagctacgagtaccccgagcgattggaccgtattgagggcggactgcaacgcgtctccgacattaccgtgatcaacaccctgcccactacggtactctccgcttttgtgctcaaacagatgagggaacggggacgcggcgtcgtcgtcaatttggcctcctcggcagcgtatttcaattggttttacctggccgcttattccgcgtcgaagaaatacgtgtgttggttgtcctccattctgcgcatggaatacgccgacaccgacattgtcatccaaacggtgtgcccgatgatggtggccaccaaaatggccaagattcgcaaggcttccttcttcacgcccagccccgaggaatttgccgcccaagcgctccgcagcattggtttggttgacgagaccaccggctgtttgtcccaccaaattcaggccgagctgatgttcggctacgtccccgccccgttgctgaacaaattcgtgcgcgacaactcactgcagacgcgcaagcgcgccctgaagaaggaagcgacggtggcgaagagtgaatga

SEQ ID NO: 801 - DNA, 627 bp, Heterodera glycines
  genomic DNA sequence=SeqID_537; cDNA sequence=SeqID_582
  peptide sequence=SeqID_1044
atgttccgcaaccaatacgatagcgacgttactgtgttcagcccgcagggccgtcttcaccaaattgattatgcagtcgaagcgatgagacagggcagtgcagcagtagcaattcgtagcaaagattatgctgttgtggtcgcacttatgcgtgcacaaaacgagctttcttcatatcagcagaaagttttcaaattggacgatcatctcggcttgtctatgtctgggcttatttcagatggacgcattttggcacgctttatgcaaagtgaatgcgccgagtttcgctggaactatcataatccaatttcggttgaactgctcaaccgtaaattaggcttgaaacttcagtccaatacccaatattacggacgccgcccatttggtgtgggactgctcatcattggatatgatgacaaagggcctcacgttgtgaaagccgaaccctcgggggacgtgtccgaaatgtttgctgcttcgattggtgctcggtcacaaagtgcgcgaacttatctcgaaaagaacctaccagaatttgagacggctgacagagacgcattgattcgccatgcgattcgctccctcaaagagacgctgcaggcggacgctggcagtttggatgagaat

SEQ ID NO: 802 - DNA, 651 bp, Heterodera glycines
  genomic DNA sequence=SeqID_526; cDNA sequence=SeqID_570
  peptide sequence=SeqID_1045
atgaaccaagaacaagacaatatcccaactttcaagcttgtgttggttggtgacggtggtaccggaaagaccacttttgtgaaacgccatttgactggagaattcgagaagaaatatatcgctacgcttggtgttgaggtccatcccctcacttttcacacttcgcgaggtcaaatccgattcaacgtttgggacacagccggccaggagaagtttggtggacttcgtgatgggtattatatccaaggccaatgtgctattgtcatgttcgacgtgaccgccagagtcacatacaaaaatgtgccgaattggcaccgcgatttggtccgagtttgtgagaacatcccaattgtgctggtggggaacaaagtggatgtcaaagataggaaagtcaaggcgaaaagcatcacttttcaccgcaagaaaaatctccagtattacgacatttccgcaaagagcaactacaatttcgagaagcccttcctttatctggcacgaaagctgatcggcgaccccaacctcgaattcgtggcgatgccggcactcgctccgcccgaagtacaaatggatcccgctttggctgccaaatacgagcaagaagtggccgaggcagcaagcgctgaactcccggacgatgatgaggacatttga

SEQ ID NO: 803 - DNA, 1074 bp, Heterodera glycines
  genomic DNA sequence=SeqID_336; cDNA sequence=SeqID_563
  peptide sequence=SeqID_1234
gccggtttcgcgggcgatgacgcgccccgcgcggtgtttccgtccattgtgggccgcccccgtcatcagggcgtcatggtcggcatgggacagaaggactcgtacgtgggagacgaggcgcagtccaagcgtggtattctgacgctgaagtacccgattgagcacggcatcgtcaccaactgggacgacatggagaagatctggcaccacaccttctacaacgagctgcgtgtcgcccccgaggagcacccggtgctgctcacagaggccccgctgaacccgaaggccaacagagaaaagatgacccaaatcatgttcgagacgttcaacacgccggccatgtacgtggccatccaggccgtgctgtccctgtacgcctccggccgtaccaccggtctcgtgttggactccggcgatggtgtcacccacaccgtgcccatctacgagggttacgccctgccccacgccatcctccgtttggacttggccggccgtgacctcactgactacctgatgaagatcctcactgagcgtggttactccttcgtgaccacggccgagcgtgagatcgtccgtgacatcaaagagaagttgtgctacgtggcactcgacttcgagcaggaaatggccactgccgcctcctcctcctcgctggagaagagctacgaactgcccgacggccaagtgatcaccgtcggcaacgagcgcttccgttgccccgaggcgctgttccagccgtccttcatcggcatggagtcggccggcatccacgagtccacctacaactcgatcatgaagtgcgacatcgacatccgtaaggacctgtacgccaacaatgtgctgtccggcggcaccaccatgtacccgggcattgctgaccgcatgcagaaggagatgaccgcgctggccccgtccaccatgaagatcaaaatcatcgctcccccggagcgcaagtactccgtctggatcggcggctccatcctcgcctccctgtccaccttccaacagatgtggatcagcaagcaggagtacgacgagtcgggcccgtccattgtccaccgcaagtgcttctga

SEQ ID NO: 804 - DNA, 948 bp, Heterodera glycines
  genomic DNA sequence=SeqID_513; cDNA sequence=SeqID_552
  peptide sequence=SeqID_1046
atgtcatttcggtcagcagcggcattagggcttaacttgcgtaaagcatccaaatttgtgttgttcggcgcattggccaccggtggcagtgtgttgctgtactcgttggagaatagcggtgcgcgtgcctacgactttgttgtgcacccgagccatttgccatggtcccacggcggactgatggacgcaattgacatgcgatcggttcgtcgcggttaccaagtgtacaagcaagtgtgtgccgcatgccattccttgaaattcatccgttacaaccattttgtcgacaatttcatgacacgggatgaggcgaagacggaggctgccgaggcactgatcccggacttggacgataatggtgtggaaattcttcgtcccgggctgctcaacgacacgttgccaagcccctacaaaaacaacaaagctgccgcggcggcgaacagtggcgcattgccacccgatttgtcactgattatgtgggcccgggaaggggccgaggactacgtgttccatctgttgaccgggttttttgatgcaccggcgggcattgacgtggaggagggcaaggcgttcaacccgtacttccccaacggctgtgtgttggccatgccgcaacaactgtttgacgaaggcattgactatgaggatggcacaccggcaacaatgtcgcaacaggccaaggacatttgcaccttcttgcgctgggccggcgaacaatggcacgacacgcgcaaacgctgggcatggaagttgatcacgctgttgccactgctcacgtttgtgctactgtacgccaagcgcaatgtgtgggcactgatgaagacggagaaggtgatcttccggcgactgcccggccgcgggtggacgcccgagtcgtcggcgccaaagccgcccaaggacgagccggagctgaaggtgatcgagccgccgcagaagccggtcgtctga

SEQ ID NO: 805 - DNA, 1275 bp, Heterodera glycines
  genomic DNA sequence=SeqID_523; cDNA sequence=SeqID_564
  peptide sequence=SeqID_1047
cccaatgagacggatgacaaaaccaaagaaataaaattttcagcgcttgacgaggatgaaattgccgcacttagtaattacaacatgggaccgtacgcggatcagttgaagcaggcggagaaggacattgatgaaattcagaagcgcataaacactctttgcggagtgaaagagagcgacacggggctggcgccgcccattctttgggacattgcggccgacaaaatggccatgtcccatgagcagccgctgcaggtggctcgctgcacaaaaatcatcaaagaagagggcaaagaaacgcgttacatgatcaatgtgaagcagttcgccaagttcgtcgtggacctgcacgaaaatgtggcgcccactgacattgaggagggaatgcgagtgggggtggaccgcaacaaataccagattcatttgcctttgccggcaaagattgacgcgtccgttacgatgatgcaagtggaggacaagccggacgttacctacgcggacattggcgggtgcgaagaacagatcaaaaagttgcgtgaagtggtcgagtttccgttgcttcagcctgagcgtttcacgagtttgggcattgagcctccgaagggcgttttgttttttggtccgccgggcaccggcaaaactttgtgtgcccgcgcggtcgccaatcggacggacgcgtgtttcatccgcgtcatcggttccgaattagtcaaaaaatacgttggcgaaggcgcgcgcatggtgcgcgagctgttttcgctggctaaaacgaaaaaggcgtgcattctcttcttcgacgaagtcgacgccatcggcggagcgcgatttgacgacggaaaagggggcgacaacgaagtgcaacggacgatgctcgagttggtcaaccaactggacggattcgactcacgcggggccatcaaggttttgatggccaccaacagaccggacacactcgacccggcgctcattcgtcccggtcgcattgaccgacgcattgaattttccttgcctgacctcaaggcacgaggaaacattctccaaattcacaccaaacggatgagcgtcgaccggaacattcggtacgaattgattgctcgactctgtccaaacacgacgggtgccgacttgcgcagcgtttgcactgaggcgggaatgttcgctttgcgtgcacgtcgaaaggtcataacggagcaagactttctcaaggctgttcagaaagtggtgaaaagctacgccaagttcagttcaacgccggcgtatatgacgcacaactga

SEQ ID NO: 806 - DNA, 1322 bp, Heterodera glycines; identical to SEQ ID NO: 553
  genomic DNA sequence=SeqID_514; cDNA sequence=SeqID_553
  peptide sequence=SeqID_1048

SEQ ID NO: 807 - DNA, 2142 bp, Heterodera glycines
  genomic DNA sequence=SeqID_507; cDNA sequence=SeqID_546
  peptide sequence=SeqID_1049
aaacaaaccaatttaagaaaagaagaaaccagcaatgagaagaaaaaggggaaaaaagctgaggaagttatgccgaaaaagtcaaaggaatcgacctcaaaaagtcgaaaaaagaacgaaagcagcggagaggaagaagactttgacgacgactccgacggggaagaggaggaatatcagccaaaggtaaggcgaagagaaggaaaacggatgaaaaaggatgacatacttcagaaaaagaaacaaaagtcggacccatccccggcgaagaaaagcgacagcaaaaagtcaacgaaaacaacaaaagttaccaaggtggaggtcaaggaagagagcggcgctggggttgagcacaagaaacggaagacaacgaaagttgaagtgaaggaagaggtcagtcggaagaagccctcctcttcccagggaagtccgtccaagaaacgtgtgaagaaacaggaggaagaagaggaagtgtggcgctggtgggaggaggacgagtcgaacgcgggcgcctccgatgggtccatcaaatggcaaacgcttgtccacaaagggcccgtctttgcaccggcctatgtgccattgccaaaacacatcaagttcaaatacgacggaaaggagatggatttgtctttgccggccgaagaagtggcttccttttacgcgaaaatgctcgaccacgactacacgtcaaaaccggtgttcaaccagaactttttcaaggattgggtcaaagtgatgacaaaggcggagcgagccgaaattaaagatttggccaaatgcgattttaggcaaatgcacgctttttacgtgtcggagtcggagaagcgcaaagcgcgcagcaaagaggagaaaaaggcggagaaagaggagaaggaaggcgaggcaaaggtgtacgggttcgccatgttggacggatacaaacagaaaattggcaacttccgaatagaaccgccgggactattcagggggagaggtgaccatccaaagatgggttctctgaagaaacgggtccagccggaggatgtggtcatcaactgctcaagaggactgaagattatgccgccggaggggcacaaatggaaggaaatccgtcatgataacactgtcacttggctgtgttcatggaccgaaaatgtgttgggcagcaacaagtacataatgctgaatccgtccagcaaactcaaaggccaaaaggattgggagaagtttgagaaggcgagaaagttaaaaggacatgtcggtcaaatccgccagcagtacctcgccgactttaagtctaaggaaatgcgtatccgtcagcgtgccgtggcactatattttatcgacaaattggcacttcgtgcgggcaatgaaaaagacaccgacgaagcggccgacacggtcggttgttgctcgttgcgttgtgagcacatcaaattgcacgatgatatggacgacctgaagtatgttgttgaattcgacttcctcggcaaagactccatccgctattacaaccgtgtgccggtggaaaagcaagtgttcaaaaatctgaagctttttatggaggagaaagacccgggggacgatttgttcgaccgattggatacgagttcgttgaaccaatacctgaaggaactgatggacggactgaccgcgaaagtgtttcgtacgtataacgcgtcgatcactctccaagaacagctggacaaactgacaaatccttccgattccgtccacgagaaaatgctttcctacaatcgtgcaaatcgtcaggtggccatcctttgtaaccatcaaagggcagtgccaaaaacgcacgaaaagtcgatggaaaatttggagaataaaataaaagagaagaagcaggagtacaaggagttgaaggatcagctgaagaagagcaaatcggtggacgagaaaatggcaaaaaaatacgaaagattgaaggaacagatcgccaaactgaacacacagcgcacggacaaggatgaaaacaaacaaattgcactgggaacctcaaaactgaactacttggatccgaggatttcggttgcatggtgcaaaaagaatgacgtgcccgttgagaaaatattcagcaaaacgcaacgcgacaaattccgctgggctctcgacatggcgaaggaggacttcattttttga

SEQ ID NO: 808 - DNA, 999 bp, Heterodera glycines
  genomic DNA sequence=SeqID_538; cDNA sequence=SeqID_583
  peptide sequence=SeqID_1050
atgatcaaaagattgacgaatggaactgagctcaaacttagtaaaaacggtacggaactcagttttcggcctggtctaattcatggaggagaattggagttcgactgtggggttcaacgttgtatcagttactttttggagcctctcattctcatggcgcctttttgcaaaaaacctttgaatgtgaatctgaccggtgttacaaattccgtcgatgaactcagcatcgacgccattcgggctacttggctcccggtcttttcccgctttgttcttgccgaccaatgcacagaaataaaaatcaaagccagaggtttcaagccgagtggcggtggttcagtgactttctccagtcccatcaaaaggaatttgcgtgctgtgcaatgcattaagccaggaaaagtttgcaagatcagaggtctcgcttacgtatgcaaagtgacgccatcaatcgcatctcgaatgattgacggagctaaaaagatgcttcacggaaacatttctgacatttacattacgattgaccagaggaagggcccccagggcggactatctcccggctttggaatcttcttgacggctgaaaccaccgaaggcgtatttttccatggagaagcgatgtcgcgccctaagggccaaaacgaagaccaaacagtgccggaagaaattggggaacaggcggcaagacgtttgctggatgaaattcatatgggaggctgtgcagattcgtcctgtcaatctttggccgccactttcatgactctctgcgacagagatgtttcgaaatttctccttggtccactcacaattaacagcgtacacacccttcggaatttgcaaatgtttttcgagcaaatgtttaaattggaggaatggtggaaggttatgaaagaaatcgtcggaaaaggcggaaatgcgatgaaaaacggaagtgaggacaaatgtttgatgacctgtgttggggttggtttcttcaacatcaacaaagaccaactttaa

SEQ ID NO: 809 - DNA, 3537 bp, Heterodera glycines
  genomic DNA sequence=SeqID_539; cDNA sequence=SeqID_584
  peptide sequence=SeqID_1051
atgttttttgacgacgatgacgaccaacagcccagggaggaatttgaaggcgatgagcaaatggatgtaaatgaatttaatattgaaacacatcaagaagcgtgttgggtggtgatttcggcttattttgacgagaagggactggtgcgacaacaacttgacagcttcgacgaatttatccaaatgagtgtgcaacgaattgttgaaaattcaccggcagtcgaattgcagacagaattgcaacatatgtccggggaaattgagacaccgacgcgtttttccttaaaatttggccaaatttacctttcgaaaccgacgcattgggagaaggatggggcgccgactccgctaatgcccaacgaagctcgcttacgaaacttgacttattcttccccgctttacgttgacattacaaaaacaatttcgcgcgagggcgaagaggaccaagttgaacagtacgagaaggtgttcattggcaaaatccccataatgctcaggtcgagctattgcatgctttccaatatgaatgatcgcgacttaaccgagctgaatgagtgtccacttgacccgggtggttattttattatcaacggcagtgaaaaagtgctaattgcacaagaaaagatggcgaccaacacagtgtacgtcttttcaatgaaagatggaaaatacatgtacagaacggagtgtcgccgtccaccatcccaattttgtgttaatatgacaaacaaaggtggaaaagctgcctctaagacaccgatgggccagaaaattgttgcagtgattccttacattaagcaggaaatcaatatcatcattcttttccgtgccctcggtttcgtctccgatcgcgacattcttgagcatatcatttatgattttgatgaccaggaaatgatggaattggtcaagccgagtctcgacgaagctgttgtcattcaagagcaaaatgttgcgctgaatttcattggaactcgtggcgcgaagccgggagtcacaaaagaacagcgaataaaatatgcgaaggaaattctacagaaggaaatgcttccccatattagcatagcggaacattgcgagaccaaaaaagcttattttatcggctatatggtccatcgtcttctattggctgcgctcggtcgtcgcgagttggatgaccgtgatcacattggcaacaaacgcttggatttggctggtccattaatggcaacgcttttccgtgctcttttccgcaacttgttaaaagaagtccgtctgactgctcaaaaatacatcaacaaaaatggcaattttaatttggatgtttgcgttcggcctacgcttatcactcgtggattgtcctattctttggcaaccggaaattggggagagcagaaaagagcgcatcaaactcgagcaggcgttagccaagtgcttaatcgactcacttacactgccacactttcgcatttgcgacgatgcaattcgcctattggacgtgaagggaaattggcaaagcctcgccaattgcacaacactcagtggggaatgatttgcccagcggagacacctgaaggccaagctgtgggcctggtcaaaaacctcgctttaatggcttacatatcagtcggttcactgcctgaaccgatcctcgaattcttagaagaatggtccatggaaaacttggaggaagtggcgccaatgtccattgcggacagcacgaaaatattcgtcaatggcgcttgggtgggcattcatcgcaatcccgaccaactgatgacaacattgctgaaattgcgtcgccaaatggacatcatcgtttccgaagtgtccatggtccgtgacattagagatcgtgaaattcgcataagtactgacgcggggcgcgtgtgtcgaccgttgttaattgtgaacgatcgcaagttggtgttgaagaagcaccacatagaacagctcaaggagagggacgtcatggacgaacagcaacagttcacttggtccgatttggtggccggcggagtggtggagcttatcgacgccatggaagaggaaactattatggttgcaatgacacccgaagacctcaaaactggtgggtactgtgaaagctacacgcattgtgagattcatccggcgatgattctcggcgtctgcgcgtctatcattccttttccggaccacaaccaaagtccccgaaacacttaccaaagtgccatgggaaaacaggcgatgggtgtttacacaaccaactttcacgttcggatggacacattggcacatgtgctgtactacccgcaaaagcccctggtgaccacgcgttccatggaatatttacgtttcaatgaactccctgccggcataaatgccatcgtcgccattctttcgtatggtggctataaccaggaggactccgtgattatgaatcaggctgggattgatcgtggtctgttccgttcggtgttttaccggtcatatcgtgattcggaacaagagattgacaatgtgaacgagcaactgattgagaagccgacgcgcgacaaatgcaaagggatgcgaaacgccatttatgagaaattggacgatgacggcatcacttcgccaggcactcgagtgtcaggtgacgatgtgatcattggaaaaacaattgctttgccggaggtggaggacgagttggaagccagcacagcgcgctactctaagaaggatgcgtcgacaacacttcgaagcagtgagacaggcattgttgaccaggtgatggtcagtgtcaacgcggagggcaacaaattcgtcaaaattcgcgtccgttcaattcgaacacctcaaatcggggacaaatttgcttcacgtcatggtcaaaagggaacaatgggaatgatgtacagacaagaggatatgcctttcacatgcgagggcataacgccggacattatcattaatccacacgctgtgccgagtcgtatgacaattggacatttgattgaatgcctccaaggaaagctttctgcaaacaaaggcgaaattggcgacgccacccctttcaacgacacagtcaatgtgcagaaaataagtgctttgcttgagggctacggctaccaattgcgtggcaatgaaataatgtacaacggatttaccgggcaaaagttgagcacacaggtgtttctgggcccaacttactaccaacggcttaagcacatggtcgaggacaaaattcactcacgcgcccgagggcctgttcaggggatgaaccgacagccaatggaaggcagggcacgtgacggtggactgcgatttggtgaaatggaaagagattgtcaaatttcacacggcgctgctcaatttttacgggagagactttttgaggtgtccgatccatacacagtttatgtgtgcaatcaatgcggattggtggtgattttcaatcaacggacgaacactttcgagtgcaaagcatgtcaaaataaaacgcaagtgtcagctgttcgaattccttacgcgtgtaagctgttgttccaggaactcatgtccatgtctatcgcaccgcgaatgatgaccaaatag

SEQ ID NO: 810 - DNA, 1474 bp, Heterodera glycines; identical to SEQ ID NO: 577
  genomic DNA sequence=SeqID_533; cDNA sequence=SeqID_577
  peptide sequence=SeqID_1052

SEQ ID NO: 811 - DNA, 2013 bp, Heterodera glycines; identical to SEQ ID NO: 547
  genomic DNA sequence=SeqID_508; cDNA sequence=SeqID_547
  peptide sequence=SeqID_1053

SEQ ID NO: 812 - DNA, 1950 bp, Heterodera glycines
  genomic DNA sequence=SeqID_515; cDNA sequence=SeqID_554
  peptide sequence=SeqID_1054
ccagctaaagctaatgcaattggtattgacctcggcacgacgtattcgtgtgttggagtcttccagcacggaaaggtggagatcatcgcgaacgaccaaggcaaccgcaccacgccgtcctatgtcgcgttcaccgacaccgaacgtttgatcggcgatgcggccaagaaccaggtggcgatgaacccatccaacaccgtgttcgacgccaaacgtctcatcggacgcaagttcgacgacccggcggtgcagtcggacatgaagcactggccgttcaaagtggtgcagggagagggtgctcgtccgaaagtgatggtggaagtcaaaggcgaggacaaagcgttcttccctgaggaggtttcgtccatggtgcttatcaagatgaaggagacggccgaggccttccttggccagactgtcacggatgcggtggtcacagtgcccgcttacttcaacgactcgcagcgtcaggccaccaaggacgcggggaccatcgccgggctgaacgtgttgcgcatcatcaacgagccgacagccgccgcgattgcctacggcttggacaagaaggggcagggtgagcgccatgtgctcattttcgacttgggcggtggcactttcgacgtgtccatccttaccatcgaggacggcatcttcgaggtgaaatcgaccgccggtgacactcatctcggtggcgaggacttcgacaatcgaatggtcaaccactttgtcgcggagttcaagcgcaagcacaagaaggacctcagttcgaaccctcgtgcgttgcgtcgtttgcgtacggcctgcgagcgcgccaagcgcactctgtccggttccacccaggccagcatcgaaattgactctctcttcgacggcatcgacttctacaccaacatcacgcgcgcccgcttcgaggagctttgcgccgaccttttccgcaacaccatggaccctgtggagaaggctttgcgcgacgcgaagatggacaagtcccagatccacgacattgtgttggtcggcggctcgactcgaattccgaaggtgcagaagcttctctccgactttttctccggcaaggagctgaacaaaagcatcaacccggacgaggcggtggcctacggagcggctgtccaggcggccattctttccggcgacaagtcggaaactgttcaggacttgctgctgcttgacgttgcccctctctccctgggcattgaaacggccggcggcgtgatgacttcactcatcaagcgcaacacgaccattccgacaaagacgtcgcagacattcaccacctattcggacaatcagcctggtgtgctgattcaggtctacgaaggcgagcgcgcgatgaccaaggacaacaacctgctgggcaagttcgagctcagcggcattccgccggcgccacgaggagtgcctcaaatcgaagtcactttcgacatcgacgccaacggcattttgaacgtgtcggcccaggacaagtctaccgggaaacagaacaagatcaccatcaccaacgacaaaggccgcctttccaaggaggaaattgagcgcatggtgcaggaggcggagaagttttccaaggaggacgaggtgcagcgtgaccgtgtgtctgccaagaacgccttggagtcctactgcttcaacatcaagcagacaatggaggactcaaatctgaaggacaagatcagcgaggacgacaagaagaaggtgctggagaagtgcggtgaggtgctggcatggctcgacgccaaccaggcggcagagaaggaggaatttgagcaccagcagaaggaactcgaagggatctgtaatcccatcatcaccaagctctaccaagccggcggcgcaatgcccggcggtccaatgcctggcggagggatgcccggaggtggcggcgctgctggtgcgggaggagccggtggaccgaccatcgaggaagtggactaa

SEQ ID NO: 813 - DNA, 1483 bp, Heterodera glycines; identical to SEQ ID NO: 548
  genomic DNA sequence=SeqID_509; cDNA sequence=SeqID_548
  peptide sequence=SeqID_1055

SEQ ID NO: 814 - DNA, 776 bp, Heterodera glycines; identical to SEQ ID NO: 549
  genomic DNA sequence=SeqID_510; cDNA sequence=SeqID_549
  peptide sequence=SeqID_1056

SEQ ID NO: 815 - DNA, 1623 bp, Heterodera glycines; identical to SEQ ID NO: 571
  genomic DNA sequence=SeqID_527; cDNA sequence=SeqID_571
  peptide sequence=SeqID_1057

SEQ ID NO: 816 - DNA, 1387 bp, Heterodera glycines; identical to SEQ ID NO: 565
  genomic DNA sequence=SeqID_524; cDNA sequence=SeqID_565
  peptide sequence=SeqID_1058

SEQ ID NO: 817 - DNA, 1506 bp, Heterodera glycines
  genomic DNA sequence=SeqID_528; cDNA sequence=SeqID_572
  peptide sequence=SeqID_1264
gcgtattttgtaatggccgctgataattttgacgctcaacgtattttgaacattttggccgagagagacaatttccaaagtaatgaactcgccgatcagttggccattgaccaccagcgactgatcggtgccatcaaaagtctgcaggtcaaagaagggttggtttgcacttcggaagtcaaaatcaaacgcatcgaattgaccacggaaggcgaggaaattatccaaaagggctcccacgagttcaatgtgtacaaaatcgtcggagaaaagggcatttccaaatcagaaattgaaaaaacatcctttggtcccatcggattgggcaaggccatgcaatgcgggtgggtgggcatggacacacgcgacggagtgcctttggtggtgcggaaggtggcaaatgccgaggacggggccaaggagcaattgaaattggtgaagaacggaaagggcgaccaattgacggcccaatgcgtggcccaactgaaaaagcgcaaatggataatggaaagcgcaattaaagccctttccgttgccaaagggccgaacttcacgacgactgtgcagaagcaggaattggatttgacttcggagatgattgcctcgggttcgtggcgtggcaagcagttcaaacagtacaatttctccgcgatgggcgtgccgcccccctccggccatctccaccctttgctcaaagtgcgtgccgaatttcgcgacattttcttccaaatgggtttctctgaaatgccaacaaatcgtttcgtggagagttccttctggaactttgacgctttgttccaaccccaacaacacccggcacgcgactcacatgacaccttttttctttcaaaaccggctctttcgacagaattcccggaggattatcttgaaagcgtcagaaaagttcattcagagggcggtttcggttccattggctatcgctacgattggaagttggaagaagcgcagaagaatttgctgaggacgcacaccaccgccgtttctgcccgtcagctttaccttctcgcacaaaaacctttccaaccgtccaaaatgttcagcatcgaccgcgtgttccgcaacgaaacattggatgccgctcacttggccgaattccaccaagttgaaggcgttgtggcagaacgaaacctctcactggcgcatgtcatcggacttttcactgaattcttcaggaaatgcggaattgaaaatctccgcttcaaacccacttacaacccgtacaccgaaccatccatggaaatttacgcttttcacaccggactgaacaaatgggtggagattggcaattcgggcatgtttaggcctgagatgttgcttccgatgggacttccggaagatgttgccgtggctgggttcggtctctctcgaacgaggccaaccatgatcagatacggcatttccaacataagagagctttttggccataagattgatctcgaaatgatctacagaaaccctttgtgcaggttggagcagaaaaactag

SEQ ID NO: 818 - DNA, 282 bp, Heterodera glycines; identical to SEQ ID NO: 585
  genomic DNA sequence=SeqID_540; cDNA sequence=SeqID_585
  peptide sequence=SeqID_1235

SEQ ID NO: 819 - DNA, 450 bp, Heterodera glycines; identical to SEQ ID NO: 555
  genomic DNA sequence=SeqID_516; cDNA sequence=SeqID_555
  peptide sequence=SeqID_1059

SEQ ID NO: 820 - DNA, 1245 bp, Heterodera glycines; identical to SEQ ID NO: 578
  genomic DNA sequence=SeqID_338; cDNA sequence=SeqID_578
  peptide sequence=SeqID_1060

SEQ ID NO: 821 - DNA, 1272 bp, Heterodera glycines
  genomic DNA sequence=SeqID_534; cDNA sequence=SeqID_579
  peptide sequence=SeqID_1061
gaaaaaacggcggacctccacaaagttgaggacgccttcgtacctctgatcaaactgcgctacgatggcattgaactcgacattttattcgctcgtttggcgttgaaagaaataaaggaagaccaggaactctcagacgacaatttgcttaagaacttggacgagaagagcattcgttctctgaatggttgtcgtgtggccgatgaaattttgcgattggtcccaaatcgactgaatttcattttggttcttagagccgttaagctttgggctaaaaaccatggcatttattccaatgtgttgggctttcttggcggcatttcttgggcaattctcgtcgcccggacctgtcaattgtatccaaatgcaacaccttctgttttattgcagaaatttttcctcgttttttctgcatgggattggccacatcccgtcattctgaaggatgtcgacgctaccccgcggattgacataccctatttcattgacatgatttgggatccgagaacacgcgcatcggaccgctaccatttgatgccaatcattacgccagccttcccagaacagaattccacatttaatgtgacaaggtcaacgagacaagtgatgaccaatgaattcaaagaaggcctagacaatatgctagaaatattcaatggacatgccacttggaaaaagctattcgaggaagtcaattttttcactcgctacaaacatttcattgcgctgctttgtctcaccgaaaatgaggaggaccacctgaacttttgcgggttggttgagtccaaaatccgccatttggtggcgtccttcgagcggaattcctgcgtgaatctttgccatgtcaatccccggcagtataaacccgcatacaaattggagctcgacatcgattacgagaaccccgtgtgcactttgtggttcatcggattggacctgaacaagcaacttacgaaaaaaattgatctcacagaagagttgcagggatttacggacaccgtttacaaaagtgcgtccgtgctgaaggacttcaaagaaacgatgagaattcacccctcttacacgcgccaaaggaatctcatcaaatggctttccaaggaggacttggaccggggtagacgagcggaacgacgctgctccgccgcggcggcttctccacgcgtgtccatgctaaacaattccctggactcaaccggaaaatcattggacaccagcggaagcaattcacccgcttctgccgaagagccgtccctgaagaaactaagagtctaa

SEQ ID NO: 822 - DNA, 360 bp, Heterodera glycines
  genomic DNA sequence=SeqID_517; cDNA sequence=SeqID_556
  peptide sequence=SeqID_1062
gcctaccctttggcggatattcaactttctcagaagttgcttgatcttgttcagcaggcaacgaactatcatcaattgaaaaagggtgctaatgaggcaaccaaaacactgaaccgaggcattgctgaggtgatcattttggcagctgatgcagaaccattggaaatcattttgcatttgccattgttgtgcgaagacaaaaacgtcccatatgtattcgtgaaaagcaaggctgcacttgggcgtgcatgcggtgtgactcggccggtgatcgcaacttcgatcattcaaaatgaaggatctcagttgaagtctcagattcagaagattaaagaagatgtggaaaagttacttatttga

SEQ ID NO: 823 - DNA, 2481 bp, Heterodera glycines
  genomic DNA sequence=SeqID_503; cDNA sequence=SeqID_566
  peptide sequence=SeqID_1063
atggcaaatgttgttgaaatgacaattgagaaaattgatgaagtcaaatcaagactaggaaggacattgggtgcgtcgatgcgcttgcgtgatttgattcgtcaagtccgagcggcacgaacagcggccgaggaacgggcagtggtggagaaagaaagtgcaaacatcagagattccttcagggacgacgacaacaaatacaaatgcaggaatatggctaaacttctctatattcacatgcttggttatcctgcacatttcggacaagttgaatgtgttaaattggtgggcagcaaggataaacgattcactgacgttcgaattggttatttgggcgccatgcttttgttggatgagcgttccgaaattcatttacttgttacaaattgcttaaagggccatttaaatgatccggaacaattcgtcgccggtttggctttatgtactcttggctcaatttgttcggcggaaatgtgtcgagatttggcaagcgaagttgagaagcttttattgaagtcgactaacacctacctcaagaaaaaggccgctctgtgtgcgtttcgtatcgtccgaaaggtccccgaccttattgaaatgtttatctccagcacacgctcattgctcaacgaaaaacaccacggtgtactaatggcgggcattacactcgtctcggaaatgtgcgatttgagtgccgatgtacgcattcacttcaaaaagatggtgcctaatttggtgcgcatactcaaaaacttgctgatgaatgagtattctgctgagcatgacgtcgctggtataagtgacccatttttgcaggtcaaaattctcaggctattgaggattttgggcagagatgacccacgggtcagtgaagagatgaatgacattttggcacaggtggcgacgaatacggaaacgacgaaaaatgttggcaatgccattttatatgaaacagtattgactataatggaaacaaaaagtgaaagcggcttgcgagttttggccgtgaacattttgggtcgttttttgcttaacaccgacaaaaacattcgatatgttgcacttaacactctgctcaaaactgttgcaattgatttccaagcagtgcaaaggcatcgcaccactgtggtggaatgtctgaaggatgccgacatttccatcaaaaagagggctcttgaactttgctttgcccttatgaaccaaacgaacatcgcgagcatgtccaaggagattataattttcctcgaaactgccgactccgatttcaaagctgagtgttcttctaaaatgtacgttgcgacggagcgcttctccccgagtcttgtttggcatttggacacaatgataaacgtgctgcaattggcagctaaccatgtacctgatgaagttgtcagtgcgatgattcagctcatctcttcccagcaggaactgcagcattacgcaaccgtccaattgtttcatgcctccaaacgggaacacatagtaaatgctcagcccttaatgcaaatcgcattttggagcattggcgaattcggtgatttgcttgtcactccgggaaatacggaggaggcaaatgtgagcgaggatgaagtggtggaattgttcgaacttttgatgcctcatccacagctcactgtgccaacccgtgagtatggactaactgcacttgccaaacttagcacgcgattcgactcgcacgccgaacaaattcatgcgttaatacgacaatattcggcacacatgaatttggagctgcaacaacgttccgttgaattctcacgattactgtcaaaggatgaactgaggaatgggctgctggagcgaatgcccgccattgaacacaatgcccttcacaccgcagcgacgccaattgaaatggacgataatcaccaggaattaatagtggcgcaaaaagaacaccaaagccaaaaaccgaaggccgatgaaattgacttgctcgggttgggcaatacggattctcctgctttggttgacattctcttcggcggggttccaaatgtgcagcccctttcaagaaatattggcaaagaccccatcgacgacctttttagttttgagtccagtaataaaaacggtgcccttgtggaagatgatcagttgaaaacgggtcaaatcgtgctcaaccagcgtggtatcgagatgcaattattcgtggattccaacggattcgactccaatggattggcacaattgcggtttcaaacagttaacaatacccccgctggagtagaagatttcaatttggcagtggccgttacaaaagcttatcaaattgaattgcttccggcgaattcgacgagtcttcaggccaatgctttgtccacgataagccaaaaggcgaatttgcggcggctggcaaattcgaaagcgcctcgtctacgactcagaatcagttatcggttggcgggtgccttgaatacaattgacgctgaagtgacgagcatcgcctgcctcgcctcctaa

SEQ ID NO: 824 - DNA, 4394 bp, Heterodera glycines; identical to SEQ ID NO: 567
  genomic DNA sequence=SeqID_502; cDNA sequence=SeqID_567
  peptide sequence=SeqID_1064

SEQ ID NO: 825 - DNA, 1410 bp, Heterodera glycines; identical to SEQ ID NO: 586
  genomic DNA sequence=SeqID_541; cDNA sequence=SeqID_586
  peptide sequence=SeqID_1065

SEQ ID NO: 826 - DNA, 486 bp, Heterodera glycines; identical to SEQ ID NO: 557
  genomic DNA sequence=SeqID_518; cDNA sequence=SeqID_557
  peptide sequence=SeqID_1066

SEQ ID NO: 827 - DNA, 532 bp, Heterodera glycines
  genomic DNA sequence=SeqID_529; cDNA sequence=SeqID_573
  peptide sequence=SeqID_1067
atggcctccaaatttgtattcagtcttcgcttttcctacccaaggctcttaaccagcagtgccctcaacaacaaaaaattggtgccaaatctcattcagtctcggtcaattgtgaccaaatttgacctggaattgcctgacgattacccggagccttggccctacaaacaatggggcttcaaccaattcatgcaacatcttgacaaaacgctgaagcgttggcacatcaactcgaaactgatcgttttcgaaagcaacattggcgtgggccggtcgtcgatcgcaaaggaattggccgatgcgttgggcttttattatatgccggcctttaaaatggacgacattttggttgaccgttacaacaatgacatgcgcgactattatcatttgtttccgaaacgctttcggttcccggacatcaacatgttctacaaggacccggccgacgaccaaacggccgtcatgcaagatctgatgtacgactgccgttgggagcagtacctaaacgcacaggcgcaccttttcaacacgg

SEQ ID NO: 828 - DNA, 492 bp, Heterodera glycines; identical to SEQ ID NO: 574
  genomic DNA sequence=SeqID_530; cDNA sequence=SeqID_574
  peptide sequence=SeqID_1068

SEQ ID NO: 829 - DNA, 1653 bp, Heterodera glycines
  genomic DNA sequence=SeqID_343; cDNA sequence=SeqID_646
  peptide sequence=SeqID_1069
atggcgctttcaattccaaagtcagggtattcccgctttatgaaggagggggccatgcacttcaaagggttggaagaagcagtgaaaagaaatattgaagcttgcatgcaacttgcacttcagacgcgttctgcttatggaccaaatgggatgaacaaaatggtgatcaatcgtttggagaaacttttcgtcaccaacgacgccgtttcgattctcaatgaactcgaagtgcagcatccggcagcccgaattttggtgatggctgcacaaatgcaggaaaagcaaattggcgacaacactaacactgtggtcattttggctgcatcgtttctggagcacgcactgcaattgcttgacatgggaatcaccgcagtagaaattgcgtcgggttacgaattcgcgcttcaaaaagtcgaggagctcttgccgggattggttgtttccactgctgaggatttatatgacattgtcaaagttcgatcctatctcaaatcgtcgcttatctcaaaacaaacggaccattacgagttaatttctgatcttgttgcgaaagcttgtgttcaaataatgccaaaaaacaataccactgcgttcaatgtcgataacattcgaatctgcaaaattcttggcgccggagtggccagttcgtacgtgacaaatggaatgctttttcgccgtggtgctgaaggcgaagttaaaggcgcgtcaaatgcgcgtgtggtcgttttcgcgtgtccatttgaccttacgcaaaccgaaacaaaggggactattttgatgaacacggcggatgatttgttgcaattcagcaggacagaggagtccgaagtggaagcccaagtgaaaagtctttcggatgtcggcgttaatgttgtggtcgctgccggcaaatttggagacctttacgtgcattttttgaacaaatatggaattatggccgtaagattgacttcgaaattcgatttgcgaagactttgccgaactttgggtgcccaggcgcaggcgcgcatttgtgcaccgtcagaagaagcaattggccattgtgacgaagtgtttcttaaggaaattggcgacactcaggttgtggttttcgataagaaaagcgaagttgggaaagttgccacaattgttgtccgtgggtcttcccagtcgttggtggatgacattgagagggcaatcgacgacgcggtgaacacttacaaagcgctgactcgagacaacaaactgttgccgggtgctggtgcaactgaagtggaattaagccaccaaattgaaattattggcgagaaggaatcgggacttcgacaatatgcgatcaaaaaatacgctactgctttggacattttgccaaaacaattggccgaaaatgcagggcttaagccaactgaaacactcaccgatttacacgcagcgcaccaaaaggggtcgaaatgggagggagtggacgcggtcagtggaaagttgtgcaacgcgatggaagcgggcattttcgacctttactccgggaaatcgttggcattaaaattggcgacgaacgcggccatttctgtgctgaagattgatcagataatcatggccaaaccgatgggcggcataaagccaagggcacccaaagggcaggacgacgacgacgatgacactgggatggcttaa

SEQ ID NO: 830 - DNA, 1383 bp, Heterodera glycines; identical to SEQ ID NO: 684
  genomic DNA sequence=SeqID_414; cDNA sequence=SeqID_684
  peptide sequence=SeqID_1070

SEQ ID NO: 831 - DNA, 362 bp, Heterodera glycines; identical to SEQ ID NO: 637
  genomic DNA sequence=SeqID_488; cDNA sequence=SeqID_637
  peptide sequence=SeqID_1071

SEQ ID NO: 832 - DNA, 1173 bp, Heterodera glycines
  genomic DNA sequence=SeqID_351; cDNA sequence=SeqID_668
  peptide sequence=SeqID_1072
atgggaagacccgaattttctccacgcggtggcggcggacgaggaggtgagaagagaaatcgcaaaggtttccgaggccgtggcggtggtggtgaccgtgggggcagaggcggtggtggtcgaggcttccgtgggggcggtggtggtggcggttttcgtcagagcaacggggagggaggcggcggtggcggagggtttaagggtggtcgaggaggcagtccacgcggtggtggtggcggtcggggaggcggtggttcgccgcgcggacgcggtggctcgccacgtggacgcggcggttcaccccgcgggggtggcgccggcggaggcatgcgcgggggacgcaaggtcattgtggagccgcaccggatcagaggcattttcatcgtcaagggcaaggaggacgcgctgtgcacgctgaacatggtgccgggcgagtcggtgtacggcgagaagcgcatctcctcccagcagaccgaaaatgcgccgattgctgcaataacgccgaagacggaagagacaacgaatggcagcaacggtgtctcagcacccaccgccgcggctgccggcccggcaccgccagtcgagtaccgggtgtggaacccgttccgctccaaactggccgccgccgtcatggccggcattgaggacacgcacatttacccgggtgcccgtgtgctttatcttggcgccgcttccggcacttccgtttcccatgtgtccgacatcgttggacccgaaggcatggtctatgcagttgagttttcacatcgcagtggacgtgacctgctcggcatggccaagaagcggcccaacgtggtgccaattgtggacgacgcacggcacccgcacaaatactccatgatgattggcattgtggacacaattttctcggacgtggcacagccggaccaggcacggattgtggcacacaatgcgcacaaatttctgaagaacaacggccatgtggtcatctccatcaaggcgaactgtgtggacagcacggcggagccggaggcggtgtttgccggcgaagtgaacaaattgcgcgaggagcagttcaaacccattgagcaggtaacactcgagccgtacgaacgtgaccacgcggtggtggtggccgagtaccgagccgccaaaaagaaggtcaagaaggaaaaaatggaggaggagtaa

SEQ ID NO: 833 - DNA, 1305 bp, Heterodera glycines
  genomic DNA sequence=SeqID_477; cDNA sequence=SeqID_774
  peptide sequence=SeqID_1073
atggcttcttccgaaggtgaagccgatcacaatgttgagctctggaaaatcaagcgtcttataaagtcacttgaaatggccaaaggaaatggtacttcgatgatttccctgatcattccgccaagagaccaaattgctcgtatccagaaaatgcttggagacgaatttggaacagcgtccaacataaagtcgcgagtcaacagactctctgttttgggggcaatcacttcagtccaggcgaggttaaagctttatacaagagtgcccgagaatggattggttgtttattgtggaacgattgtcacagaggacggaaaggaaaagaaagtgaacatcgattttgaacccttcaaagcagtgaacacatcactttatctatgcgacaacaaattccacactgaagcattgaatggcctactcgctgacgacaacaaattcgggtttattgtgatggacggaaacggatcactttttgggactttgcaaggaaatgccagggaggtgctacacaaattctctgtcgaattacctaagaagcatggaaggggagggcaatctgcactgcgatttgcaaggttgcgcatggaaaagcgacacaattacgtcagaaaagtggcggagacggccgttgaaatgttcatcaaaaacgacaaagtcgcggtggtgggcctcgtcctggccggaagtgctgattttaagaatgaactcgcccagtccgacatgtttgaccaacgattacaggcaaaaataatcaaaactgtcgacatatcatacggcggtgaaaacgggttcaaccaagcgatagatttggcagccgatgctttggcggatgttaaattcatcaaggagaagaaactgatcagcgcctttttcgacgagatttcccaagacactaacaaggcaatttacggggtaaaagaaacactgacagcattggaaatgggcgccatcgaaactctgatttgttgggagaatttggatctgataagatacgcattccgaacaaccaatggtgaaaaagtcgttaatctgaagcccgacgagaaggaccggtcgaactttgtggacccggagactggaactgactacgagattgagtccagcacgccattattggaatggctcgctaacaattacaaacgattcggtgcggcacttgaaattgtcaccgacaaatcgcaggaaggagcgcagtttgtacgcggttttggaggacttggaggtgtccttcgttattcggtggacattccgcagttggatgagctcgagaacggagtagacgagatcgacctcagcgagtactga

SEQ ID NO: 834 - DNA, 621 bp, Heterodera glycines; identical to SEQ ID NO: 753
  genomic DNA sequence=SeqID_464; cDNA sequence=SeqID_753
  peptide sequence=SeqID_1074

SEQ ID NO: 835 - DNA, 1383 bp, Heterodera glycines; identical to SEQ ID NO: 688
  genomic DNA sequence=SeqID_355; cDNA sequence=SeqID_688
  peptide sequence=SeqID_1075

SEQ ID NO: 836 - DNA, 606 bp, Heterodera glycines; identical to SEQ ID NO: 743
  genomic DNA sequence=SeqID_456; cDNA sequence=SeqID_743
  peptide sequence=SeqID_1076

SEQ ID NO: 837 - DNA, 1543 bp, Heterodera glycines
  genomic DNA sequence=SeqID_345; cDNA sequence=SeqID_648
  peptide sequence=SeqID_1077
gaataaccatcatccaactgtaaatggaaatggctttggcttgaccaatgggacacatttcgctgatgacttttctgagtccattaaagacgttggtattattggcatcgaactttactttccaaaatcctacgtgaaccaagaagaccttgaaaaatttgacaatgttacatcaaataaatacgtgctgggacttggccaacaagaaatgtgcttttgccatgagaatgaagatgtttgttcactttcgctgactgttgcagctgcactgatggacaattacaaggtcaatccaaaggacattggctttctcgcggttggcaccgaaacattggtcgacaaaagcaaaagtgtgaagtcagtgttaatggatttgtttgccgattcgggcaacatggacttggagggcgccgacgagaaaaacgcgtgtttcggtgggacccaggcgttgtttcatgccgtcgattggatgtacgctaattacgcaacagaaaaacgccttgccatcgttgtctgtgctgatgtggcagtttattcggctgggcccgcccgatgtacgggcggtgccggtgcagtggcctttctgattggaccaaatgcaccgattgcacttgaacgtggccttagggcatgccattctcaaaatgtttacgacttttacaagccaattggaggcgttagcacgcaattcccacgagtggacgggccaaacagtgtggagacctatttgaacgccgttgacatgtgttacgggcgattttgtgagaaatggaacaagaaattctgcacagggcccccttgctctctttcggattttgtcgctgtcattttccactcgccgtacgctcgtctcacccaaaaagccttttcttggctgtccttcgtcgactttaaacggggaatgatggacgatggtgtcacagctgatgatgatgatgtgtctgattgggatcaactcagcgcatacaaatcgaaatcactccatgagatttttgcggtggaacgcacaaaaactcgctcggacggcgatcgatttactgacaaaattttgcggatgagttcgcggacagcggatgccaaactgaatccatttttggagtttagtcgacgcattgggaacatgtacacgccgtcggtatatgctcagctgatcaacgtctttctgaacactgaactttccgataaatcgaacgggaaacggatcctcatattttcttatggcagcggttgtatcgccgcaatgtactcacttcgtttcaatttgtacacggaaaaactgatggctgcctacggcgcaattaaacaaagcgcgaaaaaggcacacgcgcgattggaccagcggatccgacacagccccaagcagtttacagccgcattggagagaacggagcaaattgtcgctggaggggatacttacatcgaaactcccgatgatggcaaacgcagtgatggcattccaatgtttgccgggaccttttatttgcgagaaatcgactcaaaacagagacgcttttatggccaaattgatgatgccaatgagtga

SEQ ID NO: 838 - DNA, 2619 bp, Heterodera glycines; identical to SEQ ID NO: 596
  genomic DNA sequence=SeqID_310; cDNA sequence=SeqID_596
  peptide sequence=SeqID_1078

SEQ ID NO: 839 - DNA, 1833 bp, Heterodera glycines; identical to SEQ ID NO: 587
  genomic DNA sequence=SeqID_301; cDNA sequence=SeqID_587
  peptide sequence=SeqID_1079

SEQ ID NO: 840 - DNA, 2980 bp, Heterodera glycines
  genomic DNA sequence=SeqID_420; cDNA sequence=SeqID_695
  peptide sequence=SeqID_1236
ccaatcaaagcatgtgctgacaaactggttgagggaaattgaacaatttggcaatccgccagtgtttggctaccaaagcagcgaagaaatgtcaaaaaacgggacagaattagcgaaacaggaggaggaagtggaccaaatcattaaggacaagagcaagggcaaaaagagcaaggctttggcgaaaactgtggctgccaaattccaatggcaaattatgcaatcgttgggcctcaacgacgcagaaattgccgagttttccaaatccgagcattggctgacctatttcccgcccaagtgtatggcggacctgcgcaaaatgggccttgcggtggactggcgacgtgccttcatcaccacagaggcaaatgcctatttcgactcattcgtgcagtggcaattccgaaagttgcgctcagaaaatctcatccaattcggcaaaaggtacaccatttactctcccaaggatggccagccgtgtatggaccacgaccgttccaccggcgaaggggtcggcccgcaagagtacactttgatcaaaatgcagattctggagcccaaacccaaagttctgtccaatgtctctgcttccaatggtaagccaatgtttttggtggccgccactctccgccccgaaacgatgtacggccaaacgaattgcttcatccatcccgacatcacttactccgtgttttttgtgggtacaaacgaccaagagattttcatcgcaacggaaagggccgctcggaacatggcttaccagggcatgacggcggagaacggaaaaattcgctttgtgcccggcgtggaaagagtgaagggcgcggaattgattggctgtgcgttgaaggcgccgttgacgagttttgagcgtatttacgcactaccaatgctaacgatcaaagacgacaaaggcactggcattgtgaccagcgttccgtccgacgcacccgacgactttgccgcactgatggacctgaagaaaaagaagcctttgcgcgagaagtacggcatccttgacgagatggtgatgccatttgagcccatcccaatcctcgagattcccgagtatggtcgtcttgccgctgtgcacatgtgcgaaaagttgggcatcaacagccaaaacgatcgactgaaattggaagaggcgaagaaggagctgtacctaaagggcttttaccagggggtgatgttggtcggcaattaccgggaccagaagacggaggtggtcaagaagctgatccaagccgacatgatccgggatgggcaggcgtgcaaatatgtcgaacctgagaagaaagtgatctctcggtcgggcgacgaatgtgtggtggcattgtgcgaccaatggtaccttaactacggggacccggcatggaaagaagcgactcgcaaatgtttggcttcgcttaacactttttcggatgaagtgcggcgcaactttgagcacaccatcgaatggctgcatgaatacgcttgttctcgctcgtttggacttggcactaaacttccatgggacccacaatatttgatcgagtcgctttccgacagtaccatttacaacgcttattacactgtttcgcatttgctgcaaaatgatatttacggtgctgaaacgggtgaactcggcattttaccacctcaactgactgacgctgtttgggattacatattcatgggtaatttatatgattcgactaaaatgccaattgaagaagcaaaactgaagagaatgaggcacgagtttgagtattggtaccccgtcgatatgagggtttccggcaaagatttgatccaaaatcatctcacttattacattttcaaccacgtggcaatttggcgtaaacagccgcagttttggccgcagggaattcgtgcaaatggacatttgttgttgaacaatgaaaagatgtcaaaaaatactggcaattttcttacgctttttgatgcaattgaacttttttctgccgatggaatgcgattcactttggctgacgccggagacggaatcgaagatgccaatttcatgtacgaaatggctgatgcgggcattctccgcttgtacgcctttctctcgtgggcttcagaaatggtcgaagcatgtgccaagggcgaattgcgcaaggacggcatcgagacttttgcggacaaaatattcaacaatgaaatgaaccgtctcattttggttaccggcgaccattttgagcgtactcttttcaaggaagcactgaagaccggctttttcgagtatcagttggcccgtgacaattatcggcagctctgcgggagtgaccaggcaatgagtgccgtgttggtgttacgcttcatcgaaacacaagcgattattctttcgccgatttgtcctcatgtttctgaacgtgcctgggaattgttgggaaagcccggccttctcgtgaccgatgctcgctggcccgtcactgctcctgccattccgttgctcgtcgaccagagcaacttcatccacaacaccgtgcacgagtttcggctaaggcgcgacgcgaagctgtgcccgaagaaaaaggacccgaaaaagcaattgcaacctccgaagtcggcaacaatttacatcgcaaaacgctatccgtcatggaggggaaaactcatcttggaattgggacaaatgtacacggtcaacaacggcactcttccggacaaccgaacactgctcgaaaagctgagcaaaccagaatccgcggaagagaagaaggagcgcatgtcgttcgtacagatgttccgcgatcgcattgctcagcgtggcatttttgcggtgacgtcggaagaggaattcgaccagaaggcagcgctcagccaaatcagcgactttttgctctcgactttacaactggaggaggtgaaattcgctgattcggccaacgctccctccgatgtcatccgaaattcgtgctgtcccggcgcaccgttaataatgtacgactttgttgagacaacaaacaattag

SEQ ID NO: 841 - DNA, 759 bp, Heterodera glycines
  genomic DNA sequence=SeqID_344; cDNA sequence=SeqID_647
  peptide sequence=SeqID_1080
atgctcaggaaaaccataaaaacacttcaaccgatatataacgccagaacagcattccgttttcagaccggaggttatgctgcgcctggtactgaagcacaagcacaggaagtaaaaaaacagacaagcacaaaatacgtgattgatgaacaaaagcgggagaagctgactctcttcggtcaatatgtagccgcatgtatgcccaaattcgtccagcaagttcagtttgctggtggggatgaattggaagttctgatccacccaactggtgtcctgcccgttatggccttcctcaaagggcatcactcggcccaattcacaaattttattttcgcttgtggcttggacgttcctacgcttcggacatacactgacgaagttgctccaatcgattccatcactccagtcttttccggtgctgaatggtatgaacgtgaaatctacgacatgtacggggtttggttcaacaaccacccagacttaagacgtattttgaccgattacgggtttgaaggtcatccccagcgaaaagacttcccattgtccggatacgtcgaactgcgttgggaccacgagctgaaccgagtgatttatgagccaaccgaaatgacacaagagttccggaagtttgacttgaacacaccgtgggaggttttccctgcatttcgtgacgaatcgataacctccggatacaatgtcattcaaaaggcaggcaaaattgaggccaaaaagcttgatgatgcttccaaaaaaccgtaa

SEQ ID NO: 842 - DNA, 2208 bp, Heterodera glycines; identical to SEQ ID NO: 730
  genomic DNA sequence=SeqID_445; cDNA sequence=SeqID_730
  peptide sequence=SeqID_1081

SEQ ID NO: 843 - DNA, 1488 bp, Heterodera glycines; identical to SEQ ID NO: 711
  genomic DNA sequence=SeqID_499; cDNA sequence=SeqID_711
  peptide sequence=SeqID_1082

SEQ ID NO: 844 - DNA, 1185 bp, Heterodera glycines; identical to SEQ ID NO: 657
  genomic DNA sequence=SeqID_346; cDNA sequence=SeqID_657
  peptide sequence=SeqID_1083

SEQ ID NO: 845 - DNA, 885 bp, Heterodera glycines
  genomic DNA sequence=SeqID_429; cDNA sequence=SeqID_708
  peptide sequence=SeqID_1084
attctgttgccaaattcgtgtctcgacaatttgatgcgtcgcaacattcagtacccgatgctcttcaaattgactaatgtcggcccggcccttcagaggggcacccatgccggtgtgctggagtttctggcggaagaaggccgctgctatttaccttcctggatgatggcccaactcgctctgagggagggcgacctcatcaccgtggagtacaaagcgctcccgaatgccacttacgccaagttcaagccgatgtccaccgacttttacaacatttcaaatccccgtgccatgctcgaggtcgaactgcgcaagttttcctgtctgaccaaaggcgatgtcatcgcagtgcagtacaacgaacaagtgtacgaattccaagtgaaggcactgaagccggaaaatgcggtgaccatcgtcgagtgtgacataaacattgaatttgacgctgcggaaggctacgtggagccgaacagaacgcatcaacaacggaatgagatggtcgcagcggaggaagagcagcagtcgcatccacccaacgtgttcaaaccgttctccgggtcagggtttcgtgtcgatgggaagaagccgcgatcggtctcaacaagttcacagcaggaggcgacgagcagctcatcctcttcggcatcttccgggcgacagccttcctctgggattgcttcgactgcgtccactgcgcgtgacgctttggaggcaattgctgtggacgaaaattacatccctggggagttgcgttttgtgcgtcgtccgtacaaaagcaaggcacaaagggacaaagaggcgcgcgaaaaggacaacggagggacgatgaagccattcggaggcgaagggaacacaatccgaccgacgcgaggcggacaatga

SEQ ID NO: 846 - DNA, 1631 bp, Heterodera glycines
  genomic DNA sequence=SeqID_342; cDNA sequence=SeqID_645
  peptide sequence=SeqID_1237
atgactacgacagcgcctattgcgacagaagagggtgaggacagtttgtaccctatcgctgtgcttattgatgagcttcgtaacgaagatgttcagcttcgtctcaactcaatccgtaaattgtcgacgattgctttggcattgggcgttgaacgaacgcgcaaagaattgattcaattccttacagacaccatttatgacgaggatgaagttctattggcattggccgaacaattggggaatttcactccgttggttggcggacctgagtatgtgcactgtttgctgccgccacttgaaaatttggcgaacattgaggagactgtcgtgcgtgacaaagcggtggaatcgttgcaaaaaatagcagaaaaacacagtgcagctcaactcgaggaatatttcattccgatggttctgcgattgtcagctggtgattggtttacttcgcgcacctccgcttgcggattgttcagcgtggcatacgctcgtgccaatcctgctcaaaaaactgaattacgtgccgcattccggtgcctctgtcgcgacgatacaccgatggttcgccgtgctgccgcatccaaattgggcgactttgccaaagtgcaggaggaggactatttgaaaaatgaaatcacccaaatgtttgaggacttggccaaggacgaacaagactctgttcgactgctttcagttgaggctggcattgtgatcgttggtctgttgtccgaagactcggcaaaattggcccaagtgaaaccgatcgctgtttcgttggtgcaggacaaatcctggcgtgttcgttatatggcagctgataaaattgttcaaattcagcaagcattcggtaccaaaattggcattgaagaaattgtcggatggtacaccggacttttgaaggactgcgagggcgaagtacgcgatgcagcggcagagaaactacaatcattctgtgctgctctgtcggaggaaggccgaaaaaagggaatcattgaagaaattttgccagtgattcgaccactaacaactgacgcgaatcagcatgtcaaaattgcgttggctcaggttgtgatgggattggcgcctctgctcggcaaccaatgcaccattgagcatttgttgcctatttttttgtcaatgcttcgtgatgatacacccgaagttcgcttgaacatcatttcttcattggaaaaggtcagcgatgttattggtgcagatgagctccaatactcacttttgcccgccatcatcgacttagcacaagatggaaagtggcgagttcgcttggccatcgtggaatacatgccgttgcttgccaaacaacttggccagaaattttttgacgagaaattgcttaaactgtgcatgaattggttgacggatcacgtttatgccattcgcgaggctgccacaaacattttgaaggaattagcgcagaaattcggtgccgaatgggccgtcactatggttttgccccgtgtgattgaacttgcttctgacagcaactatctgcgtcggatgacttgtctcttctgtttcaacactttgtgtgaagcattgaacaacgacgcaattatgaaggaacttttcccaacgataaaagcgctttgccatgatcaggtgtcaaacgtgcg

SEQ ID NO: 847 - DNA, 1239 bp, Heterodera glycines; identical to SEQ ID NO: 642
  genomic DNA sequence=SeqID_390; cDNA sequence=SeqID_642
  peptide sequence=SeqID_1085

SEQ ID NO: 848 - DNA, 906 bp, Heterodera glycines; identical to SEQ ID NO: 771
  genomic DNA sequence=SeqID_476; cDNA sequence=SeqID_771
  peptide sequence=SeqID_1086

SEQ ID NO: 849 - DNA, 1785 bp, Heterodera glycines; identical to SEQ ID NO: 588
  genomic DNA sequence=SeqID_302; cDNA sequence=SeqID_588
  peptide sequence=SeqID_1087

SEQ ID NO: 850 - DNA, 1090 bp, Heterodera glycines; identical to SEQ ID NO: 608
  genomic DNA sequence=SeqID_322; cDNA sequence=SeqID_608
  peptide sequence=SeqID_1088

SEQ ID NO: 851 - DNA, 584 bp, Heterodera glycines; identical to SEQ ID NO: 691
  genomic DNA sequence=SeqID_358; cDNA sequence=SeqID_691
  peptide sequence=SeqID_1089

SEQ ID NO: 852 - DNA, 358 bp, Heterodera glycines
  genomic DNA sequence=SeqID_431; cDNA sequence=SeqID_713
  peptide sequence=SeqID_1090
atgacgaaaaagagacgcaacaacggacgcaacaaaaagggacgcggccacgtgcagcccatccgttgcaccaactgcggccgctcatgtccaaaggacaaagccatcaaaaagtttgtcgtccgcaatattgtcgaggcggcagccgtccgcgacatcactgacgcgtcggtttacgatcaatacgcactgccgaaactctatcacaaattgcactattgtgtctcgtgtgccattcacagcaaagtcgtgcgcaatcgttcgcgtgaagcgcgtaaggaccgaaacccaccgccacgttttggccaacggtctgccgtcgatcgtccgcaacgtccggggggagcggcccctggag

SEQ ID NO: 853 - DNA, 924 bp, Heterodera glycines; identical to SEQ ID NO: 686
  genomic DNA sequence=SeqID_416; cDNA sequence=SeqID_686
  peptide sequence=SeqID_1091

SEQ ID NO: 854 - DNA, 1161 bp, Heterodera glycines
  genomic DNA sequence=SeqID_436; cDNA sequence=SeqID_719
  peptide sequence=SeqID_1092
atggcagcagcggaatttgctcgtaagcttcagctcatccaggcggcatcgaccagttcatcggctgtaagagatccattcgaagcaaagcatcacaaataccaattttggaacacacaacccgtcccaaaattaagtaggcggattgcattaaccgaaaacaattacattgatcctccgcttgatgtttcgaccataaaaaaagatccgtattcattgttggaaaagtttatttggtctgacattgatctcaacgcggatgaacaattggatgagctgtacattcttttgaccgagaattatgttgaggacgacgcgaatatgtttcgcttcgattatgggaaaaattttctgaaatgggcactgatgccacacggttggcagcaacaatggcattgtggggtaagggccgttacttccggaaaattggtggcatttatcgctgctgttcctgccacaattcgaatttatgacaaaaccgtcaaatctgtcgaaataaatttcctttgtgtgcacaaaaagctgcgaaccaaaagactggcgccagtgctaatcaaagaaatcacccgacgagtcaatttgtttgggatttttcaagcgactttcaccgctgggattttcattcctaagccagtgggcatttgccggtattggcaccggtcattgaacccgaaaaagctcgtcgagtcaagtttttcgcatattggcaaaaatatgacgcttcctcgtatgataaaattgtataaactgcccgaaaacaccgagtctcaattgacgctactcaacagagattctgccaaaagcgccttcgaattgctcagcggatatttgaccaaattcgacttggtccccatcttcaccatcgaagagttcgaacatttcttcctgccccgcgatgatgtcatttacacttatatgattcagaacaacggagaggtcaccgacttggtcagcttctacagccttccctccacagtgatgcaccattcccaccacaaaagcataaaggcggcttattctttctacaatgtcgccgggagtgttccgctcagccaccttttgaacgatgcgttgattttggcaagaaatgttcgtttttttctttttgtttccgttcgtttgggtatatccaaatttgtttcacaatcagcttggctttga

SEQ ID NO: 855 - DNA, 1305 bp, Heterodera glycines
  genomic DNA sequence=SeqID_484; cDNA sequence=SeqID_784
  peptide sequence=SeqID_1093
atgtctgtgcctggctctcaacctccgcaacagggtgaggacgccgaggagcggctgatcaacgaggagtacaaaatctggaagaaaaactgcccgttcctttacgacatggtgatgactcatgcgttggaatggcccagtttgaccgtccaatggctgcccgacgtgcaacgacaggagggcgccgactacacaatccatcgcctcattttgggcacgcacacgtcggacgagcagaatcatttggtcatcgccaaactgttactgcccaacgacgacgcacagtttgacgcgtctcgctacgacactgaccgaggcgaatttggtggctttggcacagtgaccggcaaaattgaggtggaaatcaaaatgaaccacgagggcgaggtgaaccgggcccgatacatgccacagaatccggttctgattggcaccaaatcaccctcctcggaggtgtacgtctttgactacacgaagcatccgtccacgccggctgacgtggagtgcaagccgcagttgcgactgcgtggccacaccaaggagggatacggcttatcctggaacaacaatttgcctggtcatttgttgagtgcctccgacgacatgaccgtgtgcctgtgggacattcaagcggcgactgcgaatgccaactttttggacgcaaaatccattttcacagcacacactgcggttgttgaggacgtggcatggcacgttttacatgacacagtctttggttcggtcggcgacgatcacaaactgatggtgtgggacacgcgcacgaacagctccacaaagccaacccatgttgtggaggcacactcggccgaggtgaattgtctctccttcaacccgtactcggaattcattttggccaccggatcggcagacaaaactgttgcgttgtgggaccttcgtaatttgaaattgaagctgcattcatttgaatcgcacagagatgaaatatttcaagtccaatggtcgccccacaatgagaccattttggccagctcgggcaccgatcgccgtctgcacatttgggatctgagcaaaattggcgacgaacagtcgccagaggacgcggaggacggaccaccggaactgttgttcatccatggcgggcacacggccaaaatcagcgacttttcgtggaaccccaacgagccgtgggtgatctgttcagtgtcggaggacaacataatgcagatttggcagatggcggacaacatttacaacgaggaggagttggacccggcgatggtggaaggtgttgcggccgcaagcggcgccggtccgatgggccaa

SEQ ID NO: 856 - DNA, 3536 bp, Heterodera glycines; identical to SEQ ID NO: 616
  genomic DNA sequence=SeqID_330; cDNA sequence=SeqID_616
  peptide sequence=SeqID_1238

SEQ ID NO: 857 - DNA, 498 bp, Heterodera glycines; identical to SEQ ID NO: 598
  genomic DNA sequence=SeqID_312; cDNA sequence=SeqID_598
  peptide sequence=SeqID_1094

SEQ ID NO: 858 - DNA, 1029 bp, Heterodera glycines
  genomic DNA sequence=SeqID_430; cDNA sequence=SeqID_710
  peptide sequence=SeqID_1029
ctgaagtatttttttgttataatgatcaacaaccacgtcaatggggcgaatgacgtcgacatggaaaggaccgaaaacgaaagttttggtgaacttaaccagcgactgattgcgcttaaagcggagaagaacaacaaagagagcgccactttggcggtcaaagtgttggccttttttgtcaactgcgacaacctcagtgctgcccaggattttgtggaggcgttgaagaatttgcccgagtcggcttccaacagcgattgggcccggtggttttattatttgggacgcatcgaagcgttgaagggcaccgacgccgagacgtacaaagcggcagagaaacattttgaggtcgcacttcgaaaggccccacaaaacggcgccgtcggcttcaaacaggaagtgaacaaatgggtcgtgctggtcaaattgctcatcggcgaaatccccgagcgcagtctcttccgcacggccgaacttcgccacgtgttggcgccgtatttgctgctgacccaaactgtacgccttggcgacgtggccggctttgaccagacgaagcgcgagcacgggcccatctttgtgaaggaccgcaccgctgcgcttgtcgagcgcatccatcagagcgtcattcggaccgcaattcgcaaaatttcgacgacatattcgcgcatttacgtgtccgacgtggccaccaaattgaattcgaccgagcaggaggcgcatcgcgagttggtcaaggcgatcaaagagggcattgttcgtgctcagttggtcgccggcgacccgttggcgggcgggcggcactacgtcaaatttgggaccaccgatgaccaatatcgcggggttgagccccgcagggaattcgacgcgcgggtcaacgaactgttggagctgtaccaccaggcggtgaaggcactgcggtacccggacatgcgcaacccggaggtggagaccattgacgagcagcgcaggcgtgaacagttggctctcgaaatggcagcagcggaagaggaggatgatgacgatttttga

SEQ ID NO: 859 - DNA, 1175 bp, Heterodera glycines
  genomic DNA sequence=SeqID_323; cDNA sequence=SeqID_609
  peptide sequence=SeqID_1239
atgatcggaggtctttttgtttataaccacaagggtgaggtgcttatttcaagaatttatcgcgacgacgtgaatcggaatgccgttgacgcctttagagtttcagttatacatgcaaggcaacagattcgttcaccagtgacaaatattgcaaggacttccttttttcacatcaaaaggggaaacgtttggatgtgcgctgttagcagacgaaacattaatgcatcgatggtcttcgaatttctcaatcgttttgcagacacaatgcaatcttattttggaaaactgaatgaggaaaatgtgaaaaacaatttcgtcctcatctacgaaattcttgatgagatccttgattttggttacccccagaataccgacccaggagtattgaaaacatttataacacaacaaggcgtccgaacagcgagtaaagaagaacaggcacaaatcacttctcaagtaacaggacaaattggttggcgccgagaaggcataaaatacagacgcaatgaactctttttggatgtcattgaatatgttaacctcctcatgtcgcagcagggtcaggtgctttcatctcatgttgcgggaaaggtggccatgaagtcttatctcagcggaatgccagaatgtaaatttgggattaatgacaaattgacgatcgaaggcaaaggcaggactggcactgacgacccctctaaaacatcccgcgcttcagttgcaattgatgattgtcaattccaccaatgcgtgaagttgaccaaatttgacaccgaacatgctataagctttatcccaccggatggcgagtacgaattgatgagataccgcaccacgaaagacatccaattgccattcagagtcattcctttagtgcgcgaggtgtcaaggaacaaaatggaagttaaggttgtgatcaaatcgaacttcaagccgtcgttattagcacaaaagattgaggtcatcattccaacgcctccaaatacaagcggagttcagctcatttgtatgaaaggaaaagccaaatacaaggctggcgagaattgcatttgctggaagattaagcgtatgggagggatgaaagagtcgcagatttctgcagaagtcgatttgctgaacaccggaaatgccgagaaaaagaaatggaaccgtccacccgtctcaatgaactttgaggt

SEQ ID NO: 860 - DNA, 407 bp, Heterodera glycines
  genomic DNA sequence=SeqID_450; cDNA sequence=SeqID_735
  peptide sequence=SeqID_1240
tgcgtcagatcaacaacggcgtattcgtcaagttgaacaaagcgacaatccagatgttgcgcattgctgacccgtacattgcgtggggctacccgagtcagaagatcattcgccagttggtgtacaagcgtggttatgccaaggagagtgggcagcgcattccgatcacggacaatgccattgttgagcgaaacatgggcaaatcggacgtgatctgtgtggaggacatgattcaccagatttggacagtcgggccccacttcaagcaagtgaccaactttttgtggcccttcaaactcagcaaccccgtgggcgggttcaagaagaagtccaaccattttgtggagggaggcgactacggaaaccgcgaggaccaaatcaacaaattgcttgaaaaaatgatctaa

SEQ ID NO: 861 - DNA, 1622 bp, Heterodera glycines; identical to SEQ ID NO: 742
  genomic DNA sequence=SeqID_364; cDNA sequence=SeqID_742
  peptide sequence=SeqID_1241

SEQ ID NO: 862 - DNA, 502 bp, Heterodera glycines
  genomic DNA sequence=SeqID_398; cDNA sequence=SeqID_656
  peptide sequence=SeqID_1095
ggctcagatggcttcggccgcgccgcccctcggcccttctttggggcagcgaggcgtaaacgtggcgaacttctgcaaggagtttaacaatttgacttcgactattcgatttggtacaaatttgcctgtgtctatccacgtcaaaccggacagaacttacgaaattgacattagcactccgaccaccgagtggcttctgcaacaagcggcggggatacgacgtaaccggcaggaggaaggagaaatcgtcggaatgatttcggtgaaacacgtatacgaaattgccaaagtcaaatctcaagacaaatctctcattggagtgccgttaaaaaaaatttgtcaattggtcattgagagagcggattcgattggcatcaaagtgcaaaatgaagatttagacccggaagaatataggaaattcctggaacatcgtcaggaagttgtgcaaagacaattggaggaaatagcgaagcaagaagaggccaaactggccagaacatga

SEQ ID NO: 863 - DNA, 1746 bp, Heterodera glycines; identical to SEQ ID NO: 634
  genomic DNA sequence=SeqID_384; cDNA sequence=SeqID_634
  peptide sequence=SeqID_1096

SEQ ID NO: 864 - DNA, 603 bp, Heterodera glycines
  genomic DNA sequence=SeqID_394; cDNA sequence=SeqID_651
  peptide sequence=SeqID_1097
atggctgccatgaatcctgaatatgactatctcttcaaattgctgttgatcggcgattctggtgttggcaagtcgtgtctgttgcttaggtttgcggatgacacctacacagagtcgtacatttcgaccatcggcgttgatttcaaaattcgcaccattgagcttgaggggaagacgattaaacttcagattgaacgcttccgcacgattacgtccagttattatcgcggagcacacggaatcattgttgtttacgacattacagaccaggactccttcaacaacgtcaagcaatggctccaggaaatcgaccgatacgcatcggagagtgtgaataaacttcttgtcgggaataaatgcgatttgaccaccaaacgtgcgatagagacgaatgttgccaaggagtatgccgaccaattgaacattccattccttgagacttctgccaaaaactccactaatgttgaacaggcgttcatcacaatggccactgaaatcaaaaatcgcatgggccctcttcaacaggccggtggcaatgcgtccgccgtgcgcattggtccgtctcagccggtgcgggacaaaaaaacgggcggatgttgctga

SEQ ID NO: 865 - DNA, 1682 bp, Heterodera glycines; identical to SEQ ID NO: 599
  genomic DNA sequence=SeqID_313; cDNA sequence=SeqID_599
  peptide sequence=SeqID_1098

SEQ ID NO: 866 - DNA, 1773 bp, Heterodera glycines
  genomic DNA sequence=SeqID_448; cDNA sequence=SeqID_733
  peptide sequence=SeqID_1242
atggacccctaccttcaagaattaataaacaaatggttatgctgggacaagaatgaaacgactcgaacagaaattgaacgactcgtaaaagagaataatgtgcacgaattgcgacttcggatggttgggaaattgtcttttgggacggcaggagttcgaacgcacatggaggcgggctttgccagactgaacgaattgaccatcatccaactgtcccatggaatggcacggcatttgacaagtgaaatgggcgaagatggcaaaaagaaaggcgttgtgattggcttcgatggccgacatcagagcaaacgttttgccgaattggctgccaatgttttcgtgctgaacggactgtccgcctttctcttttccgccgtcgtccccacccctgtcgtttcgtttgccgtcgtttctttgggttgtgctgcgggcatcatgatcaccgcttctcacaatccgaaggaggacaacggcttcaaggcttattgggccaacggtgctcaaattctgagcccacacgacacggaaatttgtcgaattgtcgcggaggagtcaaagcccgaagaagcctattgggacacggtccaactcggcacaagtgcctttctccactcggccgactcggttttggagaaatattttgccggggagagtgccatttgctgccatcacaagtcgctcaaccaaacttcgtccctccgtctcacttattccgctttccatggcgtcggctccaaattcgtccgccgaatgttcgctgagtttggctttccctcggagaacatttcgtacgttaaggaacaagacgagcccgacgccgactttggcactgttccattccccaaccccgaggaagggcaccgggtcctcaaactgtgcattgagactgcaaatgccaatgactcgactttgctcctcgtcaatgacccggacgccgaccgactccaattggcggagaaagaggcaaacggagagtggcgcgtgttcagtggcaatgagatgggcattctgctgacgtggtgggcgtggaccaattggcgtgccgccaacccaacggcggactcttcgcgggtgttcgtcctccattcggccgtctcttcccaaatggtcgccacaatggccaaaaaggagggcttcaaagcggcgcattcgttgacgggcttcaaatacataggcaatttggcacacaaattgcggtcggaaggcaacaccgttattgccgcctgggaggagtccattgggtttactcccggcacaacgctggacaaagacggcgtttcttccgccgcggtctttgctgaaatggccaattggctgcgcacccaaaagggcgtttcgctgcgtgaacagctcttccgcctcttctccatctacggctttcacctccaacgcaattcgtattggggggtcaaatcgacggaagtgacgaagaaattatttgcggaccttcgctccgattatcccgaaacgattgggcagaatttcgatgtgaaatttgtgcgcgacttgacgacgggttatgacaacgctcaaccggatgacagggccattctgccgctgagcacctcctccgaaatggtgacgttcactttggtcgacggaagtgcggtgacactgcgggcgagcggaacggagccgaaagtgaaatattacatcgaactgcgcaccgaaccgggcaaagaagaaaaggatctgagttcgatgcttgagcagctcgaccaattggaatccgacgtggtagaagtctcctccagccgaccaaatacggactga

SEQ ID NO: 867 - DNA, 915 bp, Heterodera glycines; identical to SEQ ID NO: 766
  genomic DNA sequence=SeqID_473; cDNA sequence=SeqID_766
  peptide sequence=SeqID_1099

SEQ ID NO: 868 - DNA, 1311 bp, Heterodera glycines
  genomic DNA sequence=SeqID_442; cDNA sequence=SeqID_725
  peptide sequence=SeqID_1100
atgtcttctaagccggcatacaaagttgctgacatttctttggccgactttgggcggagggaaattacaattgcggagaatgaaatgcccggactgatggccatgcgggcaaagttcggtgcgcaaaagccattgaaaggtgcgcggattgccggctgtttgcacatgactgtccaaacggcggtgcttatcgaaacgctgttggaactcggcgccgaagtccaatggtcgtcctgcaacattttctccacccaagaccacgccgccgctgcgattgccaagcgtggcgtgcccgtctacgcgtggaagggcgagacggacgaggagtacgaatggtgcattgagcagacgctgattttcccggacggaaagccgctgaatatgattttggacgacggaggcgacctgaccaaccttgtgcaccaccaacacgccgaacttctgcccggcatcatcggactgtccgaggagaccacgacgggggtgcacaatttggccaaaatgttggcggccggactgctgaaaacggcggccatcaacgtgaatgactcggtgaccaagtccaagtttgacaatatgtacggcatccgcgaatcgttgccggacggaatcaaaagggcgaccgatgtgatgttggcgggcaaagtcgccgtcgtctgcggctacggcgacgtgggaaaaggttcggccgcggggctgcgcaattttggcgcgcgagtgatcgtcacagaaatcgacccaatcaacgcccttcaggcggccatggagggttaccaagtgagtacgctggacgaagttgctgacattgctcaactcgtggtcaccaccaccggctgcaagaacattgtgaggggtgaacacatcgaacggcttccggaggatgccatcgtttgcaatgttgggcatttcgactgcgaaattaacgttacctatatgaacgagaattgcgtgtccatggagcaggtgaagccccaggtggaccgctatttgatgcgcagcggtcggcacgtcattctgttggccgagggccgactggtcaatttgggctgtgccaccggacattcgtccttcgtcatgtccgctagtttcaccaaccaagtgatcgcccagctcgaattgtacacgaaatacggcactccggacgcttacaaaacgggactgtaccttttgccgaaacagttggacgaggaggtggcacggctgcacctggacaagttgggcgccaagctgaccaaattgagcaaggaccaagccgaatatttgggcattccccaagagggaccattcaaaccaggccattaccgttattga

SEQ ID NO: 869 - DNA, 355 bp, Heterodera glycines; identical to SEQ ID NO: 653
  genomic DNA sequence=SeqID_490; cDNA sequence=SeqID_653
  peptide sequence=SeqID_1101

SEQ ID NO: 870 - DNA, 1271 bp, Heterodera glycines; identical to SEQ ID NO: 752
  genomic DNA sequence=SeqID_463; cDNA sequence=SeqID_752
  peptide sequence=SeqID_1243

SEQ ID NO: 871 - DNA, 3426 bp, Heterodera glycines; identical to SEQ ID NO: 629
  genomic DNA sequence=SeqID_380; cDNA sequence=SeqID_629
  peptide sequence=SeqID_1102

SEQ ID NO: 872 - DNA, 689 bp, Heterodera glycines
  genomic DNA sequence=SeqID_457; cDNA sequence=SeqID_744
  peptide sequence=SeqID_1103
atgcaaatctttgtcaagaccctcaccggcaagacgatcaccctcgaagttgaggcgagcgacaccatcgagaatgtgaaggcgaagatccaggacaaggagggcatcccaccggaccaacagcgtctcatcttcgctggaaagcagctggaggatggccgaaccctcgcggactacaacatccagaaggagtctactctccatcttgtcctgcgtcttcgtggaggaatgcagatctttgtgaagactctcaccggcaagacgatcaccctcgaagttgaggcgagcgacaccatcgagaatgtgaaggcgaagatccaggacaaggagggcatcccaccggaccaacagcgtctcatcttcgctggaaagcagctggaggacggtcgaaccctcgcggactacaacatccagaaggagtctactctccatcttgtcctgcgtcttcgtggaggaatgcagatctttgtgaagactctcaccggcaagacgatcactctcgaagttgaggcgagcgacaccatcgagaatgtgaaggcgaagatccaggacaaggagggcatcccaccggaccaacagcgtctcatcttcgctggaaagcagctggaggacggtcgaaccctcgcggactacaacatccagaaggagtctactctccatcttgtcctgcgtcttcgtggaggaaagaa

SEQ ID NO: 873 - DNA, 604 bp, Heterodera glycines
  genomic DNA sequence=SeqID_377; cDNA sequence=SeqID_625
  peptide sequence=SeqID_1104
atgggcatttccgacaacgatgtccaaaagcagcttcgccatatgatggcatttattgagcaggaagctaacgaaaaagcagaagaaatcgacgcaaaagcggaggaggagtttaacattgagaaggggaaattggtgcaacagcaaaggcagaaaatcatggaatattacgagaagaaagagaagcaagtggagctgcagcgcaagattcagaggtcgaatatgcaaaatcagagtcggttgaaatgtttgaaggcgagggacgaccatttgaaaaatgtgttggaggaggcacgcgccaatctcagcaaaatttcggcggacagagagcgctatccggccattctcaaaggacttttgcttcagggccttttccaattgctcgaaagcaaagttgtgttgcgatgccgcaagaaagacgaggaaatggtggcgaggattttgcccgaatgtttggaggaatttcagcggacggtgaaaattgacaatgagtactttttgtccccggaaagtgcgggcggcgtcgaattgttggccaaagacggcaaaatccgcgtctcgtccactttggaagcgcgtctcgacctcattgccgacaaagtca

SEQ ID NO: 874 - DNA, 771 bp, Heterodera glycines
  genomic DNA sequence=SeqID_412; cDNA sequence=SeqID_680
  peptide sequence=SeqID_1105
atgaaagtcatcaacgagtttggctatcgtcaagatgcccgaacacccagccaaatccgcaacattgtctatcaaatgggagtttactcacacgcggacggctccgcttacattgagcaaggcgagacgaaggtcctttgtgcggtttacggtccgcacgaatgtcgcttccgatcacgagccaaagaagacgaggccattgtcatttgccagtacagtcaggcaactttttcggttcctgacagaagaaacaggccgcgtggcgatcgtcgaggcaattccttttcccaccttttggagagggctttcgaatcagtcattttcacacatttatatcctcgaagtcaaattgatatattcttcgaactccttgaggctgacggtgccaatttggccgcctgtgttaatgtcgccagtttggcactggctgatgccggcattcccctgcggggactgctgtccgccgtcgaatgtggtagtgctgatgggttgccttgtgcggatttgagttctcgtgaacatagtgaattggtaccacgcctcacaatggccaccgttggaggtaaagacgaaattgttcttatggacatgaaaaacctactccacaaaaatcatttgccgtctttgttacaaatgggcgtcaatgcgtgtgcccaagtacacatttgtctggagacagctgtttttagacatgtcgaagcatcgcatcggaaaaacacagaaagtggaaaacaaaattcgcttttgaacagaattgttgaaggtcgctaa

SEQ ID NO: 875 - DNA, 1398 bp, Heterodera glycines
  genomic DNA sequence=SeqID_422; cDNA sequence=SeqID_697
  peptide sequence=SeqID_1106
atgggcaaggaaaagatccatatcaatattgtggtgatcggtcacgtcgattccggcaaatcgactaccactggccatctcatctacaaatgtggtggaattgacaaacgtaccatcgagaaattcgagaaggaggctcaggaaatgggcaagggatcatttaagtacgcttgggtgcttgacaagctgaaagccgaacgcgagcgtggtatcactatcgacatcgctttgtggaaattcgagacaagcaagtactatgtcaccattattgacgctcctggccatcgcgacttcattaaaaacatgatcacagggacttctcaagctgactgcgctgtgctggtggttgcttgtggaacgggagagtttgaagctggaatttcgaaaaacggccaaacgcgtgagcacgctttgcttgcgcagactttgggggtcaagcagctcatcgtcgcttgcaacaagatggacaccactgaaccgccattcgccgaggcccgttacacggaagtgatgactgaagtgtccaacttcatcaagaagatcggttacaacccagccaccgttccattcgtcccaatctctggcttcaatggcgacaacatgttggagccgtctgacaggatgccgtggtttaaggggtgggcgatcgagcgcaaagatggcaatgcatctggcaaaactctgctcgaggctcttgactccattcttccgccgcaaagaccaactgacaagccattgcgtttgcctctccaggatgtgtataagattggaggtattgggacagtgccggttggccgtgtcgagactggtgttctcaagcctggaatggtggtcacttttgctccgcaaggcatttccactgaagtcaaatcagtggaaatgcaccacgagtccttgccagaagcgcttccaggagacaatgtgggcttcaacgtgaaaaacatctctgtgaaggacattcgccgtggttcggtcgcgtccgactcgaagaacgacccggcaaaggagaccaagagcttcacagctcaagtcatcatcatgaaccacccgggtcagatcgctgctggttatactcccgtgttggactgtcacaccgcgcacatcgcgtgcaaattcgccgaactcaaggagaaggttgaccgtcggtctggaaagaaagtggaggacaacccgaaggcgctgaaaaccggcgatgctgggatcgtcgatttgattccaaccaagccgatgtgtgtggaggcattcacggactacgctccgcttggtcgtttcgccgttcgtgacatgaggcaaaccgtcgctgtcggtgtgatcaaggcggtggagaagactgaaggcggtggaaaggttaccaagtcggcgcagaaggctgctgcccctggtgggaagaagaaatga

SEQ ID NO: 876 - DNA, 1444 bp, Heterodera glycines
  genomic DNA sequence=SeqID_331; cDNA sequence=SeqID_617
  peptide sequence=SeqID_1107
ctgtcgtggtccgcatgtccgggacactggcaaagttaaggcgattgccgtcaccaaatcgtcgtccgcccattgggagggcaatgtgaacgcggagccgttgcaacgcgtctacggcatttccttcccggataccaaacagttgaagcaatggcgcatttggcaggaggaggcggccaagcgggaccaccgcaaattgggccgcgaccaggaactgttcatgttccacccgctgagtccgggcactgccttttggtacccgaaggggacgcacatttacaacacactgctcgagttcatgcgacgcgaataccgacgccggggtttccaggaggtaatttctccgaatatttataacgcaaagctgtgggagcagtccgggcattggcaccattatgcggagaatatgttccggttcgaaattgagaaggagcagttcggactgaagccgatgaactgtcctggacactgtctgatgttcgactacaaaccgcacgcctacaacgaattacccatccgttatgccgacttcggtgtactccaccgcaacgaaatgagcggcgctttgtccggtctgacgcgcgtccgtcgctttcagcaggacgacgcccatattttttgccggaaggaccaaatattgtcggagatttcgggctgtttggattttctgaattttgtctacgtggaagtgttcggcttttccttccgtctccatctgagcacgcggcctgaagagggctatttgggcgacttggccacttgggaggcggcagagacacagctgaagcaggcattggacaacagcggactcaaatgggagctgaacccgggcgacggagcattctatgggccaaagattgacattcaaatcaaagatgcgttgggcagacattggcaatgtgccaccatccaattggacttccaactgccccaacgcttcgacctttcctattacgatgagaacaaagagcgtcttcgtccggtgatgatccatcgtgcaatttacggttcaatcgaacgaatggtggcaattttggcggaaaattgtggagggaaatggcctttttggctgtcgcctcgtcaggcaatgattatcgttgtgcaccattcggtgagtgactacgcgagcaaagtgttccgccgcattttcgacgcgggcttcgaggtggaatttgacgaggacagcccggacacgctgaacaaacgcattcgcaatgcccaactcgcccagttcaacttcattttggtgatcgggcaacaggagaagaacaacggaacagtgaatgtgcgcaccagggacaatcaggtacgcggtgagattgctgtcgatgcgctcatccaaaagttccaaattttccgcgacacttttgcccaagacacagaaagtgcaggatcttttgaaggcccgaaggaacaaaaagaaattttggatgacaaaaaatga

SEQ ID NO: 877 - DNA, 1844 bp, Heterodera glycines
  genomic DNA sequence=SeqID_428; cDNA sequence=SeqID_706
  peptide sequence=SeqID_1108
atgtcaaactggcagaaaatggctgttgcagctgctgtgattgtcggactgcaatacttcatcaatcggctcgcttacacagaaatatcatggaaacagttctacacggactttttggaaaagaacaatgttgaacgcctcgaagttattgacaataaatgggtccgtgtcattaccagggagccaacgcagaccgttttttacttcaacatcggaagcgtagacacttttgagcgcagtttaacccaggcacagcaacatttgggcatggagacgagtcagcagcaggtgccggtgttgtacaaaagcgaaacggacatagtcggaatgattccccatatggttaactttcttatcacgggcatcttcctgttttacatgttcagaatgtttcgagggttcggaggaaaaaagcccggccaacgtggcggcggcggaggttttccggggatgggcaatctcttcggtgttgggcagtcgactgcacgggtcatcaacagagaggacgtgaaaacggcgtttgcggatgtggcggggtgtgaagaggcgaaaatcgaaatcatggaatttgtcaactttctgaagaaccccgcacaatacaaagcactgggcgcaaaaattcccaagggtgctcttctgactggccctccgggcactggtaaaactcttctcgccaaagcaactgctggcgaagcaaatgtgccatttatcactgtgtccggttccgagtttttggagatgttcgtcggtgttgggcctagccgagttcgggacatgtttgaaatggcgcggaaaaaggcaccatgcattctgttcattgacgaaattgacgctgttggacggaaacggggcggaaagggcgccatgggaggccactccgagcaggagaacacactgaatcaattgctggtcgaaatggacgggttttcaactgatgaatcgaacgttgtggtcatcgctgccacaaaccgcgtggacattctcgaccccgcgttgatgcgtccgggccgatttgatcgacaaatattcatccccgttcccgacatcaaaggccgtgcttccatcttccgcgttcatttgacaccaatcaaaacaaccttggacaaaatcgagctttcccgcaaacttgctgcgcacacgcccggattttccggcgcagacattgccaatgtttgcaatgaatcggcactaattgcggcccgagatgcacacgatgaggtgacttccaaggactttgagaatgccatcgagcgggtcatcgccgggatggagaagaaaagtcaggtcctgcagccggacgagaagaaaacggtggcgtaccacgaggcgggccatgccgtggccgggtggtttttggagtttgccgacccattgttaaaggtgtcaatcattccgcgtggaaagggcctcggctacgcgcaatatatgcccaaggatcaatacctttactcgaaggagcagctgctggacagaatgtgcatgactttgggtggcagagtgtcagaggaaattttcttcgggcgaattaccactggcgcccaagacgatttacggaagatcacacagatcgcctactctcaggtggtcaaattcggaatgagcgagaaagtcggtccggtgtccttcgacactccggagcctggcgaaatggcattcgataagccctattcggaggctaccgctcagctgattgaccaggaggtgcgcgacatggtcagcgcggcactgcggcgaacgcgcgaacttttgatgtcgaaggtggaacagatcgaacgggttgctcttcgactgttggagaaggaaatcttggcaagggaggacatgatcgagttagccacacgttt

SEQ ID NO: 878 - DNA, 1323 bp, Heterodera glycines; identical to SEQ ID NO: 770
  genomic DNA sequence=SeqID_475; cDNA sequence=SeqID_770
  peptide sequence=SeqID_1109

SEQ ID NO: 879 - DNA, 936 bp, Heterodera glycines
  genomic DNA sequence=SeqID_393; cDNA sequence=SeqID_650
  peptide sequence=SeqID_1244
atggccgaatacgatttgattaagcgccttattccctttttcgacttgcatcttgtcattccgttgttggaatacatcgaacagcaaaagatttatgacgaggaatccttcaaaaaagtgcatttggccgttcttcagaagacgaatatggtcgacagtctcatcgaagggtggggcaaagacgagcgccttttggagcagtttcaggcgaagaagcagcaggtgttggaggagagagaacggctcaaggatatgtgcgactcggcagcagaaattttggaccacaaggacgtgaaggaaatgacggagagcacaacgcgggacagagaggggaataacaaagtgttggagtacatcggagaacgcttcgggttcacaatggagatgcttgacagtctgtacaaatacggaaaatttttgtacgaatgcggaaattatttggccgcctccacttatttggacttttatcggaatttgatcccccaacacgaccccaactatttgaatgcccaatacgggaagttggcgtccgaaatactgctccaaagttgggaccacgccaaggacgacctgaacagactgcgcgcctacgtcgactcggagccgtttggctccgaattggaactgctgcagcaccgggcctggattctgcattggtccctttacattcacttcaattacccgaagggccgggacgaagtgatcgacctttgtctgaaccagcagccctatctgaacaccattcagattctctgtccccatttgttgcgctatttggccgtttctgttattaccagcaaaaacaaacagaaagcgagcctcaaagacttggtcaaaaccatcgaagtggtaagcgggggagaatattgtcacaacaattggaattgggatgtctttatttgccattttcgggttttgcaacataaaatgttctaa

SEQ ID NO: 880 - DNA, 1044 bp, Heterodera glycines; identical to SEQ ID NO: 610
  genomic DNA sequence=SeqID_324; cDNA sequence=SeqID_610
  peptide sequence=SeqID_1110

SEQ ID NO: 881 - DNA, 1206 bp, Heterodera glycines; identical to SEQ ID NO: 589
  genomic DNA sequence=SeqID_303; cDNA sequence=SeqID_589
  peptide sequence=SeqID_1111

SEQ ID NO: 882 - DNA, 321 bp, Heterodera glycines
  genomic DNA sequence=SeqID_432; cDNA sequence=SeqID_714
  peptide sequence=SeqID_1112
atggctgacgcagctgctcaagaacaaaaaaagaaacgcacttttcgtaaatttgtctatcgcggagttgacttagaacagcttctggaaatgaacgagaagcaattcaaccaaatgattcccgcccgtcaacgtcggaagatgaaccgcggattgaaccgaaagcacaaatctttgctcgttcgtctgcgtaaggcaaaactcaattgtcccgagctgatgaaaccggagtgcgtgaagactcatttgcgtgatatgatcgtgctgccggagatggtcggctgtgtggttggcattcacagtgggaaggcatacaatcag

SEQ ID NO: 883 - DNA, 2454 bp, Heterodera glycines
  genomic DNA sequence=SeqID_415; cDNA sequence=SeqID_685
  peptide sequence=SeqID_1113
atggcgcaagagccgcccttgcaaattgtgattcccagattggatgatgataaaccgttggtgcgtcgaccgacgcctcaggcacaaccggcggctccagcggtgccggctgaactacgcgtgtccaatcgggaggaggacgcgcagaacatcgaaccgtcaatgagtggcaaacaaatagtcgggttgatcattccaccgcccgacattcgaacaattgtggacaaaacggcgcttttcgtggctcgcaacggattggaatttgagatgaaaatcaaagagcgcgaggcttccaacatgcgtttcaactttctcaaccctaccgacccatactttgcctactatcgcaacaaggtcaatgaatttgagacgggcgttgcatcggcggacactcagtccaaagtgaagttgccggaggctgtccgtgagcatgtgcagcgggccgaatttattccgcggctgccgcccaaaccgttcgaattctgtgccgatcctttgacgctaaacgcattcgatttggatctcatccatttgaccgctttgtttgtggcgcggaacggccgtcaatttctcactcagctgatgaaccgtgaggtgcgaaacttccagtttgatttcttaaagcctcaacactccaacttccaatacttcaccaagctggtcgagcagtatacgaaggtgctgatcccgccaaaaacgattgtggatgatttacgtgcttcggtcactcaacacaaaatcttggaggacgtgcgttaccgcgtcggttgggaccgccaccaaaaagcgctgaaggaccgcgaggaccaagcggtggagaaggagcgcattgcgtacaatcaaatcgactggcacgaatttgtcgttgtccaaacggtggactttcagcccagcgaaacactaaatttgccgcccctgtgcacgccaaaggatgtcggggcacgaattctgttgcaacaacgtacggaagcggccaaagcggcggctgagagtgtggcgatggatgtcgagtcggacgaggagggcggcgccgagtcgggtgacgaggaaacggccaaagaacgagccgcaatcgaagcggcggaggatgcggctggcgaactgcaccaacgcttgaacatcggggcggagaagcaacacaccggctcaacgctgacgcaaccggcacccgcggcgccgaccgccggcagcgtaatcatccgcgactacgaccctaaaaaatcgcgtggtggtccggtgtccaaaactgcggctgcctccacggagaagtacataatttcgccgctgacaaacgaacgcattcctgcagacaaactgcacgagcatgtgcgttacaacaccgttgacccacagttcaaagagcaacgagaccgtgaacaaatggatcgccaggacgaagacttagtgatggcgcccggggcagaaattagtcgaaatattgccaaattggccgaacgtcgaacagacattttcggtattggtgaaaagggagccgaacaaacaatcatcggcaaaaagttgggggaggaggaacggcaaatgccgcgttcggacccgaagaccatttgggacggacaattgtcgacgattgatgctaccactcgcgcagcgcaacagagtgtttcgttagagcagcaaatcagcgaaatccagcgacagcatgggtatttgccgaacccagccgcagaacgaatggtgccgtcgatgccgcccccgacttcgacaccctcacaacaattcggcggtggacaaccgccgacttcacattcaatggctccacctcagcgccctccgcctcatcagtccaccggtggcattgcgtccaatgtgcagaaaattgtgccggttccccaacagccgccgcaaatgtctattccaccacagcaccagcaacaacaacaaatgcgtcctccgcagcaaatgccaccgcaatttatgcagccgccgggcggtcgtccgcatatgccacctccgcctcatatgggcatgccaccgcacggcgttatgggcgcaatgccaccgcacatgcaaccgggaatgcctcctcctggcatgatgcgtccaccgcatggctctttcatgcttcctcctccgccccccggcgcctctgttggcgatgagccgccaaacaaacgcccgcgcgaagaaacgctggaaccggaagaacgttggcttcaaaaggtccacggtcaaatcgctgtgcaaatcgctacgccgcaaaatgatgaatggaacctgaaggggaacacagtacaaattcagttggacatcagttcatcggtcactgcgttaaaatcgttaatccaagagcagatcggagttcctgcaaccaaacaaaaattagtctacgagggcattttcatgaaggacagtcagagtttggcctactacaattttatgccgaatgcttcagtgcaacttcagttgaaagaacgcggaggacgaaaaaaatga

SEQ ID NO: 884 - DNA, 651 bp, Heterodera glycines
  genomic DNA sequence=SeqID_356; cDNA sequence=SeqID_689
  peptide sequence=SeqID_1114
atgaccagtcgaattttgagctgcaatttgcgaaggtacttctccaagatgaaccaacacatcgagttcggcacaacgaagagcgcttcgtccgacaaacaatcgccgccttcccctacaaacaatcaaacgcaacacgagggaatgagtcaggaatgtcgggagcaaatcgagcagatggaaaagctgaagagcgacaacgaaatgctgaccgacaaatacaaaagaacacttgcggacatggaaaacttgcggaagagaacgcagcggcaaattgaggaggcaaaactttttgcaattcagccattttgcaaggatttgctggaggtggctgatgtgcttgacttggcgttgaattcgttggaaaaaatgaaaacggaggacggtgccgcctccttggacagtggagtgaacaaagggatcaaaatgacgaaggaagtgttgctgaagacgttcaaaaagcatgggcttgtaccggttcaacccgaaggacagaagttcgacccgaatttgcacgaagcggtgtatgaaataccgaaggaccagtcagataggcctgccggtcacattgcgcatgtgttgaacattgggtacagtttgcacgaccgtccgattcgaccagccaaagtgggcgttgtgaagatggaatga

SEQ ID NO: 885 - DNA, 498 bp, Heterodera glycines
  genomic DNA sequence=SeqID_427; cDNA sequence=SeqID_704
  peptide sequence=SeqID_1115
atgcagacgattagcaagaacaacaagatgatggcgcacctcaactacaaaatgaaggtgatcgtccaggattcacgcgtttttatcggatacttcaaagcattcgataaacacatgaacataattctggccgactgtgaagagatgcgccgcattaagcccaaacaaggagctaagaagtcaaacgtcgaggaggaaaagcgcattcttggcctggtgttgctgcgaggggacaaaatcatctccatttcggtggaaggaccgcctcaaaaggaggattctggtgtgcagttgccaaaggctggcggactcggtgggcctggacaaggacgaggtgccggtcgaggaatgccgatgggtgtggtgccgccaatgggagctgttcctccgggtttgcagggcgccgttcgtggaattggtggtcctggaatgggtgggcccatgcagcccggatacatgcaagggatgccgcagggaatgccgccacgtccattttga

SEQ ID NO: 886 - DNA, 303 bp, Heterodera glycines
  genomic DNA sequence=SeqID_469; cDNA sequence=SeqID_760
  peptide sequence=SeqID_1116
aatcgtgtcgccaaaatagacgtggttccatcggccgcttctctgatcatcaaagaactgcgtgaaccgccaagggaccgcaagaaagtcaagaacgtgaagcacagcggcaacctgaccattgaacaagtgatcaacatcgctcgtcagatgcgcccccgttcaatcgcacgaaaattgcaaggcaccgtcaaggaaattttgggcaccgctcaatcggttggctgtaccgtcgatggacaacaccctcacgacattgtggacatgatcagggcgggagagattgaagtgccagaagaatga

SEQ ID NO: 887 - DNA, 1584 bp, Heterodera glycines
  genomic DNA sequence=SeqID_447; cDNA sequence=SeqID_732
  peptide sequence=SeqID_1117
tttttgcgcgtttctgtgtcatcaaaagaaggacaaaagcaatgggaaaagccatctaaatcggcgatgaaaaaggcaatttcgcgtttggaagaagaacgacgtaaacgggaaaaagcaacaaattccgcggcagcgaaattaacggaagaggcaaagtcagtcgcagaacagcaacaagaaatggcacgagaaaaacgtttggaagaagcaaagaaaatgcaagttaaattggacgaatccttgcccgaagcgaagcgaaccaaaattcgcgaatgtccggcactgtgtggccagcgggtgaaagtgttcgcattcgtccatcggatgagacagcaaaggaaaaacttgatgttcctcgtccttcgcgatggctccggcttcctccagtgcgttctcaacggcactctctgtcaaaccttcgaagcgttgacactgactactgaaagttctgtttgcgtgtttggccaaatcaacaaattgcccattggaaaagttgcgcccggcggcatcgaattgacggccgatttttgggaacttatccacggatcaccgcccggaggggttgacaatgtgctgaacgtggaggccaacgtggacgtgaagttggacaaccgccatttggtggtgcgtggagagaattgctcagccattctacgaattcgcgccgctgtgacacgcgcaatgcgtgaacatttccatgaagctaaatacatggaagtgtgtccaccaactttggtgcagacacaggtcgaaggtggctctacccttttctccctgaatttcttcggcgagtccgctttcctcactcagtcttctcagctttacctcgaaacgtgcattgcctcgttgggcgattgttattgcatttcgcagtcttaccgcgctgaaaagtcgcgcacgcggcgccatttggccgaatattcgcacgtggaggctgagtttccatttatcaccttcgaagatttgatggtgcgcattgaggaaatgacatgtgacacagtcaacagagtgatggccgacccggaaatacgcgaacttatccagcagcagtggcaaaaggattcccaatatgagttcgtcgctcccaaacggccttttcttcggatgacttatgcggaggcaattgaatggcttcaaaagaatgaagtgatgaacgaagaggggaaacccttccaattcggcgaggatattcccgaaggccctgagcgatttatgaccgacacaattggacagccaattcttctcaatcgctttccgcatggaattaaggctttttatatgtcacgttgtgcagatcaaccggaattgaccgaatctgtggatttgctaatgccgggcgttggcgagatagtcggaggatcgatgaggatttggaaggaggacgaactgcttggggccttccaaaaagccgacatcgatcccaagccatactactggtacgtggaccagcggaaatacggaggttgcccccacggaggttttggacttggtctggagcggttcgtatgctggttggccaatcagcatcatatccgtgatgtgtgtctcttccctcggtacatcgggcggtgtgcgccgtag

SEQ ID NO: 888 - DNA, 339 bp, Heterodera glycines
  genomic DNA sequence=SeqID_452; cDNA sequence=SeqID_737
  peptide sequence=SeqID_1118
atggttgaagtgttcgactctctcagcaaactttacgcggattatcaacgcacaacggcaaagaagttgaagatcatcgatgcttacatggtctacattttcttaaccggtgtcttccaatttgtctattgtttgctcgtcggcactttcccttttaacgcgttccttgccggattcatctccaccgtggcctgttttgtgcttgccggttgtttgcgcatccaagtgaacccggaaaacaaggtcgaattccccaacatttctcccgagagggcctttgccgatttcatcttcgcccatgtaattctccatttggtggtcgtcaactttatcggataa

SEQ ID NO: 889 - DNA, 1353 bp, Heterodera glycines; identical to SEQ ID NO: 661
  genomic DNA sequence=SeqID_400; cDNA sequence=SeqID_661
  peptide sequence=SeqID_1119

SEQ ID NO: 890 - DNA, 1257 bp, Heterodera glycines
  genomic DNA sequence=SeqID_368; cDNA sequence=SeqID_768
  peptide sequence=SeqID_1120
ggccgaatgctgcacatattcgccggcgaagagaagagagtgcggacgaacggtgcagacgacgacagcacaaacgacggatgccaaagtgcgttccaacgcgaacggaacgaaaaacgcaaggcgaacgacgcggaaggggcgacagaggcggcgacaaacaatcgttgcacttggaacgcgctgtttcttggcactgacgcggtggcggagacattagcggaaaattatgaagtggagaagcgcgatttgctgctggttgacggcaaacagcagaacagtgccgcggtgcgcgtggcaatggccgaggcgcgtttggtgcgcgagacgcgcaaattcctgcttgacaacggcgttcggttggacgcgttcgcccagcggtggcaccttttgagcaatggtggcgacaacgtcgacggcactgaggacggaaccgcaaaaatgagacgttcaaagacgacaattttggtcaaaaatttagacgccacgagggaagggaaaaaggaatggctgcactctctgtttggacgctttggggtcgttaagacggtgctggtgccaccagtgcacggaatcactgcgatcgttgagatggcaaatgcccgtgacgcgaagtgcgcctttgaggcgttggcctactcgaagaaacacactccgagcgggggacgaccgctgtttttggaatgggcgccgtccaacgtttttgacgaggcgcaccccctcagagcaattggacattacggctatcagcaaaagggtcaaactgccgtcctttctgatgacccatcatcagttgggcatcagtccccggcggagacgaaaatggaaaaaacagacagagagagagggggagaagaggaaggcaaattggaggagaaaccgaagaaagaggagaaggaggacgagaagcacaccaaaatactcgtcagaaacgtgcctttccaggcgaatctcaaggagcttacgcagctgttttccgcatttggtgaactcaacttcatccgattaccaaaaaagcctggctccgaaggccaccgcggcttttgtttcgccgaatttctctccgtgagcgacgcgcaccgcgccatggacgcgctggtgcattccacgcatttgtacggtcgacggttggtgttggagtgggccaaaccgagcgaagaaagcgcggaggagaagcgacagcgaacgcaggacagaatggcaatggccgcgggcgttgccggggcgaagaaaaggccgaagatgcgatcattttag

SEQ ID NO: 891 - DNA, 1425 bp, Heterodera glycines
  genomic DNA sequence=SeqID_325; cDNA sequence=SeqID_611
  peptide sequence=SeqID_1121
atggtatcgacaacaaatgagcaagatgaagaacaacaaaattggttgatgaaacaagacttgcaaaagctcaatccggaaaaattgacaccgctgacagaagaagtgatcagtcggcaggcaaccataaacattgggacaattggacatgtggcacatggaaagtcaacactcgtcaaagcaatttcgggagtgcatacggtcaaattcaaaaacgaattggaacgaaacatcactatcaaattgggctatgcaaatgcaaagatctttcgttgctccaatatcaaatgtccccggccgcattgctacaggtctgctgggtccagcactcccgaccgtttcccatgtgaacggcccaattgcggtggtgactttgtgtgtgttcgccatgtttctttcgtcgactgtcctggccacgacattctgatggccacgatgcttaatggtgctgctgtcatggatgctgcgcttcttctggtggccggcaatgagccgtgccctcagccgcaaacttcggagcatttggctgctgtggagataatgaagcttaaacaccttctgatcctgcaaaacaagattgaccttatcaacgagtctcaagcaaaggaccagcatgatcagatcaagagttttgtggaaggcactgtcgccgactcggcccccataattccgatttctgcccaacttaaatacaacatcgacgtcatttgtgagtatttgtgtaagaaagtgcccattcctccgcgtgacttctcttctgacgctcgtttgattgttgtccggtcgttcgacgtgaataagcccggctccgaagttgagcatttgaagggaggcgtagcgggcggttcaattttaaaaggcattttgcgagttggccaggaaatcgaagtccgacccggaattgtcactaaaagtgccgatggttctgtgcaatgccgtcccatctactcgcgaatagtttcattgtttgccgaacagaaccagctccagtacgccgtccctggtggccttatcggagtgggcactcaaatcgacccgacaatatgccgcggggaccgtttggttggccatgtccttggcgctgtagggactctgcccgacatttttactgacatcgaagtttcctaccatttgcttcgacgtcttcttggagtgcgcactgaggcagggaaaaaagcggcgaaagtgagcaaacttgccaagggcgaagtgctcatggtgaatattggctctctctccaccggaggtcgtgtaattgcagtcaaaggcgatgcggcaaaaatagcactgactgatccaatttgcactgaaagtaaccaaaatattgcattgagtcgacgcattgaaaagcattggcgtttaattggatggggcaccatcagaagggggacgaccatcgcagtgccccaaccatcgatcggataa

SEQ ID NO: 892 - DNA, 782 bp, Heterodera glycines
  genomic DNA sequence=SeqID_304; cDNA sequence=SeqID_590
  peptide sequence=SeqID_1122
tgccttatgacgaggactccgagaattcaaacattttctttcttgatgctgattttctggaggacatgtttgggatgttttacaaagtcgcggcacgtgaaagaattgtcggatggtatcactctgggccgcgtctttgcaagaatgacattctgatcaacgaagtcatcaaacgctttaccccgaaccccgtgctggtcataatccaagcttctcaaggccgacaggatttggcactgccgacggatgcttatgtggaagtccaggaagtgcacaatgatggttctcccccggtgaaaacctttgaacacgttcccagtgaaatcggagcagaagaagcggaagaggtcggagtggagcacttgctcagagacatcaaaaatcaaacagccggcaccctctcgcaacgaattgctaatcagttgacgggaattcgtggtctcgagaaccatttggctggttttacgagctatttgcatcgtgttgcgagtcgagaattgcccatcaaccacgctatcatatttctaatacaagaaatgctcaatttgttgccggaggtcctctcaccggactttgtcgacgcgcacaatgtgcagacgaacgaccatttgatgtgcgtttacatcggttcgatggtgcggacgataatcgcattgcacaatctgatcgacaataagttaacgctgcaaaaagtggcagaaaaaagtgcgaaggaaaagacggtcaaagagacggaaaagaatgaagcaaatgacaaagagattgtcaaaaacaccaaataa

SEQ ID NO: 893 - DNA, 652 bp, Heterodera glycines; identical to SEQ ID NO: 701
  genomic DNA sequence=SeqID_426; cDNA sequence=SeqID_701
  peptide sequence=SeqID_1245

SEQ ID NO: 894 - DNA, 564 bp, Heterodera glycines
  genomic DNA sequence=SeqID_347; cDNA sequence=SeqID_659
  peptide sequence=SeqID_1246
gctgagcgtgagcgtttgctgcaggcggagcgcgaatacatcacacgacgggtgctgaaaattgtggaactgaaggagacggtctgtgccggtggagatcaaggatttgtggtgattaatcaaaagggcattgatccgccgtcgttggatttgttggcacagcacggcattttggccctgcgacgtgccaagcgtcggaacatggaacggctgcagttggcctgcggtggcgaggcggtcaattcggtggacgacctgacgcccgatgtgctcggctgggcaggcagtgtttatgagcatgtgctgggcgaggacaaatacacttttgtggaggagtgcaaaagtcccaagtcggtcactttgctgctcaaagggcccaacaagcacagcatcacgcagctgaaggacgccatttatgacggacagcgggcggttgccaatgcgttgaaagacggtgccgttttgcccggcgccggtgcatttgaaattgcgggatattgtgcactgaaaaagcttgccgacaatgtgaaagggcgtgccaaactcggtgttttggtgccgtaa

SEQ ID NO: 895 - DNA, 518 bp, Heterodera glycines; identical to SEQ ID NO: 678
  genomic DNA sequence=SeqID_497; cDNA sequence=SeqID_678
  peptide sequence=SeqID_1123

SEQ ID NO: 896 - DNA, 1260 bp, Heterodera glycines
  genomic DNA sequence=SeqID_362; cDNA sequence=SeqID_728
  peptide sequence=SeqID_1124
aagaaagagtcggctggtgactccgatgccattccggaaggacaaatcaaatcacttgcagaactgaaaatggatgacatcaaagaaatgaaaatttcgcaaattaaaacagtcaagggaatggtggacgaagaagtcagacggaccaaactcagaatggaaacgcttgagggggacagaaatgagcatttggccaaaattgggaatttgctgcataattcggtgcccatcagtgacaatgaagacgaaaatcgagtcgaacggacatttggcgactgcgcaagcagaaaaagttattctcatgttgacctcgtggtgatgtgcgacggatttgacggagagagaggcaccaatgtggcgggaggacgaggctattttctgaaaggaccgttggtgttccttgaacaagcgctcatcgcattggcattgcaaatgctcaacaaaaagggcttcacgccgctttacacgcccttttttatgcgcaaagacgtaatgcaggaggtggcacaactcagccaattcgacgaagagctttacaaggtgaccaccgcaaaaaagacggacgcagccaatgaagacggctctcccgacgagaaatatctaatcgcaacttctgagcagccaatcgccgcctttcatcgtgacgaatggcttaacccatcggatttgccaatcaaatatgccggaatgtccacctgttttcggcaggaggtcggaagccatgggagagacacccgcgggattttccgtgtgcaccaattcgagaagatcgaacaatttgtcatctgttcaccatttgacaacgaatcgtggaagcacatggacgaaatgattggcaatgctgaagagttttgcaaagtgctcggccttccctaccgaattgtggccattgtttcggccgaactgaacaacgcggcggcaaagaaattggacctcgaggcgtggttcccgggcagcggtgcatttcgggagctggtttcatgctccaactgtacagattaccagtcgagacggttacgaatacggtacggacagacgaagaaaatggacggagaggtcaattatgtgcacatgctgaacgcaacaatgtgtgccaccacgcgagtgatctgtgccattctggagaacaatcagacggaggatggcattgtcgtgccggaacccctgcggccgtttatgccatcgcaatattcgcaacgaattccctttgtaaagccggcgccaattgagcaggaaaaagtgcagaaaaagaagaaatag

SEQ ID NO: 897 - DNA, 789 bp, Heterodera glycines
  genomic DNA sequence=SeqID_311; cDNA sequence=SeqID_597
  peptide sequence=SeqID_1125
atggctgtcggaaagaacaagaagatggggaaaaagggagcaaagaagaaggccgtcgacccatttacgcgcaaggaatggtacgacatcaaagcgcccgcaatgttcacacaccgaaacgttggcaaaactttagtgaaccgcacccagggaacacgcatttcaagtgactttctgaaaggtcgggtctacgaagtttcgttgggcgatctcaacagcacggacgccgactttaggaagttccgattgatctgcgaagaagtgcaaggcaaaatttgtttgaccaatttccacgggatgacattcaccagggacaaactgtgctccattgtcaaaaagtggcatacactcattgaggccaatgtggcagtgaagaccaccgacggtttcttactccgactcttttgcattggctttaccaaacgaaatgccaatcaaatcaagaagacgagctatgcaaagacatctcaagtacggatgattcgtgccaaaatggtggaaataatgcaaaaagaggtctcttccggcgacttgaaagaggtggtcaataagctgatcccggactccatcggcaaggacattgagaaggcgtgctccttctactacccgttgcaggacgtttacatccgtaaagtgaaggtgttgaagaagccgaagttcgagctgggcaaattgctggagatgcacggcgagggtgccggaacggtcgccactattacgacggccaccggagagaaaatcgaaagtcggccggacgcatacgaaccgcccgttcaacaaagcgtttaa

SEQ ID NO: 898 - DNA, 2592 bp, Heterodera glycines
  genomic DNA sequence=SeqID_349; cDNA sequence=SeqID_662
  peptide sequence=SeqID_1126
atgtctgatccagttccggacaaaagaatcaacaagaaaaagttggagaatatcgaacgacttcggcgtaaaaatgaaacgaaaatatcaaaaaataaatcaaaaaaacttgcccaacttgctgaacgaaagaaaataaagcaaacgcgtgaatcattgttcgaaatgttgcaacaatatcagcttgacgaagggaacatgaatttactaacttccattgcaagtagccaaaaagaagcaggcaatcaaaaacacaaaattgaagttgtgaaaaagctgagatgcgtttccggtgaaaaattgaaaaatatcagagcaacatcgaaacaactcaatcacattgaaacggacagcagttcttgtgaagaggactttagtgggaatggtgaacagcaacaacctgggaaaagcatagaacgaatgccaaagttgacgcatcaaattgaaacttgtttgctggcaggaaataacgcgcggactgcacagaatctcccaattgacaaaaacgaacaaagatatgaggctgcgtcaaaacaaaataaacagcatgccaaaggacaattgcaatgctccaacgccctttctcgcatcaaaggacgccaaattattgttccacgggacgaaaacattgaaaagaagagacgacaattaccaattaatgctgaggaacagccaattgttgaggcaatcaacgaatatcccgtggtcataatttgcggcgagactggttccgggaaaactacgcaaataccccaatttttgtatgaggctggctacacctccaatggacacttaattggagtgaccgaaccaaggcgtattgctgcgataagtatggcatcgcgagttggccacgagttggacaacgaaaaattggcatcataccagatcagacatgaagggaatcgaagtgaagagacaaaaatactatttatgacggacggagtactcttgaaagagttgcagacggactttacactttcgcgttactcagtcgttgtcattgatgaggcgcacgaacgttccatttatagtgacgttttaattgggcttttgtcaaggatttgtgcgctcagaatgaaacgcggttatcctttaaaactgattatcatgtcggcaacactgaaacttcaggattttcttcgacaaagacttttttccatcagtcaaccaaaagttgtcagtgtccaagctcgtcagtttccagttacaatttattttgaacggcgcactccaacaaattatttggaagcaacattcaaaaaagtgtgtaaaatccacgaggaatacccagcgggtggcatccttgcgttcgtcacaggtcaacgtgaagtcacacatttggtcaaattgctagaaaacaaatacacaaaaatatctgcatcaaaattactgagaaaagagaaaatgaaaaagtgtcggaagaaagagacaaaagaggaggaggaagagggactactgcttgacaacgacgagttcggaacttcggatatggaccttgaagatgaggcgtggcaaaataccttttttgggtctgacgatgaatcacttaatgcttcgcaatcgttcaaaaagtaccctcctctgctggccatccctctctattctctcctaccagtgaatttgcagaagaaaattttcaacgaaccgccagatgacgggtctagggtgtgtgtagtttctacaaatgttgcagaaacttcgttgacgattccaaatgtccgttacgtcatcgattctgggcgggaaaagaagagggaatatgacccgattacgggagtttctcggtttgtggtcggatggtgttcaaaggcgtctgcagaccaaagatccggtcgtgccggacgagttcagtccggatacgcattcagattgtattcttcggctgtttacgaagatatgcgcgatcattctactcctgagatccttaataaaccgatcgaccaattgattcttatgttgaaagcaatgaatttcacgaaaatcgacaattttcctttcccgactcctccaagattggaccaaatcaaatcttctgagctgagactttctcacataggggcgcttagagttcaagaagggctttataccatcacacaacttggacaatcacttgcgcagctgcctctcactccttcttttgcgaaggtcgtcatcagttcaattcgtggcggacttcttccttttgccgtcactttggtgtcggctctctccgttcgtgaaccattattgttcatttcaagcacaaaagaggacggaacggaagagagacgaaaaagaatgtccgaagtgattaagcaaagatttctttggtgtgctgttggcgaggctcgactctttggtgatttgacagtaattctgaacactgttggtgctgctgactatgaggaagagaacgctcacgcaatcgaagccctaggacttcgccctaaggccctaaaggaaatcaacaaacagagacatcagctgacgcttcttctgaacaaatccgattctggtggagaagttgcccgagaagttcagaatggatgcaccctcccaagaacaactgaggagattaaggcatataatggtgaaatgccatccggataa

SEQ ID NO: 899 - DNA, 1149 bp, Heterodera glycines
  genomic DNA sequence=SeqID_418; cDNA sequence=SeqID_693
  peptide sequence=SeqID_1127
atgagtttgtttggttcgtccatcggcacttcttcgccttttggcagcaagccgagtggtggtctctttggcgctgcgaacaccgcagttgtgcagcccagcacttcgaccacaacgcagcaggacatcgaggttccacaagctcccgatgacactgtgcaggcaatgaaattcaatccgctggtggccgggtctcccatttttttggctgctggttcctgggacaacacctgtcgcatttggcaggtcaatgaaaatggaatggttgaaccgaaggcaatgcaaaatgttggagcgcccattctttcgctggattggtcggaggacggctcaaaaatattcatcgctggtgcagacaaacaagcgttcgcctgggatttaggctcaaaccaaatggctgttgttggcacgcacaatgagccagtgcgaagttgccattggatagcgacaccccaatattcgtgtctaatgacgggaagttgggaccggacgctgcgtttttgggacatgcgccaattgcccacccaaaactccctggcaaccatccaactgcctgaacgcgtgtactgctccgacatggttttcccgctgatggtcgttgctttggccgacagacacatcaaaatgtataagttggacggaacaccctctgaaattcaagacgtggaatctcagttgaagtttcagagtcgttgcattgcgattttcaaagacaaaatgacgggacagcccaatggattcgctcttggctccaccgaaggacgagtggcgattcaatgtttgcagccaaaggacccgaaggacaatttcactttcaaatgccatcggtcagccgaactcatcaacaattaccaggagatttacccggtcaatgacgtcgcttttcatccgacccaccaaacattggccacagcgggcgcagacggaaaatattccttttgggacaaagacgcgcggacgaaattgaagggttccgatgccttgccaatgccaatcacaaaatgcgccattcattcgggtggaaacataatggcctatgcgatcggttatgattggagcaagggcttcgaatacagcacggcgaataatgtgacgaaaatctttctgcacgggtgtgacgaggagatgaaaccaaagccgaagaagtga

SEQ ID NO: 900 - DNA, 942 bp, Heterodera glycines; identical to SEQ ID NO: 717
  genomic DNA sequence=SeqID_500; cDNA sequence=SeqID_717
  peptide sequence=SeqID_1128

SEQ ID NO: 901 - DNA, 1335 bp, Heterodera glycines
  genomic DNA sequence=SeqID_405; cDNA sequence=SeqID_671
  peptide sequence=SeqID_1129
atggcaacttccgaagcacccaattatgcattgtatgaacatgcagtgggttacacactattcaagatcaaggaatatgaagacattggtcaaatacaaccagaggtgcaaagtgcgatgacagatgctcagcgttttcaaacgattgtccaagttcatgcatttgacccattcagaaacactgaggcggcgcttgaaaatgcgaataacattgcggaagggattatccacgttgatttgctgaactttttggaggctaatctaccgaaaaaaaagaaaaaggttctgcttggagttggtgatcagcgtttgtcagcttctctagtagaggcattaccaggtattcgtgttgctttcaatggcgtcgtgcaggaattgcttcggggcattcggatgcattttcgcgtgttggccaaggatttgccacatgcacaactcggaaaggcacaactttcattgggccatagctattcgagatccaaggtgaaatttgacgtccatcgtgtcgataacatggtgatacagtcaattgcactgcttgaccagctggacaaagacatcaacttgttcggcatgcgcatcaaggaatggtacgcttaccactttccagagttgattaaaatagtgccggaattatacaaatacgtgtgttgtgcaaccgcaattatgaatcgagaaaaaatggatgaagcggtggaaacgaaacaagaaaaatttaaagagattctggaagatgaacaaaaggcagctgaagtcattgaagcggctcggacatcgatgggaatggaaatttcggaaatggatttgcacaacatcgaactgttcgcaaaacgggtggcatcgctttctgagtatagacagcgtttacaccaatacatcaaggatcgcatggattcgtgtgctccgtctttgtcttcattaattggagaacaggtcggtgctcgactgatctctcacgcgggaagtctcacaaaccttgccaaatatcccgcgtcgacaatccaaattttgggcgcagaaaaagcactcttccgagcactgaagacgaaatcaaatacgccgaaatatggtcttttgttccattcgactttcattggacgcgctcaggccaaacacaaaggtcgtatcagtcgtttcttggccaataaatgcagcttggcctctcgcatcgactgtttctctgatgttcctgtgccctctttcggcgaagcattgcgtcagcaggtggaagagcgtttagtttattacgaaaaaggagtcattccgaagaagaatcttgatgtaatgcatggagctgttgaggaggcgacagtcgaagttgaaaaggtgtcttaa

SEQ ID NO: 902 - DNA, 494 bp, Heterodera glycines; identical to SEQ ID NO: 762
  genomic DNA sequence=SeqID_471; cDNA sequence=SeqID_762
  peptide sequence=SeqID_1247

SEQ ID NO: 903 - DNA, 510 bp, Heterodera glycines
  genomic DNA sequence=SeqID_435; cDNA sequence=SeqID_718
  peptide sequence=SeqID_1130
atggttcgtcatgtgactgcctcctgctttcgtgcgccatggccttttgaaaaaaagggctcaactggatggcggaagaatgggccggttgttattgaatcgcacaaatggcccggtcaacaaaaggaattccccgagctctcgccaaaatttctaggagcaaactttaaacagctatggagatacaccggagtggcgcccacaggatttaatgaccccaaaactgacgattttgttcatgttcccgaaatggtgcccgaattggtcgtgccggacctagcaaatttcgagctgaagccatacgtctcttacaaaacagatgcaaaaattgaagaaaggctacgcaattttgacaaaaaattgacaaaattcggtgggaatgagaaagcagcgattgccaattccaaagagacggaactatggcctcctccgccaatcgacgcgagaattctcttcgactttttctacgctgaaaaaattcgtcaggcatttgaaaaagggaagaagtaa

SEQ ID NO: 904 - DNA, 681 bp, Heterodera glycines
  genomic DNA sequence=SeqID_409; cDNA sequence=SeqID_675
  peptide sequence=SeqID_1131
atgaaaccaacaatcgatttgaagcaggacatttccaagtacaaggaacgcttccaaaaacttcatcataaaagagaagagtcaagaaaaataaaccacgaacacgtcgtggaggaggatcgacgtctgaagttgcccaacaattttgaggcaaagcgaaaacgacaagaatgggagttggaggagcttgtggcaagaaaggaagcggaggagcgtggcgaagattatgacagaataaaggcactgggaacgcaagcagacatcgccgacaaaatggaagcggcaaaacgaagaaaagcaaaccccgacacgggatttgcgagttatgaagcgatgtcaattcggcaatacgaaagaatgaccaatgggataaagccggacatggaatcttaccaaaagatgaaaggagtcgtcggagaagatcaattctacgcaagtgcaaatacgttgatccaaggctcgcattatcccaccgacaaggcactcgataaactttcggaggatgttcataaccagatgaagaaacgtgaccagtaccaccgccgtcggatgttcgaccctgatgccccgattgacttcatcaacgaacgcaacagaaaattcaaccacaaattggagcgctattacggcaaatatacggcagatattaaagaagatttggagagagggacggccatttaa

SEQ ID NO: 905 - DNA, 546 bp, Heterodera glycines
  genomic DNA sequence=SeqID_466; cDNA sequence=SeqID_755
  peptide sequence=SeqID_1132
atgccaatcaaagcatccggagaaactttaagaaagtacatcgttgttggacgtaaactcccaactgcaaatgactcaaatccgacactgcatgaaatggttatttttgccagcaaccacgtcgttgctaagtcccgcttctggtacttcactagcatgttgcgtcgtgttaaaaaaacacacggagaaattatttcatgtcaagaggtcttcgagaaaaagcctggctccgtgaagaactttggcatttggctccgctacgattctcgtactggacaccacaacatgtaccgcgagtatcgcgatgtttgtgaagcgggtgctgttacgcagtgctatcgcgacatgggcgctcgtcaccgcgctcaagcggatcgcattcagatcatcaaagtgcaaaccatcagtgtggcggactgcaagcgtgccggggtgaagcaatttcagaactccaagatcaaatttccgcttcctcaccgtgtgaattccaagcgacgcaatatgactcctttcacgacacagcgtccgagaactcattttgtgtag

SEQ ID NO: 906 - DNA, 789 bp, Heterodera glycines
  genomic DNA sequence=SeqID_443; cDNA sequence=SeqID_727
  peptide sequence=SeqID_1133
atgagcaatcttcgtctgcaaaagcgcttggctgcttcggtgttgaaatgtggtaaaggaaagatttggctcgacccaaatgaagtcaacgagatttcgaatgctaattctcgtcaaaatgttcgacgtcttgtcaaagacggtctcattatccgcaagccggggaaagtccattcacgttatcgcgctcgtgaacgtttggaagcacgcagaaagggccgtcacatggggttcggcaagcgtcatggtactcgcaatgcgcgtatgccagagaaagtgatttggatgcgtcgaatgcgtgtgcttcgtcatttattgaagcgttatcgtgatgctaaaaaaatcgacaaacacctttaccatgagctctacctcaaagcaaaaggaaatgcgttcaagaacaagcgcaacctcatggaatacatctttaagaaaaaaaccgaaaaccaacgttctaaacagcttgcagaacaggccgaggcacgtcgcaacaagaacaaggaaacccgcaaacgtcgcgaggagcgtttggttcagaagcgaaaggaacttttgcacaaaatttcggagagcgagaaagagaagacacctcagcccctagtgacaaagccagccgagaaagagcaaccgaagccacaacctgtcgctgcacggaccgctgataaggaacagcccaagacacaacctgccgcggtaaaaactgcagagaaggagcagccgaagtcaaaaacggaaactgtgggcaaaagggaaactgttggtcccaagaaaaagaaaggaggcaagtaa

SEQ ID NO: 907 - DNA, 1722 bp, Heterodera glycines; identical to SEQ ID NO: 673
  genomic DNA sequence=SeqID_407; cDNA sequence=SeqID_673
  peptide sequence=SeqID_1134

SEQ ID NO: 908 - DNA, 1260 bp, Heterodera glycines
  genomic DNA sequence=SeqID_314; cDNA sequence=SeqID_600
  peptide sequence=SeqID_1135
gagacattgaaggcgactctcgacttggacgaaatatttggcaacgaaaacgaaggtggaaaatcggccggcagcagcagttcgtcgacgagttcttcgcgttcctccagccccgacttgaccaagtcacgttctccttctcccgaagtcaaacaagagattaaaacaagggatgaaattatccgttgccaacttttccggcgaaagctcgcgaaatttgttcatgctccgttcttcgctaaaacagtggtcggttgcttcgttcgcatttcaatcggtcccaacaaatcggatgggaagcaagtgtacagagcggctcaggtagtcgaagttgtggagacagcaaaagtttacgaagtcgagccgaacagtgacatccgtacaaacaaaggctttcgcctcaaggtgagcgatggcgagccaatgcgagtctatcggttggagttcgtctccaacagtcttattatggaaagcgagtttctgttttggttcaacaaaatgcggtcttcgaacacgcccatgctaaccgtcgactttgttgaccggaaaaggaaggaaattgtggacgcactcaactacaaatacaatgaggcggagatcaatttgctgatcaaagaaaagcagcgcttcaaaagacaaccgaccaatttcgcctttcaaaaatcggaattgctcagaatgaaggagcaagcagaacaaagcggcgatgtcgcgagggtgcgcgacttgcagcagcaagtcaacgaattggaagagaaggccaagaaaattgaacaccaaagaacgaagaacttaagtgccatcagtgccatcaaccagcggaatagggaccatatgaaacaaacattccttggtgccggaatggtgcgggaagagcaggagaaggacgacgacccattcacacggaagtcggcgcggatgaaagtggtctcgggatccgtgaagtccaaaaccgccggcgaaggaagtggcgccaatgccgagttatccgttatggacacgatggtttcttcgttgggttcgttgtcgtcttcgtcggagtcctctccaaacaaaaaagtgcaacttccctcaactcacgatttattcaacgcacatggaatcgacataaatattgacataaaaatgcccgccgtcgtcggcggttcgttgagagcgccgccaattaccgactcacaggcaccacgaacacaacagaagacgagcagctcgcggacactcacattggaagaatacaaaaagaagagaggacttgtgtga

SEQ ID NO: 909 - DNA, 361 bp, Heterodera glycines; identical to SEQ ID NO: 702
  genomic DNA sequence=SeqID_492; cDNA sequence=SeqID_702
  peptide sequence=SeqID_1136

SEQ ID NO: 910 - DNA, 871 bp, Heterodera glycines; identical to SEQ ID NO: 779
  genomic DNA sequence=SeqID_482; cDNA sequence=SeqID_779
  peptide sequence=SeqID_1137

SEQ ID NO: 911 - DNA, 2037 bp, Heterodera glycines; identical to SEQ ID NO: 632
  genomic DNA sequence=SeqID_382; cDNA sequence=SeqID_632
  peptide sequence=SeqID_1138

SEQ ID NO: 912 - DNA, 705 bp, Heterodera glycines
  genomic DNA sequence=SeqID_437; cDNA sequence=SeqID_720
  peptide sequence=SeqID_1139
atggacacaaccatggaacaaccggctgaagatgttgaggacgtacagttggatttggggaagaaaaagaagaagaaaaaggcgaagaccacagaactcaaattgtcagaagatgagcatgaggaggaaaaggaagtcactgcactcgccgaaggcgttggccgtacaaatttgctcgacgcaaaaaaccccgacgcgtggacggactacaactacgacgagatgctggacatggtcttcaacatcatgcgggagaagaacccagaaatttccggcaagaaaaagacatttgtgatgaaaccgccggaggtgcaaagggcgggcagcaaaaagacggcgttcacaaatttcactgaaatttgtcggctgctgaagcgtgacccgaagcatgtgctgcaatttcttatggccgagctgggaacgacgggctcaattgacggcaatcagtgtttaattgtcaagggcaagttccaacagaaacactttgagaatgtgctgcgcggttacatcaatgaatacgtccgctgtcacacgtgccgctcctcggacaccgagttgaccaaggatgtgtcccgcctgttcttcatccaatgcaaacggtgcgggagtcgtttcgcggtgtcctccataaagtcaggctacacggcaatggtgggcaaacgggcggcactccgtcgggcggccgaagcgacggcgggcaaatga

SEQ ID NO: 913 - DNA, 938 bp, Heterodera glycines
  genomic DNA sequence=SeqID_371; cDNA sequence=SeqID_773
  peptide sequence=SeqID_1140
atgtctcaagcggatgccggacgtatcattcacattgggaagcggcgagagcgtgccaaagaggacattgagagccaacgacaaaggcttgaggaagagcggcgaaatttggcggcgagcatcaaagcgaaattcactacaaatattgacgaacaagaagagaaattcaaagaacgaacggttggattggtaacacttgacgaagtgaaggagagacagaacgaaatattttacagtgggccatctttaaaattttcaaacgaagaccgacccaaatttgagaaagccattcaaaaaagagtgctttcgtttggcgcttttgacgacgacgacgacgaggaggacgaggcactgattccaatcaccaaaaagagacacggaatggacccaacggtggacacttcttttctgcctgaccgcgaaagggacgaacaattgcaacgtgagcgcgaacggatcgctaaagaatggcaagaaatgcaggagagggaaaagaatgaggagataaccgtggcattttgctattgggacgggtccagccatcggaaggactcaaaaacaaagaaagggacgacaattgctcaatttctgcagaaggcattggacacatttcgcaaagaattcctcgaattgaaattggcaacagtggataatctgatgttcgtgaaggaggacttaatcatcccgcacttttacacttttcaagacttcatcaaaacgcgtcaaatgggcaaaacgggtccgctgtggcagttcgaagctgttggcgaaattcgcgtgcggcaagatgccgcgttggacattggcgaatcgcacccggtgaaggtcattttgcgcagttggtatgagaaaaacaagcacatttacccggcttcgcgttgggagccatttgtgccggggaaagtgtacaaacggacaattgacgacttatccacgat

SEQ ID NO: 914 - DNA, 2211 bp, Heterodera glycines
  genomic DNA sequence=SeqID_419; cDNA sequence=SeqID_694
  peptide sequence=SeqID_1141
atgccattgcgtttggatgtaaaacggcgattgctggcgagatccgatcgcgttaaatcggtggatttacatctcaatgagccttggatgttgatttcactttacaatggctttgtgcacatatggaattatgactcacaacagctcatcaagtcatttgaggtttgtgatctgcccgtgcgtgctgcaaaattcattgtgcgcaaaaattggatcgccactggttctgatgacatgcagttgcgcattttcaattataacacgttggaacgtgtacatcaaatggaagcgcattccgattatctccgatcccttgccgttcacccaacccaaccatttttgctgacttcatccgacgacatgctgatcaaactatgggattgggaagacaaatggaagctgaagcaaacatttgaaggacacacacattacgtgatgcaattggtgataaatccaaaagacaacaatacctttgccactgcatctctggacaaaacaatcaaagtttggcagttcggaagctcagtgcccaattttacgcttgagggtcatgaaaaaggggtcaattgcgtcgattattatcacggaggtgagaagccctacttaatttcgggtgcggacgaccggctaatcaaaatttgggactaccaaaacaaaacttgtgttgtcacgttggatggtcattcccacaacgtgtccgccgtgtgtttccaccccgaattgcccattatcatcaccgggtccgaggattcgaccgtgcgcatttggcatgtgaacacaaacagacttgaaacaacgctcaattatggtttggagcgtgtttggtgtgtcatggcccagcgcggctccaacacattggcaattggctacgacgaaggctcagttgtcatcgcacttggtcgagaggaaccggccgtatcaatggatcccagtggcaaagtgatttgggcacggcacagcgaaatacaactggcaaacttgaaaaccatcgaagagcagacgcttgaaaacattcaggacggggagcgattgtcattggctatcaaagacatgggatccacggaaatatatccgcaaaaagtgcagcactcaccaaacggacgctttgtcgttgtatgtggtgatggcgagtacattatctacaccgcaaccgcattgcggaacaaatcctttgggtcgagtttcgattttgcatgggcaaacgatgccaacttttacgctgtccaggagaattcgcagctgatcaaattgttcaagaatttcacggaacttctccaaatccgacccgatgtgatggttgagggcattggcggtggtcatttgctcgctgcgcgctctgccggttctctgcttttttacgattggagcactggacatttgatacgccgtatagaaattgcatccaaaaaagtgtattggagtgaaaatggagaaatggttgcgatctgtggcgaccaatcactttacatcctaaaatacaactctgaggcggtaacaaatgcaaatgtggcggacatcggacccgatggcatcgaggatgccttcgaagtgatcggcgaattgggagagtcggtgaaaaccggcttttggattgggcactgttttatctttacgacgactctgaaccggctcagctattacgtgggaggggaactggtcaccatcgcgcacaccgacagacccctttatttgctcggttatttgtcaaaagagaaccgggtgttcgcttgtgacaaggaccacaacattgtctcgttcaaacttttgttgtctgtcttggagtaccaaacggcggtgatgtgcaaggattttgacacggccgatcaaattttaaaaatcattcccgaaaatctacacacacgggtggcacaatttcttgagaagcagggatttaaaaaacaagcactggcgattagcaaagatcctcagcatcggtttgagttagccttgtcacttggtgatttgcccgccgcttatgaaatggccaagcaagcggacagtgaggaaaaatggaaacaattggcacatgcggcgacaatcaaatctgagctccgtttggcaggtgaatgccttgctaaggccaacgatttcgggggccttcttctgctcgcttcctgcgccggttcgaatcgtttggtaaattatttacgcgttttcatgcggttcttcatttctcaatcatttacaagttcatttttgctgccggtttaa

SEQ ID NO: 915 - DNA, 1353 bp, Heterodera glycines; identical to SEQ ID NO: 660
  genomic DNA sequence=SeqID_348; cDNA sequence=SeqID_660
  peptide sequence=SeqID_1142

SEQ ID NO: 916 - DNA, 1435 bp, Heterodera glycines; identical to SEQ ID NO: 601
  genomic DNA sequence=SeqID_315; cDNA sequence=SeqID_601
  peptide sequence=SeqID_1248

SEQ ID NO: 917 - DNA, 1524 bp, Heterodera glycines; identical to SEQ ID NO: 602
  genomic DNA sequence=SeqID_316; cDNA sequence=SeqID_602
  peptide sequence=SeqID_1143

SEQ ID NO: 918 - DNA, 600 bp, Heterodera glycines; identical to SEQ ID NO: 775
  genomic DNA sequence=SeqID_478; cDNA sequence=SeqID_775
  peptide sequence=SeqID_1144

SEQ ID NO: 919 - DNA, 651 bp, Heterodera glycines; identical to SEQ ID NO: 640
  genomic DNA sequence=SeqID_341; cDNA sequence=SeqID_640
  peptide sequence=SeqID_1145

SEQ ID NO: 920 - DNA, 2246 bp, Heterodera glycines; identical to SEQ ID NO: 612
  genomic DNA sequence=SeqID_326; cDNA sequence=SeqID_612
  peptide sequence=SeqID_1249

SEQ ID NO: 921 - DNA, 1083 bp, Heterodera glycines
  misc_feature (7)..(7): n is a, c, g, or t
  genomic DNA sequence=SeqID_399; cDNA sequence=SeqID_658
  peptide sequence=SeqID_1146
atgtctngaattggtaatttcgaaataagaaatgtgtctaaagtcgaacgtatcggtgcacattcccatatcactggtctcggcttaaaggcaaatttcgaaccaatttttatttccgatggaatggtcggacaatgtgcggcacggaaggcagccggattgattgttcgcatgattaaagatggacaaattgcgggcagagctttgctaattgttggcgagccggggacgggcaaaacggcggtggccatgggaatttcgaagtcaattggcggcgatacgcccttcatttccatttcggccagtgaagtgttttccatggatctgagtaaacccgaagcattgactcagtcattccgaaaggcaattggagttcgaatcaaagaggagactgaggtcctttgcggtgaggtcgtacaactcgaaattgaccgtccccagtcgggtgccgggccacgagttgggaaattgactctgaaaacaacggacatggaagcaatttacgacattggaaacaaaatgactgaatccgtcatcaaagagcgaatcacggccggcgacgtcatccaaattgacaaggcaaccggtaagatttcgaaaattgggcggtcgcttgcccggtcaaaggatttcgacgcacttgggccccaggacaaattggtcgcctgtccgtcgggggaaattcagtcccgcgtggaaacggttaacacaatttcattgcacgacattgatgtgatcaattcgcgttcctccgggtatttggcggttttttcgggcgatacgggcgaaattaaaagcgaagtgagggagcaaattgacaaaaaggtgatggaatggcgggaggaaaacaaagcgcaaataatcccgggtgttctgttcgtcgacgaagtgcacatgttcgacctcgagtgcttctccttcatcaaccgttacatcgaatcggacctttcgcccattttggtgatggccaccaaccgcggcattgtgaacattcgtggcacttccgttgagtctccccacggtgtgcctttggacttattggaccgcagccttatcatcaggacgtcgagttacaaagaaaat

SEQ ID NO: 922 - DNA, 645 bp, Heterodera glycines
  genomic DNA sequence=SeqID_489; cDNA sequence=SeqID_644
  peptide sequence=SeqID_1147
atgggacgtcgtcccgctcgttgctatcgctacattaagaacaagccttatcccaagtctcgcttttgtcgcggtgtccctgacccgaagattcgcatttttgacttgggtaggaaacgcgcaactgttgacgagtttccatgctgtgtgcacatgatatcgaatgaaagggaacatttgtcgtctgaggctctcgaagctgctcgaatttgtgcgaacaaatacatggtgaagaattgcgggaaggacggcttccacatgcgcgtccgaatccacccgttccatgtgattcgcatcaacaaaatgttgtcctgcgctggtgctgaccgtcttcagacgggaatgcgcggcgcctttgggaaaccccaagggttggtggcgcgtgtcggcatcggtgatatgctgatgtcggttcgtgtccgtgaccagcatcaagcccacgctcttgaagcattccgtcgagcaaagttcaaattccccggccgtcaatacatcgtcatttcgcgcaaatggggcttcaccccttttgaccgcgaagtttacgagaagcaccgcaaggaagggcgagtcattccggacggagtcaactgccgattcctcaagcaacacggaccattgacggaatggctcaaaaatccaatctga

SEQ ID NO: 923 - DNA, 1188 bp, Heterodera glycines
  genomic DNA sequence=SeqID_317; cDNA sequence=SeqID_603
  peptide sequence=SeqID_1148
atgcgttctccatcaccgaccgataatgacaaagcgcgttccttaaatgcgtacagacgtaaattggccgaatataaagaaattgagaatcggcttaaggaattgcggactaaggaacgcgaaagtcacaaattgttcgacaagtcggaaaatgagattaaatcgcttcaatcggtcggtcaaattgttggcgaagtgcttaaacaattgacagaagagaaattcatagtcaaagcgaccaatgggccacgatatgtggtcggatgtcgtcggaccattgacaaggagaaactgaagcagggcacacgtgtggctttggacatgaccacgctgaccataatgcgccaacttccgcgcgaggtggacccgttggtgtacaaaatgagccacgaagaccctggcaatgtgagctatgccgaaattggaggtctctccgagcaaatcagagaactgagagaggttgttgaactgccgctgatcaatccggagttgttcaaacgcgtcggcataacaccgcccaagggctgtcttttgtacggaccgccgggcaccggaaaaacacttttggccagggcggtcgcttcgcagctcaactgtaactttctcaaggtcgtctcgtcggcgattgtggacaaatacattggagagtcggcacgaatgatccgcgaaatgttcaattacgcccgtgacaaccagccgtgcatcgtttttatggacgaaattgacgccatcggcggacgtcgtttttcggaggggacttcggccgaccgcgaaatccaacgcactttgatggagttgctgaatcagatggacgggttcgactcgcttggcaaagtcaaaatcatcatggccaccaatcgacccgacacgcttgacccggcactgctccgtccgggccgattagacagaaaaatcgaaattggactgcccaatggacagagtcgtcttgaggtgctgaagatccatgccaccaaagtgctgaaaaaagaagaaatcgattacgaagcggtggtcaaattgtccgagggattctcaggggcagacctgcgcaatgtgtgcacggaagctggactgaatgcgatccgaaaggagagggacggcgtggtacaggaggacttcatgaaggcagtccgtaaagttgcggacgccaaaaagttggagaccagtcttgactacaaacccgtgtga

SEQ ID NO: 924 - DNA, 1026 bp, Heterodera glycines
  genomic DNA sequence=SeqID_332; cDNA sequence=SeqID_618
  peptide sequence=SeqID_1149
atgggcaagggattccaaaattttatgtccaagaaggacttccatccaagtgcatggtggaacttaaaaaggaaatgggaagctgagcaaaagaatgacttggagaaaagaagacaggatgaattgcgtgtccaatatgagaaggagcaagaaattctcaacaataaggcacttcttggtgacgaaaaagcgaggttgggcctttctttcatgtacgatgcgcccgctggcattaacaaaaagaaggaggaagggccggaaccgaaattcgaatggcaaaggaaatacaatgcaccgcgtgaagaatgggcgaaaggaaatgaactcatccaggaccaacctttcggaattcaggtgcgaaacgttcgctgtgtcaaatgtcgcgcgtggggtcatttgaacacggaccgcgaatgcccactgtatggtatgagtggaaatgctgaagaccatggctatgcaaataatccctccgatatcattcgtgatttaaatgtcgaaaagaaaacaaagactgtctctgatgtcacgaccaatgagcagattgatataaaaccgaaaattgaggtgcgcaaaagctacgaagagaagaaaaagaagcgacaccattactcatcggaagaagaggaagaggggacggaagaaaagaagccggaaccgatcgatcaggaacaattgctggtgaacatgcgtgaggagcacaatttgaagttcaagaccggcattctgattggtcttcgagcggacgaacacataaaaaaaatgtcagcgatggttggaggaggagaggaaaaaacttttgaggcttttctgaaaggactggatgagaaaaaacgaagaaaattaatgaaaaaaatcatgaagactgaagtgagcgatgactccgatatcgagaaggacaaaaaacagcgaaggaagcaaaagaaggaggaaaagcgcaaggcggacaaaaaacacaaacatcgcaggtcgtcgagtcgggagaccagcagaaagcggaaggaggggaagcaccaccgccactga

SEQ ID NO: 925 - DNA, 474 bp, Heterodera glycines
  genomic DNA sequence=SeqID_439; cDNA sequence=SeqID_722
  peptide sequence=SeqID_1250
aacacacatgagacggcgcgtgccatcaaacatatgccgttgaagcgtgccatccgctttctggagaatgtacgggagaagaaggagattgtgccgttccgccacttcaacggcggcgtgggacgcaaagcgcaggcgcaagcgtggggcacaacacagggacgttggccgaaaaagtccgccgagttccttctccaacttctcagaaatgcggagagtaatgccgaggtgaagggcctggacgtcgaccatttggtcattgaccacatcgtcgtgcaagcggccgccaaaatgcgtcggcgcacttaccgcgcgcacgggcgcatcaatccgtacatgagttcgccgtgtcacatcgaagtgattctgaccgagaaaaaggacgtcgttgcgaagccggccggcgcattggtcaaagtgaagaaagagtcgaagaagaagcagcgacggcaattggcacgtggcgaattctga

SEQ ID NO: 926 - DNA, 3066 bp, Heterodera glycines
  genomic DNA sequence=SeqID_379; cDNA sequence=SeqID_628
  peptide sequence=SeqID_1150
atgttgattacgacatatgtgttcaagatttctgtcagtgaagaggaaaacgaagaagagcaggttgaggaagaggacgacttcgacgagaacgaattggcactgaacaaacctaaaacaaagaagaagcgcagagttagggtggcgactgcgcgcgattttatccaagatgatgtcgaagtcgacgacgacgatgaagacgaggatgactacgatgctggggcggacggcgatgatttgtttggagtggacccgaatgaacgcgcagaagctgaacgttttctacgagaacaggaaaagatgaaagagaaacgccgcaacaaatacgcgttcagagacatgaccgaggaggaaatggagcggtacttccaggaaagacatgcagcacaagtggcgacacaccagggcgacatggacgaggacgcatatgacgacatcactcagaacggactgttgccaagcacgaaagacccgaatttgtggattgtaaagtgtcgactgggcgaggaaaagacgacctgtcttcgtttaatgcgcaaatacttgacttttgtcaacaccgacgagcctctccaaattaaatctgtcattgtcaaagagggcctcaaggggatgatctacattgaagcgtttaaaatggcccacgtggccaaagcaattgaagggatttcggcgctgaaccaattcaaaatcacgatggtcccaataaaagaaatgtccgatactctccgcgttgtcaagaatattccaactttaaagcccggtgcatatgtccgtttgagcaagactctttacaaagacgacctcgcgcaagttgattgggtggatatatcacaaaatcgagtcaacctcaaactcatcccccgcattgattacacgcgcttaaggggggctcttcggtcacaagacgacagaattatgaagaaaaaacgccgtccattgcctgctccattcgatttggaccgtataaaatcaatcggtggtgaagtgacaaacgatggcgacttttacattttcgaaggtggccattatcgcagaggctttctttacaaatcttttccaatgaatgctattgaagtcgacattactcatccaacccttacggagttggagcggttccaagattccaccgacgacttaaaaaaagaactggagaacactcacctaagggagaagcgccatagttttgctcctggtgataacgtcgaagttatggacggtgaactggtgaatctccgtggcaaaattcaaagcattgatgggcagaaagttgtcatccttcccgagcatgaggatttaaatgaacccttgactttgaatgcgagtgaattgcggaagtattttaaacctggtgaccatgttcgagtgattgccggtcgttacgagggtgacacgggtctgattgtacgagttgaggacaacgtagtcatcatgttgtctgatcttaccatgggagagatgaaaattttgcccaaagatgtacaactttgtgctgaggttgcgactggtgttgaacggatgggccaatatcagtaccaagacctggtgatgctggataaagaaacagttggagtaatcgttcgtttggaacgcgaaaatgtggaagttttgagtatgcatggcaaaatacttcgtgttaaccctcaaacgattgaatgcaaaaagaattcgcggttcgtcaaggcacttgattctcaaaagaatacaatccaagcgggagatacggtcaaagttgttgagggcttcctggcgcgaaagaaggaaactgaagaagaacgtcagggcgagatcaagcatcttttcagaaattgggccttcgttttttcacgtaaatatccacaaaacgggggaatgtttgtttgcaaagcgcggaatttggcattgattggtggaagcaaagcgtcggagtcacaaatcaacactactattttggataacagtcaacttatgagtcctcgtcctaatccgctcgaaagtcctcgcaccattcacggcggaatgactccccattccgggtcaagtgttgttggtgcacaatctgtccgtggcgatcatggttttaaagcaccaagtgtggtcgggagcatcgcaacatcagcaaccggagttggtcggcaacatgtacgtcggaacatggaaataatgggcaaaactgtgcgcgttctggctggtccaatgaagggttacattggaattgtgaaagatgcaacggaatcgactgtcaaggtggaactgcacaccatgccaaaaacggtcaattttgacatcaacaaagtgatggaggttggtggtgccgtcccgagggaattgatggacactgctggcgcaatgactccgggaacggccaccattggcgggcgaactccgatgtacggaggagcgcagacgccaatgtacggtggagcagcaacgcctatgcacgactcattcggtgctcgtactcctcattacggctctatgaccccggcttacgacggcagtcgaacgccttcgcaccaaccatcttcgtcttgggaccctgctttggccaatacgccggctcattcaactgctcattttgacaatgaatttgacacaatgggatttggcggaggagcatcaacgccggcaggttctgtgagaagccgacttgggggagcgaatactccaatgggccaaatgacaccgcgagatatgttcggcgattattcttcaagcccttaccccaacccaagcacaaatgccgattccgaaattcccactggttcatggtgtatggtcgacctgtgcgtcaatgttcttccgacgtgtggaaaggaccaacttctcggtttagaaggctcaatacggtcaattagagagggcgaatgttgtttgtatttcgaggagcttgacgatgacttcactattgagcacgaacatgtggtgcccattcgaccggcaagtggagaccaggctaaggtcatttatgggcatgatcgtggggtgtctggctctttaatcaccacggaaggggaggatggtgtgctgcaggggccgaacggggcaaagctttattcgatgtccgttctttgtaaacttgtttga

SEQ ID NO: 927 - DNA, 1668 bp, Heterodera glycines; identical to SEQ ID NO: 692
  genomic DNA sequence=SeqID_417; cDNA sequence=SeqID_692
  peptide sequence=SeqID_1151

SEQ ID NO: 928 - DNA, 861 bp, Heterodera glycines
  genomic DNA sequence=SeqID_451; cDNA sequence=SeqID_736
  peptide sequence=SeqID_1152
atggacgaggaacaacttttggattatgaggaagaacaagaagagactcaggaacaacaatcaaaaaatgatgcagcaacaaacggagatgcaacaaagaaaattaaaggtaattatgcgagcattcacagcagcggattccgagatttgatgctccgtccggagttacttcgtgcgataattgattgtggatttgagcacccttctgaagtgcagcatgagtgtattccacaagctattcttggaatggacattgtctgtcaggcgaaatcgggaatgggtaaaactgcagtgtttgtgcttgccactttgcaacaactgacaccgactgatggcacggtctctgttctcgtcatgtgtcacactcgtgaactcgcctttcaaatttcgaaagaatatgagcggttcagcaagtacatgccaggagtgaaggtttctgtgttttttggtggtatgccgattaagaaagatgaggaggtcctggccaaaaacactccgcacattgttgttgggacgccgggtcgccttttagcactgggacgcactggacatctgaagcttaaaggagtcaaattcttcgtgctggatgagtgtgacaaaatgattggggatgctgacatgcgtcacgacgtacaagaaatcttcaaaatgacgccgcaggagaagcaagttatgatgttcagtgcaactttgcctcgggagctgcgcgttgtctgcaagaagttcatgcaggaagtgagtagttcggttccttctttgctgcggttagcctcttcgaatcggcggtgttcggataggccttgtttttgcataaattcttctcaacaattgcccgttcgttgtctattcaatgagccatga

SEQ ID NO: 929 - DNA, 855 bp, Heterodera glycines
  genomic DNA sequence=SeqID_468; cDNA sequence=SeqID_758
  peptide sequence=SeqID_1153
atggcaaatcgcacagctcgagacgcacataccataaaaggcacaaatcctcaatatttaattgaaaagatcatccggactcgcatctacgattctctttactggaaggaacagtgttttggactctcagctgaaacagtcgtcgaccgtgccactgaattgcgttacattggtggaatatatgctgggaacataaagccggctcagtttctctgtcttacactcaaattgctccaattgcaacccgacaaagacataataattgaatttataagacaagacgacttcaagtatgtccgtgctttgggtgccatgtatatccgtttggtatttaattccgtcgaagtcttcaaatacttggaaccgctgtacaacgattaccgaaaactgcgttacatgaacagaatgggaaaattcgagttgctatacatggatgaatttgtcgacaatttgttaagagaagaccattattgtgatatacagctgcctcgtctacagaaacggcaagcactcgaagaaaaggaccaactcgagttgtacgcttccgccttggacgaagacttagagcgtctttccaccgactccgaagatgagcaggagacgcggaaagcacggccaaatatcgtttctcggcgccgaagtcgctcgcgcagccgtggccgaagtcggagcaaatcgagagaacggagacgccgatcactttccacggatggtatcaaatcaaccctaaggacaaattgccagttggatttagaccgtcggggaggacgaagtgccgcgaaagacaccgaaagagaaattgaggagaataacgcactgagaaagaaattgggattggcaccattggagcgttaa

SEQ ID NO: 930 - DNA, 1543 bp, Heterodera glycines; identical to SEQ ID NO: 627
  genomic DNA sequence=SeqID_378; cDNA sequence=SeqID_627
  peptide sequence=SeqID_1154

SEQ ID NO: 931 - DNA, 642 bp, Heterodera glycines; identical to SEQ ID NO: 592
  genomic DNA sequence=SeqID_306; cDNA sequence=SeqID_592
  peptide sequence=SeqID_1155

SEQ ID NO: 932 - DNA, 1691 bp, Heterodera glycines; identical to SEQ ID NO: 734
  genomic DNA sequence=SeqID_449; cDNA sequence=SeqID_734
  peptide sequence=SeqID_1251

SEQ ID NO: 933 - DNA, 567 bp, Heterodera glycines
  genomic DNA sequence=SeqID_453; cDNA sequence=SeqID_738
  peptide sequence=SeqID_1156
atgaagctgattgaatccagcgacatcgtcaaattcccagacaatgtcacattcgcgctcaacaaccgtgttgtgactgtgaagggaccgcgcggtacgctcaagcgcgactttcgccacttaaacattgaaattatgcgagaaaacccgaagctgctccgtgtgcggaaatggtttggcatccgcaaagagttggcagccattcgcacagtgtgctcacacattgaaaacatgatcaaaggtgtgactgttggatttcggtacaaaatgcgctcagtctacgcgcattttccgattaacatcacgcttcaggagaacaacaccgtcgtcgagattcgaaacttcttgggcgagaaatttgtgcgccgtgtcggactaccgcaaggcgttagcgctgtaatgtcgaccaaacagaaggacgagttgatcattgacggtaccgacatccaaaaagtgtcccaggccgctgctcgcatccaacagtcgacgaccgtcaaaaacaaggacattcggaaattcctggacggcatttatgtgtcggagaaggtggccattgccgatgaatga

SEQ ID NO: 934 - DNA, 2725 bp, Heterodera glycines
  genomic DNA sequence=SeqID_433; cDNA sequence=SeqID_715
  peptide sequence=SeqID_1157
atttgagtcggactttctgatcgcttcttcggtgggcagtgaagaggactttgttgctgcgttgggcccctcccttgacgaatgttctgttttgggaataatctcaagagcggatgcgctaaggtatatgaccgcaaaggttcgaattgaacaaacggtgagacggaaaacctttggcggtgcttccgcaactgtccgaacttcacaagagcatgacgtcctcgatttcctcgccaattcgatgatttgtcacattcaatcgtccggtggaaatatgaaaatgaaggcggtcttcctgggcttgatgatcagacggctaatcgaagcggagaagggcgtttgcgaggcggacgatcgcgatttttacggaaacaaacgcattgagttggctggatctttgctttctctgttattcgaggaccttttcaaaaggttcaactccgaattgaaacgaattgccgacagtcacctcaaccgaaatatggccgctccgctggacatcgtacgacacatgcgccaagatttgataacaaatggtcttgtcaatgctcttgccactgggaattggacaattaggcgttttaaaatggaacggcatggcgtcacgcaagttttgtcacggttgtcttacatcagtgtgttgggaatgatgacgaggatcaattcgacgttcgaaaagacacgcaaagtgtcagggccacgttccctgcagtcttcgcaatggggaatgatttgtcccgccgatacgcccgagggcgaatcttgcggtttggtcaagaatttatcgttgctcagtcacataaccacggacagcgacgaagcgcccattttgcaacttctctacaatttcggtgtccaagacgttcgtccgttgaaatttagcgtcgttcatgaaagacgttatcacatcgttttcctcaatggttccattgtcggaattactgatgacgttgaaaaaatcattggcacggtgcgactgatgcgccgaagagggcatttgggtgcctttgtctcggtcagtttcaacacgtccacaaatgcgctgtatttggccagcgacgggggccgactctgtcgtccgtatgtcatcgttgaaaatggtcgtccatgtctcacgcagtcccaaattcaggaagtccgagacggtcagaaaacctttgaccatcttttggcggagggatgcatcgagtttttggacgtgaacgagttgaacagtacgcgcatcgctgtctatgagcaccaaattttgccgcagaccacccacttggagatcgaacccttttcgttgctcggcgtcgtctcgggactgatcccttacccacaccacaatcagagtccccgcaacacttaccaatgcgcaatgggcaaacaggcgatgggcaccatcggatacaatcagcagaagcgaattgattcgctgatgtatctgctcgtttaccctcaaaagcctttggtgaaaaccaaaacaattgaattgtcaaacttcgaaaagctccccgctggtcaaaatgcgattgtggcggtgatgtctttcagcggctacgacatcgaagacgcattggtactgaacaaagcgtcgttggaccggggttttggacgctgtttggtctaccgatttgccaagggcaccgcgcgaaagtacgccaatcaaacgtacgacaaaatcatgggaccgtcgctggacgcgacgacgcgcaagccgattgcgaaacatgccgttttggaccaggacggcattgtttttgttggggcgaagattatgccgagacatgtgctcatcaacaaatccatgcccataatgcaatccgaaatgcttcccgctggcaatgtcgccgggttcaaccacaattttgagacaaaggacgtgtcaattccctaccgcggctcaatgaatgccgtggcggagcgcgtgctattgacctgcaacgacgaggagcaatacttggccaaagtgttgatagcgcaatgccgaagacccgagttgggtgacaaattcagcagtcgacacggccagaaaggcgtttgcggactgatctcgccccaggaggacatgccatttgatcacaacggcactgtgcccgatttgatcatgaacccacacggttatccgagcagaatgacagtgggaaaactgatggaattgttgagtggcaaaaatgcgctgatgggcccgtgccaaaagtggcggttgcattacggcacagccttcggaggggaccaagtggaaactgtcagcaaacaattagccgcccacgggtacaacttccttggcaaggacatgctcacgtcgggcagcacgggacagcaaatggccgcctatgtctattttggcccaatttactaccagaaactgaagcacatggtcatggacaaaatgcacgcgcgagcgaaggggccccgcgctgttctgactcgacagcccaccgaagggagggccagggacggcggacttcgacttggcgaaatggaaagggactgtctgatagcgtatggcgcgtcgatgctgctgatggaacggctaatgatctcctccgatcaattcagtatggatgtttgtgccgagtgcggtttgatcggctacttgggatggtgccaaaattgcaagtcatccgccgccatggcaaagattaaaatcccttacgcgtgcaaattgctgtttcaagagttgcaagggatgaacattgtgccacggctaaagacagcaaaatacaccgacggactgtga

SEQ ID NO: 935 - DNA, 1041 bp, Heterodera glycines; identical to SEQ ID NO: 781
  genomic DNA sequence=SeqID_372; cDNA sequence=SeqID_781
  peptide sequence=SeqID_1158

SEQ ID NO: 936 - DNA, 1684 bp, Heterodera glycines; identical to SEQ ID NO: 663
  genomic DNA sequence=SeqID_401; cDNA sequence=SeqID_663
  peptide sequence=SeqID_1159

SEQ ID NO: 937 - DNA, 1176 bp, Heterodera glycines
  genomic DNA sequence=SeqID_406; cDNA sequence=SeqID_672
  peptide sequence=SeqID_1160
tttaaggaatcaattgtcgatgtttatgggcttgtggcgcgcacccctcagccggtcactgcttgcactcaaagcgatgttgagattaaagtgcacaaatttttcattgtctcgcaagcagagcctcggcttccgcttcaacttgaagacgcggttcggcccgacaacgaccaagaggaattggccgtagtcaaattggacactcgtttggacaacagagtgctcgacttgcgaacgcaaacgagtcaggcaattttccgtttgcagggcggagtttgcgacgcctttcgcaagattttgtcctctcgcggtttcatggaaattcacactcccaaaatcatttctgctgccagtgaaggcggtgcaaacgtttttgaggtttcttacttcaaaggccatgcttttctggctcagtcgcctcaactttacaaacaaatggcaattgctggggactttggccgcgtgtttaccattggctccgtttttcgggctgaagacagtaatacgcatcgtcatttgaccgagtttattggccttgatcttgagatggctttcaatttccattaccacgaagttcttcaaactattgctgagatgttcattgacctgttcaaatatttgcaatgcaattacattgctgaaattgaagcagtccgtcggcaatacccagccgagccgtttctctttacacaaagtccactcgttttgcaataccccgaagcggtggccatgttaaagaaagctggtgttgagcagggagatgaagaagacttgagcactccaaatgaaaaacttttgggcagattggtgcgtgagaaatatcaaacggatttctatgttctggacaaatacccattggctgtccgccctttctatacaatgcccgacccaaatgacaccaaatattccaatagttacgacatgttcatgagaggcgaagaaatcatttccggtgcccagcgtgttcacgactcggcaatgctcaccgaacgtgccaaactgcacgggatagacattgagaagattcagtcatacatagacgccttcagatttggatgcccaccacatgcggggggaggaattggtttggaacgcgtgacgatgcttttccttgggttgcccaacgtgcgtttggccagtctttttccgcgcgacccgaaaagaataacgccatag

SEQ ID NO: 938 - DNA, 543 bp, Heterodera glycines
  genomic DNA sequence=SeqID_392; cDNA sequence=SeqID_649
  peptide sequence=SeqID_1161
atggggcaactattctcttatttcaagtctttgtttggtcatcgggaaatgcgaatactaatattgggcctcgacggtgctggcaaaacgaccattctttacaggctgcaggtgggcgaagtggtgacgacaattccgaccattggctttaatgtggagcaggtgacttacaaaaacttgaaattccaagtttgggatttgggcggccaaacgtcgatccggccctattggcgctgttactactccaacaccgatgcaatcatttacgtggtggattctgcggacagagaccgagttgggatttcaaaacaagaattggtgtcaatgctggaggaggaggagctgaagaacgcgatcctcatggtgctggccaacaaacaggacatccatggctgtctgtccctggcggaagttcacaaggcgttgggcttggaggcgatacgaaacaggacattccaaatcttcaaaacctcagcgaccaaaggcgacggactggacgaagcaatggaatttcttgctgcttctcttcaatctgccaaatga

SEQ ID NO: 939 - DNA, 510 bp, Heterodera glycines
  genomic DNA sequence=SeqID_375; cDNA sequence=SeqID_622
  peptide sequence=SeqID_1162
atggccggtatcgcagcaggaagactgacggaggagcggaaagcctggcgcaaagaccatccattcggtttcatcgcacgacagtgcaaaaaggaggacggcacattggacctgtacaattggatctgtgccattcccgggcccaagtcgaccatttgggaaggtggtctgtacaaattgcgcatgatcttcaaggacgacttcccatccacgccgccaaaatgccgttttgagccgcctctcttccacccgaatgtttatccgtccgggacggtctgcttgagtctgttagacgagaacaaagactggaaaccgtccatcactgtgaagcagttgctgctcggcatccaggaactgctggtgtcgcccaacccggaggacccggcacaggcggaggcgtaccaaatttatgtgcaaaatcggcccgagtatgagcgtcgagtgcgcaaacaggcccaacagttctcggaggaccaggtgctgaagcagttgttgacggacgacagctga

SEQ ID NO: 940 - DNA, 345 bp, Heterodera glycines; identical to SEQ ID NO: 643
  genomic DNA sequence=SeqID_391; cDNA sequence=SeqID_643
  peptide sequence=SeqID_1163

SEQ ID NO: 941 - DNA, 1302 bp, Heterodera glycines; identical to SEQ ID NO: 740
  genomic DNA sequence=SeqID_363; cDNA sequence=SeqID_740
  peptide sequence=SeqID_1164

SEQ ID NO: 942 - DNA, 606 bp, Heterodera glycines; identical to SEQ ID NO: 707
  genomic DNA sequence=SeqID_495; cDNA sequence=SeqID_707
  peptide sequence=SeqID_1165

SEQ ID NO: 943 - DNA, 555 bp, Heterodera glycines
  genomic DNA sequence=SeqID_411; cDNA sequence=SeqID_677
  peptide sequence=SeqID_1166
atggtgcgcacattgaaattccatgagaaaaagttgctgaagaaagtggacttcatcaattggccggccgagttggacaacagtcttcatgagaacaaaatcatgcgccgttaccatgtggagaagcgcgagcactacacactgtacaacaaactgtccagagagatccgagaaatggccaaacgcatccgcgagttggacgacaaaaacccgaacaagttggtgttggcacggatgctgctcggcaagctgttcgacatgggcgtgattccgaccgcggacacgctcgagcgatgtgacaaagtgacggcatcgtccttttgccgccgtcgcctccctgtcgtttgccacaaaatgcaaatggcaccgacggttaggaagtccagccaactggtggagcagggccatgtccgtgttggtgtcgaaatggtcactgatccggcctttttggtcacgcgaaaccaatcggatcacatcacatggacgcgggaatcgaaggtccgaagacatctcagcacttacaacaacgaattggatgactttgaggggtgttga

SEQ ID NO: 944 - DNA, 905 bp, Heterodera glycines
  genomic DNA sequence=SeqID_446; cDNA sequence=SeqID_731
  peptide sequence=SeqID_1167
ttgaagaattcacagatcacatgacgcggattgtatcaaatgtaaaagactccaaattgggcaaagatgcgattcagcagctaaaggtggcaacagaaactgccgaaagagttgctcaacaagttggcgaaatgcaggcgtataagcaagtgtcttatatggccaaggaaatcgaccgattggccgatgttcgaatgtataaaaggccaggtttgttaatatttaaatgtcaacgggatgcaacgggaattgaacttcacaaagagtcgcgttggtacgcgggatggaagacattcacagagtccaactcctattacaacaaaattattgactggaaaacacgcattgacgaaagcgagaatattttcgtccgaactgttcgtggtaccttcgaacgtgtccaactcgcatttgaatccaaagacaatgtgtcggaagtgctaacgcaaatatccaaaatcgaccccgaattcgacaagtcggaatggctccgtttttgcgaaaaagaaatgatcccgaacattcttgaatcaacttaccaaatgaacttcgaaatccttcgtgattggtgttacgagaaagcgttcaatttaatcgcaaattctatcaaagaatacgaaaagattggcttcaacacgagggattctcgcattatcgatgttagcaaagtggagttggtcacggggaatatgaccgaccaagggccgactttggtcatccaattccaagtattcatgacaaatgtggtgaagaacagcgaggggaaaattgtccaaggtgaccctgaaaaagcggttcgagtgagacacatttgggtaatatgccgagacatggaggagttcaacccggcaacagcttggaaactgcttgagctgcacatgataaaggaggatttatttgtttag

SEQ ID NO: 945 - DNA, 1396 bp, Heterodera glycines; identical to SEQ ID NO: 745
  genomic DNA sequence=SeqID_458; cDNA sequence=SeqID_745
  peptide sequence=SeqID_1168

SEQ ID NO: 946 - DNA, 906 bp, Heterodera glycines; identical to SEQ ID NO: 721
  genomic DNA sequence=SeqID_438; cDNA sequence=SeqID_721
  peptide sequence=SeqID_1169

SEQ ID NO: 947 - DNA, 1310 bp, Heterodera glycines; identical to SEQ ID NO: 655
  genomic DNA sequence=SeqID_397; cDNA sequence=SeqID_655
  peptide sequence=SeqID_1170

SEQ ID NO: 948 - DNA, 807 bp, Heterodera glycines; identical to SEQ ID NO: 604
  genomic DNA sequence=SeqID_318; cDNA sequence=SeqID_604
  peptide sequence=SeqID_1171

SEQ ID NO: 949 - DNA, 470 bp, Heterodera glycines; identical to SEQ ID NO: 703
  genomic DNA sequence=SeqID_493; cDNA sequence=SeqID_703
  peptide sequence=SeqID_1252

SEQ ID NO: 950 - DNA, 2184 bp, Heterodera glycines; identical to SEQ ID NO: 593
  genomic DNA sequence=SeqID_307; cDNA sequence=SeqID_593
  peptide sequence=SeqID_1172

SEQ ID NO: 951 - DNA, 924 bp, Heterodera glycines; identical to SEQ ID NO: 746
  genomic DNA sequence=SeqID_459; cDNA sequence=SeqID_746
  peptide sequence=SeqID_1173

SEQ ID NO: 952 - DNA, 480 bp, Heterodera glycines; identical to SEQ ID NO: 682
  genomic DNA sequence=SeqID_353; cDNA sequence=SeqID_682
  peptide sequence=SeqID_1174

SEQ ID NO: 953 - DNA, 1383 bp, Heterodera glycines; identical to SEQ ID NO: 750
  genomic DNA sequence=SeqID_461; cDNA sequence=SeqID_750
  peptide sequence=SeqID_1253

SEQ ID NO: 954 - DNA, 402 bp, Heterodera glycines
  genomic DNA sequence=SeqID_410; cDNA sequence=SeqID_676
  peptide sequence=SeqID_1265
catatgacggaggaggaaaggcgcaattacttacgaatgaacccaaaaatcatcaccaaccaacagaacaagggcaaatacaaattcctgcagaagtattaccatcgtggtgcctattttctggacaaagaggacgatgtgctgaggcgtaactttgccgaggcaacgggcgaagacgtttttgacaagtcggtgttgccgaaagtgatgcaggtgaaaaatttcggcaaagcgagtcgctccaaatggacccatttgacggcggaggacacaacggaccaccagggagtgtgggcaacgccgaccccactgagtgctaaatttgtggcaaaacacgcggcggggatgaaaaatgtattcgaaaagccatcagcaaaaaaacgaaagattggtggggattga

SEQ ID NO: 955 - DNA, 2016 bp, Heterodera glycines; identical to SEQ ID NO: 748
  genomic DNA sequence=SeqID_460; cDNA sequence=SeqID_748
  peptide sequence=SeqID_1254

SEQ ID NO: 956 - DNA, 743 bp, Heterodera glycines; identical to SEQ ID NO: 716
  genomic DNA sequence=SeqID_434; cDNA sequence=SeqID_716
  peptide sequence=SeqID_1175

SEQ ID NO: 957 - DNA, 1131 bp, Heterodera glycines; identical to SEQ ID NO: 619
  genomic DNA sequence=SeqID_333; cDNA sequence=SeqID_619
  peptide sequence=SeqID_1255

SEQ ID NO: 958 - DNA, 1008 bp, Heterodera glycines
  genomic DNA sequence=SeqID_479; cDNA sequence=SeqID_776
  peptide sequence=SeqID_1176
atggctgatgacaaaagctgtgacggtgcttcttctgcgttgcctccgtgtttaattgtgcttggaatggccggttctggaaaaagctcatttgtccaaaggttggcgagtcatctccactccaagaaggtgttcccctacttggtcaatctcgacccggcggcagcaaccgttccattcccagcaaacattgacatcagagacactgtaaattacaaaaaggtcatgcaggaatacggcctcggtccaaacggtgccattctgaccagtctgaatttgttttgcactcgcttcaaccaagtgttggacttgttggacagacgaaaggggtccataccatacgccattttcgacaccccgggccaaattgaggtgttcacgtggtccgccagcggcactgtcatcaccgattcattggccgcctcttttccgaccgttgtcgcttatgtgatggatagtgcccgttcgaccaacccgacgactttcatgtccaacatgctctacgcctgctccattctttaccggaccaaattgccatttttcgtcgttttgaacaagtccgacgtggtggaccctgcttttgccgtcgaatggatgagagattttgagcagtttcaaactgcgcttgaccaaagttcgtccagtttcatgaacgacttgacccgctctttgtcccttgtgctcgattcgttctacgaaaatttaaattgggtgtccgtatcggcaaagacgggtcagggctttgataaggttttggagttaattgaaaagtgtcggttggaatattgggaagtgtataagccaatgtgtgaacgagtggcacaagagagagctgctgagacagcgaacgacggcacaaccgacgcaatgccaacggaaaagttggcgaatttggaaataagagaaaatgatgtgccaagtgatgagaagggacaaacggaggaggcgcaaattacagaaacaaatggcgaagaacattcaacggaagaaagtgaagcgcaaaagtga

SEQ ID NO: 959 - DNA, 1382 bp, Heterodera glycines
  genomic DNA sequence=SeqID_423; cDNA sequence=SeqID_698
  peptide sequence=SeqID_1177
gctggccgtttcgccgtttgttttggcatttgtgcctatccatccctcttcgtcagggcgacgtgctgctgcgcgtgaacgaagtcgacctgcaaaattccacccacgcgcaagcggcacaaaccctcaaggccatccccaattactccgaagttcaattagtgctccaacatctgccccaggagtatcagagattcgaggagaaactggaacgtgcccgtgccgaaatggcccaactccagcaaaatccacaacagccgccctatttgccacccgatgcgatgccccctccgcagcagataatgccaatgcccatccgacaggacttttacgtgagagccctcttcgacaacgacccctcccgcggggatgcggtgctgccgcaccgttccctcgcctttcggtacggcgacattttgcatgtgacgagtgtggcggacgacgactggtggactgcgcgaagggtcgccgaaaatggggacgaaggccccgagggaatcattccgtccaagaaaagggtggagaagcgcgagagacagcggcgcaaacaggtgaacttcaacgctggcagtcaaagtttgggcagaaacgcgtcagtgagtgccggcggattcggcggcggcggattggacggccgacgcggttctcgcagccaactttccttttctcgcaaatttcccttcgttaaatcgactgagaaactgaacgaatatccctcggacggaggcgaaacaggcggcggcactatcgcagatgagccaattcattcatacgttacggtagaactgcgaacagttaattacgttcgcccggtcattgtgctcggggctttgaaggatcgcataaatgacgaattggtcagtcgacaccccgacagattcagcagctgtgtgccacatacttctcgcccaccgcgggaaggcgaagtgcacggacgcaattattatttcgttacgaaggccgaaatggagagggacgtgaagagcaaccttttcattgaagcgggccaattccaaaacaatttgtacgggacgagcgtagcggcggtgatggaagtggccgaatctggaaggcattgcattttggacgtttccggcaatgcgatacggcgactgcaaaacacagcccatatttatccagtttcggttttcgttaagccgcttaattaccaacaattacgagaatgggactctttgctcagtgaagaagatgccctgaagcaatttgaacggtgtcaacgccaagaacaaaacttcggggatttgttcaccggaatggtcaccggacattcgcccgacgatattttcgctcgcgtaattcacataataaacgaacagtcgcgacccgaagtttggattccgacgaatgaacagttgccttga

SEQ ID NO: 960 - DNA, 1947 bp, Heterodera glycines; identical to SEQ ID NO: 638
  genomic DNA sequence=SeqID_387; cDNA sequence=SeqID_638
  peptide sequence=SeqID_1178

SEQ ID NO: 961 - DNA, 389 bp, Heterodera glycines
  genomic DNA sequence=SeqID_308; cDNA sequence=SeqID_594
  peptide sequence=SeqID_1179
cgatcactctctgtcttggcaaagtggccgatgtttatctgatcgacgagcccagcgcgtacttggactccgagcagcgcttacatgcagccaaagtcatcaaacgcttcatcctgcacagcaaaaagagtggcttcattgttgagcacgattttatcatgtccacttatttggcggaccgcgtcatcgtttttgacggacaacccgccataaaagccactgcaaatgcccctcaaccgctggtgaacggaatgaaccgttttctgagccaactgaacatcactttccgaagggacaacgaaagtcatcggccgagaataaacaaattgaattcgcagctcgacgtggaccaaaagacgagtcaaaattacttttatttggacaattga

SEQ ID NO: 962 - DNA, 900 bp, Heterodera glycines
  genomic DNA sequence=SeqID_485; cDNA sequence=SeqID_623
  peptide sequence=SeqID_1180
atgcggccaccggttgacgaggattatcgcccgatccgcgtacttggccaaggcgcgtacggcgaagtttggttggtgaccagcaaagaaaatgagagagagcagttcgccatgaaaaaaattcccgttaaagcgacggaggagggaattccgcagagtgtcgtcagagaggtcgcttctctcgtcgcactcaaacagatgaaacacccaaatattctcaggctccacgacgcattcattcgccgaaagggcggcaccatcagtttgaacatcgtctgcgaaaagtgcgactgggacttgtgcgactttttgcgaaaaattccgaaaaatatgtgcgacgcgcagtgcaaatattttgcacgtcaaataatgacgggcattgatttccttcatgccaacagtattattcaccgtgaccttaagcctcaaaacattttggtgaacaaagaccacactttgcggatcgccgatttcggactgtctcggaactacggtctgcatgccaccttcaccaccgaggtggtcaccctgtggtaccgtagccctgagctgctgctccagtgcaagtacggtactgcggtcgatctttggtccgccggttgcattttggcggagctgtacacgcgcgacgcgctcttcagaggggatacggaggcggagcaattgcgcatcatttttgaaaaactcggcactccgtccgtctctgtttggcccgccgatgcaattgtccctcattctttctacgccgaaaactctccgcacataacacctccgtttgccaatcagatgccccaatatttgcccgcctccggtgttgagttgctcacggcaattttgcaatttaatccgcacgaacggccgactgcggttgaatgtctgcagcacaaatactttgtctga

SEQ ID NO: 963 - DNA, 1646 bp, Heterodera glycines
  genomic DNA sequence=SeqID_305; cDNA sequence=SeqID_591
  peptide sequence=SeqID_1181
atggcttctgttccaactcaaaaagatgagaaaacgaaacgaaatgaggagttggcaactgcgattctcaagaaaatgccgaagccgaacagactcattgtggaccaatcgcccaaagacgataacagcagcgttctaatggcacagactaaaatggatgacctgggattgtttcgcggcgattcgatccttctcaaaggcaaaaaacgtcgtgagacaactagcattgtcatagccagtgacacttgtcctcccgagaaaatcttgatgaatcgagttgtgcgtcagaatctccgcgtcaaactgggcgatgtcgtcagtgtgtcgtccgcttcaaatacgccaaatggactgcgcattcacgtgcttccgattgatgacaccgttgaggggctgaccggaaacttgttcgaggtgtttcttaagccctactttttggaggcctaccgtccggtttacaaaggcgacacgttcactgtcaacgcagcaatgcgaactgttgagtttaaggtgattgaaactgatccggcgcctgcttgcattgtggtcccaacaacgatcattcattgtgagggggaaccgatcaaacgtgaggacgaggagaacaatctgaacgacgtcggctatgatgacattggcgggatgcgcaagcagttggcgcagatcaaagagatggttgaactcccgctccgccacccgatgcttttcaaatccatcggcattaaacctccccgaggaatgcttttgttcggtccgccaggcactggaaaaacacttgtggcccgtgctgtcgcgaatgaaactggcgcattctttttcctgctcaatggacctgaaataatgagtaaattggctggtgagtcggagtcgaatttgcgcaaagcattttccgagtgcgagaagaattcgcctgccattcttttcatcgatgaaattgacgcaattgccccgaaaagagaaaagacacacggcgaagttgaacgtcgcattgtttcgcaattgctcactttgatggatggactgaagcagcgctcgaatgtcattgtcattggtgcaacaaatcgtcccaattccattgacccggctcttcgtcgctttgggcgtttcgatcgcgagattgacattggtattcctgacgcaattgggcgtttggaaattctgcgcattcacactaagaacatgaaattggcggacgacgtcgacttggaaaagattgctaatgagtgtcatggctatgttggtgccgatttggctgcactgtgctctgaggcggcaatgcagcaaattcgtcaaaagatggagctgatcgacttggaatcggaaaatattgatgcggaagtcttggcgcaattggctgttactatggacgactttcagtttgcactcggtaaaaacagtccgtccgcgttgcgtgaaaccgtcgttgagactccgaatgtcacttgggaagacattggaggccttgaaaatgtgaagagggaattacaggaattggtccagtacccggttgaacacccagagatgttcctcaaattcggaatgcaaccatcccgcggtgtcctcttctacggtccgcctggttgtggaaaaactttgcttgcgaaagcaattgcacgcgagtgccaagcaaacttcataagcatcaa

SEQ ID NO: 964 - DNA, 474 bp, Heterodera glycines
  genomic DNA sequence=SeqID_470; cDNA sequence=SeqID_761
  peptide sequence=SeqID_1182
atgacgacaacaaaagaagggagcatcaaacgcgagcagttttatgtgcgctattatgttggccacaaaggaaagttcggtcatgaatttctcgagttcgaatttcgcccggacggcaagttgcgctacgcgaacaattccaattacaaaaacgacactttgatccgaaaggaatgctatgtgggcaagtcggttatggacgaattgaagcgtatcattgaagattctgagattatgaatgaggatgatgccaattggcccgaacctgaccgagttggacgtcaggaactcgaaatattgagcgggaatgaccacgtgtcattcactaccagcaaaatcggttgtctcgtcgaagtgaacgacagcaaagatccggtgggactgcgctcgttttactatttggtccaggacttgaagtgtttggtgttctcactcatcggactgcacttcaaaatacgaccaattgcgcaatga

SEQ ID NO: 965 - DNA, 1032 bp, Heterodera glycines; identical to SEQ ID NO: 741
  genomic DNA sequence=SeqID_455; cDNA sequence=SeqID_741
  peptide sequence=SeqID_1183

SEQ ID NO: 966 - DNA, 1290 bp, Heterodera glycines
  genomic DNA sequence=SeqID_374; cDNA sequence=SeqID_783
  peptide sequence=SeqID_1184
atgattatcagcagcaaagccgtccaacttttgacttgctacagaaataggatcaccagaaaactacaatattcgactacggagaatgtgccggtgaatgtgcctgagccggtcatttcctcctccaacatggcacagttccgcaagggagcgggcggtcgttccagcttctcgggcaatgtcattacagtttttggcaataccggatttaccggccgaagggtggtcaatcggttggccagacacgcaaatcagctaattttgccgtaccgctgcgattcgtattttctcagagaattgaaagtgccttgtgaccttggtcaagttctgttttttcctttccaattggacgacgatgaaagcattcggaaggcagtcaaatacagcaacgttgtgatcaatatgatcggcacatatgtcgacacaccgaattattccatttatgacgccaatgtggagggtgcgtggagaattgcgcgcatttgtcgggaaatgggcgtggaacggctgatccatgtgagcgcattgaacgcggacccatcgtacaaaacacaattcatcaaaaatggcgcctttctgaaaagcaaaggcatggccgagcaggcggtccgtgccgaattcccaagtgccaccatcattcggccctctgtgatgtacggcgacattgaccgtctcatttataatctgatcacccgttggcgcgttgacccgttcggcaatgtgtacactttcaatgcgggcgaaggcatttacaaaatgccactttttgtcaatgactttgccgacggagtgaacagagtggcgatggactcctcaacagcgggcaaaacctacgaatttgtcgggccgcactgctacgaaatgtgcgagttgttcgacttcatcttcatcaaaggcggcctcgtcgctgacataactagcagataccgtcgtgttggtattccgatttggttccttttcacgtcttttctctgtcattcgtatacgaaaatatatcgtcgtcctggcgttattaattgggagtggttcgatttcatggaagcgacgagtgatgtgctgtcggctggggacacttatcttctgaaggatttgggcgtttcgttgaccgattttgaggatatgggcggctattacgccatgcaaatttcttttcagagaccataccagccaagaatggctgactatccgcagtgtccgctcccccttcgttcgccgcctctttacaaacggaagccgatcacttttaagaagcaaaatatagtcactgagcaaagggcgttcggactttga

SEQ ID NO: 967 - DNA, 1175 bp, Heterodera glycines; identical to SEQ ID NO: 778
  genomic DNA sequence=SeqID_481; cDNA sequence=SeqID_778
  peptide sequence=SeqID_1256

SEQ ID NO: 968 - DNA, 2160 bp, Heterodera glycines
  genomic DNA sequence=SeqID_365; cDNA sequence=SeqID_749
  peptide sequence=SeqID_1185
atggcccacctcatccaggacggttttgtcgtcaatgacgcaacatggaaactaggcattttcatcaccgatatgaacatatcgcgagagttattcgttcgcggtgacatgaccatcggtagtctgatgatgcagttggtggggcaaattggcgagactcaggactggagtgaccattacatgtggtggcctgaccgccgtaagtggctgaaacacacgcgaagcacgttggaccaaattggaatcactgcagcgacttacttggaatttacaccgatgcataaacatgccaaggtccaactccccgatttgcagattatcgatgcccgactcgatttttccgtgcccattttgaaggtcacccaaaaaatctgccaagaacttgccatccgtcacccggaagaactgtcgctgaagcgtgatattccgccagatattttgcgaaaaggcgcatctgtcgaatcggaggctcagattcagccatacatgaagccgggcgaggagtccattggacccggcactctccgaacggccaaacccatccgcgcttcaactgtcaacctcactagcgggcgaggctcacctgcactttcgcaggcatctgcaatgggccccggtcacttgtttaacgcttctgaaattggcacactgccgaagatgggaacgattccgcgcggaatgagccccggtccagccgcatatcgcgaagtgcttggacgaacaccggagcccggttactctgaaggaggcggtctcgaatgtgaccagttcgacgaaaatttgataaactcaccgaaaataactccgggtcgtgaaacattcagaccccaaaattatttggagaaagccgcgttgaaccggggatggttggactcatcgaggtcgctgatggaacaaggcatttgcgaaggcgatgttgtgcttcttcgttttaaattcatgcagtttttcgacatgaatctgagatatgaccccgtccgtatcaatcaattgtatgaacaggccaaatggtccgtccttttggaggaggtcgaacacacggaggaggagtcatcattatttgcagcgctgcagttgcaagccgcgcttcagcgaaactctccggaccgcgaatctccggaacgtgacgaggtcgatgtactgcttgatgagttggaacagactttggacaccactgcctcactaagtcgccgtgatttaacatacgtgcctgagttgacagaatatctcaaatatttgaaacctaaaaaattgggttttaacaacttcaagagagcttactttacatttcgagacctttacttgagttattacaacacagctcaagatgcaaatgggcctccacttggtcactattatctcaaaggttgcgaggtcagccaggatttgagcgtctcgcaaggaaagttcaacataaaattgcaagtgccgagcagtgaagggatgtcggaactgatattgaagtgtgacacggagcaacagtttgccaaatggatggccgcttgtcgtttggcatctcgtggaaagacaatggccgattcttcgtacaattcggaggttgaatccattaagaaagtgctgcagatgcaagcaggaagggcagcggcagcgcaaaacggtgcacaaaacaagaagaaatcgcaaccggtgcagctgcccacggatttcaattcggaagagttcgtttgtcagcgatattggaagagatcggggaacaaaagcatgcaacagcgcatttcggatgcccattcaaacgtgaaaacattgagttgcaccgaagcgaagcttcagtacattcgcaattgggaggctctgcccgagcacggccttcactatttcatcgtcaaattcagaaatgggaagaaagctgaactcattgcggtggctcacaataggatgatgaaagtgaacagcgacaacggagaatcatcaaagacatggagattctctgggatgaaaaaatggcacgtgaactgggagataaggcacttaaagatacaattcgacaacgaggatgtcgaattcaaacctttgtcagcggactgcaaggttgttcatgagttcataggcggctacatttttctctcaatgcggagtaaagaccaaaaccaaacactggacgaggaagggttccatcgcctgactggaggatggggatag

SEQ ID NO: 969 - DNA, 2058 bp, Heterodera glycines
  genomic DNA sequence=SeqID_385; cDNA sequence=SeqID_635
  peptide sequence=SeqID_1186
catcctcgtgttcgttacgccgtttgcaatgccattggccagatgtgcaccgacttccagcccaccatccaaaagaaatgccatgagcgtattgtgcccgttctcctcgaggccatggccgacatgtccgtcccgcgagtggctgcgcacgcggcggccgcaatggtgaacttttgcgaagattgtcccaagtcaatcatcagtatttatttgccatcgataatggaacgattggagtcagtgctttcacaaactttccagcaaatgatgaccaatggcaaaaaactcgtcttggaacagataatcaccacgatcgcttcggtagctgatgccgcccaggatcacttcgccaaattttacggcaatttgatgccccctctcaaatacatttttgaaaacgccaaagatgacaatttgaagttgttgcgtggcaaaaccatcgaatgcatttcgctcattggaatggcagtcggcgcggaactgttcgagacggacgccgacagcgtaatgcaagtgttgctcagctcgggagtcaaattcgagaacaatgacgacccccaaatctcctacttcatcagcgcgtgggcgcgcatttgcaaaatcctcggcaagggtttcgccaagtatttggacatgattatgccggccgtgctgtccgccgccgacttcaagccgtctgttgcgcttgtggatggcaaggacacggatgacaacgaggactgggattacatgccaatcgacgagaaccgctcgctgggcgttcacacggccggactcgaggacaaagtgactgcgtgcgaaatgttgtgctgtttcgcgcgtgagctgaaggacagttttgccgcttacgtggagcgcgttatgcaactgatgctgccactgctctcctttctgttccacgacggagtccgttctgcggctgccgagtgtcttccgtgtttgttggtctgtgccaaagggtacggggatgagtacgtgcgccaaatgtggtcggtcatcctctccaattacataattgcgattggcaaagagactgatcttgaagttctctgcgaaatgctcaatggaattgcgcaatgtgtggaggactttggagggaatgacgccattgtgacggaccaagatgtggcgaacattttctgcgtaatttaccaacaaatcgaaaactttgacaagcgacgggcggagagggaaaagaagtctaaagaagaggagcatgacgaggaggaccaagagagattagacgaaatcatcgaactcgaaacttcggttttggcccgtgtgtcggacatcatccattaccttttcttgaccaaacgcgaggctgtcatcccccactttgacaaaatggcacaaatattcgctgcccttctcaacccgcgacgccctttccacgacagacagtggggcctttgcatatttgacgatgtcatcgaatttggaggcgaattgagtatgcgctatcagaatattttcttccaaccgatggtcactgctttggccgacaaatatcccgaggttaggcaggcggccgcttacggctgcggaattatgggactgaaggggggacagaattacgcgaaacattgcgcccaaatgcttcagccattaatcaatgccattgagaagaacgggtcgagaagcaccgaagaggacacgcgggcgacggaaaatgcgataagtgcggtggcaaaaatactcaaatacaacgcgacagaagtgaatttcaacgaggttgtgccgcgtttcgtcggttggttgcccatttggaatgacgaggaggaggtgccgtacgtgttcgacttcttctgcgatttggtcgagtctcagcacgacgcagtgcgagaggacccgtctcgtgttttccacattattctaaacgctttttcgcacggtgcttttgaggacgactcggcggaagagatgcgattggtcaaaagtcggatgaagggaataatggcacacattcgtgccaatgaacagttgttcacgcaaattgtacaatcgctacaattgaacactcaccagcgaactgtgctggagcaaattttagcctga

SEQ ID NO: 970 - DNA, 1158 bp, Heterodera glycines; identical to SEQ ID NO: 751
  genomic DNA sequence=SeqID_462; cDNA sequence=SeqID_751
  peptide sequence=SeqID_1187

SEQ ID NO: 971 - DNA, 741 bp, Heterodera glycines
  genomic DNA sequence=SeqID_366; cDNA sequence=SeqID_759
  peptide sequence=SeqID_1188
atggtcgcactccgtgcccaatttgaggcgagcaatgatgtcggagttttctgtaaactcaccaatgcttattgtctggtgggcattgcttcttccgaaaatttttacagtattgtggaggctgagttggccgacgtcatcccggtcatccattgcacagttgcgggctgtcggattgttggccgtgtgacggccggtaatcggcacggactgttggtgccgaacgcgaccacggaccaggaattgcagcacatccgcaacagtttgcctgactcggtccaaattcggagggttgacgaacggttgtcagcgctgggcaatgtaattgcatgcaatgaccacatcgctgttgtccacgcggacataagcaaggaaacggaggcggcgctggccgaagtgctcaaagtggaagtgttccggctcagtctcggcgaaaatgcattggtgggctcttacgcggcgatgacctcaaacggtgcgttggtggcggcaaagacaccgccggaggtgcagcgcgagttcgcctcgctcgcccaagtgccggtggtcgccgggacggtcaaccgcggctcggaactgatcggtgccggctgttgcgtcaacgattggatcgcattcacaggcctcgacacgacttccgccgaactgtccgtgttggagtccatcttcaaattgggagacgcggcaccgagcgcaatttccaccgatttgcgcgacactttgatagaatcgatgctttga

SEQ ID NO: 972 - DNA, 957 bp, Heterodera glycines
  genomic DNA sequence=SeqID_454; cDNA sequence=SeqID_739
  peptide sequence=SeqID_1189
atggctaacaaaatgaagaaaaagaagaaaaatgctgttgctactacaactgctggaccccaaaaggatggaggcaaattcaagcagaaagggatcaaattcaacacggaaaagggccaacacattctgaagaatcccggcgtggtccatgccatcgttgagaagtccgctgtcaagggcactgacactgtgctcgaggttggcccaggcaccggcaatttgtccatgaaattgttggaccgtgccggccgtctgattgcctacgaattggaccctaaaatggtggcagagctgcagaaacgtgtggtcggaacacccgtccaatacaaattgcgtatcattgctggcgatgtgatcaaagcagccgagtggcctccgtttgatgtgtgcgtctccaatttgccctaccaaatttcatcaccgtttatttttcgactattgctccaacggccattgcccaggtacgccgtgctgatgctgcagaaggaattcgccgatcgactgttggccaagccgggcagtaaggtgtattgtcggctgtccgtttctgttcaattattggccaccgttgagcatctgatgcgtgtgaagcgttccgaatttgtgccacctccaaaggtggactcggccgtcattcgcattcagccgcgcaatccgccgccggccatcaattacaaggaatgggatggaatgttgcgcattgcgtttatgcgcaaaaacaaaacactgtcggcgctgttcaagcagaagcaggtggtcgatgtgttgcgcaaaaattacgcagtcgtttgcggcacgaggggaaaggaagtgccaactgatttttgcatgacctcacacattgaacgggtgttggaagaagcacaatttgccaagcggcgtgcccggacaatgtcaattgaagactttttggcactaatgttaacatttaacaaggcggacattcatttttgttga

SEQ ID NO: 973 - DNA, 393 bp, Heterodera glycines
  genomic DNA sequence=SeqID_334; cDNA sequence=SeqID_620
  peptide sequence=SeqID_1190
atggtgcgaatgaatgttttagccgacgctttaaagtcaattaacaatgctgaaaagcgtggcaagagacaggtgatcatccgaccgtcttcaaaggtgatcatccgtttcctcacggtcatgatgaaacacggctacattggcgaattcgaaattgttgatgaccatcgtgccggcaaaattgtggtgaatctcactggacggatcaacaaatgccaagtgatcagtcctcgtttcgacattcgaatggccgacttggagaaatggaccagcaatttacttccatcgcgtcagttcggttttttggtgctcaccacttcggctggcattatggaccacgaggaggcacgtagaaaacacgtgggagggaaaattctcggtttctttttctga

SEQ ID NO: 974 - DNA, 689 bp, Heterodera glycines; identical to SEQ ID NO: 683
  genomic DNA sequence=SeqID_413; cDNA sequence=SeqID_683
  peptide sequence=SeqID_1191

SEQ ID NO: 975 - DNA, 3153 bp, Heterodera glycines; identical to SEQ ID NO: 726
  genomic DNA sequence=SeqID_361; cDNA sequence=SeqID_726
  peptide sequence=SeqID_1192

SEQ ID NO: 976 - DNA, 386 bp, Heterodera glycines; identical to SEQ ID NO: 670
  genomic DNA sequence=SeqID_491; cDNA sequence=SeqID_670
  peptide sequence=SeqID_1266

SEQ ID NO: 977 - DNA, 2307 bp, Heterodera glycines
  genomic DNA sequence=SeqID_319; cDNA sequence=SeqID_605
  peptide sequence=SeqID_1193
aatcaaatttcaggggctattgatgtgattgttgtggaacaacctgacggctcattggcctccactccatttcatgttcggttcggaaagtacggcgtgttcaactacgagaacaaatacgtcgacattgaaatcaacggggaagagattgacctgaaaatgaaattgggagagaacggagtcgcctttttcttggcaaatgacgaagagggaattggcgagacaaaaaacgcggagggaaaggagtttttgagagaatcgcaaaacaaaaagtggagcgaagacacacaacagaacaatcggccgtcagcaattgacctggaaaaccaacggaaatgctcttttgcgagcagtagcagcagcaccagcagttgcacttcccaaccgcagcacaatgaatgcccaccaacggcgacgacaacagccgaaagaaagcaatcgacgccgccaaagcggtcaaaaatgttcaatccgtcctttctcaaccacaaggcgtccgtccaacagaaccgtcagcgactgcctttttcgtcgtccatttattcgtgccgaaggaatcgctctttgcccgatttggccaatttgttgtcgccttcgtcgaacatctacgactctgaaactgttgctgaagaggaggggatgggccgacggaagggcacaatgagcagccgaatggacgagttgagaaagtcggacgggacgccggaggtcaacaacgccctgaagcattccaattccgcatcggtgccgttgaagagttattataaacacgagtcagcaaaaactacccaattctcctcccctgacagtgacaagggacgggcagagggagaaaagggacagcgggcagaggacgacgagtcgaagagttgtgccccgtcgaccagcgaattggcggacggcgctttgtccgactcggaggtggacagacacggaagcattaaagatccagaatggaaatggggcgaaatccccaaatccaacgggaaagggtcgaacaaagcggacggaagtgcatcgaggaaaaaggtgagtcgatgggactattggtttggccgttggtcccgccaaaacaaagagaaggaaacggagggacggaccggcggtggcgaaaatggtctttcgttggaggacatcggcaacaacccggtcaaattcggcctttacatcggcccaagcaaaaccgaggccatttgcatttcctcaaaaagttcggacagcggaaatggaccttctcttggcaccagccccacaatgtcattctcgccggtgcttacaattagcgaagagaatttggcctccgaattcgcaaaaggcaacgtaacaattgcggacagacgcccttcgaatgcaatggacttcgaactgtttgaggagaaggcaaaagagaagcggtcgttgcgtctctcccgtgaccaattggacctgttgaacttgaactacgggtcgaacgacgcgcggttcagcatcacaacaaaatatcagggaactgcttggtgttcttgtcacatttatttgctcaaatggtatgacaaattggtcatctcggatatcgacggcacaatcacaaagagcgacgtgcttggccatgtcattccagcaattggtggcacttgggcccattccggggttgcagagctgtatactggcatcaaaaagaacggatatcaaatggtttatttgtcttcgcgtgccattggacagtcccactacacgaaaacgtacctgcagaacttcgcccaggggtccaggactttgcccgacggacccgtccttctctcgccttcttccgttctgatggcattcagaaaggaggtcattgaacggaaacccgaggagttcaaaatcgcatgtctcaccgacctgaaatcgctgttccccgtaggacagccattctttgccggatttggcaatcgcgaaacggacgttaaatcgtatcttgcggtccaaattcccccggaaaggatcatgattattgacccgcaagggtcgctcagaagggcggacaacaaagcgggtggttacgtgtccgattacccaaccttggccatggacagtgtcgactacgtgttcccgcctcgggtggacatggacggcatcgacattaggacgaaagaggacggcattttgagtgaattcgtcgcatggcgaactgacgctgaacaattcgatgcgctggtggacgcggaattggaacagtacgaagaaaggagcaaacgagcgaaagcaattgtcgcggggacgacggatggacgaggggcggacggaaagaagaaaatgtataggaacggaagacgggcaaagtga

SEQ ID NO: 978 - DNA, 1016 bp, Heterodera glycines; identical to SEQ ID NO: 780
  genomic DNA sequence=SeqID_483; cDNA sequence=SeqID_780
  peptide sequence=SeqID_1194

SEQ ID NO: 979 - DNA, 2636 bp, Heterodera glycines; identical to SEQ ID NO: 636
  genomic DNA sequence=SeqID_386; cDNA sequence=SeqID_636
  peptide sequence=SeqID_1195

SEQ ID NO: 980 - DNA, 2103 bp, Heterodera glycines; identical to SEQ ID NO: 641
  genomic DNA sequence=SeqID_389; cDNA sequence=SeqID_641
  peptide sequence=SeqID_1196

SEQ ID NO: 981 - DNA, 2678 bp, Heterodera glycines; identical to SEQ ID NO: 654
  genomic DNA sequence=SeqID_396; cDNA sequence=SeqID_654
  peptide sequence=SeqID_1197

SEQ ID NO: 982 - DNA, 1188 bp, Heterodera glycines; identical to SEQ ID NO: 613
  genomic DNA sequence=SeqID_327; cDNA sequence=SeqID_613
  peptide sequence=SeqID_1198

SEQ ID NO: 983 - DNA, 878 bp, Heterodera glycines
  genomic DNA sequence=SeqID_388; cDNA sequence=SeqID_639
  peptide sequence=SeqID_1199
ggtatatggtcgatgaatcgggcgcctcgctgacactgcgcgtgttggagcacaaacagtttgtgcgcttcgtcaacatttgggcgcgcggcttttggaccattggccgggcggaggacggacgtctgtttgtgtgcggcctcaacaattttggacagcttggcgtgccgccccaatcgccggcgcaccgcaagtccgccgctgggaccagcgacgaagatgacggtggaatcggtccgcccaagccaaagtcgccggccaccatcgccgctggccaagaggagtccaacaaggtggcactgctcacttgcgccaccgcgtttccggccgaaaaacggtggacccatgtggcgggcgtgcagcatgtgatctgtcggagtggggacgacagccaaatttatgggattggcaagaacacggacaacgcgttgggcctcgacacgtggcagggcaaccatgacgaggagcactggcgctatgacacactgcagcacatcccattgccggacggagtgaacaccgtggccggcgtggacgcaacgctgggcgccaccatattttggacggatgatggtcgagtgttcggtttcggctgcgacacggttggccaactcgggctgggcatcaaggaagaggatgagaaggtggtgtcgaagccgcgtcagatcacttcggcacatttggacggatatcgagtgttgggcgtgtccattgccgacaatcatgcgctttttctcgccgcgtcgattgaccaacaaccgccgctgtcatcagcttcaccaccaccaccaccacaacagcagaaggcccagcagcagaaacaactgcagaccaacggcaacggaatattggaaacaccgattgatggcaaagcttga

SEQ ID NO: 984 - DNA, 759 bp, Heterodera glycines; identical to SEQ ID NO: 769
  genomic DNA sequence=SeqID_369; cDNA sequence=SeqID_769
  peptide sequence=SeqID_1257

SEQ ID NO: 985 - DNA, 2608 bp, Heterodera glycines; identical to SEQ ID NO: 614
  genomic DNA sequence=SeqID_328; cDNA sequence=SeqID_614
  peptide sequence=SeqID_1200

SEQ ID NO: 986 - DNA, 1287 bp, Heterodera glycines
  genomic DNA sequence=SeqID_444; cDNA sequence=SeqID_729
  peptide sequence=SeqID_1201
atggttgagacagcggaacaacctgctaaaaaggaagacgagaagatggaaaccgccgaagatgagatcgatgctgaaattttgcaaatgtctacggaccaaattcgggagcggtcgctgttgctcgacaacgaaattcgcataatgcgcagtgaaattcagcgcattagtcacagtatgcaaacactcaaagagaagacaaaggaaaacaacgaaaggatcaaaatcaacaaaactcttccctatttggtctcaaatgtcattgaacttttggatcttgaagagcaacaggaagaggaaggagcaaacattgaccttgatgcccacaaaacaaagtgtgccgtcatcaaaacatccacgcgtgccacttactttctgcccgttgttggtcttgtggacccggaagaaatgaaaccgtccgatttggttggcgttaacaaggactcttatctcatcctggaaaaactgccacccgagtacgactcacgcgtgaaggccatggaagtggacgagcgtccgaaagaaacgtactcagacattggcggatgcgatagtcaaatcagagaattggttgaagcaattgttcttccgatgactaaaaaagatctcttcataaacattggcattcagccgcctaagggcgttcttatgtatggaccaccaggtacgggtaaaacgatgttggcacgtgccgttgccgctcaaaccaagtccacttttctgaagctggctggtccgcaacttgtccaaatgttcatcggagacggcgccaaattggttcgagatgcttttgcactggccaaagagaaagcaccgtccattattttcattgacgaattggacgcaattgggacaaaacgattcagttcggagaaggccggcgatagggaagtgcagcgaacgatgttggaattgcttaaccaactcgacggcttccagccaaatgacgacataaaagttattgctgcgacaaaccgtgtcgatgtgctcgacccggctctgctccgttccggcagattggaccgcaaaattgaactgccagcgccaaacgagaaggcccgggcgcacatcgtccgcattcactcccggaatatgaacgttgataaggatgttaatttcgatgagttggcacgttgtaccgacgattttaatggtgctcaatgcaaagctgtttgtgtggaggcgggtatgatcgcgcttcgtcgtgaatctcacatcattctgcacgaagattttatggacgctgtgcaagccaagaagaaaacgagtctgaattattatgcctga

SEQ ID NO: 987 - DNA, 1326 bp, Heterodera glycines
  genomic DNA sequence=SeqID_424; cDNA sequence=SeqID_699
  peptide sequence=SeqID_1202
atggaaaatgaaagtcaaggtgcgcatttaatggaccaattggacagtgtcatcccttcgctggtcaatccttccgagtgccaaagtgagaaggatttggcattgtttcggcaacttttccgccaatttttggaggatccgcacaaagtgaattggcaggaaatacaaccaatggcaaaggaaaagcaaatgccatacgaacatttgccgaaggtggagggatcggaggagagaagggcaattttggaacgaattgcggtgataaaactgaacggaggattgggcactacaatgggctgttccgggcccaaatcgctggtccaactgcgtgacggactcacctttttggacttcgccctgcagcagcaccgcattctgttgaactgcgccgacttgcgctcccccgttccgcttctgttgatgaactctttcaacaccgatgcgcaaaccaaagccttcctctgggcacaaaatgccaattctgtcgctgctgtcaaatgcttttgccagtcgaagtgtccccgaatatttgccgattctcttcgtccggtgcccaactcgtgggatgaccgtgccgaagaaggttggtacccgcctggccatggcaatgctttccatgctttggatcagtgcggaatgctcgacgaacttttggcgaacggaagggacttggcatttttcgccaacattgacaacacaataattgcggacggaaaggccgattatgtgatggaaatgacggaacggacacaagcggacgtgaagggtggcacattggtggaattggacgggggaaagcgtctgatgcatttggaatgtccgcaagtgccgtcggatcggttggacgaattctgttccctgcggacgttcaagatgttcaacactaacaacatttgggtgaatcttcgcgtggtcaaaaagcgattggacaaattcaaaatggaaattctcgccaatgaaaagcgtttatcagacggtcaacgcgtcgtgcaattggagcaatccattggcggtgccattcgaaactttcccggccgcgcatgggcaatttacgtttcacgacaacgctttttaccggtcaaatccactcgtgatctgttccgcgtccgttcttctgatttattcgaattctgggccgattcttttgtgctgcgacagcgtgtctctctgctgccaaatgtgtgcctttctgatcacttctcttcacttatagactttgaacggcgaattcctcaaattccaaaaatggaaaaagtgaaaagcgtccgtttggagggcgatgtttggctgggcaaaagcataacgatgagggtatttaatagttaa

SEQ ID NO: 988 - DNA, 936 bp, Heterodera glycines
  genomic DNA sequence=SeqID_309; cDNA sequence=SeqID_595
  peptide sequence=SeqID_1203
atgattggggaagagcttacggatgttgacaaggctcgcattgcgtcagacattctgcttcagtcgccgccgggcgagttcaacgaggtgttcaacgacgtgcgcactttgttgcagaacgacgcacttttggaaaagggcgtctgtctggaggcggtccggcgctacaacaaggcacagtttgtgccggtcaaccccgagccgggcgctgaacacccgactttgatcaccgaacacaacgaattgccggacggacgtttcgtggacccaaaaacgggccgtgttttcaaatacgaccatttgcgaaaggaggcggccgatgcgcagccgtcggggcccaaggaaattgacgaaaaattggagccatggcgaaaggcactgcaaaaagagttggacgagtacatttacgagcatttccatctgaccggcgtcgccactgttttcacgccgttgcagcaccaaaaagagccgaaactcattctatgcattgagtcccatcagttccagccaaaaaactattggaacggtcgttggcgttccgaatggcattttcccaactttgacggctcttcaaaaacggcggggactctccaaaaatgcacgggcaaattgcgtttgcaggtgcactattatgaagacggaaatgtgcagctgatttcggagaaagaggcgacggtggaagtgaaaatgacgaatgaccgggagacgagtgcccgtgaactgttgcgggcaatttgcgaagcggagtcagcttatcagacctccatccaggagtcccaagtgcaaatggagagcaccttcaaggcgcttcgccgtcagttgcccgtcactcgctccaagctgaactggctgaacttccactccttccgcatcactcaacaggacatgaaacagccgccgacgcccaccgtcgctgtccaacaacagtcccagtga

SEQ ID NO: 989 - DNA, 574 bp, Heterodera glycines; identical to SEQ ID NO: 626
  genomic DNA sequence=SeqID_486; cDNA sequence=SeqID_626
  peptide sequence=SeqID_1204

SEQ ID NO: 990 - DNA, 969 bp, Heterodera glycines
  genomic DNA sequence=SeqID_440; cDNA sequence=SeqID_723
  peptide sequence=SeqID_1205
atggacgagccgcttctgcaggaaaacccaaatcgttttgtcattttccccatcaaataccatgacatatggcaattttacaagaaggcagttgcttcattttggacagttgaggaggttgatttgtcaaaggatatttccgattggaaaagcttaactgataatgaacgattttttatttctcgagtacttgcattcttcgcagcttctgatgggattgtcaacgaaaatttagtggagcgctttgctcaagaagttcaagttccagaggctcgctgtttttatggtttccaaatagccattgaaaacattcattctgaaatgtattcgctgttgattaactcttacgttaaggattcggatgaacgtgctaagctttttaatgccattttcgagttcgaatttatcaaaaagaaggccgactgggcccttcgttggatcgcaagttccgacgcttcttttgcggagagactcgttgcatttgctgcggttgaggggattttcttctcggggagttttgctgcaattttttggcttaaaaaacgaggccttttgcccggtctgacgcacagcaacgaattaatttcgcgtgacgaaggcttacaccgtgactttgcctgtcttctctacacccacctcaaaaacacgccacccaaagaacgcatctacgaaatcatctcggacgcggtaaaaattgaacaggaatacctaaccgacgcacttcctgtctatatgatcggcatgaattccgatttgatgtgtcaatacattgagttcgtcgctgaccatttgctggttgaactaggctatgacaagaaatacaatgtcctcaatccgttcgacttcatggagaatctgtcgatacagggcaagaccaatttttttgagaagcgagtgtcggagtaccaaaagatgggagttatttcaacagaagagcagcgtgaattccgtcttgacgctgatttttga

SEQ ID NO: 991 - DNA, 393 bp, Heterodera glycines
  genomic DNA sequence=SeqID_376; cDNA sequence=SeqID_624
  peptide sequence=SeqID_1258
atgatttaccaccgatttgttgagattggccgtgtcgtttacattgccaaggggaaggaccaaggcaaattggcagtcattgtgaatgtcatcgacggtaacaaggttttattggacggcccctcctcgggtgtgcctcgcggtgtttggaatttcaaagacttgcagttgacaaaattcaccctcccactgcgtatcggccaacgtacgaaaggagtgcgcgaggcttatgaaactgccaaaatcaacgagttatggcaaggcactgagtgggcaaagcgcattgatcggaaacagaagcgtgccgggctcaacgacttcgagcgcttcaaagtgttcaaagccaaacagcacccgaaacccgtttggtccgcgttgagatggctaaactga

SEQ ID NO: 992 - DNA, 1560 bp, Heterodera glycines
  genomic DNA sequence=SeqID_465; cDNA sequence=SeqID_754
  peptide sequence=SeqID_1206
atggaccatcaggcgttgattgacgagctgccggaggtggagaaaatgccagcccaacagcgcatcgctttggcccgtgaacgacgtgaacaacaattgcggttgtgtcagcagcgcgaaggacatttgccgcagcccgccccgcgtcggccgcggctgcggttcagttccgacatcgctctgctggagacaaccgtccgtggcgacgcgcaggaagttgagctgatgctgatggatggtgtcaacccaaactcacacaatgaagatggcctgactccccttcaccagtgtgctattgacaataatgaaagaattgtgcgacttttgcttaggttcggcgccgatgtaaacgccaaagacacggagaattggacacctttgcatgccgccgcttgttgtggttacattgaaattgtcagacttttaatcaaacacagtgccgatctgttggcggtcaatgcagacggaaacatgccttatgacatatgtgacgacgaacagactttggatcttattgaatccgaaatggcgggtcagggcatcacccaggaaatgatcgacgaacgacgtcagttgccggagcgggaaatgctcagcgacatgaaactgctccaccagcaaggcattccactggaccaacggatgccggacgaatccacttacctccatattgccgctgccaacggcttttacgacgtcgccgccttcctcttgcgctgcggtgtgtcgcccgcctcgcgggacaaagactcgtggatgccaatccacgcggcagcctcttggaatcagcctgatttgatcgaattgctctgtgaatatggggctgacatcagtgcgaagacgcgcaacggggagacgccgctggacctaacggaggacccgcaaacgcaattagtcattcggaccattgcacagacggaggcacgaaggaagcgaatcggacactttggagtgcgagatagtcgacgacagtcgagaaagcgaaagaaattcgaatcaccgcaagccgtaccgcctgccgcgaacaccgacttcattcagacagcccggggcgcaattcggcgtcagtcattacgcgatcggagtgggatgacacttgcacggcttgattcacaacgtgaagggtccgacttgattaggagttggagcaaggaggatgtgtccaatgaggaaatgtctgcgcatcatttcggcaacgggggaccgtccacctctcaccagccgacagcaaatcagcaaagacgcgactcgccgcctaaaagaatgcagaaacaatcgcagcaaaagcagaagcaaatgtcgccagacgagtggttgaagaagttggaggccgaatcgggcggccttcgagacgaagaggaggagcaggcggagaaagacgtgctgaaagggagcgccggggagagcatgcggaagggagcgaaagcacagaaaggcaacggggtgattaggagagatcagcaacagcagcagcaacacgatatgaacggaatgaatctgaagggatcactcggtggacagaatcggaggcggaagaagagctgttgctgcattatttga

SEQ ID NO: 993 - DNA, 369 bp, Heterodera glycines
  genomic DNA sequence=SeqID_335; cDNA sequence=SeqID_621
  peptide sequence=SeqID_1207
atgaagcttgtccgctttttgatgaaattgtcccatgagtctgtgaccatcgagctgaagaacggcacacaagtgagcggtgctattcagggcgtcgacgtggccatgaacattcatttgcgctcggtaaaaatgacagtgcgtggacgagagcaaatcagtttggacacactctccatcagaggaaacaacattcgctatattgttcttccggattctttgccattggacactttgctcatcgatgacgagccgcgcaagaagcccactcaacgccgatttggtggccgtggaggacgcggtgggccgcgcggacgtggacgaggccgcggagggcctccacgcggcggcggcgggggacgacgctga

SEQ ID NO: 994 - DNA, 1191 bp, Heterodera glycines; identical to SEQ ID NO: 764
  genomic DNA sequence=SeqID_340; cDNA sequence=SeqID_764
  peptide sequence=SeqID_1259

SEQ ID NO: 995 - DNA, 983 bp, Heterodera glycines
  genomic DNA sequence=SeqID_403; cDNA sequence=SeqID_665
  peptide sequence=SeqID_1267
atttgttgttgccgaccgaaatgccatttcgcgaccgaacggcggaattcagaacagtggcaaagtcatgtcagcttcgacagcagccaaatggatatatgggaaagagcgaacgagaaaaaatcgttaattcttcaattcagttcaaccaattggccaagcgcattggtcgggatttaagtatgacatgtgccaaaatggagaaattggcacaattggccaagaaaaaatcattgttcgatgacagagctggggaagttgaagaactttcacaaattatcaaacaggacatcacgggcctcaacaaacaaatcgccaatttgcagcaattggccactcaccgcacttccggcggctcttccgtttcgttgcggcaggagcaacaaagccaaaaccactccaagttggttgtggttgggttgcagtcgaagctcgccaacattagcaaaaacttccaaaatgtgctggagattcgaacagagaatttgaagttcaaaagagagagacgagaaaagttcagtcagtcggcggcaattccttcgaatttgcccccttcgacaagcaatggacaaatgggttcgcttcttctgcacgatgaaatggcgtccgcttccagcggttcttcgacctttgcgttggacatggataaattggagcaacagcgggtgcaggaacagaccactttactgctcgacgataccgagcagttccaccaatcccggttcaacgccatggaaagcattgaaagcagcatctctgagctgggcacgattttccgccagttggccactctcgtctcggaacaaggcgaaatgatcacgagaattgactcaaatgtggaggagagcagcctcaacgtggaggcagcacaccacgagttgctcaagtatttcaacaacatttcccgcaaccgttggctgattatcaaagtgttcggcgttctgatggcattctttgtgttctttgtgattttcctcacctga

SEQ ID NO: 996 - DNA, 345 bp, Heterodera glycines
  genomic DNA sequence=SeqID_359; cDNA sequence=SeqID_709
  peptide sequence=SeqID_1208
atgcaggacaatgagccattgatgcgagcgttgagtaagttgatccacatgaacaagcccgacttggtgttgtttgttggcgaagctttggtcggaaacgaggcggttgaccagctggtcaagttcaaccaggcgttggccgacaattccgccgtcggggagcaggcacggctgatcgacggcattgtgctgaccaaattcgacaccattgacgacaaagttggcgccgccatttcgatgacttacatcacgggacagcccatcgtttttgttggcaccggtcaaacttaccacgacttgcgcactctgaacgcgaacgctgtcgtgaacattctgttgaagtga

SEQ ID NO: 997 - DNA, 399 bp, Heterodera glycines
  genomic DNA sequence=SeqID_487; cDNA sequence=SeqID_630
  peptide sequence=SeqID_1209
atggctacttacaatcccaactatgaatccattgggcaggcctttgtccaacacttttacaccaaatttgatgtgcccgatggtccgactcgcaccgtcggccttcatgatttgtatgatgctgaacactcttttatgacttttgaggggaaccaagtgaaaggtcgacaggccattttggacaaatatggagcgctacctttccgaacgattcaacatgggattacaaagactgacagtcagccgcttccggatgggtcaattttggtgacggtgattggtcagcttaagaccgacgatgacccagtgaattcattcaaccactgcttcattctgagaccaaattcttccgggggatttttcatttcgaatgaagtgttccgtcttgttttgcattga

SEQ ID NO: 998 - DNA, 275 bp, Heterodera glycines; identical to SEQ ID NO: 652
  genomic DNA sequence=SeqID_395; cDNA sequence=SeqID_652
  peptide sequence=SeqID_1260

SEQ ID NO: 999 - DNA, 651 bp, Heterodera glycines; identical to SEQ ID NO: 712
  genomic DNA sequence=SeqID_360; cDNA sequence=SeqID_712
  peptide sequence=SeqID_1210

SEQ ID NO: 1000 - DNA, 1416 bp, Heterodera glycines
  genomic DNA sequence=SeqID_350; cDNA sequence=SeqID_667
  peptide sequence=SeqID_1211
atggtttctgtggtcgctgggagagtgcatcttttgccgcgcaccgcctcttttggcaaatcgtttctttcatcggatgcgactaaaaagcctgataagacttcctttggcaatttgaacgactctgatcggattttcactaatctttacggtcgacatgactatcgcctcaaaggcgctttggcgaggggcgattggttcaaaacaaaggaaattattctgaagggtcccaaatggattctcggcgaaattagcacttccgggctgcgcggccgaggcggggccggctttcccagcggaatgaagtggggcttcatgggtaaaccgttcgacggtcggcccaaatatttggtggtcaatgcagacgagggcgagcccggcacatgcaaagatagagagataatgagacacgaccctcacaaattgatcgaaggttgtcttatcgcgggcgttgcaatgggcgcgagagccgcttacatttacatccgaggcgaattttacaacgaggcgtgcattctgcaagaatcaattcacgaagcttacaaagcgggttacattggaaaggactgtcttggcaccggctacaacttcgacattttcgtccatcgcggagcgggcgcttatatctgtggggaggaaacggcactcattgagtcgttggaagggaagcagggaaagccccggctgaagccgccatttcccgcggacatcggattgttcggctgtcctacgaccgtaacaaatgttgaaactgtcgctgttgctcccgcaatttgtcgccgcggtggcgcatggtttgccagttttggcagggaaagaaaccgcgggacaaagttgtattgcatctccggccatgtcaatgatccgaccaccgttgaggaggaaatgtccatcccattgcgcgatttgatcgaaaggcacagtggtggagtgatcggtggttgggacaaccttttggccatcattcctggcggttcatctgtcccattgttaccgaagagcatttgtgacgatgttctaatggatttcgatgcgcttgtccaagtgaattcggggcttggcacagcggcggtcattgttatgaacaaacagtgtgacgttgtcaaatgcattgcgcgtcttgccgagttttacaaacacgaaagttgtggacagtgcacgccttgccgggaggggtgcaattggctgaacaaaataatgtggcgcttcgtccagggcaaaggagtgcccagcgaaattgacatgctgtgggaactgacaaagcaaatagaggggcacaccatttgcgctttgggagacgcagctgcttggccagtacagggactgatccgacattttcgtcctgaattggagaggcgcatggcgaaatatgcggagagtcatcccgaaataaaggaaactttagcgaccgcataa

SEQ ID NO: 1001 - DNA, 678 bp, Heterodera glycines; identical to SEQ ID NO: 687
  genomic DNA sequence=SeqID_354; cDNA sequence=SeqID_687
  peptide sequence=SeqID_1212

SEQ ID NO: 1002 - DNA, 3843 bp, Heterodera glycines; identical to SEQ ID NO: 747
  genomic DNA sequence=SeqID_339; cDNA sequence=SeqID_747
  peptide sequence=SeqID_1213

SEQ ID NO: 1003 - DNA, 402 bp, Heterodera glycines
  genomic DNA sequence=SeqID_494; cDNA sequence=SeqID_705
  peptide sequence=SeqID_1214
atgaacatgaatcaacttttggttggccgttcgctgttcccaaaaatcatccgccctttctcgcacaccaaaccccttgccaagtctgaggctgacccggatgattacggctacttcccggacccaattgaacactcgtggggtttggagaggaaaatgctcatcgctcgtctgaagggtgacgaccgctatgagccgaaggtatatttccgcgctgaacataccacccgggactatccgaatttggtgccggtccatttgcaggacaaagtcgtcgggtgcctttgcgagccggacgcggagtacgtgaactattggcatattaggaaaggccagatgaagcgatgcgagtgcggacattggtttaagggcgtgcaggccgaccctgacagtttcgcctga

SEQ ID NO: 1004 - DNA, 266 bp, Heterodera glycines; identical to SEQ ID NO: 666
  genomic DNA sequence=SeqID_496; cDNA sequence=SeqID_666
  peptide sequence=SeqID_1215

SEQ ID NO: 1005 - DNA, 2044 bp, Heterodera glycines; identical to SEQ ID NO: 674
  genomic DNA sequence=SeqID_408; cDNA sequence=SeqID_674
  peptide sequence=SeqID_1268

SEQ ID NO: 1006 - DNA, 618 bp, Heterodera glycines
  genomic DNA sequence=SeqID_425; cDNA sequence=SeqID_700
  peptide sequence=SeqID_1216
atggtaactgcggaagataccgttaaaacaaaggaagaagaccccaaaaaaacgacaacggacgacggatcgagttcagaggaagaagtgcccgagctcgaagagggcgacgttactgaagagcagaaaaaagttgctgaggcggccggactcagtgagcaggttgccgaaaagggctccaaacaatcgcgttctgaaaagaaggctcgtaaactattcagcaaacttggcctcaagcaagtgcacggcgtttcgcgcgtatgcatccgtaaatcgaagagcattttgttcgtcatcaacaagccggacgtgtacaaaagtccgggctccgacacatacgtcgtttttggcgaggcaaaaattgaagatttggcacaacacgctcaaatcactgacgtggagaatttgaaaccgccctcaatcattcgcgatgttcgcaaccgaatcacaccggcggaggaggaaagcgatggcgaagaggctgatgctactggaattgaagaaaaggatattgagttggtgatgtcgcaagcaaatgtttctcgaaacaaagctatcaaagcattgaaaaaggctgacaatgatttggtgaacgctattatggcattgacaatgtag

SEQ ID NO: 1007 - DNA, 1218 bp, Heterodera glycines; identical to SEQ ID NO: 615
  genomic DNA sequence=SeqID_329; cDNA sequence=SeqID_615
  peptide sequence=SeqID_1217

SEQ ID NO: 1008 - DNA, 570 bp, Heterodera glycines; identical to SEQ ID NO: 679
  genomic DNA sequence=SeqID_498; cDNA sequence=SeqID_679
  peptide sequence=SeqID_1218

SEQ ID NO: 1009 - DNA, 1635 bp, Heterodera glycines; identical to SEQ ID NO: 777
  genomic DNA sequence=SeqID_480; cDNA sequence=SeqID_777
  peptide sequence=SeqID_1261

SEQ ID NO: 1010 - DNA, 741 bp, Heterodera glycines; identical to SEQ ID NO: 664
  genomic DNA sequence=SeqID_402; cDNA sequence=SeqID_664
  peptide sequence=SeqID_1219

SEQ ID NO: 1011 - DNA, 512 bp, Heterodera glycines; identical to SEQ ID NO: 633
  misc_feature (463)..(463): n is a, c, g, or t
  genomic DNA sequence=SeqID_383; cDNA sequence=SeqID_633
  peptide sequence=SeqID_1262

SEQ ID NO: 1012 - DNA, 469 bp, Heterodera glycines; identical to SEQ ID NO: 763
  genomic DNA sequence=SeqID_367; cDNA sequence=SeqID_763
  peptide sequence=SeqID_1263

SEQ ID NO: 1013 - DNA, 1301 bp, Heterodera glycines; identical to SEQ ID NO: 696
  genomic DNA sequence=SeqID_421; cDNA sequence=SeqID_696
  peptide sequence=SeqID_1220

SEQ ID NO: 1014 - DNA, 774 bp, Heterodera glycines; identical to SEQ ID NO: 757
  genomic DNA sequence=SeqID_501; cDNA sequence=SeqID_757
  peptide sequence=SeqID_1221

SEQ ID NO: 1015 - DNA, 411 bp, Heterodera glycines
  genomic DNA sequence=SeqID_467; cDNA sequence=SeqID_756
  peptide sequence=SeqID_1222
atggcgattagcaagggcactaaaattacgccaaaaggtggtaagggcggcaaaggaaagaagaagaagcttacgctaaagtttgtgatcgaatgcaaaaacccagtggaggatggcatcatgaagactgccacatttgaaacctttcttaacgaacggatcaaagtcggcggaaaaaccaatcaactggcggctaatggtgtcaaagttgaagccacgaagacaaaactggtcgttacatcggagcagccattctccaagcgttacttgaaatatctgacgaagaaatttctgaagcgcaatgctctccgggattggttgcgcgtggtagccagtgccaaggacacttatgagcttcggtacttccaaatcaatcaggaagatgaagatgaaagcgacaatgaagcatga

SEQ ID NO: 1016 - DNA, 567 bp, Heterodera glycines
  genomic DNA sequence=SeqID_320; cDNA sequence=SeqID_606
  peptide sequence=SeqID_1223
gaattgttggagcaacgggaaaagttggaacgggccgaacagaatttggacaccattcaccacaccactcagcacacacagcgcagcctgaacagcttgaaatcgtggtttggtgggctggtcagaaacaaactttcacgagcgccaaaagggttgggcacggcaaatgccaatgccaacaatcagcagcaacaaccggaacagaccgtgcagcaacaacatcagcagcgtccgctgcatgcccatttggtgcagtcgtctgctgacgaatttgccggggccatcggtggcggaggcggcggtgttcagcccccgcaacagcactcgctgaactcctcgtcacgcgcgtacattcagggcactcgttgggaggcgatggacgacgaaattgacaacaatttggatctgatgagtgcccatttgggccgactgagaacgtttggcgtcgcgctgggcgacgaggtgcaggaccaaaatctgatgttggaccgcattcaaaagaagacggagcgcaacgacggcgtcatccgctcgcaggaggaccaaatgcggaagttgctcggctaa

SEQ ID NO: 1017 - DNA, 348 bp, Heterodera glycines
  genomic DNA sequence=SeqID_474; cDNA sequence=SeqID_767
  peptide sequence=SeqID_1224
atgaatactcctgctgcctatgagccgtttctgttggctgatggagagaaaaaggtggtcattgagaaggacacaaaagtgccgaatgcggcggtgtttacttttaacaaggaggaccacaccctcggaaacctcctcaaacatcagctcctcaaagatccgaaagtgctttttgccggctaccgaaacccccaccccttggaacacaaaattttgctccgtgtccaaacaaatcccgaaacaacgccaatggaagcattgaacaatgccattgaggatttggtggcggagttttcattattggaagagcgatttcgagacgcgataagggaaaaacgagaagaatga

SEQ ID NO: 1018 - DNA, 876 bp, Heterodera glycines
  genomic DNA sequence=SeqID_373; cDNA sequence=SeqID_782
  peptide sequence=SeqID_1225
atgactttgcttatcaccggaatccttcgcaaatttgcacttacaaaattcccatttactgcatcaaattcttctttgtcgtcatggtgtaaagctgagagtcccctttcccatctcaatggcgaacaattggaaagcctttttgttgatgaacgcgtccaacgcttgctgctttcgctgaccggccatgacaccgacaaaattttgcgccatcgtcgcatcaaccaaacggagcgcaagcattacgcgttgatgacggacggcatggtgaaggagttcatgtcacgactggaccaacgggcgggcaaatttctgcgaattgtgccgttcaaagagccgcgctcaaaccgaaccgaagtgttggcacgggacgcggaaattgacggatttgacaccgccaaattcgttttcaccgacatttcattcgacgccacagatatggatcgcactgtcgttgtccgggagcaggacggaacgctacgaacggcgttgccggaagaacacgatcggatgaatcggctgttttttgtgcaacccaatcggcctgtcaacgaaccgccgctgtttgcaatgaccgacgaatggttacagaagacgctggaccgtgatgagcatgagtttgtgctggactgggcctgtcatttttacgagccggacgctcccaaatttgttgagctttgtaagtacatttttgaccacacattggaaaatgacaagttggacgtgctgtactccaccagacatttcggcacattggccttctatttggtgatcaacggcaaaatggacaaactattggaattctatgagcagaagaacagaaatgacggcgtagatcaaacgcgacaactttggcagatactttcttgttattga

SEQ ID NO: 1019 - DNA, 687 bp, Heterodera glycines
  genomic DNA sequence=SeqID_404; cDNA sequence=SeqID_669
  peptide sequence=SeqID_1226
ccctactttgtgaagatgcccaactttctgaacgtcgtgtcaaaaaaatttgacccggaaacgtacgaggacgaagtggaggaggacgacgcgctggacgaggagggacggcgaacgcggctcaaagtcaaaatggaaaacacaattcggtggcgcattgcgcgcgacagtcagggggaggagaagcgcgaaagcaatgccaaaattgtgcgatggtcggacggcagcatgtccctctatttgggcaaagagatcttcgagattgagaagcagcggctgatggacaacaaccatttgtacacgcgccaagggaccgcgctgcaggcgcaagcgctgttccgtgaaaaactcattttccgcccgcattccaccgaaacgatgacccatcgcaaaatgacgatgaacatggcggagaagacgaacaaagcgcagaaggtcaaagtgttggcgcaagttggcgacaaccccgaggcagaacgaagggaactcatccggacggaggaggaaaagctgcgggccgcggcgcagttgacagacatggcccccaatgggcaaaaacactcccatttattttttccaaaaaattgccgaaaagaatcaaatatttgtaaaaaaataggagccaacacacaacacaaacagcagcagacatcagcctcaacagaagaagaaaattgtcatcgatga

SEQ ID NO: 1020 - DNA, 806 bp, Heterodera glycines; identical to SEQ ID NO: 681
  genomic DNA sequence=SeqID_352; cDNA sequence=SeqID_681
  peptide sequence=SeqID_1227

SEQ ID NO: 1021 - DNA, 381 bp, Heterodera glycines; identical to SEQ ID NO: 631
  genomic DNA sequence=SeqID_381; cDNA sequence=SeqID_631
  peptide sequence=SeqID_1228

SEQ ID NO: 1022 - DNA, 1038 bp, Heterodera glycines
  genomic DNA sequence=SeqID_357; cDNA sequence=SeqID_690
  peptide sequence=SeqID_1229
atgggtagagcacgtagaaaaaaggggaaaactgccagaagagctcggcaaggattgcttggatttacacgaattgcaagagaaggaaagaagccaaaacaatttgagaagagagtcaatcaaagactggacagaaaagacgatgttcgaacggaggaaattttgcgtgaaaatattgccggacaaaagacccaagaggagccgagaacgccgcatgcatttgtaattcactcggcaggagtgggacgatatgtgcgacagttggagatggacttacggcgggtgatgagtccgaacacttcgaaggcattgcgggtgctgaaacgcaacaaactgaaagactttgtcgtgcattcgcaatttttgggcgtctctcatctgatcatcctctcgagaacagaactttccacgcatttgcgcattattcgaaacccgcaaggcccaactttgcacttcagagttgaaaaatattcgttggcacgcgacgtgctctccgtgcagaagagaccggtcatctacgaagaactgttccaacacgcgcctttggtggtgatgaatgggttttccagtgaagacggcagcaaaaaacatttacaattggtgcagacggtggtgcagaatatgttcccttccatcgacgtggacagagtgaaactcgcgtccattcgtcgcactttgctattaaactacgacacagaggacggactgatggagttcagacaatactccataaagtcagtgcccgcgggcgtttctcgttcggccaaaaaactgatgcagagcaaagtgccagacctgtccaagtacaaagacatcagtgacttcatgctcaaaccggagcagttgagtgacagcgaatttgaaggcgaacagacggaattggagctcacgcaggatattggcggacggggcaaaaaacgaggacagcaaaccaaattgaggttgatggaaattggaccacggatgacattacgtttgatgaaaattgaggaaggcgtcaacgcgggcactgctctttggacacactcttcaacataa

SEQ ID NO: 1023 - DNA, 483 bp, Heterodera glycines; identical to SEQ ID NO: 724
  genomic DNA sequence=SeqID_441; cDNA sequence=SeqID_724
  peptide sequence=SeqID_1230

SEQ ID NO: 1024 - DNA, 624 bp, Heterodera glycines; identical to SEQ ID NO: 765
  genomic DNA sequence=SeqID_472; cDNA sequence=SeqID_765
  peptide sequence=SeqID_1231

SEQ ID NO: 1025 - DNA, 2079 bp, Heterodera glycines; identical to SEQ ID NO: 607
  genomic DNA sequence=SeqID_321; cDNA sequence=SeqID_607
  peptide sequence=SeqID_1232

SEQ ID NO: 1026 - DNA, 6135 bp, Heterodera glycines; identical to SEQ ID NO: 772
  genomic DNA sequence=SeqID_370; cDNA sequence=SeqID_772
  peptide sequence=SeqID_1027

SEQ ID NO: 1027 - protein, 2044 aa, Heterodera glycines
  genomic DNA sequence=SeqID_370; coding sequence=SeqID_1026
TAKCGSGASSEARQNALSTRRLLCLSESCIIERDPISYAVICARSLRTIVCLVRDINDPQKFTIVYECGVERTFSSNERDSMLAALLDGIRGSGNYQVHLISSQRHFRAMRMLQFGQSLDEDSEVLLLKHIINVPAGLKRIDMVRRFNANIPYNGLYHSTQSEGFFTDNKSKTIVACLDAVLSEQIVVDTTEPIIRIEAQLACLHRLFASKTGFQAFTTVDGIREKLGSLVISVLKRRCEAIDHATVELLCALMQPMHANFDLRIEQLNKQSLLSSRAFVEHLLQLVVEHVARGTGALVIASMLDFLTFTVCAPYSETTPGDTFDSILAMVAQRGRTFYKLFQHPSMTIVKGAGMVMRAIIEESGRDISRQMQLLALTEGAFLKHLELALLSTGKDLRVLTNKQLSGYLVALWIAENQAAKDLLQRCLPRGLIDYLDSNEHVPASAVAEERDLLTIRNNLEMANNSERERPFAQLQDQFRVTLEARLDSLLQHWNLEQKLNFLQSNRIREEHQQQKIQQRPVVLRKRRRLVKATANWKLFCYQFGQNHARADLIWNEKTRDEFRQSIENEWRQLQQELEFIQPGTTVSWNHSEFTVTYDSLLDEIRIGDYYLRFLLTEENSSNSATPIHRPEDFFNKIYHRFLLSQRTEMRCICLRAMALVYERHCISIGPFADTRHIVEMLAKCTNVAERDHFLFLINKLSLDKQNVRELISANSISLFIDIAVLAHLHTNRAKLHGQTNVIEATKDAAHCEETEPKEWYYNDRQGQRQGPISFKRMKRLYRDGVLFEKSEIWAEGLDKWCHLSSVSQFRWTVCCVGNAKLSSIGDEAVTEGRDDEPTTLPMGLYNLTDLCSLILDTLIQMCTFFPSRDETDAVIRPMPRIKKVLSEPVLLYQLVQLLLTYDPSIVQRVATLVNDVMQDNPYISRLYLSGIFFFILMYNGSNILPVARFLKDTHLRQAFRSTLSKSELASRSVLCPMLPEANIFYLEEYGAEKYAEVFLGEFENPECIWNSEMRRNMIEKIALHVSDFSSRLSSNVKALYRYCPIPPIDYPQLKEELFCHFYYLRHLTDNHRFPNWPIREPVDFLRACLSAWHDEITRKPAKMSVEQACERLGLSTTDSTGGWKDASAVRRAYFKLAQKYHPDKNPDGREQFEQINYAYEFLTSTLVRANSSSTPDMNRIVIIIRAQSIVYKRNLQVLSPYKYAGYTQLIKTIDLESSDDTLFARTKEDGGQLLVAAVELCHWTLRSSSLNAEQLRRDGGLDALYKTFERCVPMITAGSLESEMPVQVCTHVCNCFATAARFDACREKIAEMKTLFQSICQLLRFESLHRLACAAAECVCAFSVCTLLQTQLFQAGVIWQLLPHLFRFDYTLDEGGVAHSEKTNHQAVLNRLARNCCEALACLAGFRPDTPDNDGVQKSLRAMLTPFICRQMQLCRNDFVLKLLNANTEDPYLIWDNSTRAELLDFVDKQRNSHENVFSEMFGAEFKLSIYATELVVGEIFVRIYNAQPEFRLLEPKRTCMDFLDYLSKHVEELLIGEGVVRPAAVKQKPITIGTVNLNGASGGRFPLQERVRMVLEALRNVLMMNPGIELLLIGHFSAIFAFLRVHSLSAIQLKALQIISIAANNKECVSDIACSIQLPLLLTLLSKLHKATEVILRTLIALVINGTVVKDLLEYGGLIYVLCTFTESNLTQNGRILSAELLAKLQADKLTGPKWARCMARFLPSTFADALRDNPGQAIQMFDTNTENPELIWNDTMRDGVRQILRRSLDELINAQQKDPNAKWNSSIIGENRCAFEEVISGELIVGGIFLRLFIANPSWAVRHPRQFATELIERLLELWQLPHQKLDQVSKALILLAAHHPTTTDMIPAQGYLPQFCQAMQSTLSDDVARSALRVLNQLSENLNCASAFAAVPSLPKGLLVCMRMQPELARESAHALKMLSQRCTPEMAEQMLLSGMVDHLLKMLGSSLPGVNNPSAAKAEIADALKACSRDAHFGERITQLLQKSQIWAQYRDQRHDLFLPTITQTQAITAVAPLLLPGI

SEQ ID NO: 1028 - protein, 562 aa, Heterodera glycines
  misc_feature (57)..(57): Xaa can be any naturally occurring amino acid
  genomic DNA sequence=SeqID_542; coding sequence=SeqID_788
YCELLKMMESEYQQLRELSAGRMVDLDSLIAFIRAAQLELLWIHQREELEVTRNWSXLDIPMLQNYFKQLLHEIELHEKQFNDVHNQGAALINQRHPAGEVIEVYLRTMQNQWDWMLNLSKCLEGHLRDAYNAKAFVEESEQVEQQMQQQLDHLDREYSRTDFSLDDGEQMLRQLDSVREYIQQLHARLISLTDRCAQISPLWQRGERISKPLPVMALCEYKSKDKIHIRQGDECTLLDNHDQIQWRVRGMDGVEASVPSVVFRIPPPDPRLASFLSRLHNQFEKLRKLWDRTHHLVRYNMVLNTMRTVRAWDLDTFLSIPSDQRDEIIKALNEDVNKLLSEMDPNDPLAKRLKDELRMTNEHFYDLLARAQKEPEPDYSNQFDAACAELVRKFEEGWKQLNHRVQERVATNLEELERQIKEHKAFEDALQTLDVDVSNVKELYRQLPHPTPTQRAAHDNMVQRWQDIWELSRMYVERLKGLESVLNGLDEVTDIVRRHEITLASFDDMPAALERLRGVHAQLLELNMVLQQQENIVKKLNRDTATLRQHVARTRFGAANHP

SEQ ID NO: 1029 - protein, 342 aa, Heterodera glycines
  genomic DNA sequence=SeqID_430; coding sequence=SeqID_858
LKYFFVIMINNHVNGANDVDMERTENESFGELNQRLIALKAEKNNKESATLAVKVLAFFVNCDNLSAAQDFVEALKNLPESASNSDWARWFYYLGRIEALKGTDAETYKAAEKHFEVALRKAPQNGAVGFKQEVNKWVVLVKLLIGEIPERSLFRTAELRHVLAPYLLLTQTVRLGDVAGFDQTKREHGPIFVKDRTAALVERIHQSVIRTAIRKISTTYSRIYVSDVATKLNSTEQEAHRELVKAIKEGIVRAQLVAGDPLAGGRHYVKFGTTDDQYRGVEPRREFDARVNELLELYHQAVKALRYPDMRNPEVETIDEQRRREQLALEMAAAEEEDDDDF

SEQ ID NO: 1030 - protein, 495 aa, Heterodera glycines
NLTLIDLPGLTKVPVGDQPPDIEQQIRDMIGTYISRETCLVLAVTPANSDLATSDALKLAREVDPQGLRTIGVLTKLDLMDEGTDARDILENKVFPLRRGYVGVINRSQKDIVGRKDIRQALDAERKFFLSHQQYRHMADRLGTPYLQKALNQQLTNHIKDTLPTLRDNLQKKLYSMEKEVAEYKNFQFNDPSRKTKALMQMVQQFTTDMERSIEGSSAKMVSTNELSGGARINRLFHERFPFEIVKMTIDEKEMRREIQFAIRNIHGIRVGLFTPDMAFEAIVKKQIERLKEPALKCVDLVVNELANVVRQCAVCVNRYPRLRDCVEQIVTNFMRQQEMFTKQHISMLVDYELAYMNTNHEDFIGFSNAEAKASSTNTKKNLGNQVIRKGWLSVHNISFVRGSRECWFVLTSDSLSWYKDDEEKEKKYMLPLDGIKLKDLEAGFMSRQHKFALFYPDGKNIYKDYKELELSAKNLDEVDAWKASFLRAGVYPEK

SEQ ID NO: 1031 - protein, 1006 aa, Heterodera glycines
  genomic DNA sequence=SeqID_505; coding sequence=SeqID_786
YALGHSAMEHLRKASVLVSGLGSVGVEVAKNLILGGVRSVTLHDTKALAFRDLSAHFYAKESDVGTNRAKVCFDKLAELNDTVNCALSVENLSEDFVKQFDLVVLTDASFSTQTEVNGWMRNHRKMFISADARGLFSYAFVDLGDEFVVNDSDGETCKEVLVEYIDCESGDMTTLEGAFHQLEDGDHVVFTDFEHAELNELPPVPVTLKGSKVFNIGNALAAFSGAVQGPVSRGRVQQVKVPKKMSFKPLSRALAEPDFMIWDFAKFDEPAQLHALWQALYSFEEMKNYSPLPRSDADAKLLKEMLPKDAPEMPDSLLFNFSYQACGNLQPIASLIGGLVAQEAMKAVTHHTTPLKQFLYTDSLEALPGADSTFDAAKLEKNDCAPRNNRYDGQAAVFGWAFQEALQQQKWFIVGAGAIGCELLKNMAMMGLGCGNSGSLTITDPDTIEVSNLNRQFLFRRPDVGKKKSEVAARSVKAFNSTIHINPMSEIVAESTEHIFGDDFFARLNGVCNALDNVEARRYVDRRCVYYQLPLLESGTMGAKGNTQVVFPHLTESYGSTSDPPEKETPICTLRNFPYQIHHTIQWARAKFTDYFTSVAETVNQYLDNVNDFLHRVNQMTFSQRIEVLSTLERALVVEYPKNAEECVSWARELFDTLYHNDIAQMLHNFPSSMLTAQGDKFWSGTKRCPHTLNFDVNNPEHFEFVFSASILRAQSYSLAPITERKKVAQLAMAYCSKPFRPQEGVRIAVTDAEATANDGNTANGDGDETVLRLNDLNVKLARLNLENIRRMTPIDFEKDDDSNHHVDFVTSASNLRADNYDIEKADRMKTKQIAGKIIPALATTTALVSGLVCIELYKTIEADGRRSTAQIEHIKNAFINLATPFIAFSEPGKAQKKKYLDIDFTLWDRFEVDGPMTLGQLIDWVEVSKSGLTVSMISSGVSLLYAFFQPAEKVAERKNMDLIAVFEEVSRGKVPDHRRAIVLEALTQNEENEDVDIPFIKYNFR

SEQ ID NO: 1032 - protein, 337 aa, Heterodera glycines
  genomic DNA sequence=SeqID_506; coding sequence=SeqID_787
MECMRMLIVRLRGEFEKRVRFLRPSDETVHSVPDDDDTLEEPPRLPQGNRRRLGVSAEVPDENEAANYQRVVIPKDDDVQKALRAAMCKNVLFAHLDLDEEKAIFDAMFPVEKHLGETIIEQGEEGDNFYVIDSGEVDVFVNGEFVLSIKEGGSFGELALIYGTPRAATVVAKTNTVKLWAIDRITYRAILMGSTMRKRKMYDEFLSKVQILADLDKWERANVADALEQCQFPSGTHVVEQGHPGDEFFIIVEGEAEVLQRPNDDAPFEVVGKLGPSDYFGEIALLLDRPRAATVVAKTLLKCLKLDRARFERVMGPVREILKRDVSNYNSYVKLMT

SEQ ID NO: 1033 - protein, 493 aa, Heterodera glycines
  genomic DNA sequence=SeqID_519; coding sequence=SeqID_789
MVTEQNGATFAVDVEEIAAGHHVTPVDMTTATSKLQLEAAEVRNPANKPNWSSYLRSQLVPQNEYNFIIELEKAKNKQERDEALAKDKTNSARSIINLITEVAKDQLIRYVLTLFDDLLQEDKSRVEIFHDYARRQKRTIWSWFQGILTRNDSFIVNQMSAIFSKLACYGSVLMDGQELQAYFNFLQQEIKNSVSNEYINTSVRCLQMMLRKEKYRRKFVEYDGVKSILLALNGRANFQLQYQLIFCLWCLTFDSNIAQFVQGLGIIQPLGDILSECSKEKVIRIILATFRNLLEKIDNREMVRESALQMVQCKTLKTLELMDAKKFDDPDLVDDIEFLSERLHASVQDLSSFDEYCAEVRSGRLQWSPVHKLEKFWRENAQRFNEKNFELIKILIKILETSSDPLPLSVAAHDIGEYVRHYHRGKTIVEQYQGKQAVMKLLSAEDPNVRYHALLAIQKLMVHNWEYLGKQIEGLEGAKGAAGEEAKEVKTRT

SEQ ID NO: 1034 - protein, 1091 aa, Heterodera glycines
  genomic DNA sequence=SeqID_531; coding sequence=SeqID_791
MGVPAFFRWLSRKYVSIIVDAVEQRRREIDGVKIPIDATQPNENYQEFDNLYLDMNGIIHPCTHPEDRPAPKTEEEMFILIFEYIDRLFSIVRPRKLLYMAVDGVAPRAKMNQQRSRRFRAAQEAAEKRELIENVRKRLESEGIPLPPPRKEEEHFDSNCITPGTPFMARLSVALRYYVHKRITYDPAWQKIQVILSDANVPGEGEHKIMDYVRRQRASPAHDPNTVHCLCGADADLIMLGLATHESNFNIIREEFLPNQPRPCELCGQYGHEVEHCEGLARAETGPDQADPLKKEKNFIFIRLPVLREYLERELSMPNLPFPFDLERAIDDWVMMCFFVGNDFLPHLPSLEIRENAIDRLVKLYKDMVYQAGGWLTENGIVNIERVKKIMGGLGKVEDEIFKQRQLKELRFKESKKQRKQQQRQAMAKIMPYNANLIAPMPLGQQKRMSGEEMRRLAAGDRQEFVRLADVASSHKLQSLLTPVDRRKATDGGDRKRKLAPSSVDSPNGAPPAKSFKEGVAAASVSSETALKPEIKLVTPSGKTAPLAKGAVGALAYDSDEEEEVLDEIRLWESGWKDRYYRAKFQVSETDLEFRKKVACAYVEGLCWVLRYYYQGCASWKWYYPYHYAPFASDFELIADFQPDFNMPTKPFKPLEQLMGVFPAASRAHIPDGWRWLMTDSSSPIIDFYPETFEIDLNGKKYAWQGVALLPFVEEKRLLDALDSVYATLTTDEIARNATGPDRLFVGNKHNLFSLVYEVHSQKTTTSIKDELTNDDTKETSEGTRETEGEAEETQQAENGESEQIAKTEETTAQEEQANEEAISKPEQAPKQEFETEIEFVDDEEKKWVHIDAVKAYGMSGEVSYDVEALAFGEAHRSLFRNSLEFGDIKENTCIMVEFRDPQFPMHFIFKANRLDGIKELPRVLKPNDWDQRRHGSFQPQIGFSRDIPRANLSMAGHRTLNHHINDNRRSCPASLFSVQTSPPAHTLPWHMSTNSPQQQHQMQYQHQQQWQQGQFYNGQQQQQPVPLFSFGQMAMPPPPPLPPQNWITSHPPPQIQSHVPYGQPPPLISQPRNTQHHHRRNDNNRTYNRK

SEQ ID NO: 1035 - protein, 724 aa, Heterodera glycines
  genomic DNA sequence=SeqID_535; coding sequence=SeqID_792
MNSFTRDKETFEPISGNQVKCYICGPTVYDSAHMGHARAYLSFDIVRRVLTDYFNYDVLYVMNVTDIDDKIIKRARQNFLFEQYLNGIDSVGFEELEQHLQAALQHYLKKASIEPDTDKRKLFVDTVSDLVQFKTRISQPDNGQSADVRTVLVRKLVESAKEVLSDWLDVTRGNTVTKHDIFAKLARKYENEFLCDMNALNVLEPDVLTRVSEYIPEIIDYVQQIIRNGYAYVSDGSVYFNTAQFASKPNHSYAKLLPEAYADAESAEKHLREGEGELSVAVDNLKEKRSPSDFALWKASKDGEPFWESPWGKGRPGWHIECSAMSGAICGDKLDIHAGGFDLKFPHHDNEIAQCEAYNDNDHWVNFFLHCGTLRIEGLKMSKSLKNFVTIREALNKYTARQLRLLFLMHNWTDNLDYSESTMEHAIHFEKCFCEFFLNVKDIIRKQIKEKNFKCFKKYGEEEMEVLNKFNAIKVSVHLAMCDSIDTRAVLDKIRTIISLLNTYIMVRKQEEAVLNCQLLTKCANFVRELLCIFGVQPDVGKYEFFTKDCCATSDDREAIIMPYLEILAQFREVVRSEARAQKNIGILKECDRLRDEILPELGVRLEDHSKDTCVKLVDRETLIKEREQKEAAQREKEQRKIQLQKEKEMKRQAKEEQKRKTRETQQKNERENQFLRFTTTLVYTNQTISTKIKTIEYKAIECICNNESQKFLHIHTYTYVFNV

SEQ ID NO: 1036 - protein, 501 aa, Heterodera glycines
  genomic DNA sequence=SeqID_532; coding sequence=SeqID_793
MAKSAIDVNRGITEDQTATIRNYFTQPHLIYKTVTGVRGPLVILGDVKFPQYAEIVKLTLPNGEKRMGQVLEVTKDKAVVQVFEGTSGIDAKNTICEFTGDIMRTPVSEDMLGRIFNGSGTPIDKGPNVLAEDYLDIDGQPINPWSRIYPEEMIQTGISAIDVMNSIARGQKIPIFSAAGLPHNEIAAQIVRQGGLVKQPNRKKENEVEGDDDFAIVFAAMGVNMETARFFKQDFEENGSMENVCLFLNLANDPTIERIITPRLALTCAEFLAYQCQKHVLVVLTDMSYYAEALREVSAAREEVPGRRGFPGYMYTDLARIYERAGRVEGRKGSITQIPILSMPNDDITHPIPDLTGYITEGQIYVDRQLHNRQIYPPINVLPSLSRLMKSAIGEGMTRADHSDVSNQLYACYAIGKDVQAMKAVVGEEALSSDDLLYLEFLTKFEKNFISQGNYENRTVFDSLDIGWQLLRIFPREMLKRIPAKTLDKYYPRGGTGARNE

SEQ ID NO: 1037 - protein, 313 aa, Heterodera glycines
  genomic DNA sequence=SeqID_520; coding sequence=SeqID_794
MERLLRLGGLSGLGAGSLNATPHDSNQVDTSETVYISSLALLKMLKHGRAGVPMEVMGLMLGEFVDDYTVNVIDVFAMPQSGTGVSVEAVDPVFQAKMLDMLKQTGRPEMVVGWYHSHPGFGCWLSGVDINTQQSFEALSDRAVAVVVDPIQSVKGKVVIDAFRTINPQAIALNQEPRQTTSNIGHLQKPSIQALIHGLNRHYYSIPIAYRTNENEQQMLLNLNKQSWMDSMNLVNYNEHCTRTEKAVEHMLKLAKLYKKSLEEEEKMTEEQLAIKNVGKQDPKRHLGETVSQLLADNLVQGLAAMLDVSAFQ

SEQ ID NO: 1038 - protein, 852 aa, Heterodera glycines
  genomic DNA sequence=SeqID_337; coding sequence=SeqID_795
MVNFTVDEIRALMDRKKNIRNMSVIAHVDHGKSTLTDSLVSKAGIIAGAKAGETRFTDTRKDEQERCITIKSTAISMFFELERKDLEFVKGESQADIEQVDGKSQKYNGFLINLIDSPGHVDFSSEVTAALRVTDGALVVVDCVSGVCVQTETVLRQAIAERIKPVLFMNKMDRALLELQLGQEELFQTFQRIVENINVIIATYGDDDGPMGPIQVDPSIGNVGFGSGLHGWAFTLKQFAEMYADKFGVQIDKLMKNLWGDRFFNMKTKKWTNNQEPETKRGFCQFVLDPIFKVFDAVMNIKKDEVAKLVEKLNIKLTLEEKEQEGKPLLKTMMRKWLPAGDTMLQMIVMHLPSPVTAQRYRMEMLYEGPHDDEAAVAMKNCDPNGPLMMYISKMVPTSDKGRFYAFGRVFAGRVATGMKARIQGPNYVVGKKEDLYEKTIQRTILMMGRYIEPIEDIPAGNIAGLVGVDQYLVKGGTITTYKDAHNMRVMKFSVSPVVRVAVEPKNAGDLPKLVEGLKRLAKSDPMVQCIFEESGEHIIAGAGELHLEICLKDLEEDHACIPLKKSDPVVSYRETVTEESEIVCLSKSPNKHNRLFCKARPLPDGLPEAIERGDVNPTDDPKNRAKILTEKFEMDATDSRKIWCFGPEGTGANLLIDVTKGVQYLNEIKDSVVAGFQWATKEGVLCDENMRGVRFDIHDVTLHADAIHRGGGQIIPTARRVFYASVLTAKPRLLEPVYLVEIQCPEAAVGGIYGVLNRRRGVVFEESQIAGTPMFIVKAHLPVNESFGFTADLRSNTGGQAFPQCVFDHWQVLPGDPFDGTSRPGQVVTETRKRKGLKEGIPSLDNFYDKL

SEQ ID NO: 1039 - protein, 230 aa, Heterodera glycines
  genomic DNA sequence=SeqID_521; coding sequence=SeqID_796
MERYDRAITIFSPDGRLFQVDYAQEAVKKGSTAVAVKGKNCVVIGVEKKSIPTLQDERTIRKIHALDSHVMVAFAGLSADARVLIDRARVECENYKLTLEDRVSVMHISRIIADIKQRYTQTTGRRPFGISMLVGGFDSDGTPHLFKTEPSGVYYELLAGSIGRNEKIVKEYLEKEYGNDNTADEESTLKLMLKSLAPVVQSGAQNIEIAVLKWVDGTNGEPGYCEQQIL

SEQ ID NO: 1040 - protein, 251 aa, Heterodera glycines
  genomic DNA sequence=SeqID_525; coding sequence=SeqID_797
MFLTRSEYDRGVNTFSPEGRLFQVEYAIETVKLGSTSIGIHTKEGVLLAAERRSMSKLVVDDSMSKISEVEKHIAVASAGLIADSRTWVEHARVEAQHFWFTYGGKIRVEDITQKVSRLALHFGDDDSTISLGRPFGVSMLFAGIDHTGAHLFHLDPSGTYIKCLAKAIGAGSDAAEQTLQEHCKNCDKKMEMAEAKQVALNTLKQLMEEKINSKNVEIVMIKPQTDKEGKTLGKIVWLEESELQEIISRL

SEQ ID NO: 1041 - protein, 434 aa, Heterodera glycines
  genomic DNA sequence=SeqID_522; coding sequence=SeqID_798
YRYENEHRDLRRVMGVGIAITRGAAAALSVDLALILLTVCRNLLTMLRETFVGEYLPLDSAITFHKIVAITAGTFAAIHTIGHCVNFYHVATQSQEGIACLFQEAVFGSNFLPSISYWFFGTLTGITGILLVAVMSIIYVFSAPAVMKRAYHAFRITHLLNVLLYALTILHGLPKLLDSPKFWYIVLGPVIIFIIDRIIGMRKHYKQLRIVDAAILPSDIIYIQFKRPHSFKFRSGQWVRISCPAFSCTFNESHAFSLASAPQSPTLELFIKAVGPWTWNLRNELSEAKDNALPYPVVNLSGPFGDGNQEWHNQEVVVFVGGGIGITPYASTLMDLVLERASGNHSGIKCRKVYFLWICPTHKNFEWFVDVLKQVERHDQDGILEIHIFVTQFFHKFDLRTTVLYICEKHFRGDNSGISMFTGLRATNHDSRGS

SEQ ID NO: 1042 - protein, 570 aa, Heterodera glycines
  genomic DNA sequence=SeqID_536; coding sequence=SeqID_799
MDLLKSYDGSSSSDNEQELADIPSSSNHNKLLALKIPSINLTPNVIEQRAIQQVAVVDPKTKELYHNPRFDELFKPESGPQNPFKSEHQRAEKNTLTGYVEPAHFNAFHFERSLRSYDTLGYADNPTADTTSAKFVGDVGQAQEKAGESLFESVKTGGQKRKRVINYDASNVDGYTGPWARFEDEKTIARPDPELQKEMDEIVRKRKLKSRAGRRAAIAELHLAEESTKLHIKDDTDYLGRSFMEPPKYTGTNLREDFVPDRCFPPTKQAHTYSSHTKPVTAIRWFPRSAHMFISCSMDGKVKLWEVYGNRKLIRTYTGHKVPVKDIYFNNTGTEFLSAAYDNYIKLWDTETGQVKNRYTIGGHRAYVVKFNPDDDKQNIFMAGMSNKKIIQWDTRTGEIEQEYDRHLGPVNSITFFDKNRRFVSTSDDKSLRIWEFGIPVDTKLIQHAGLHSIPSMTRAPNEKWIVGQSMDNRIVLFQIVDDKLRFARKKAFRGHNTAGYACSTDFSPEMSFLASGDADGKITMWDWRTHKIVSTWKAHDNVCISTLWHPHEKSRMISCGWDNVIKMWV

SEQ ID NO: 1043 - protein, 316 aa, Heterodera glycines
  genomic DNA sequence=SeqID_512; coding sequence=SeqID_800
MSFLVTLAGYLTIAIFLQKLFRSLYNVVFPYLFAVPQNIKVLAGAEWAVVTGSTDGIGKAYALELAKKNFNVVLISRSMDKLNAVAEEIKQKYPNVEVKCISFDFTNANLKDYEQTIFSQLSNIEVGMLVNNVGMSYEYPERLDRIEGGLQRVSDITVINTLPTTVLSAFVLKQMRERGRGVVVNLASSAAYFNWFYLAAYSASKKYVCWLSSILRMEYADTDIVIQTVCPMMVATKMAKIRKASFFTPSPEEFAAQALRSIGLVDETTGCLSHQIQAELMFGYVPAPLLNKFVRDNSLQTRKRALKKEATVAKSE

SEQ ID NO: 1044 - protein, 209 aa, Heterodera glycines
  genomic DNA sequence=SeqID_537; coding sequence=SeqID_801
MFRNQYDSDVTVFSPQGRLHQIDYAVEAMRQGSAAVAIRSKDYAVVVALMRAQNELSSYQQKVFKLDDHLGLSMSGLISDGRILARFMQSECAEFRWNYHNPISVELLNRKLGLKLQSNTQYYGRRPFGVGLLIIGYDDKGPHVVKAEPSGDVSEMFAASIGARSQSARTYLEKNLPEFETADRDALIRHAIRSLKETLQADAGSLDEN

SEQ ID NO: 1045 - protein, 216 aa, Heterodera glycines
  genomic DNA sequence=SeqID_526; coding sequence=SeqID_802
MNQEQDNIPTFKLVLVGDGGTGKTTFVKRHLTGEFEKKYIATLGVEVHPLTFHTSRGQIRFNVWDTAGQEKFGGLRDGYYIQGQCAIVMFDVTARVTYKNVPNWHRDLVRVCENIPIVLVGNKVDVKDRKVKAKSITFHRKKNLQYYDISAKSNYNFEKPFLYLARKLIGDPNLEFVAMPALAPPEVQMDPALAAKYEQEVAEAASAELPDDDEDI

SEQ ID NO: 1046 - protein, 315 aa, Heterodera glycines
  genomic DNA sequence=SeqID_513; coding sequence=SeqID_804
MSFRSAAALGLNLRKASKFVLFGALATGGSVLLYSLENSGARAYDFVVHPSHLPWSHGGLMDAIDMRSVRRGYQVYKQVCAACHSLKFIRYNHFVDNFMTRDEAKTEAAEALIPDLDDNGVEILRPGLLNDTLPSPYKNNKAAAAANSGALPPDLSLIMWAREGAEDYVFHLLTGFFDAPAGIDVEEGKAFNPYFPNGCVLAMPQQLFDEGIDYEDGTPATMSQQAKDICTFLRWAGEQWHDTRKRWAWKLITLLPLLTFVLLYAKRNVWALMKTEKVIFRRLPGRGWTPESSAPKPPKDEPELKVIEPPQKPVV

SEQ ID NO: 1047 - protein, 424 aa, Heterodera glycines
  genomic DNA sequence=SeqID_523; coding sequence=SeqID_805
PNETDDKTKEIKFSALDEDEIAALSNYNMGPYADQLKQAEKDIDEIQKRINTLCGVKESDTGLAPPILWDIAADKMAMSHEQPLQVARCTKIIKEEGKETRYMINVKQFAKFVVDLHENVAPTDIEEGMRVGVDRNKYQIHLPLPAKIDASVTMMQVEDKPDVTYADIGGCEEQIKKLREVVEFPLLQPERFTSLGIEPPKGVLFFGPPGTGKTLCARAVANRTDACFIRVIGSELVKKYVGEGARMVRELFSLAKTKKACILFFDEVDAIGGARFDDGKGGDNEVQRTMLELVNQLDGFDSRGAIKVLMATNRPDTLDPALIRPGRIDRRIEFSLPDLKARGNILQIHTKRMSVDRNIRYELIARLCPNTTGADLRSVCTEAGMFALRARRKVITEQDFLKAVQKVVKSYAKFSSTPAYMTHN

SEQ ID NO: 1048 - protein, 440 aa, Heterodera glycines
  genomic DNA sequence=SeqID_514; coding sequence=SeqID_806
ESQYGFVYGVSGPVVTAEKMSGAAMYELVRVGHSELVGEIIRLEGDYATIQVYEETSSVTIGDPVLRTGQPLSVELGPGIMGSIFDGIQRPLHDISEMTKSIYIPKGVNVKALNRAKRWEFMPRKDLRVGDHVTGGDIIGMVHESALVKHKIMVEPKACGTVKFIAPQGQYTVEDTILEVEFAGHTQKLTMMHIWPVRNPRPSAEKLAANFPLLCGQRVLDALFPCVQGGTTAIPGAFGCGKTVISQSLSKYSNSDAIIYVGCGERGNEMSEVLRDFPELTMEVDGVTTSIMERTALVANTSNMPVAAREASIYTGITLAEYFRDMGLNVAMMADSTSRWAEALREISGRLGEMPADSGYPAYLAARLASFYERAGKVKCFGSPEREGSVTIVGAVSPPGGDFADPVTSATLGIVQVFWGLDKKLAQRKHFPSINWLISY

SEQ ID NO: 1049 - protein, 713 aa, Heterodera glycines
  genomic DNA sequence=SeqID_507; coding sequence=SeqID_807
KQTNLRKEETSNEKKKGKKAEEVMPKKSKESTSKSRKKNESSGEEEDFDDDSDGEEEEYQPKVRRREGKRMKKDDILQKKKQKSDPSPAKKSDSKKSTKTTKVTKVEVKEESGAGVEHKKRKTTKVEVKEEVSRKKPSSSQGSPSKKRVKKQEEEEEVWRWWEEDESNAGASDGSIKWQTLVHKGPVFAPAYVPLPKHIKFKYDGKEMDLSLPAEEVASFYAKMLDHDYTSKPVFNQNFFKDWVKVMTKAERAEIKDLAKCDFRQMHAFYVSESEKRKARSKEEKKAEKEEKEGEAKVYGFAMLDGYKQKIGNFRIEPPGLFRGRGDHPKMGSLKKRVQPEDVVINCSRGLKIMPPEGHKWKEIRHDNTVTWLCSWTENVLGSNKYIMLNPSSKLKGQKDWEKFEKARKLKGHVGQIRQQYLADFKSKEMRIRQRAVALYFIDKLALRAGNEKDTDEAADTVGCCSLRCEHIKLHDDMDDLKYVVEFDFLGKDSIRYYNRVPVEKQVFKNLKLFMEEKDPGDDLFDRLDTSSLNQYLKELMDGLTAKVFRTYNASITLQEQLDKLTNPSDSVHEKMLSYNRANRQVAILCNHQRAVPKTHEKSMENLENKIKEKKQEYKELKDQLKKSKSVDEKMAKKYERLKEQIAKLNTQRTDKDENKQIALGTSKLNYLDPRISVAWCKKNDVPVEKIFSKTQRDKFRWALDMAKEDFIF

SEQ ID NO: 1050 - protein, 332 aa, Heterodera glycines
  genomic DNA sequence=SeqID_538; coding sequence=SeqID_808
MIKRLTNGTELKLSKNGTELSFRPGLIHGGELEFDCGVQRCISYFLEPLILMAPFCKKPLNVNLTGVTNSVDELSIDAIRATWLPVFSRFVLADQCTEIKIKARGFKPSGGGSVTFSSPIKRNLRAVQCIKPGKVCKIRGLAYVCKVTPSIASRMIDGAKKMLHGNISDIYITIDQRKGPQGGLSPGFGIFLTAETTEGVFFHGEAMSRPKGQNEDQTVPEEIGEQAARRLLDEIHMGGCADSSCQSLAATFMTLCDRDVSKFLLGPLTINSVHTLRNLQMFFEQMFKLEEWWKVMKEIVGKGGNAMKNGSEDKCLMTCVGVGFFNINKDQL

SEQ ID NO: 1051 - protein, 1178 aa, Heterodera glycines
  genomic DNA sequence=SeqID_539; coding sequence=SeqID_809
MFFDDDDDQQPREEFEGDEQMDVNEFNIETHQEACWVVISAYFDEKGLVRQQLDSFDEFIQMSVQRIVENSPAVELQTELQHMSGEIETPTRFSLKFGQIYLSKPTHWEKDGAPTPLMPNEARLRNLTYSSPLYVDITKTISREGEEDQVEQYEKVFIGKIPIMLRSSYCMLSNMNDRDLTELNECPLDPGGYFIINGSEKVLIAQEKMATNTVYVFSMKDGKYMYRTECRRPPSQFCVNMTNKGGKAASKTPMGQKIVAVIPYIKQEINIIILFRALGFVSDRDILEHIIYDFDDQEMMELVKPSLDEAVVIQEQNVALNFIGTRGAKPGVTKEQRIKYAKEILQKEMLPHISIAEHCETKKAYFIGYMVHRLLLAALGRRELDDRDHIGNKRLDLAGPLMATLFRALFRNLLKEVRLTAQKYINKNGNFNLDVCVRPTLITRGLSYSLATGNWGEQKRAHQTRAGVSQVLNRLTYTATLSHLRRCNSPIGREGKLAKPRQLHNTQWGMICPAETPEGQAVGLVKNLALMAYISVGSLPEPILEFLEEWSMENLEEVAPMSIADSTKIFVNGAWVGIHRNPDQLMTTLLKLRRQMDIIVSEVSMVRDIRDREIRISTDAGRVCRPLLIVNDRKLVLKKHHIEQLKERDVMDEQQQFTWSDLVAGGVVELIDAMEEETIMVAMTPEDLKTGGYCESYTHCEIHPAMILGVCASIIPFPDHNQSPRNTYQSAMGKQAMGVYTTNFHVRMDTLAHVLYYPQKPLVTTRSMEYLRFNELPAGINAIVAILSYGGYNQEDSVIMNQAGIDRGLFRSVFYRSYRDSEQEIDNVNEQLIEKPTRDKCKGMRNAIYEKLDDDGITSPGTRVSGDDVIIGKTIALPEVEDELEASTARYSKKDASTTLRSSETGIVDQVMVSVNAEGNKFVKIRVRSIRTPQIGDKFASRHGQKGTMGMMYRQEDMPFTCEGITPDIIINPHAVPSRMTIGHLIECLQGKLSANKGEIGDATPFNDTVNVQKISALLEGYGYQLRGNEIMYNGFTGQKLSTQVFLGPTYYQRLKHMVEDKIHSRARGPVQGMNRQPMEGRARDGGLRFGEMERDCQISHGAAQFLRERLFEVSDPYTVYVCNQCGLVVIFNQRTNTFECKACQNKTQVSAVRIPYACKLLFQELMSMSIAPRMMTK

SEQ ID NO: 1052 - protein, 491 aa, Heterodera glycines
  genomic DNA sequence=SeqID_533; coding sequence=SeqID_810
GATQQVQKLTDQFLSFISLEDDLFMLSRYTKSSPFSFYAINDPSITADQIDALVADIANGLFAVCVTLGVVPVIKCPKNNAAERVAEKLDQKIRDNLRDARNNLFVQENIRAGHLSIHRPVLVIADRTTDLSTMLHHTWTYQAMIADILEMELNRVRMKDKNGRQKDYEFGTEDKLWANYKGSPFPLVAEAIQEDLEAYRRNEDEIKRLKESMGLSDGDSAEMAVDIFGTAATAKLSTAVGSLPELLEKKRLIDLHTNVATALLDNIKTRKLDVLYETEEKLLTGQEIPVIETLRDCPDKDDILRLILIALCSRNMPTAEQRELQAFIDERAISSDALHFVRQLRAFSHLGAEAEQHQGAGTKTVSMFSKLLSHSSRFVMEGVKNLVPKKHNLPLTKVEQLTTDVKMGVGVAGITGSSSDFDPDQFRLFDPKLLQGSAVNRDVRPTQAAADVIVFVIGGGNYVEYQNVQEWAKARGLQRCTYGCTEMVNPK

SEQ ID NO: 1053 - protein, 671 aa, Heterodera glycines
  genomic DNA sequence=SeqID_508; coding sequence=SeqID_811
VPFVAVLLALATPGTFGAFECANHETATFVRISRARLDGTPLVVSTAGHDLTCSQYCRNNIEPTTGAQRLCASFNFDGRETCYFFDDAASPAGTADLNPNPSANNFYYEKTCLPGVNAHEACTYRSFSFERMRKTSLDGFVRKSIQVPSREQCLSACLLEKEFVCRSVNYNYDSYACEMSTEDRRSKPTHLRMTNQPVDYYDNNCLNRQNRCGQQGGNLVFVKTTQFEIKFYDHTQSVEPQESNCLQKCLDSLNTFCRSVEFSPNEKNCIVSDEDTFSRADQQVAVHSKDYYEPICVAADLSSSTCRQQAAFNRFIGVSIEGQPVASAQGVTVSDCISLCFQNLNCKSINYDRTQSTCHIYAVGQATANIKKNPSYDFYEFNCESQFGGMALCTNDGIRFIVNTKEPYTGAIYAAEKFSTCSQVVENAKQISITFPPPNVSPACGTTIKDGKLEALVVVSLDGVLPHQVTTEWDRFYRVSCDVNMDKPGFEGTVIVTTIFETKEAEPQVLSAGTPPPITAQLSFLDKDNQPLEKASIGDQLHLVVNSEQAGPHNMMVTECVATRVGGEGEPVPFTIIDNGCPRYPALVGPVEQDFDKNRLKAEMKAFRLDGSYDIQIVCTVMFCAGPNGCPPSNCLDSGTNELFMSHGRRKRRNIGGQQLLAQQQQHEQQT

SEQ ID NO: 1054 - protein, 649 aa, Heterodera glycines
  genomic DNA sequence=SeqID_515; coding sequence=SeqID_812
PAKANAIGIDLGTTYSCVGVFQHGKVEIIANDQGNRTTPSYVAFTDTERLIGDAAKNQVAMNPSNTVFDAKRLIGRKFDDPAVQSDMKHWPFKVVQGEGARPKVMVEVKGEDKAFFPEEVSSMVLIKMKETAEAFLGQTVTDAVVTVPAYFNDSQRQATKDAGTIAGLNVLRIINEPTAAAIAYGLDKKGQGERHVLIFDLGGGTFDVSILTIEDGIFEVKSTAGDTHLGGEDFDNRMVNHFVAEFKRKHKKDLSSNPRALRRLRTACERAKRTLSGSTQASIEIDSLFDGIDFYTNITRARFEELCADLFRNTMDPVEKALRDAKMDKSQIHDIVLVGGSTRIPKVQKLLSDFFSGKELNKSINPDEAVAYGAAVQAAILSGDKSETVQDLLLLDVAPLSLGIETAGGVMTSLIKRNTTIPTKTSQTFTTYSDNQPGVLIQVYEGERAMTKDNNLLGKFELSGIPPAPRGVPQIEVTFDIDANGILNVSAQDKSTGKQNKITITNDKGRLSKEEIERMVQEAEKFSKEDEVQRDRVSAKNALESYCFNIKQTMEDSNLKDKISEDDKKKVLEKCGEVLAWLDANQAAEKEEFEHQQKELEGICNPIITKLYQAGGAMPGGPMPGGGMPGGGGAAGAGGAGGPTIEEVD

SEQ ID NO: 1055 - protein, 494 aa, Heterodera glycines
  genomic DNA sequence=SeqID_509; coding sequence=SeqID_813
MTISATADVDKLQDAANRMRISSIEQTCAANSGHPTSSCSAAEIVATLFFAEMRYDVKDPRSASADRFILSKGHACPILYAAWEEAGLLSRDQVLSLRKIDSDIEGHPTPRLNFIDVATGSLGQGLSCAAGMAYTGKYVDHSSYRVYCLMGDGESAEGSVWEAAAFASFYKLDNLVAIVDVNRLGQSQETQLQHDIEAYVQRFAAFGWNAIGLEDGHDISALLNAYANAKNVTGKPTAIIAKTLKGKGIDGVADLNNQHGKPVSKDKAEPIRALLKSDKPANWTIPAPIRDAPAVDLGIGAIAMSAPPQYKMGEKVATRQAYGNALLKLAEANKRVIALDGDISNSTFSNLVQKKLPEQFVQCYIAEQNMVGVGVGMACRGRVLPHVSTFAAFFTRAGDQIRMGAVSFTNVKFTGSHCGVSIGEDGPSQMALEDLALFSALPASVVLYPSDAVSAERATELAANYTGITYTRVSRPATPVLYTSDEKFELGKCK

SEQ ID NO: 1056 - protein, 258 aa, Heterodera glycines
  genomic DNA sequence=SeqID_510; coding sequence=SeqID_814
NDGREAKEKGEKSGTEREKEAVIANWEPSPLVPLYSEREQNDPNYRPRSIEGRMGKFVVIDDKRCVNLASTDFFGFIGNQKIEEVAKNAIFKYGVGSCGPRNFYGTVDVHLDLERELAEFMGCEEAILYSYGFPTIASAIPAYSRRGDVIFADKGVNFAIQSGLMASRSDILWFEHNDMADLERKMVELEEKDKMNPKRKASIRRLIVVEGIYTNSGDICPLPKLIELKWRHKVRIFIDESFSFGVLGKHGKGGEFHF

SEQ ID NO: 1057 - protein, 540 aa, Heterodera glycines
  genomic DNA sequence=SeqID_527; coding sequence=SeqID_815
MSPSLSVANSNVSRPLGQPKVAGFKDKDKPESVRTSNIVAAKAVADAVRTSLGPRGMDKMIQSGNGEVTITNDGATILNQMSVVHPTAKMLVELSKAQDIEAGDGTTTVVVLAGSLLDAAEKLLAKGIHPTTISDSFQRAATFSEKVLEEMATPIDINDDDELVKLAMTSLNSKVVSQYSHLLAPMAVQAVKKLMSSPEDSSVNLKLIKVVKKLGETVEESQLIEGALIDQKSMGHGGPARVEKAKIGLIQFQISPPKPNMENQVVISDYAQMDRALKEERNYILELCKQIKKAGCNVLLIQKSILRDAINEMALHFFAKMKIMVIKDIERDDIEFYAKILGCRPVASVDHFVPESLGTADLVEEIETADGKVLKVTGLKQSGCAVSILVRGSSKLVLDEAERSLHDALCVIRCLVKKRALLPGGGAPEMEVSVRVRAAAQTKHGAEQYCWKAFADALEVVPYTLAENAGLSPIETVTEMRSQHAMGNKEHGVNVRMGAITDIREENVVQPLLVSSFAVKQAAECVRSILKIDDIVLSVR

SEQ ID NO: 1058 - protein, 462 aa, Heterodera glycines
  genomic DNA sequence=SeqID_524; coding sequence=SeqID_816
TKQKEYDLQQKQLEARIAAMQSENVRVAEEERRKTLIEETKHARARADYQDQLARKRQEEEMSMKARMQEETLRRQEESVKKQEALRKATIEHELSLRHKYDLERIDADVRAKARAARDNRDVNLEMMRASEEERRKTVTEQIRTTAGVVGAGLSEFLSDRSKIMAAVGGLTVLAVGWYSAKRGTGVVAKQVEARLGKPSLVRETSRLTLFELFKHPIASVRTLFRAREDPLKGIVLNPSLESRLRDIAITTRNTKRNFGLFRNVLFYGPPGTGKTMFAKSLARHSGLDYAIMTGGDVAPMGRDGVSAIHKIFDWAQTSRKGLVLFVDEADAFLRKRSTEQISEDMRAMLNAFLFRTGEQSRKFMLVVASNQPEQFDWAVNDRLDELVEFGLPGELERERLLLQYFKQYIADPATSGARTQRLKLGDFDWLSKMKQIASLTAGMSGRELSKLVFGWQVSGWA

SEQ ID NO: 1059 - protein, 150 aa, Heterodera glycines
  genomic DNA sequence=SeqID_516; coding sequence=SeqID_819
IMVGSGGVGKSALTLQFLYDEFVENYEPTKADAHRKQVVLDGEYCAVDILDTAGQEDYSAIRDNYYRSGEGFICVFSITDLDSFDQLVEFREQILRVKNADPNVCILLVGNKSDLDAERKVPLEQAQQRAELWGCPFVETSAKTRENVDK

SEQ ID NO: 1060 - protein, 414 aa, Heterodera glycines
  genomic DNA sequence=SeqID_338; coding sequence=SeqID_820
CISGGEVVEIQGPAFAESISEGDIRWNKQVGDFVKTDDIVAEIETDKTSVEVPAPFAGKIVELLVEEGAKVLAKQKLYKLEKGAEGGEGPAKEAKEEMPKKEGEVPKPKREEQGQAEQRTEGMPIRDRNFQIPFSAPPMQSKMPPLPKEPISSKPVSEIKVPKFQQQPPHAPAGDSTAITGQRSETRVKMNRMRLRIAERLKEAQNTSAMLTTFNEVDLYNVVRMRKQYQEAFTKKHGVKLGLMSPFVRASAIGLQELPVVNAVIEGADIVYRNFVDISIAVATPRGLVVPVVRNVESMSYADIEKTLGDLGVKARDNKLAIEDMEGGTFTISNGGVFGSLFGTPIINPPQSAILGMHGIFDRPVAVDGKVEIRPMMYIALTYDHRLIDGREAVTFLRKIKQAVEDPLTILLDL

SEQ ID NO: 1061 - protein, 423 aa, Heterodera glycines
  genomic DNA sequence=SeqID_534; coding sequence=SeqID_821
EKTADLHKVEDAFVPLIKLRYDGIELDILFARLALKEIKEDQELSDDNLLKNLDEKSIRSLNGCRVADEILRLVPNRLNFILVLRAVKLWAKNHGIYSNVLGFLGGISWAILVARTCQLYPNATPSVLLQKFFLVFSAWDWPHPVILKDVDATPRIDIPYFIDMIWDPRTRASDRYHLMPIITPAFPEQNSTFNVTRSTRQVMTNEFKEGLDNMLEIFNGHATWKKLFEEVNFFTRYKHFIALLCLTENEEDHLNFCGLVESKIRHLVASFERNSCVNLCHVNPRQYKPAYKLELDIDYENPVCTLWFIGLDLNKQLTKKIDLTEELQGFTDTVYKSASVLKDFKETMRIHPSYTRQRNLIKWLSKEDLDRGRRAERRCSAAAASPRVSMLNNSLDSTGKSLDTSGSNSPASAEEPSLKKLRV

SEQ ID NO: 1062 - protein, 119 aa, Heterodera glycines
  genomic DNA sequence=SeqID_517; coding sequence=SeqID_822
AYPLADIQLSQKLLDLVQQATNYHQLKKGANEATKTLNRGIAEVIILAADAEPLEIILHLPLLCEDKNVPYVFVKSKAALGRACGVTRPVIATSIIQNEGSQLKSQIQKIKEDVEKLLI

SEQ ID NO: 1063 - protein, 826 aa, Heterodera glycines
  genomic DNA sequence=SeqID_503; coding sequence=SeqID_823
MANVVEMTIEKIDEVKSRLGRTLGASMRLRDLIRQVRAARTAAEERAVVEKESANIRDSFRDDDNKYKCRNMAKLLYIHMLGYPAHFGQVECVKLVGSKDKRFTDVRIGYLGAMLLLDERSEIHLLVTNCLKGHLNDPEQFVAGLALCTLGSICSAEMCRDLASEVEKLLLKSTNTYLKKKAALCAFRIVRKVPDLIEMFISSTRSLLNEKHHGVLMAGITLVSEMCDLSADVRIHFKKMVPNLVRILKNLLMNEYSAEHDVAGISDPFLQVKILRLLRILGRDDPRVSEEMNDILAQVATNTETTKNVGNAILYETVLTIMETKSESGLRVLAVNILGRFLLNTDKNIRYVALNTLLKTVAIDFQAVQRHRTTVVECLKDADISIKKRALELCFALMNQTNIASMSKEIIIFLETADSDFKAECSSKMYVATERFSPSLVWHLDTMINVLQLAANHVPDEVVSAMIQLISSQQELQHYATVQLFHASKREHIVNAQPLMQIAFWSIGEFGDLLVTPGNTEEANVSEDEVVELFELLMPHPQLTVPTREYGLTALAKLSTRFDSHAEQIHALIRQYSAHMNLELQQRSVEFSRLLSKDELRNGLLERMPAIEHNALHTAATPIEMDDNHQELIVAQKEHQSQKPKADEIDLLGLGNTDSPALVDILFGGVPNVQPLSRNIGKDPIDDLFSFESSNKNGALVEDDQLKTGQIVLNQRGIEMQLFVDSNGFDSNGLAQLRFQTVNNTPAGVEDFNLAVAVTKAYQIELLPANSTSLQANALSTISQKANLRRLANSKAPRLRLRISYRLAGALNTIDAEVTSIACLAS

SEQ ID NO: 1064 - protein, 1464 aa, Heterodera glycines
  genomic DNA sequence=SeqID_502; coding sequence=SeqID_824
QYPQTVNLTLHMHKRYDITYIRLKFASPRPESFVVYKKNRAEDDWIPWQYYSGSCRSTFKLQDKAPILPGNEAVAQCTREFSDISPLTGGDIAFSTLDGRPSAENFEESEVLQEWVAAEQIRISLVRMNTFGDEIFGDSRVLRSYYYGISDFAVGGRCKCNGHANQCVKSTGRGEEQLVCDCQHNTAGVDCQQCAPFFVDRPWRPATSMEANECLPCNCNGLSNRCYFDAKLFENTGHGGHCIDCAGNTQGPHCEHCLPDHWRRQSEHYCRPCQCDEIGSADTQCDEKGQCRCKPGVGGQFCDRCEHGFYDFGATGCKDCRCDANGSFNNTPTCSSSSGSCVCKENVEGQRCDKCKPSFFLLSSSNPFGCSPCFCFGHSSVCSAAEGYFAVNVSSQFFDSTEDWSGGSERQLEDVQWAQVDRAAAVSQLDDYPVYFFAPSQFLGDQRHIYNNFIDFHLRVQLPNPGPSKKDIVIVGANGQELVLPIFAQGNPLPAVREQRFRFRVHFHPSLQWSPSLRETDFIAVLSNVSAFKIRGTFSKGDVGYLYNFTVNSAASVPNVDLAEPANWVEQCKCPDAFVGQFCESCAPGYKRTLHFGGPLAKCIPCECHGHSDSCDSESGSCICQHNTAGETCERCARGFYGDALTGTADDCKKCDCPENGPCILMGDGDTLCTECPEGYAGRKCDICAEESFGNPAEGIPCQKCDCNSNTDPNAIGKCDTISGECKRCIYHTTGWRCDKCMAGFWGDALSEVKGDCRSCNCYTQGTLRPGQDFEALECRQTDGQCSCQPNVIGLRCDQCAPGFFNISSGNGCHQCGCDPLGSLDGGVCDLITGQCQCKKGVTGRRCDQCATRHFGFGPEGCLECGCDPTGSETLECDVASGQCLCRQNVEGRRCDQCSENRFNLRGGCPACDDCYALIQSRKNELNGTMSELRENLDEIINNPIKVDDREFDAHVQKVRVEVESLHERALKKMGDDSHIRDQAISMRAQLAEADTLVLGLRDRLQQIDTNAAVIEQQLGQFSTDKETTHKELSVGVNYVQTQGEQHLAKAQEAFDRYGEKSQQLSEIAGESKQLSDTQEQRRREILSLAEQIRKESRQSLSDANEAIFGASSTSLQISALLTEVHELEQRLKAIQQMATEQSLETNQTHDGAAFILSGVDSIRLPNVFSDELMEKVKRAQEEGLEALSKTRSEAEKQAELVEKVDKLVEEACEQLRNAQQKQMSVDNSFDEAESFNARTQTAFELATKTWNDAKDSHDALSDFHSKIEQSRAEATEEMTNLADIEKEIEEAQAMTKEAEDAVGDASQNAKEAAEVAEEAKMKAQNLAMEAANLTDATEQTMAGATETKSALDTLSSELDSVLTTTKDFENQAISDAERSNEVAKKATLSEATANSLQEKLSDSDTKLTEALAQLSSLDNVDDAQLDTVEKLLKEAENRFDSSGNEVKMRERIIQAETKAVKQK

SEQ ID NO: 1065 - protein, 470 aa, Heterodera glycines
  genomic DNA sequence=SeqID_541; coding sequence=SeqID_825
QQQQQQNTGDEAGTKKQTRLGLDVTKTENYSEWYSQVIVKAELIEYYDVSGCYVIRPWAYSVWEHIQAFFDAEIKKLGVKNCYFPMFVSAAALEREKTHVADFAPEVAWVTKAGNSDLAVPIAIRPTSETVMYPTFAKWCKSHRDLPIKINQWCNVVRWEFKHPTPFLRTREFLWQEGHTAYATKEEAEEEVYDILNLYARVYTDLLAIPVVKGRKSEKEKFAGADFTTTVEAYVPVNGRGIQGGTSHHLGQNFSKMFNIEFDSLVKGQVEFVHQNSWGLSTRTIGAMVMIHGDDTGLVLPPRVADIQVVVIPVGITVKLSDEKRVELIEKSEALVKMLKEEHGVRAVLDQRDNVSPGWKFNHWELKGVPIRLELGPKDLAKEQALAVIRHSGQKVPLPLSNLGESIKQLLDTIHGEMYKKVEQIRDEHMVICLDLEEMTPLLDKKCVVLAPFCGRIECETSIKDFTVRE

SEQ ID NO: 1066 - protein, 161 aa, Heterodera glycines
  genomic DNA sequence=SeqID_518; coding sequence=SeqID_826
GEFGLRNKREVWRVKLSLAKIRKRARELLTLEDKDPKRLFEGNALLRRLVRIGVLEEDKMKLDYVLGLRVEDFMERRLQTQVFKLGLAKSIHQARVFIRQRHIRVRRQVVNIPSFVVRLDSQKHIDLSAKSPYAGGRPGRVKRKNAKKGAGGGGSGGEEED

SEQ ID NO: 1067 - protein, 177 aa, Heterodera glycines
  genomic DNA sequence=SeqID_529; coding sequence=SeqID_827
MASKFVFSLRFSYPRLLTSSALNNKKLVPNLIQSRSIVTKFDLELPDDYPEPWPYKQWGFNQFMQHLDKTLKRWHINSKLIVFESNIGVGRSSIAKELADALGFYYMPAFKMDDILVDRYNNDMRDYYHLFPKRFRFPDINMFYKDPADDQTAVMQDLMYDCRWEQYLNAQAHLFNT

SEQ ID NO: 1068 - protein, 163 aa, Heterodera glycines
  genomic DNA sequence=SeqID_530; coding sequence=SeqID_828
MINYMLLFSRQGKLRLQKWYVAYPDKAKKKITRELVTTILSRKPKMCAFLEYKDTKVVYKRYASLYFCCAIEQTDNELLCLEVIHRYVELLDRYFGSVCELDIIFNFEKAYFILDEFLLAGEIQETSKKQVLKAISAQDLLQDVSGGGDGTDHFVGRNKKPNK

SEQ ID NO: 1069 - protein, 550 aa, Heterodera glycines
  genomic DNA sequence=SeqID_343; coding sequence=SeqID_829
MALSIPKSGYSRFMKEGAMHFKGLEEAVKRNIEACMQLALQTRSAYGPNGMNKMVINRLEKLFVTNDAVSILNELEVQHPAARILVMAAQMQEKQIGDNTNTVVILAASFLEHALQLLDMGITAVEIASGYEFALQKVEELLPGLVVSTAEDLYDIVKVRSYLKSSLISKQTDHYELISDLVAKACVQIMPKNNTTAFNVDNIRICKILGAGVASSYVTNGMLFRRGAEGEVKGASNARVVVFACPFDLTQTETKGTILMNTADDLLQFSRTEESEVEAQVKSLSDVGVNVVVAAGKFGDLYVHFLNKYGIMAVRLTSKFDLRRLCRTLGAQAQARICAPSEEAIGHCDEVFLKEIGDTQVVVFDKKSEVGKVATIVVRGSSQSLVDDIERAIDDAVNTYKALTRDNKLLPGAGATEVELSHQIEIIGEKESGLRQYAIKKYATALDILPKQLAENAGLKPTETLTDLHAAHQKGSKWEGVDAVSGKLCNAMEAGIFDLYSGKSLALKLATNAAISVLKIDQIIMAKPMGGIKPRAPKGQDDDDDDTGMA

SEQ ID NO: 1070 - protein, 460 aa, Heterodera glycines
  genomic DNA sequence=SeqID_414; coding sequence=SeqID_830
MEQEQQQNVHHSGREVRQMFIDFFVKEKAHKYYHSSSVIPHEDPTLLFTNAGMNQFKPIFQETVDPNSDMAKLKRAVNTQKCIRAGGKHNDLDDVGKDVYHHTFFEMLGNWSFGDYFKREICTWAYQFLTEWLHISSERLYVSFFGGDLANNLLPDEECRQIWLDIGVPSEHILPFGMKDNFWEMGETGPCGPCSEIHYDRIGGRDAAHLVNADDPMVVEIWNLVFIQFNREEGGVLKSLPNKHIDCGLGFERLVAVAQQKTSNYDTDLFTPIFSAIQEGTGAREYTGKVGSEDVDGVDMAYRVVADHIRTLTIALSDGGSPDSTGRGYVLRRILRRGVRYATEKLGAKPGFFASLVPVVIDILGDTFPELRKDPSSAMEIINEEEAQFLKTLRRGHVLFEKAVNALPSGNKTFPGSIAWRLYDTYGFPIDLTQLMAEEKGLTVQMDEYEDSKKKARGKK

SEQ ID NO: 1071 - protein, 120 aa, Heterodera glycines
  genomic DNA sequence=SeqID_488; coding sequence=SeqID_831
LIAKVRPSSYGQRRNYSSIDISAEKWLMHYDADSLAKLENPPSLADGINRELERDIRYLGCELIQSGAILLRLSQTSAATAQILFQRYYYLKSFVRYNFEHMVQACLLLASKIEEEPRKP

SEQ ID NO: 1072 - protein, 390 aa, Heterodera glycines
  genomic DNA sequence=SeqID_351; coding sequence=SeqID_832
MGRPEFSPRGGGGRGGEKRNRKGFRGRGGGGDRGGRGGGGRGFRGGGGGGGFRQSNGEGGGGGGGFKGGRGGSPRGGGGGRGGGGSPRGRGGSPRGRGGSPRGGGAGGGMRGGRKVIVEPHRIRGIFIVKGKEDALCTLNMVPGESVYGEKRISSQQTENAPIAAITPKTEETTNGSNGVSAPTAAAAGPAPPVEYRVWNPFRSKLAAAVMAGIEDTHIYPGARVLYLGAASGTSVSHVSDIVGPEGMVYAVEFSHRSGRDLLGMAKKRPNVVPIVDDARHPHKYSMMIGIVDTIFSDVAQPDQARIVAHNAHKFLKNNGHVVISIKANCVDSTAEPEAVFAGEVNKLREEQFKPIEQVTLEPYERDHAVVVAEYRAAKKKVKKEKMEEE

SEQ ID NO: 1073 - protein, 434 aa, Heterodera glycines
  genomic DNA sequence=SeqID_477; coding sequence=SeqID_833
MASSEGEADHNVELWKIKRLIKSLEMAKGNGTSMISLIIPPRDQIARIQKMLGDEFGTASNIKSRVNRLSVLGAITSVQARLKLYTRVPENGLVVYCGTIVTEDGKEKKVNIDFEPFKAVNTSLYLCDNKFHTEALNGLLADDNKFGFIVMDGNGSLFGTLQGNAREVLHKFSVELPKKHGRGGQSALRFARLRMEKRHNYVRKVAETAVEMFIKNDKVAVVGLVLAGSADFKNELAQSDMFDQRLQAKIIKTVDISYGGENGFNQAIDLAADALADVKFIKEKKLISAFFDEISQDTNKAIYGVKETLTALEMGAIETLICWENLDLIRYAFRTTNGEKVVNLKPDEKDRSNFVDPETGTDYEIESSTPLLEWLANNYKRFGAALEIVTDKSQEGAQFVRGFGGLGGVLRYSVDIPQLDELENGVDEIDLSEY

SEQ ID NO: 1074 - protein, 207 aa, Heterodera glycines
  genomic DNA sequence=SeqID_464; coding sequence=SeqID_834
NVKDYSAAKALHISDTDKRKYFHLNAHFGYACGALELGTFASQRIKIISKPSKKKQSMKSSDCKYLCVGNKSKIALFNRLRSQTVSTRYLHVDENAFVASSTKWGAFHINVVDQPEFGGQQSQQQQQQHTVTYGSVIQLVDSQTEMRLPLMRIRKVDKQHVLLDPAGQGEPVSQLHKCAFQMVDVASNGAELFYLCLSQDKIIQFQA

SEQ ID NO: 1075 - protein, 460 aa, Heterodera glycines
  genomic DNA sequence=SeqID_355; coding sequence=SeqID_835
MSIAPTYKVHKPNVPILMEDIFGWVREGNSFQVRVWLDDSEHDLNVGDDHAFSLLHWASKEGHVSIVEMLLSRGARVNATNMGDDTALHLAAAHGHRQIVVKLLLRKAEVNVQNEHGMTPLHYACFWGYEQICEDLIRSGALTTMCNKRGLTPLDVCQPQIALSNGQNPQQKIQYSGDAWQNTKTFRSRDATWSRYTGVDLQSLALTKQIAQSHSGILYRGKWQNNDIVARVLNVPNVTERISRDFATEFLQLRIFASAFVNPVLAVVNQPPQLIVISQFMPFGSLYNVLHEQSSVVIDHHQAIRFALDLARGMSFLHSLDQPVLRYYLSSKHVLIDEDLSAKISMADTKFSFQEVGRLYSPAWMAPEALQRSPESLNTRASDMWSFGILLWELNTREVPFSDLSPMEIGMKIALEGLRVTIPPGISRNMFRLINICLNEDPGRRPNFDQIIPILEKMGH

SEQ ID NO: 1076 - protein, 201 aa, Heterodera glycines
  genomic DNA sequence=SeqID_456; coding sequence=SeqID_836
MKVFGLMVLSKDSSTAKVRLLKGAFELNSFSFFTRKNVQEFMQFTAKLIAERSATPSRSSVKEGEYFIHCMVRQDNLVGVCITDEQYQSRVAFTLLNKVLSDFAERILELEWKRMSGESDCSYSELPGFLTRWQNPREADALTRVQDEVEETKAVLHTTMQAVLERGEKLDDLIKASENLSDQSKMFYTQARKMNKCCSYT

SEQ ID NO: 1077 - protein, 513 aa, Heterodera glycines
  genomic DNA sequence=SeqID_345; coding sequence=SeqID_837
NNHHPTVNGNGFGLTNGTHFADDFSESIKDVGIIGIELYFPKSYVNQEDLEKFDNVTSNKYVLGLGQQEMCFCHENEDVCSLSLTVAAALMDNYKVNPKDIGFLAVGTETLVDKSKSVKSVLMDLFADSGNMDLEGADEKNACFGGTQALFHAVDWMYANYATEKRLAIVVCADVAVYSAGPARCTGGAGAVAFLIGPNAPIALERGLRACHSQNVYDFYKPIGGVSTQFPRVDGPNSVETYLNAVDMCYGRFCEKWNKKFCTGPPCSLSDFVAVIFHSPYARLTQKAFSWLSFVDFKRGMMDDGVTADDDDVSDWDQLSAYKSKSLHEIFAVERTKTRSDGDRFTDKILRMSSRTADAKLNPFLEFSRRIGNMYTPSVYAQLINVFLNTELSDKSNGKRILIFSYGSGCIAAMYSLRFNLYTEKLMAAYGAIKQSAKKAHARLDQRIRHSPKQFTAALERTEQIVAGGDTYIETPDDGKRSDGIPMFAGTFYLREIDSKQRRFYGQIDDANE

SEQ ID NO: 1078 - protein, 872 aa, Heterodera glycines
  genomic DNA sequence=SeqID_310; coding sequence=SeqID_838
NGAKEENSESDFEKMEEEAQKDIEERDALSKRIREREKHNTRHVMSKNISEKDDEANDMMGKLRYESRKSYLAKRKEDKRMELEAKVHDDETIFANEKLTKREQLDAKYRKEVLHYVKQYDEAGNVLKVPRYHVPDASSKIIPTEYVEENELPGGDGRRWEDEKLGSAVFHYGAKDAKAKPMEKGLLEDEQIDFVEALQQLEGTRETEVRKGANQRRLSLQETRKTLPVYAYRDEFIEAVKEHQVLIIIGETGSGKTTQLPQFLFESGFCSGDKRLGCTQPRRVAAMSVAARVAEEMSTKLGGMVGYTIRFEDCSSERTKIKYLTDGMLLREFLNEPDLASYSVLMIDEAHERTLHTDVLFGLVKDIARFRKDLKLLISSATLDALKFSTFFDDAPIFRIPGRRFPVQIYYTKAPEADYLDAAMISVLQIHLTQPLPGDILVFLTGQEEIETVQEALQERIKLLGSRIKELIVLPIYANLPTDMQAKIFEPTPPNARKCVLATNIAETSVTIDGIVYVIDPGFVKQSSYDARGGIDHLNVVTISKASANQRAGRAGRTGPGKCFRLYTAWAYQHELEEQPIPEIQRTNLGNVVLMLLSLGITDLVHFDFLDPPPYEALAAALEHLYALGALNHKGMLTKLGRRMAEFPCDPAMSKMIISSEKYECSEEIITISAMLSVNAAVFYRPKAMVIHADTARKGFWSSSGDHLTLLNVYNKWRETNFSMQWCIENFVQHRTMKRARDIRDQLEGLLERVEIEPKSSSDTMAILKTITAGYFHNLATLDKGGQYKTVKHRHTVQVHPNSCLFEDRLRWVIYYELVFTSKEFMREIIECDPKWISEVAPHYYQQTQLEDSVNKKMPKQMGKAKSELVGS

SEQ ID NO: 1079 - protein, 610 aa, Heterodera glycines
  genomic DNA sequence=SeqID_301; coding sequence=SeqID_839
DRFKLEDLLKRRFFFDQSFAIYGGVSGLYDYGPMGCALKANMIQAWRTHFVLEEGMLEVECTSLTPEYVLKASGHVDRFIDWMVKDKQTGACFRADHLVKNQVETLIRDKKTDEKAKSELMNVLVMLDGMSCDDLHEVIKKFNFKSPLTGGDLSEPVSFNLMFPTEIGPTCDQRAFLRPETAQGIFINFKRLLEFNQGRLPFAAAQVGSGFRNEISPRQGLIRVREFTMCEIEHFVDPTDKRHPKFEKIAHLELTLFPACNQMESKNPQKISIGNAVKLGIVNNETLGYYMARTHLFLLSVGISPDKLRFRQHLSNEMAHYAQDCWDAECFTSYGWIECVGNADRACYDLHQHQKASGVKLVAEKKLGAPKQIEVVEAVPNKQLLGKEFKSDSKQILAALDDLTEAQIEELEREIKSNGKYRLSLREGKTFELNSSMVEVKRFEKTVHVEEVTPSVIEPSFGIGRIFYAVLEHSFRQREGDEKRCYLELPPLIAPIKCSILPISSNERLDPIIFAVRDQLTSREISSKIDDSSGSIGRRYARTDEIGIPFGITVDFESELQPWTVTLRNAPTMQQIRVSVSEIGEVVGHLVKGKMNWETAMAKYPIFNAK

SEQ ID NO: 1080 - protein, 252 aa, Heterodera glycines
  genomic DNA sequence=SeqID_344; coding sequence=SeqID_841
MLRKTIKTLQPIYNARTAFRFQTGGYAAPGTEAQAQEVKKQTSTKYVIDEQKREKLTLFGQYVAACMPKFVQQVQFAGGDELEVLIHPTGVLPVMAFLKGHHSAQFTNFIFACGLDVPTLRTYTDEVAPIDSITPVFSGAEWYEREIYDMYGVWFNNHPDLRRILTDYGFEGHPQRKDFPLSGYVELRWDHELNRVIYEPTEMTQEFRKFDLNTPWEVFPAFRDESITSGYNVIQKAGKIEAKKLDDASKKP

SEQ ID NO: 1081 - protein, 736 aa, Heterodera glycines
  genomic DNA sequence=SeqID_445; coding sequence=SeqID_842
MMEVDDPPNIQTPSSKPMEIEREIEHLPQAQATKDETEQLPQVQGTKGIESDDIAYEEDIIRNPGLLRPWERYIEHKVKTKADPKQVRLVFERALKLFNRSYKLWYNYLKYRRKTIAHKPPTDIAYAHLSDAYERCLVFLNKMPRIWIDYCMLMIRRGQITETRRVFDRAIRALPITQHMRIWPLYIDFATRHNVPETAIRVYRRFLKVYPGGREDFVEYLKSIDKLDEAAQQLVILVNEDRPISEKGKTGHQLWTELCDLISKNPNKIFTLRVEPIIRQGIGRYTDQVGGLWLALAEYYIRMPNFEKARDIFEEALGVVKTVRDFTQLFDAYSKFMERLTSLKMDALSSARPTQVDERELELELVMTRFEHLMNRRPLLLNSVLLRQNPHNVHEWVNRVQIYEGDPENQIATFEKAVATVDPKQQVGRLGQLWIEFGKLYEKLDKLDEARKVFDRAVQANFVRVDELAQVWCEYAEMELRHSNYELATALLRRATTPPPVRRDSYFDDSAKVQNRVFRSLKLWSLYADIEESMGSLESCKAIYERMLELRIATPQIVINYALFLEDNQYFEDAFKAFEKGIGLFRWPLVFDIWNVYLTKFIQRYGGKKLERARDLFEQCLDKCPPKYAKNIYLLYAKLEEEHGLARHSMDIYNRATGAVEKEEMHLIYNVYVKKAMQFYGITKTRPIFESAIERLPEERSREISVRYAQMERNLGEIDRARAIYAHCAEICDPRV

SEQ ID NO: 1082 - protein, 495 aa, Heterodera glycines
  genomic DNA sequence=SeqID_499; coding sequence=SeqID_843
MEQLEIQPGTFSEGTIACCDCGTPIAPNPANMCLGCVRARADITEGIPKQCPLQSCRNCERFFVPPNAWNAAKPESKELMALCLARLKPAMAKVRLVDAAFVWTEPHSKRVKVKLTIQKEVFSRAVLQQSMVVEFVLLNQMCDDCRRFEAKDYWRACVQVRQRCDYKKTLFYLEQLLIKHNAQAQASGIKPVPTGIDFFFARQQEARKLVDFISSALPSKFHQSQQLVTHDVRSNFYDYKHTFCVDIVPITKDALICLPRTLAQSFANIGQFVLCLRVTDVVSLINPQTLQLYELNATTYWKNPFDILVHPKSLVEFFVVDVEEVDDPYAVLPHGHGSVSTKHRLADVWVVRSDQVGHSDAKSVCCRSHLGHLLNAGDTTNLNNRTFDAVKEENVPDVVLIRKAYDRSRRLRKRQWRLKRLLDQEETASVEREFNEFMDDIEEDPALRERINIYKKGGGKHEGGEEEHIDGAPTLAEMLDDLELDDVEMREEEEG

SEQ ID NO: 1083 - protein, 394 aa, Heterodera glycines
  genomic DNA sequence=SeqID_346; coding sequence=SeqID_844
QLLARVLDKNKRVQEAACSAFATFEEEAGHELVPYMPEILGTLVEAFKRYQAKNLLILYDAVGTLADSVGGNLAEPPYAEMIMDPLMSKWAQLRDDDKELFPLLECISSVATALHTAFYPYCEPTNYSFLKDREAQHDQPEKDFLIVALDLLSELAEALRDYIDPLVAQSNIIQLVYICAQDTTNEVRQSTFALLGDLVKACYAHLQQNIHQFIPILAQNLNPDFVSVCNNAIWALGEISMKIGDQMRQYVPILLPQLIHVMNRDKPPKTLLENTAITLGRFGIHCSAEVSPFLADFVRPWCMSLRNVRDNEEKESAFRGICLMVNCNPQGVAAAFIFLCDAIASWQTPSEELRFMFGRIIYAFKSQVGEENWNNFVAQIPEPLKQRLGTQYQL

SEQ ID NO: 1084 - protein, 294 aa, Heterodera glycines
  genomic DNA sequence=SeqID_429; coding sequence=SeqID_845
ILLPNSCLDNLMRRNIQYPMLFKLTNVGPALQRGTHAGVLEFLAEEGRCYLPSWMMAQLALREGDLITVEYKALPNATYAKFKPMSTDFYNISNPRAMLEVELRKFSCLTKGDVIAVQYNEQVYEFQVKALKPENAVTIVECDINIEFDAAEGYVEPNRTHQQRNEMVAAEEEQQSHPPNVFKPFSGSGFRVDGKKPRSVSTSSQQEATSSSSSSASSGRQPSSGIASTASTARDALEAIAVDENYIPGELRFVRRPYKSKAQRDKEAREKDNGGTMKPFGGEGNTIRPTRGGQ

SEQ ID NO: 1085 - protein, 412 aa, Heterodera glycines
  genomic DNA sequence=SeqID_390; coding sequence=SeqID_847
RGDVDTVVIEKFVPLLVDLEEEGQLAPVVDVESGTHMIWIRFNNIYVVAVSRCNTNVSLVQTFLYKLVAVFAEYFKDVEEESIRDNFVIIYELLDEMMDFGYPQITEGRILREYITQEGHKLEAAQQPRPPMAVTNAVSWRSEGVRHRKNEVFLDVIESLNLLASGAGTVLQSEIVGSVKMRVFLTGMPELRLGLNDKVFSFNSIQFSNLGGRSKAVELEDIKFHQCVRLSRFENDRTISFIPPDGEFELMSYRLSTIVKPLIWVEAVIEKFSHSRVEYMVKAKSQFKRRSTANNVEIVVPAPSYSDSPRFKTAIGNCRYQPEDNSFVWNIKNFPGGKEYLMRAHFKLPSVLSEEVEAKRPIKVRFEIPYFTTSGIQVRYLKIIEKSGYQALPWVRYITQSGDYSLRLNSVT

SEQ ID NO: 1086 - protein, 301 aa, Heterodera glycines
  genomic DNA sequence=SeqID_476; coding sequence=SeqID_848
MLVLFETSAGYALFRLDDESILQKVDDIWKEFSSGDNKALQLVSFKKYKTVAEAVSNATALNEGKLDKTLKRFLKKSIIDQTEKLAVDDTQIGKIIKNSLDIKCLHNSAVSELMRSIRANVSSFLGEETAHEMNAMRLGVAHSIGRYKVKFNPEKIDTMIVQAVSLLDDLDKELNNYVMRCREWYGWHFPELGKLIADAQAYAKCVKAIGMKANAQNADLSAILPEELAEKVRQEAEISMGTDISELDLIHIVELCDQIVELAQYRAQLHDYLKNRMNALAPNLTVLLGELIGARLVSKAG

SEQ ID NO: 1087 - protein, 595 aa, Heterodera glycines
  genomic DNA sequence=SeqID_302; coding sequence=SeqID_849
VFCAINELGQTKRVDEALCGQGLEEKPVAREECVNEEKCTGTFFTSQWSNCTAKCDGGTQTRTVVCLNYDKKPVPEWCDEKEKPAEQQECGMDKCQNCTDSEFGCCPDGESFASGPYLEGCSNCSSVAEFGCCADNVTAREDAQGTNCPEAAAGKKGVTFDEAEGSGEAAPPSKEMCAIETVGTKEKLQIPCAEAAAVTETMNETVQLIKLASADETAPEAKETKFGCCPDWSTPAEGPNYAGCPKFVLGNCNGTKFGCCPDEVSMARGPDFEGCGEPTCAASTFGCCKDRRTIAFGPHYAGCDRSSFPCELSTYGCCEDGETAALGPNGTGCGASCLLTKFGCCPDGKTHAQGANNEGCGCEYAQYGCCPDGHNAAKGPGFYGCPESCAQSKFGCCPDGKTIARGPNKEGCPCQYTRWGCCPDGETTALGPLNEGCDDCRYAKYGCCLDGVSKAIGPDYAGCPTTTPAPYMLGGTVSPSYIVSCSLPQDQGQVCHSGYQLAWYYDMVEGSCSQFWYGGCGGNNNRFSSKEQCEQICVEPPQIGRCYLPRVEGPQRCDQLAARYYYDYLTRQCAAFWWRGCRGNANNFGSWEECQ

SEQ ID NO: 1088 - protein, 363 aa, Heterodera glycines
  genomic DNA sequence=SeqID_322; coding sequence=SeqID_850
AFLKKVTRARAKREHLKLEGLLRAKPTFSYDHLVRERYPTFASALCDLDDALCLCFAFSALTQSKIARPRTIGQCRRAVTEFMHFVIEAKALRKVFISIKGVYYQAEILGERVTWVVGHERAVGRANELDFSVMANFVDFYLCMLCFVNFRLYKTLGLFHPPQLRRQQMPSENDFSFDHSNELDERVYSLAFPLKRTDKMDADSCGEPSIIDTFAEDDAEGGESLAEKMRQAEVQKTLFAKCKFFLNREVPKEALAFVIRSGGGFVCWDGCAPNSVDEHSEQITHQIVDRKVEKTNINRVYVQPQWVFDCFNARRILPPAKYAPMATLPPHLSPFVDAQHLEVGAGAYIPLERIEHAKQQNGT

SEQ ID NO: 1089 - protein, 193 aa, Heterodera glycines
  genomic DNA sequence=SeqID_358; coding sequence=SeqID_851
ADGTFSTQAEWLLETDGTALLRVLSEPDVDFIRTHSNDICEIFEVLGIEAVRKAIEREMNQVISFDGSYVNYRHLALLCEVMTARGYLMAITRHGINRQEVGALMRCSFEETVDILMEAAVHAETDPVKGVSENIMLGQMAKAGTGCFDLVLDSDKCKLAMDIPDFIMAKSAGGLFGGGMSPPGFANKRIDLF

SEQ ID NO: 1090 - protein, 119 aa, Heterodera glycines
  genomic DNA sequence=SeqID_431; coding sequence=SeqID_852
MTKKRRNNGRNKKGRGHVQPIRCTNCGRSCPKDKAIKKFVVRNIVEAAAVRDITDASVYDQYALPKLYHKLHYCVSCAIHSKVVRNRSREARKDRNPPPRFGQRSAVDRPQRPGGAAPG

SEQ ID NO: 1091 - protein, 308 aa, Heterodera glycines
  genomic DNA sequence=SeqID_416; coding sequence=SeqID_853
MKPDLKDRDFMYKLIVGQLFYDGHQQLALNLAQTLGLSLRPPPPSDKLFRLVAIAKQFVEDPESKERETILQSAGLDLEFDADVVPTSPEPSLYETVYLTTHKAPCRAAAFSPDGALVATASNDCSIKILDVDKIISRIDVTLSESGPDAHHPVIRTLYDHLDEVTCVAFHPRESVLLSGSNDFTLKMFDYSKTAVKRAMKTITEVEPITAVSFHPSGEFFLCATRHPTLRLYSAETQQCFVSPIPKDQHSDSITDVCYSENARMFVTGSRDGNVKVWDGVSNRCIETFTRAHDGAPICSAQFTRNGK

SEQ ID NO: 1092 - protein, 386 aa, Heterodera glycines
  genomic DNA sequence=SeqID_436; coding sequence=SeqID_854
MAAAEFARKLQLIQAASTSSSAVRDPFEAKHHKYQFWNTQPVPKLSRRIALTENNYIDPPLDVSTIKKDPYSLLEKFIWSDIDLNADEQLDELYILLTENYVEDDANMFRFDYGKNFLKWALMPHGWQQQWHCGVRAVTSGKLVAFIAAVPATIRIYDKTVKSVEINFLCVHKKLRTKRLAPVLIKEITRRVNLFGIFQATFTAGIFIPKPVGICRYWHRSLNPKKLVESSFSHIGKNMTLPRMIKLYKLPENTESQLTLLNRDSAKSAFELLSGYLTKFDLVPIFTIEEFEHFFLPRDDVIYTYMIQNNGEVTDLVSFYSLPSTVMHHSHHKSIKAAYSFYNVAGSVPLSHLLNDALILARNVRFFLFVSVRLGISKFVSQSAWL

SEQ ID NO: 1093 - protein, 435 aa, Heterodera glycines
  genomic DNA sequence=SeqID_484; coding sequence=SeqID_855
MSVPGSQPPQQGEDAEERLINEEYKIWKKNCPFLYDMVMTHALEWPSLTVQWLPDVQRQEGADYTIHRLILGTHTSDEQNHLVIAKLLLPNDDAQFDASRYDTDRGEFGGFGTVTGKIEVEIKMNHEGEVNRARYMPQNPVLIGTKSPSSEVYVFDYTKHPSTPADVECKPQLRLRGHTKEGYGLSWNNNLPGHLLSASDDMTVCLWDIQAATANANFLDAKSIFTAHTAVVEDVAWHVLHDTVFGSVGDDHKLMVWDTRTNSSTKPTHVVEAHSAEVNCLSFNPYSEFILATGSADKTVALWDLRNLKLKLHSFESHRDEIFQVQWSPHNETILASSGTDRRLHIWDLSKIGDEQSPEDAEDGPPELLFIHGGHTAKISDFSWNPNEPWVICSVSEDNIMQIWQMADNIYNEEELDPAMVEGVAAASGAGPMGQ

SEQ ID NO: 1094 - protein, 166 aa, Heterodera glycines
  genomic DNA sequence=SeqID_312; coding sequence=SeqID_857
MPKHEKGTPKEIANRAKAKGLQKLKWFCQMCQKQCRDQNGFKCHMMSESHQRQLLLFAENQNSYLRQFSREFEANFMHILRHTFGSKRIRANEVYQEYIKDKGHVHMNSTVWHTLTGFVMYLGKSGKCKIDENEKGWHIQYIDQEEELRRQKLQQRAKQEKDDEER

SEQ ID NO: 1095 - protein, 166 aa, Heterodera glycines
  genomic DNA sequence=SeqID_398; coding sequence=SeqID_862
AQMASAAPPLGPSLGQRGVNVANFCKEFNNLTSTIRFGTNLPVSIHVKPDRTYEIDISTPTTEWLLQQAAGIRRNRQEEGEIVGMISVKHVYEIAKVKSQDKSLIGVPLKKICQLVIERADSIGIKVQNEDLDPEEYRKFLEHRQEVVQRQLEEIAKQEEAKLART

SEQ ID NO: 1096 - protein, 581 aa, Heterodera glycines
  genomic DNA sequence=SeqID_384; coding sequence=SeqID_863
MEPPSVASSDYRSAISSRPYFSRPRPLSPTRYSSDGGGTRVLKMVSESSSISSRPLSPYPASTTATAIRDAREREKKEMSELNDRLATYIEKVRFLEAQNRKLATDLDFLNKRWGKDTSNVREMYETDLRQAKKLLEETQRQKDELEKKAKAMEEEMDTLKKKNANAVTAHEGDKKLMEELLQSLSSLEAELTMLKRRLEILDEDLKALRRENQHLNGEMQKARTDLDQETLNRIDYQNQVQTLLEEIDFLRRAHDAEIQDLQAMASRDTTGENREFFRNELASAIREIRNDYDVLNNRNRSDIESWYKMKVQEIQTMSARQNLEQNYAKEEVKRLRTQLGDMRGKLADLEGRNSLLERQAEELAYQVEDDQRAYESALNDKDAQIRKLRDEAQALMLELQMLLDTKQTLDAEIAIYRKMLEGEEDRSGLYQLVEQVVKTQNIRRQDEAESQRILRGEKSSRQSYQRSAKGNVSILETSPEGKYVVLENTHRSKEEPIGEWKLKRRIDGKREIVYSFPQEFVLRPGKSVKVWAQREGINAPPDHLVFDGEESFGTGSNVQTLLYNRDGEERASLIQRSSGR

SEQ ID NO: 1097 - protein, 200 aa, Heterodera glycines
  genomic DNA sequence=SeqID_394; coding sequence=SeqID_864
MAAMNPEYDYLFKLLLIGDSGVGKSCLLLRFADDTYTESYISTIGVDFKIRTIELEGKTIKLQIERFRTITSSYYRGAHGIIVVYDITDQDSFNNVKQWLQEIDRYASESVNKLLVGNKCDLTTKRAIETNVAKEYADQLNIPFLETSAKNSTNVEQAFITMATEIKNRMGPLQQAGGNASAVRIGPSQPVRDKKTGGCC

SEQ ID NO: 1098 - protein, 560 aa, Heterodera glycines
  genomic DNA sequence=SeqID_313; coding sequence=SeqID_865
RAIHRGAFFTEMRTTDVRKLRPEAWGFICPVHTPDGSPCGLLNHLTASAGVTTHITETTKLKQTLSSLGLIPHNALTYHPKESKLYPVVLDGDFVGFIPRKKAAFIERQLRAMKVASHDDRVPAFTELTLIRHSPDSENIQMQFAAFFIYSGLGRLMRPVRNLLFDQIEQIGIFEQVYLSIIIDPEEAEPGVTMHQELHPSSLFSFAGNLIPFPDHNQSPRNVYQCQMGKQTMGVPVHAWQTRTDNKMYKLQTAQKPLLKLEAHDKYEMDEYPLGTNACVAVISYTGYDMEDAMVINKASYQRGFAHGTVVKVQRISLVDRSTGGFGQSKNAEMVFLGKPNERNYGIGADGLPIEGRLYQQGDCYYGTFNLVSGQFNEHKFTNSEPAYCGLVRIVQEADHKNKNVHVLIQWRIQRNPIIGDKFASRHGQKGINSFLWPPESMPFSESGMVPDIIFNPHGFPSRMTIGMMIESMAGKAAAMHGTSYDASPFVFNEQNTAIEHFGKLLAKSGYNYYGNETMYSGIDGREMKVQIFFGIVYYQRLRHMIADKFQVRSTGPVDP

SEQ ID NO: 1099 - protein, 304 aa, Heterodera glycines
  genomic DNA sequence=SeqID_473; coding sequence=SeqID_867
RIWRNTKIRSDFRHVMNAVEEAKKRKAAEVLRLPKSNREAIAAVVSNESEESKISEKAALFITAGDGADFTGNLMVATVPSKPQQDNANLRALLPSRANLITKPKWHAPWKLYRVISGHTGWVRAVDVEPNNEWFASGGADRIIKIWDLASGHLKLSLTGHISAVRAVKVSPRHPYLFSAGEDKQVKCWDLEYNKVIRHYHGHLSAVQDLALHPTLDILVTCARDSTARVWDMRTKAQIFCLSGHSDTVASVICQGVNPQVVTGSHDSTIRLWDLATGRSMCTLTNHKQTVSGREIHMSYNTFR

SEQ ID NO: 1100 - protein, 436 aa, Heterodera glycines
  genomic DNA sequence=SeqID_442; coding sequence=SeqID_868
MSSKPAYKVADISLADFGRREITIAENEMPGLMAMRAKFGAQKPLKGARIAGCLHMTVQTAVLIETLLELGAEVQWSSCNIFSTQDHAAAAIAKRGVPVYAWKGETDEEYEWCIEQTLIFPDGKPLNMILDDGGDLTNLVHHQHAELLPGIIGLSEETTTGVHNLAKMLAAGLLKTAAINVNDSVTKSKFDNMYGIRESLPDGIKRATDVMLAGKVAVVCGYGDVGKGSAAGLRNFGARVIVTEIDPINALQAAMEGYQVSTLDEVADIAQLVVTTTGCKNIVRGEHIERLPEDAIVCNVGHFDCEINVTYMNENCVSMEQVKPQVDRYLMRSGRHVILLAEGRLVNLGCATGHSSFVMSASFTNQVIAQLELYTKYGTPDAYKTGLYLLPKQLDEEVARLHLDKLGAKLTKLSKDQAEYLGIPQEGPFKPGHYRY

SEQ ID NO: 1101 - protein, 118 aa, Heterodera glycines
  genomic DNA sequence=SeqID_490; coding sequence=SeqID_869
MSSESDEQSADVNGLCSQSLRSDEKVCPDPDTIKMFIGQIPKAWDELQLKEYFEEFGPIYQLSVLRDKETASSRGCCFVTYYHRKDAISAQNELHNVRTFPGLSHPIQMKPADVENKN

SEQ ID NO: 1102 - protein, 1141 aa, Heterodera glycines
  genomic DNA sequence=SeqID_380; coding sequence=SeqID_871
MYIKEVNITGFRSYKELTTVRNFSPKHNVVVGRNGSGKSNFFTAIQFVLSNDFSSLTLQDKNAFLHEGVGSRAPIAKVEIVFDNTDRRIPTDSDEVRIMRQVGQKKDQFFIDNKPVTRTEIVNLMESAGFSRSNPYYIVKQGKITELATASDPYRLKLIKEVAGTRVFDEKKDESTKILHETQTKIEKSVQLLGYINERLKKLEEEKEDLKEYQKWDKMRRAIEYTIYDLEIKEARSKNEKLTSHRERINAQQNEVETKLIQAKMSIQEAEMQIRRLETHYKGVKEERATLLKEQTDLMERKTQLELAIRDLAEDVDRERSGREIAEHSLQQLKRDIAEKEGQLEQLQPQFEQLLEEESQLGSDIRIGEQKCRELYAKQGHREQFKTVEERDRHLRKEIHWIERRIDETEHQITEIDESIVEDGKEHKRLRAEIHDLEQILREKSTRMDTLNAEEKQRKAELDRAMNARMENARQEKDVRERLTLVQYEMQQSEQELRRLTSKAVLNGINSVNQVLEEMRQNGNGQNIVDGYFGRVIDLFECESQHNKAVEVTAESRLFYHVVSDDRVAMKLLERINQRGLPGEVNFYPLNRVLVKDRRPVSDADASPILDHLQYDPNFEPVFRSIFGNCVFVRDLAAGSRVAKQERFDCVTLDGDQVSRRGPMTGGYIDRKRSKIDLAKKLRNFERERINLEEQADLLSLSVSDSLKEVERIRLEISKLAMDIQMLSKEHKALLEKKRSVSELLSQHSLNLEPKKSQKTVLRNRIRELEAHRKLVQDQLGTELQSQLSSEERDELDGVEDEIKAKKENMDKLMRQRMEVENRIQTLKNQLQSNLLRKRENLNAKIESITVELDLDLGKYDTEKEELGNALDAHQEESRELNEQLEEFAKNAEIYCTKIANIQSKREECLRKITDIGSLPTDTAMGKYDTMGLKQLDKKLTECMNELKKYENVNKKALDQFMRASTQKEELTKRVEELQNNEKTIQDLLSVLENRRFETLQLTFKQVAKNFEDVFKKLIPQGTANLVMQKVDPSMISALSGGQKTLVALALIFAIQKCDPAPFYLFDEIDAALDQEHRRAVAEMIHELSEIAQFITTTFRAELLEHAEKFYGVRFRDKMSYIDDISQQQAQDFVQDDQTHS

SEQ ID NO: 1103 - protein, 229 aa, Heterodera glycines
  genomic DNA sequence=SeqID_457; coding sequence=SeqID_872
MQIFVKTLTGKTITLEVEASDTIENVKAKIQDKEGIPPDQQRLIFAGKQLEDGRTLADYNIQKESTLHLVLRLRGGMQIFVKTLTGKTITLEVEASDTIENVKAKIQDKEGIPPDQQRLIFAGKQLEDGRTLADYNIQKESTLHLVLRLRGGMQIFVKTLTGKTITLEVEASDTIENVKAKIQDKEGIPPDQQRLIFAGKQLEDGRTLADYNIQKESTLHLVLRLRGGK

SEQ ID NO: 1104 - protein, 201 aa, Heterodera glycines
  genomic DNA sequence=SeqID_377; coding sequence=SeqID_873
MGISDNDVQKQLRHMMAFIEQEANEKAEEIDAKAEEEFNIEKGKLVQQQRQKIMEYYEKKEKQVELQRKIQRSNMQNQSRLKCLKARDDHLKNVLEEARANLSKISADRERYPAILKGLLLQGLFQLLESKVVLRCRKKDEEMVARILPECLEEFQRTVKIDNEYFLSPESAGGVELLAKDGKIRVSSTLEARLDLIADKV

SEQ ID NO: 1105 - protein, 256 aa, Heterodera glycines
  genomic DNA sequence=SeqID_412; coding sequence=SeqID_874
MKVINEFGYRQDARTPSQIRNIVYQMGVYSHADGSAYIEQGETKVLCAVYGPHECRFRSRAKEDEAIVICQYSQATFSVPDRRNRPRGDRRGNSFSHLLERAFESVIFTHLYPRSQIDIFFELLEADGANLAACVNVASLALADAGIPLRGLLSAVECGSADGLPCADLSSREHSELVPRLTMATVGGKDEIVLMDMKNLLHKNHLPSLLQMGVNACAQVHICLETAVFRHVEASHRKNTESGKQNSLLNRIVEGR

SEQ ID NO: 1106 - protein, 465 aa, Heterodera glycines
  genomic DNA sequence=SeqID_422; coding sequence=SeqID_875
MGKEKIHINIVVIGHVDSGKSTTTGHLIYKCGGIDKRTIEKFEKEAQEMGKGSFKYAWVLDKLKAERERGITIDIALWKFETSKYYVTIIDAPGHRDFIKNMITGTSQADCAVLVVACGTGEFEAGISKNGQTREHALLAQTLGVKQLIVACNKMDTTEPPFAEARYTEVMTEVSNFIKKIGYNPATVPFVPISGFNGDNMLEPSDRMPWFKGWAIERKDGNASGKTLLEALDSILPPQRPTDKPLRLPLQDVYKIGGIGTVPVGRVETGVLKPGMVVTFAPQGISTEVKSVEMHHESLPEALPGDNVGFNVKNISVKDIRRGSVASDSKNDPAKETKSFTAQVIIMNHPGQIAAGYTPVLDCHTAHIACKFAELKEKVDRRSGKKVEDNPKALKTGDAGIVDLIPTKPMCVEAFTDYAPLGRFAVRDMRQTVAVGVIKAVEKTEGGGKVTKSAQKAAAPGGKKK

SEQ ID NO: 1107 - protein, 480 aa, Heterodera glycines
  genomic DNA sequence=SeqID_331; coding sequence=SeqID_876
CRGPHVRDTGKVKAIAVTKSSSAHWEGNVNAEPLQRVYGISFPDTKQLKQWRIWQEEAAKRDHRKLGRDQELFMFHPLSPGTAFWYPKGTHIYNTLLEFMRREYRRRGFQEVISPNIYNAKLWEQSGHWHHYAENMFRFEIEKEQFGLKPMNCPGHCLMFDYKPHAYNELPIRYADFGVLHRNEMSGALSGLTRVRRFQQDDAHIFCRKDQILSEISGCLDFLNFVYVEVFGFSFRLHLSTRPEEGYLGDLATWEAAETQLKQALDNSGLKWELNPGDGAFYGPKIDIQIKDALGRHWQCATIQLDFQLPQRFDLSYYDENKERLRPVMIHRAIYGSIERMVAILAENCGGKWPFWLSPRQAMIIVVHHSVSDYASKVFRRIFDAGFEVEFDEDSPDTLNKRIRNAQLAQFNFILVIGQQEKNNGTVNVRTRDNQVRGEIAVDALIQKFQIFRDTFAQDTESAGSFEGPKEQKEILDDKK

SEQ ID NO: 1108 - protein, 614 aa, Heterodera glycines
  genomic DNA sequence=SeqID_428; coding sequence=SeqID_877
MSNWQKMAVAAAVIVGLQYFINRLAYTEISWKQFYTDFLEKNNVERLEVIDNKWVRVITREPTQTVFYFNIGSVDTFERSLTQAQQHLGMETSQQQVPVLYKSETDIVGMIPHMVNFLITGIFLFYMFRMFRGFGGKKPGQRGGGGGFPGMGNLFGVGQSTARVINREDVKTAFADVAGCEEAKIEIMEFVNFLKNPAQYKALGAKIPKGALLTGPPGTGKTLLAKATAGEANVPFITVSGSEFLEMFVGVGPSRVRDMFEMARKKAPCILFIDEIDAVGRKRGGKGAMGGHSEQENTLNQLLVEMDGFSTDESNVVVIAATNRVDILDPALMRPGRFDRQIFIPVPDIKGRASIFRVHLTPIKTTLDKIELSRKLAAHTPGFSGADIANVCNESALIAARDAHDEVTSKDFENAIERVIAGMEKKSQVLQPDEKKTVAYHEAGHAVAGWFLEFADPLLKVSIIPRGKGLGYAQYMPKDQYLYSKEQLLDRMCMTLGGRVSEEIFFGRITTGAQDDLRKITQIAYSQVVKFGMSEKVGPVSFDTPEPGEMAFDKPYSEATAQLIDQEVRDMVSAALRRTRELLMSKVEQIERVALRLLEKEILAREDMIELATR

SEQ ID NO: 1109 - protein, 441 aa, Heterodera glycines
  genomic DNA sequence=SeqID_475; coding sequence=SeqID_878
MSNLPVSSLIRQQHGGGLGEEDGIESGKRKSKDEYRRQKDLEEQRKAGTAPAMVDVETGRDINPHIPEFIEKTPWYVPSSGPTLKHQRPHPERQKQMSSVAEWYPKGTTERVAFKYRDGACQNCGALGHNRKNCFEKPRLVGAKFTNSNIAPDDHVLPSLEMGYDAKRDRWNGYNAEDYSLVAAEFEKMEETRKLIRAEQLKEAGEEDKKAEEDEDIYAEDASAPGQSVDMDSRTRITVRNLRIREDTAKYLYSLDPNGAYYDPKSRSMRENPYKNVPGKEEEAAKFSGENFVRFTGEVADANDAQVFAWQARCKGIDVHSLAEPTRLEALKREFEKQKGARKESVKNELLEKYGGEEHLDILPRELLLAQTEKYVEYNRKGKVVRGDDRPTMKSRYEEDNYINNHLTVWGSYWREGRWGYACCHQFLKNSYCIGESGIIA

SEQ ID NO: 1110 - protein, 348 aa, Heterodera glycines
  genomic DNA sequence=SeqID_324; coding sequence=SeqID_880
MKIDKIGNYLQDEREKEKRAKEVKNNKKKEKPSNFIRNFLSRLMPVMTSEHLATDSKWVDRERVMLLCSRGSLARTRHLVNDFKRLMPHVHGESKYGKNGKMAEDLNEMCELANCTTCLYFESRKGRDIYLWLSNVDGGPSAKFLVSNVHTMSELNMVGNCLKGSRPILSFDPEFDGKSHLRLIKELLVNTFKTPNHHPRSQPFIDHVINFAVTEDGNIWFRNYQVAENNELMEIGPRFVLQLIRLFDNSFCGAVLYDNPNYQTPNAIRRQIKLQKAAEFKQRQGQREEGKVKERMIKEVEMEDPLGEVFDTEEKMEEEEKTEEKEGKKKKRVNAAKALEKRILKKNK

SEQ ID NO: 1111 - protein, 402 aa, Heterodera glycines
  genomic DNA sequence=SeqID_303; coding sequence=SeqID_881
MSSKALNVRVITMDAELEFTILPSTTGKQLFDQVVKTINLREIWYFGLQYTDTKGFSSWLKLNKKVLKQDIKKEQTLQFKFRAKFYPEDVAEEIIQDVTLRLFYLQVKDLILTDEVYCPPDQAVLLGSYAMQAKYGDYSKEEHSSGSLANDRLIPQRVLNQFKMNMSEWENRVMTWWTDHRGMNRETAMLEYLKIAQDLDQYGVNYFSIRNKKGSELFLGVDALGLTIYDQNDKLNPKVGFPWSEIRNISFNDKKFVIKPVDKKAQDFVFYAPRLRINKRILALCMGNHELYMRRRKPDSIEVQQMKQQAKEERIQRQLEQERLQREMCAREAAEQKQHEYEAKMLSMKEEMESAQRELEVAQGRIRRLEDQIYELNEAKRLLEEKEHELQTLNTELASERA

SEQ ID NO: 1112 - protein, 107 aa, Heterodera glycines
  genomic DNA sequence=SeqID_432; coding sequence=SeqID_882
MADAAAQEQKKKRTFRKFVYRGVDLEQLLEMNEKQFNQMIPARQRRKMNRGLNRKHKSLLVRLRKAKLNCPELMKPECVKTHLRDMIVLPEMVGCVVGIHSGKAYNQ

SEQ ID NO: 1113 - protein, 817 aa, Heterodera glycines
  genomic DNA sequence=SeqID_415; coding sequence=SeqID_883
MAQEPPLQIVIPRLDDDKPLVRRPTPQAQPAAPAVPAELRVSNREEDAQNIEPSMSGKQIVGLIIPPPDIRTIVDKTALFVARNGLEFEMKIKEREASNMRFNFLNPTDPYFAYYRNKVNEFETGVASADTQSKVKLPEAVREHVQRAEFIPRLPPKPFEFCADPLTLNAFDLDLIHLTALFVARNGRQFLTQLMNREVRNFQFDFLKPQHSNFQYFTKLVEQYTKVLIPPKTIVDDLRASVTQHKILEDVRYRVGWDRHQKALKDREDQAVEKERIAYNQIDWHEFVVVQTVDFQPSETLNLPPLCTPKDVGARILLQQRTEAAKAAAESVAMDVESDEEGGAESGDEETAKERAAIEAAEDAAGELHQRLNIGAEKQHTGSTLTQPAPAAPTAGSVIIRDYDPKKSRGGPVSKTAAASTEKYIISPLTNERIPADKLHEHVRYNTVDPQFKEQRDREQMDRQDEDLVMAPGAEISRNIAKLAERRTDIFGIGEKGAEQTIIGKKLGEEERQMPRSDPKTIWDGQLSTIDATTRAAQQSVSLEQQISEIQRQHGYLPNPAAERMVPSMPPPTSTPSQQFGGGQPPTSHSMAPPQRPPPHQSTGGIASNVQKIVPVPQQPPQMSIPPQHQQQQQMRPPQQMPPQFMQPPGGRPHMPPPPHMGMPPHGVMGAMPPHMQPGMPPPGMMRPPHGSFMLPPPPPGASVGDEPPNKRPREETLEPEERWLQKVHGQIAVQIATPQNDEWNLKGNTVQIQLDISSSVTALKSLIQEQIGVPATKQKLVYEGIFMKDSQSLAYYNFMPNASVQLQLKERGGRKK

SEQ ID NO: 1114 - protein, 216 aa, Heterodera glycines
  genomic DNA sequence=SeqID_356; coding sequence=SeqID_884
MTSRILSCNLRRYFSKMNQHIEFGTTKSASSDKQSPPSPTNNQTQHEGMSQECREQIEQMEKLKSDNEMLTDKYKRTLADMENLRKRTQRQIEEAKLFAIQPFCKDLLEVADVLDLALNSLEKMKTEDGAASLDSGVNKGIKMTKEVLLKTFKKHGLVPVQPEGQKFDPNLHEAVYEIPKDQSDRPAGHIAHVLNIGYSLHDRPIRPAKVGVVKME

SEQ ID NO: 1115 - protein, 165 aa, Heterodera glycines
  genomic DNA sequence=SeqID_427; coding sequence=SeqID_885
MQTISKNNKMMAHLNYKMKVIVQDSRVFIGYFKAFDKHMNIILADCEEMRRIKPKQGAKKSNVEEEKRILGLVLLRGDKIISISVEGPPQKEDSGVQLPKAGGLGGPGQGRGAGRGMPMGVVPPMGAVPPGLQGAVRGIGGPGMGGPMQPGYMQGMPQGMPPRPF

SEQ ID NO: 1116 - protein, 100 aa, Heterodera glycines
  genomic DNA sequence=SeqID_469; coding sequence=SeqID_886
NRVAKIDVVPSAASLIIKELREPPRDRKKVKNVKHSGNLTIEQVINIARQMRPRSIARKLQGTVKEILGTAQSVGCTVDGQHPHDIVDMIRAGEIEVPEE

SEQ ID NO: 1117 - protein, 527 aa, Heterodera glycines
  genomic DNA sequence=SeqID_447; coding sequence=SeqID_887
FLRVSVSSKEGQKQWEKPSKSAMKKAISRLEEERRKREKATNSAAAKLTEEAKSVAEQQQEMAREKRLEEAKKMQVKLDESLPEAKRTKIRECPALCGQRVKVFAFVHRMRQQRKNLMFLVLRDGSGFLQCVLNGTLCQTFEALTLTTESSVCVFGQINKLPIGKVAPGGIELTADFWELIHGSPPGGVDNVLNVEANVDVKLDNRHLVVRGENCSAILRIRAAVTRAMREHFHEAKYMEVCPPTLVQTQVEGGSTLFSLNFFGESAFLTQSSQLYLETCIASLGDCYCISQSYRAEKSRTRRHLAEYSHVEAEFPFITFEDLMVRIEEMTCDTVNRVMADPEIRELIQQQWQKDSQYEFVAPKRPFLRMTYAEAIEWLQKNEVMNEEGKPFQFGEDIPEGPERFMTDTIGQPILLNRFPHGIKAFYMSRCADQPELTESVDLLMPGVGEIVGGSMRIWKEDELLGAFQKADIDPKPYYWYVDQRKYGGCPHGGFGLGLERFVCWLANQHHIRDVCLFPRYIGRCAP

SEQ ID NO: 1118 - protein, 112 aa, Heterodera glycines
  genomic DNA sequence=SeqID_452; coding sequence=SeqID_888
MVEVFDSLSKLYADYQRTTAKKLKIIDAYMVYIFLTGVFQFVYCLLVGTFPFNAFLAGFISTVACFVLAGCLRIQVNPENKVEFPNISPERAFADFIFAHVILHLVVVNFIG

SEQ ID NO: 1119 - protein, 450 aa, Heterodera glycines
  genomic DNA sequence=SeqID_400; coding sequence=SeqID_889
GMALNLETDNVGVVVFGNDKVIKEGDVVKRTGSIVDVGVGEALLGRVVDALGNPIDGKGPINVSKRSRVEVKAPGIIPRVGVREPMLTGVKAVDSLVPIGRGQRELIIGDRQTGKTAIAIDTIINQKRFNSSTEEKKKLYCIYVAIGQKRSTVAQIVKRLTDTDAMKYTIIVSATASDAAPLQFLAPYSGAAMGEFFRDNGKHALIIYDDLSKQAVAYRQMSLLLRRPPGREAYPGDVFYLHSRLLERAAKMNETHGGGSMTALPIIETQAGDVSAYIPTNVISITDGQIFLETELFYKGVRPAINVGLSVSRVGSAAQTKSMKQVAGSMKLELAQYREVAAFAQFGSDLDASTQQLLNRGVRLTELLKQGQYVPMAIEEQVAVIYAGVKGHLDKIDPSQITRFEREFLAHIRAHEQELLKVIREEGQLTTATDEKLKNLVTSFLGGFKA

SEQ ID NO: 1120 - protein, 418 aa, Heterodera glycines
  genomic DNA sequence=SeqID_368; coding sequence=SeqID_890
GRMLHIFAGEEKRVRTNGADDDSTNDGCQSAFQRERNEKRKANDAEGATEAATNNRCTWNALFLGTDAVAETLAENYEVEKRDLLLVDGKQQNSAAVRVAMAEARLVRETRKFLLDNGVRLDAFAQRWHLLSNGGDNVDGTEDGTAKMRRSKTTILVKNLDATREGKKEWLHSLFGRFGVVKTVLVPPVHGITAIVEMANARDAKCAFEALAYSKKHTPSGGRPLFLEWAPSNVFDEAHPLRAIGHYGYQQKGQTAVLSDDPSSVGHQSPAETKMEKTDRERGGEEEGKLEEKPKKEEKEDEKHTKILVRNVPFQANLKELTQLFSAFGELNFIRLPKKPGSEGHRGFCFAEFLSVSDAHRAMDALVHSTHLYGRRLVLEWAKPSEESAEEKRQRTQDRMAMAAGVAGAKKRPKMRSF

SEQ ID NO: 1121 - protein, 474 aa, Heterodera glycines
  genomic DNA sequence=SeqID_325; coding sequence=SeqID_891
MVSTTNEQDEEQQNWLMKQDLQKLNPEKLTPLTEEVISRQATINIGTIGHVAHGKSTLVKAISGVHTVKFKNELERNITIKLGYANAKIFRCSNIKCPRPHCYRSAGSSTPDRFPCERPNCGGDFVCVRHVSFVDCPGHDILMATMLNGAAVMDAALLLVAGNEPCPQPQTSEHLAAVEIMKLKHLLILQNKIDLINESQAKDQHDQIKSFVEGTVADSAPIIPISAQLKYNIDVICEYLCKKVPIPPRDFSSDARLIVVRSFDVNKPGSEVEHLKGGVAGGSILKGILRVGQEIEVRPGIVTKSADGSVQCRPIYSRIVSLFAEQNQLQYAVPGGLIGVGTQIDPTICRGDRLVGHVLGAVGTLPDIFTDIEVSYHLLRRLLGVRTEAGKKAAKVSKLAKGEVLMVNIGSLSTGGRVIAVKGDAAKIALTDPICTESNQNIALSRRIEKHWRLIGWGTIRRGTTIAVPQPSIG

SEQ ID NO: 1122 - protein, 259 aa, Heterodera glycines
  genomic DNA sequence=SeqID_304; coding sequence=SeqID_892
PYDEDSENSNIFFLDADFLEDMFGMFYKVAARERIVGWYHSGPRLCKNDILINEVIKRFTPNPVLVIIQASQGRQDLALPTDAYVEVQEVHNDGSPPVKTFEHVPSEIGAEEAEEVGVEHLLRDIKNQTAGTLSQRIANQLTGIRGLENHLAGFTSYLHRVASRELPINHAIIFLIQEMLNLLPEVLSPDFVDAHNVQTNDHLMCVYIGSMVRTIIALHNLIDNKLTLQKVAEKSAKEKTVKETEKNEANDKEIVKNTK

SEQ ID NO: 1123 - protein, 172 aa, Heterodera glycines
  genomic DNA sequence=SeqID_497; coding sequence=SeqID_895
FEKAYAFYRKKNDTAALGVIRKLDGSVPRVMELKAQILYRMEQYQEALELFKKLIRTHSDEFDDIRRANLIAVKARLQSQGDSQELDLANLESFETMYNTSCHMIACQKFDDALRLLEKTAVECERSLNADGLGKEEIQQEMAPILAQKAFTLQKLDQKKEALKLYQNVLKT

SEQ ID NO: 1124 - protein, 419 aa, Heterodera glycines
  genomic DNA sequence=SeqID_362; coding sequence=SeqID_896
KKESAGDSDAIPEGQIKSLAELKMDDIKEMKISQIKTVKGMVDEEVRRTKLRMETLEGDRNEHLAKIGNLLHNSVPISDNEDENRVERTFGDCASRKSYSHVDLVVMCDGFDGERGTNVAGGRGYFLKGPLVFLEQALIALALQMLNKKGFTPLYTPFFMRKDVMQEVAQLSQFDEELYKVTTAKKTDAANEDGSPDEKYLIATSEQPIAAFHRDEWLNPSDLPIKYAGMSTCFRQEVGSHGRDTRGIFRVHQFEKIEQFVICSPFDNESWKHMDEMIGNAEEFCKVLGLPYRIVAIVSAELNNAAAKKLDLEAWFPGSGAFRELVSCSNCTDYQSRRLRIRYGQTKKMDGEVNYVHMLNATMCATTRVICAILENNQTEDGIVVPEPLRPFMPSQYSQRIPFVKPAPIEQEKVQKKKK

SEQ ID NO: 1125 - protein, 262 aa, Heterodera glycines
  genomic DNA sequence=SeqID_311; coding sequence=SeqID_897
MAVGKNKKMGKKGAKKKAVDPFTRKEWYDIKAPAMFTHRNVGKTLVNRTQGTRISSDFLKGRVYEVSLGDLNSTDADFRKFRLICEEVQGKICLTNFHGMTFTRDKLCSIVKKWHTLIEANVAVKTTDGFLLRLFCIGFTKRNANQIKKTSYAKTSQVRMIRAKMVEIMQKEVSSGDLKEVVNKLIPDSIGKDIEKACSFYYPLQDVYIRKVKVLKKPKFELGKLLEMHGEGAGTVATITTATGEKIESRPDAYEPPVQQSV

SEQ ID NO: 1126 - protein, 863 aa, Heterodera glycines
  genomic DNA sequence=SeqID_349; coding sequence=SeqID_898
MSDPVPDKRINKKKLENIERLRRKNETKISKNKSKKLAQLAERKKIKQTRESLFEMLQQYQLDEGNMNLLTSIASSQKEAGNQKHKIEVVKKLRCVSGEKLKNIRATSKQLNHIETDSSSCEEDFSGNGEQQQPGKSIERMPKLTHQIETCLLAGNNARTAQNLPIDKNEQRYEAASKQNKQHAKGQLQCSNALSRIKGRQIIVPRDENIEKKRRQLPINAEEQPIVEAINEYPVVIICGETGSGKTTQIPQFLYEAGYTSNGHLIGVTEPRRIAAISMASRVGHELDNEKLASYQIRHEGNRSEETKILFMTDGVLLKELQTDFTLSRYSVVVIDEAHERSIYSDVLIGLLSRICALRMKRGYPLKLIIMSATLKLQDFLRQRLFSISQPKVVSVQARQFPVTIYFERRTPTNYLEATFKKVCKIHEEYPAGGILAFVTGQREVTHLVKLLENKYTKISASKLLRKEKMKKCRKKETKEEEEEGLLLDNDEFGTSDMDLEDEAWQNTFFGSDDESLNASQSFKKYPPLLAIPLYSLLPVNLQKKIFNEPPDDGSRVCVVSTNVAETSLTIPNVRYVIDSGREKKREYDPITGVSRFVVGWCSKASADQRSGRAGRVQSGYAFRLYSSAVYEDMRDHSTPEILNKPIDQLILMLKAMNFTKIDNFPFPTPPRLDQIKSSELRLSHIGALRVQEGLYTITQLGQSLAQLPLTPSFAKVVISSIRGGLLPFAVTLVSALSVREPLLFISSTKEDGTEERRKRMSEVIKQRFLWCAVGEARLFGDLTVILNTVGAADYEEENAHAIEALGLRPKALKEINKQRHQLTLLLNKSDSGGEVAREVQNGCTLPRTTEEIKAYNGEMPSG

SEQ ID NO: 1127 - protein, 382 aa, Heterodera glycines
  genomic DNA sequence=SeqID_418; coding sequence=SeqID_899
MSLFGSSIGTSSPFGSKPSGGLFGAANTAVVQPSTSTTTQQDIEVPQAPDDTVQAMKFNPLVAGSPIFLAAGSWDNTCRIWQVNENGMVEPKAMQNVGAPILSLDWSEDGSKIFIAGADKQAFAWDLGSNQMAVVGTHNEPVRSCHWIATPQYSCLMTGSWDRTLRFWDMRQLPTQNSLATIQLPERVYCSDMVFPLMVVALADRHIKMYKLDGTPSEIQDVESQLKFQSRCIAIFKDKMTGQPNGFALGSTEGRVAIQCLQPKDPKDNFTFKCHRSAELINNYQEIYPVNDVAFHPTHQTLATAGADGKYSFWDKDARTKLKGSDALPMPITKCAIHSGGNIMAYAIGYDWSKGFEYSTANNVTKIFLHGCDEEMKPKPKK

SEQ ID NO: 1128 - protein, 313 aa, Heterodera glycines
  genomic DNA sequence=SeqID_500; coding sequence=SeqID_900
MEPNKYEKQKGFAAEAQKLEEDIDRFMEALAERGKNVRSSNSEKKFDFEKWCEEIDKHPAFARDLKPTEDGQYSMEMQAIQAMKYDEDNPTECANAYKEEGNRHFEKRNYRWAIDAYTKGIKLRCSDVRLNSVLFANRSAAHRRLGNVRSAFKDCFFARRFDAENLKVLPMGAIRRGAECLLELGEAAKCIAWIETKANEGGTISPKAHVDEQLEKTRKKAEAMRAEEDRDARRERATHSMVRLVDEGTKSARLIWPLLLQYPEKGQTDFVSECAEDIPLAEAFEEVYTRQHLEQNELKASGGEKDIYHFGKG

SEQ ID NO: 1129 - protein, 444 aa, Heterodera glycines
  genomic DNA sequence=SeqID_405; coding sequence=SeqID_901
MATSEAPNYALYEHAVGYTLFKIKEYEDIGQIQPEVQSAMTDAQRFQTIVQVHAFDPFRNTEAALENANNIAEGIIHVDLLNFLEANLPKKKKKVLLGVGDQRLSASLVEALPGIRVAFNGVVQELLRGIRMHFRVLAKDLPHAQLGKAQLSLGHSYSRSKVKFDVHRVDNMVIQSIALLDQLDKDINLFGMRIKEWYAYHFPELIKIVPELYKYVCCATAIMNREKMDEAVETKQEKFKEILEDEQKAAEVIEAARTSMGMEISEMDLHNIELFAKRVASLSEYRQRLHQYIKDRMDSCAPSLSSLIGEQVGARLISHAGSLTNLAKYPASTIQILGAEKALFRALKTKSNTPKYGLLFHSTFIGRAQAKHKGRISRFLANKCSLASRIDCFSDVPVPSFGEALRQQVEERLVYYEKGVIPKKNLDVMHGAVEEATVEVEKVS

SEQ ID NO: 1130 - protein, 169 aa, Heterodera glycines
  genomic DNA sequence=SeqID_435; coding sequence=SeqID_903
MVRHVTASCFRAPWPFEKKGSTGWRKNGPVVIESHKWPGQQKEFPELSPKFLGANFKQLWRYTGVAPTGFNDPKTDDFVHVPEMVPELVVPDLANFELKPYVSYKTDAKIEERLRNFDKKLTKFGGNEKAAIANSKETELWPPPPIDARILFDFFYAEKIRQAFEKGKK

SEQ ID NO: 1131 - protein, 226 aa, Heterodera glycines
  genomic DNA sequence=SeqID_409; coding sequence=SeqID_904
MKPTIDLKQDISKYKERFQKLHHKREESRKINHEHVVEEDRRLKLPNNFEAKRKRQEWELEELVARKEAEERGEDYDRIKALGTQADIADKMEAAKRRKANPDTGFASYEAMSIRQYERMTNGIKPDMESYQKMKGVVGEDQFYASANTLIQGSHYPTDKALDKLSEDVHNQMKKRDQYHRRRMFDPDAPIDFINERNRKFNHKLERYYGKYTADIKEDLERGTAI

SEQ ID NO: 1132 - protein, 181 aa, Heterodera glycines
  genomic DNA sequence=SeqID_466; coding sequence=SeqID_905
MPIKASGETLRKYIVVGRKLPTANDSNPTLHEMVIFASNHVVAKSRFWYFTSMLRRVKKTHGEIISCQEVFEKKPGSVKNFGIWLRYDSRTGHHNMYREYRDVCEAGAVTQCYRDMGARHRAQADRIQIIKVQTISVADCKRAGVKQFQNSKIKFPLPHRVNSKRRNMTPFTTQRPRTHFV

SEQ ID NO: 1133 - protein, 262 aa, Heterodera glycines
  genomic DNA sequence=SeqID_443; coding sequence=SeqID_906
MSNLRLQKRLAASVLKCGKGKIWLDPNEVNEISNANSRQNVRRLVKDGLIIRKPGKVHSRYRARERLEARRKGRHMGFGKRHGTRNARMPEKVIWMRRMRVLRHLLKRYRDAKKIDKHLYHELYLKAKGNAFKNKRNLMEYIFKKKTENQRSKQLAEQAEARRNKNKETRKRREERLVQKRKELLHKISESEKEKTPQPLVTKPAEKEQPKPQPVAARTADKEQPKTQPAAVKTAEKEQPKSKTETVGKRETVGPKKKKGGK

SEQ ID NO: 1134 - protein, 573 aa, Heterodera glycines
  genomic DNA sequence=SeqID_407; coding sequence=SeqID_907
EVPFIVQNNVTKRTYTKGIFLGKGGFARCYELTDNQTKKIYAGKVVSKTLLVKKHQRDKMAQEIQIHQALAHPHVVKMEGFFEDDDNVYILLELCSRRSLMELHKRRKAVTEPEARYFTFQIVEACKYLHGKKIIHRDLKLGNLFLNSEMQLKIGDFGLATVVDYDGERKKTLCGTPNYIAPEMLDKKGHSYEVDIWAIGCILYTLLVGKPPFETETLKDTYNRIKANQYTIPPKIGKDAASLITRLLAPDPARRPRVTEILNFQFFTDGFLPKVLPSSCLTMAPKFNMHRTNIFSLLVGPCPQSSCRQRPRFHWTCAASLRPRDESASAGGGGKAGRGIGENNDVPADFYLSDLYAQLCSLLNTNPERFSEADKVSDEIEDPRAQPFFWVSRWVDYSDKYGLGYQLCDNSVGVLFNDNTKVILDAAGNQLQYTERNNTEHFYGANKYPQALEKKITLLKFFRSYMNEHLMKAGANIKMRDGDELARLPCLNTWFRTKSAIVLHLSNGTLQINFFQDHSKLIVCPLMSAATYIDQQKNVFTCKFQYLEKYGCPKDLCQRLKYTKVIRLMKTIE

SEQ ID NO: 1135 - protein, 419 aa, Heterodera glycines
  genomic DNA sequence=SeqID_314; coding sequence=SeqID_908
ETLKATLDLDEIFGNENEGGKSAGSSSSSTSSSRSSSPDLTKSRSPSPEVKQEIKTRDEIIRCQLFRRKLAKFVHAPFFAKTVVGCFVRISIGPNKSDGKQVYRAAQVVEVVETAKVYEVEPNSDIRTNKGFRLKVSDGEPMRVYRLEFVSNSLIMESEFLFWFNKMRSSNTPMLTVDFVDRKRKEIVDALNYKYNEAEINLLIKEKQRFKRQPTNFAFQKSELLRMKEQAEQSGDVARVRDLQQQVNELEEKAKKIEHQRTKNLSAISAINQRNRDHMKQTFLGAGMVREEQEKDDDPFTRKSARMKVVSGSVKSKTAGEGSGANAELSVMDTMVSSLGSLSSSSESSPNKKVQLPSTHDLFNAHGIDINIDIKMPAVVGGSLRAPPITDSQAPRTQQKTSSSRTLTLEEYKKKRGLV

SEQ ID NO: 1136 - protein, 120 aa, Heterodera glycines
  genomic DNA sequence=SeqID_492; coding sequence=SeqID_909
VDLVFTNWLLMYLADQEAVQFVANALQWLRPDGYLHLRESCSEPSTKKSADHSTTTTTTSTSSSSSSSLHNNSKPNPTRYRFSSAYIQLLRSLRHTDVQSGTQWRFDVQWACSVGVYIEV

SEQ ID NO: 1137 - protein, 289 aa, Heterodera glycines
  genomic DNA sequence=SeqID_482; coding sequence=SeqID_910
EKKAQSMLAEAEKKLQKSSGVLSFLFSGSSTPSDAAELFIKAANHFKLAKNWNGAAGAFLKAAQLYDRDAKHDAAINFGEAGNCFRKVDLQKAVECYQKGADIYLDMGRFNMAAKMHTTMAELYESTLGDKDKCIEQYQKAADMYKGEEQRSSAAKCLLKVAHYAAELDQYQKAQLTFEEVAIYEADNPMLKYAAKTHFFQALLCSLCIDLLDSQRALKRYEELSNYFADARECQLGKQIIEAMENGDPDGFTEAVQQFDKISRLDQWHVAMLVKVRKNEAGEEEDDLR

SEQ ID NO: 1138 - protein, 678 aa, Heterodera glycines
  genomic DNA sequence=SeqID_382; coding sequence=SeqID_911
MEKVQFGKELMEECPEIAAKVQERDKLKYQLNILKRANAVPTEGHQTEKKLATDGNKVANNRTVPNGPSGSAHLQIEDFGDSIIERLSDVFAKAVQNAYPTLGMDPSIIRVKEANNPKFGDYQFEMVMQISRRLLSEQSVKEPPPVVAKKIVAALEQIELVEKYQLVNAYINVYISRKHLGKRIAEISRKGFSLPKIAKKHVIVDYSSPNIAKQMHVGHLRSTIIGEAIARLLECFGFTVLRLNHIGDWGTQFGMLIAHLKKCFPNYLNETPPIQDLQEFYKQSKVKFDNDPQFKSEAYQCVVALQNFEPDTVKAWKMICDVSRKDFATIYERLGITDLVERGESFYQSRMQSLIQELKQTQLLVEDDGRKLFFPHECNIPLTVVKSDGGFTYDTSDLATLKQRLSEERADWILYVVDRGQSEHLENVFATGKQLKWFDAAQKRVEHVQFGLVLGEDRKKFKTRSGENVKLTELLDEGVRRAEEKLRTKGKEGEFTPQEFREVAESVAYGCIRYADMAQSRTGDYVFSFDRMLDDRGNTAVYLLYAYARIRSIARNAQVTRDAINSFINGLPSDDGVFLDHPREVKLAKQILKFSDVLLSVLESLQLNKICDYVYELATVFHDFYGECYVVSKLPTEGESGQAVTTKVNFNRLVLCEVTADIMQRCFNVLGIRALERM

SEQ ID NO: 1139 - protein, 234 aa, Heterodera glycines
  genomic DNA sequence=SeqID_437; coding sequence=SeqID_912
MDTTMEQPAEDVEDVQLDLGKKKKKKKAKTTELKLSEDEHEEEKEVTALAEGVGRTNLLDAKNPDAWTDYNYDEMLDMVFNIMREKNPEISGKKKTFVMKPPEVQRAGSKKTAFTNFTEICRLLKRDPKHVLQFLMAELGTTGSIDGNQCLIVKGKFQQKHFENVLRGYINEYVRCHTCRSSDTELTKDVSRLFFIQCKRCGSRFAVSSIKSGYTAMVGKRAALRRAAEATAGK

SEQ ID NO: 1140 - protein, 312 aa, Heterodera glycines
  genomic DNA sequence=SeqID_371; coding sequence=SeqID_913
MSQADAGRIIHIGKRRERAKEDIESQRQRLEEERRNLAASIKAKFTTNIDEQEEKFKERTVGLVTLDEVKERQNEIFYSGPSLKFSNEDRPKFEKAIQKRVLSFGAFDDDDDEEDEALIPITKKRHGMDPTVDTSFLPDRERDEQLQRERERIAKEWQEMQEREKNEEITVAFCYWDGSSHRKDSKTKKGTTIAQFLQKALDTFRKEFLELKLATVDNLMFVKEDLIIPHFYTFQDFIKTRQMGKTGPLWQFEAVGEIRVRQDAALDIGESHPVKVILRSWYEKNKHIYPASRWEPFVPGKVYKRTIDDLST

SEQ ID NO: 1141 - protein, 736 aa, Heterodera glycines
  genomic DNA sequence=SeqID_419; coding sequence=SeqID_914
MPLRLDVKRRLLARSDRVKSVDLHLNEPWMLISLYNGFVHIWNYDSQQLIKSFEVCDLPVRAAKFIVRKNWIATGSDDMQLRIFNYNTLERVHQMEAHSDYLRSLAVHPTQPFLLTSSDDMLIKLWDWEDKWKLKQTFEGHTHYVMQLVINPKDNNTFATASLDKTIKVWQFGSSVPNFTLEGHEKGVNCVDYYHGGEKPYLISGADDRLIKIWDYQNKTCVVTLDGHSHNVSAVCFHPELPIIITGSEDSTVRIWHVNTNRLETTLNYGLERVWCVMAQRGSNTLAIGYDEGSVVIALGREEPAVSMDPSGKVIWARHSEIQLANLKTIEEQTLENIQDGERLSLAIKDMGSTEIYPQKVQHSPNGRFVVVCGDGEYIIYTATALRNKSFGSSFDFAWANDANFYAVQENSQLIKLFKNFTELLQIRPDVMVEGIGGGHLLAARSAGSLLFYDWSTGHLIRRIEIASKKVYWSENGEMVAICGDQSLYILKYNSEAVTNANVADIGPDGIEDAFEVIGELGESVKTGFWIGHCFIFTTTLNRLSYYVGGELVTIAHTDRPLYLLGYLSKENRVFACDKDHNIVSFKLLLSVLEYQTAVMCKDFDTADQILKIIPENLHTRVAQFLEKQGFKKQALAISKDPQHRFELALSLGDLPAAYEMAKQADSEEKWKQLAHAATIKSELRLAGECLAKANDFGGLLLLASCAGSNRLVNYLRVFMRFFISQSFTSSFLLPV

SEQ ID NO: 1142 - protein, 450 aa, Heterodera glycines
  genomic DNA sequence=SeqID_348; coding sequence=SeqID_915
MKFPLAFFSLCLFAFAEVAADRVLLLIDNPTIRESHSVFIKSLEERGHSVIIAMADDPNLSLIKFGKFLYDHLIIFAPSVDDFGGNINVDEITKFIDGGGNVLVAADKNLGDAIRDLAAEVGFEFGEDQSMVIDHHNYDTVLDDGSHTTIAVPNAQLIKAPLITGESALLAPVLYRGIALVADELGPLQMILMTASSTAYSHNPNKTVEERPSAVGKSTILLGALQARNNARVILSGSLDFFSNKFFTATVNQAGGHTANVKSGNQQLAASVLKWLLKESGVLRIKSVKHHTVGQKSPPAEYTIMDYVRYEIGIEELQNGKWVPFQGKDVQLEFVRIDPFVRVTLKNNNGKFSAEFKIPDVYGVYKFLVDYHRIGYTHLTDVQQVSVRPLKHTQYERFSRCAYPYYVSAFSMMVGVVLFSFVFLYFKESPPQSSSSAAPSAKGLQKAKAS

SEQ ID NO: 1143 - protein, 507 aa, Heterodera glycines
  genomic DNA sequence=SeqID_316; coding sequence=SeqID_917
MRIILPSRAHLFVRDGFRPIHPLRSFSRTATQNSSNTTDVDLVVIGSGPGGYVAAIKAAQLGMRTVCVEKNDTLGGTCLNVGCIPSKAMLNNSHFYHMAKHGDLNARGVEVSPTLNLDTMMKAKLASVKGLTSGIAALFKANKVTHLSGVGTISGPNKVRTKSGSSDVMEVNTKNILIASGSEVTPFPGIDIDEEQIVSSTGALALKKVPQKMVVIGAGVIGLELGSVWQRLGAEVTAVEFMSAIGGVGIDGEVSKQFQRSLTKQGIKFLMNTKVLGAQRTSDGQVKVQVETVKDGKKQELNCDVLLVSIGRRPYTDGLGLNNVQLNTDEKGRVPVNERFQTAVPSIYAIGDVIQGPMLAHKAEDEGILAVEGIAGGPVHIDYNCVPSVVYTHPEVAWVGRAEEQIKQEGVNYKVGKFPFVANSRAKTNNDVEGFVKVIGDKDTDRLLGVHIMGPNAGEMIAEATLALEYGASCEDIARVCHPHPTLSEAFREANLAAYCGKAINSI

SEQ ID NO: 1144 - protein, 199 aa, Heterodera glycines
  genomic DNA sequence=SeqID_478; coding sequence=SeqID_918
NMLIAKNGHIKLADFGTCVKMNTDGLVRCSSAVGTPDYISPEVLRSQGGEGVYGREVDWWSVGIFLYEMLVGETPFYSDSLVNTYSKIMDHDRQLQFPADVRISAHAKDIIRKFLSEPNERLGKSGIDPIKKHPFFGNSNWTFDTIQHATPPFVPELKSDDDTSHFEDVEQAEAVNPDNFQIPKAFTGNQLPFIGFTYS

SEQ ID NO: 1145 - protein, 216 aa, Heterodera glycines
  genomic DNA sequence=SeqID_341; coding sequence=SeqID_919
MSAQRTRPGNGGAPTKTCQFKLVLLGESAVGKSSLVLRFVKGQFHEYQESTIGAAFLTQTICLDDATVKFEIWDTAGQERYHSLAPMYYRGAQAAIVVYDITNQESFAKARNWVRELQRQASPNIVIALAGNKADLAAKRMVEYEEAQAYAEDNGLLFMETSAKSSMNVNDIFLAIAKKLPKTEGGGGPSGHGRSGVDISAAEAAAQQRRGTCCSK

SEQ ID NO: 1146 - protein, 361 aa, Heterodera glycines
  misc_feature (3)..(3): Xaa can be any naturally occurring amino acid
  genomic DNA sequence=SeqID_399; coding sequence=SeqID_921
MSXIGNFEIRNVSKVERIGAHSHITGLGLKANFEPIFISDGMVGQCAARKAAGLIVRMIKDGQIAGRALLIVGEPGTGKTAVAMGISKSIGGDTPFISISASEVFSMDLSKPEALTQSFRKAIGVRIKEETEVLCGEVVQLEIDRPQSGAGPRVGKLTLKTTDMEAIYDIGNKMTESVIKERITAGDVIQIDKATGKISKIGRSLARSKDFDALGPQDKLVACPSGEIQSRVETVNTISLHDIDVINSRSSGYLAVFSGDTGEIKSEVREQIDKKVMEWREENKAQIIPGVLFVDEVHMFDLECFSFINRYIESDLSPILVMATNRGIVNIRGTSVESPHGVPLDLLDRSLIIRTSSYKEN

SEQ ID NO: 1147 - protein, 214 aa, Heterodera glycines
  genomic DNA sequence=SeqID_489; coding sequence=SeqID_922
MGRRPARCYRYIKNKPYPKSRFCRGVPDPKIRIFDLGRKRATVDEFPCCVHMISNEREHLSSEALEAARICANKYMVKNCGKDGFHMRVRIHPFHVIRINKMLSCAGADRLQTGMRGAFGKPQGLVARVGIGDMLMSVRVRDQHQAHALEAFRRAKFKFPGRQYIVISRKWGFTPFDREVYEKHRKEGRVIPDGVNCRFLKQHGPLTEWLKNPI

SEQ ID NO: 1148 - protein, 395 aa, Heterodera glycines
  genomic DNA sequence=SeqID_317; coding sequence=SeqID_923
MRSPSPTDNDKARSLNAYRRKLAEYKEIENRLKELRTKERESHKLFDKSENEIKSLQSVGQIVGEVLKQLTEEKFIVKATNGPRYVVGCRRTIDKEKLKQGTRVALDMTTLTIMRQLPREVDPLVYKMSHEDPGNVSYAEIGGLSEQIRELREVVELPLINPELFKRVGITPPKGCLLYGPPGTGKTLLARAVASQLNCNFLKVVSSAIVDKYIGESARMIREMFNYARDNQPCIVFMDEIDAIGGRRFSEGTSADREIQRTLMELLNQMDGFDSLGKVKIIMATNRPDTLDPALLRPGRLDRKIEIGLPNGQSRLEVLKIHATKVLKKEEIDYEAVVKLSEGFSGADLRNVCTEAGLNAIRKERDGVVQEDFMKAVRKVADAKKLETSLDYKPV

SEQ ID NO: 1149 - protein, 341 aa, Heterodera glycines
  genomic DNA sequence=SeqID_332; coding sequence=SeqID_924
MGKGFQNFMSKKDFHPSAWWNLKRKWEAEQKNDLEKRRQDELRVQYEKEQEILNNKALLGDEKARLGLSFMYDAPAGINKKKEEGPEPKFEWQRKYNAPREEWAKGNELIQDQPFGIQVRNVRCVKCRAWGHLNTDRECPLYGMSGNAEDHGYANNPSDIIRDLNVEKKTKTVSDVTTNEQIDIKPKIEVRKSYEEKKKKRHHYSSEEEEEGTEEKKPEPIDQEQLLVNMREEHNLKFKTGILIGLRADEHIKKMSAMVGGGEEKTFEAFLKGLDEKKRRKLMKKIMKTEVSDDSDIEKDKKQRRKQKKEEKRKADKKHKHRRSSSRETSRKRKEGKHHRH

SEQ ID NO: 1150 - protein, 1021 aa, Heterodera glycines
  genomic DNA sequence=SeqID_379; coding sequence=SeqID_926
MLITTYVFKISVSEEENEEEQVEEEDDFDENELALNKPKTKKKRRVRVATARDFIQDDVEVDDDDEDEDDYDAGADGDDLFGVDPNERAEAERFLREQEKMKEKRRNKYAFRDMTEEEMERYFQERHAAQVATHQGDMDEDAYDDITQNGLLPSTKDPNLWIVKCRLGEEKTTCLRLMRKYLTFVNTDEPLQIKSVIVKEGLKGMIYIEAFKMAHVAKAIEGISALNQFKITMVPIKEMSDTLRVVKNIPTLKPGAYVRLSKTLYKDDLAQVDWVDISQNRVNLKLIPRIDYTRLRGALRSQDDRIMKKKRRPLPAPFDLDRIKSIGGEVTNDGDFYIFEGGHYRRGFLYKSFPMNAIEVDITHPTLTELERFQDSTDDLKKELENTHLREKRHSFAPGDNVEVMDGELVNLRGKIQSIDGQKVVILPEHEDLNEPLTLNASELRKYFKPGDHVRVIAGRYEGDTGLIVRVEDNVVIMLSDLTMGEMKILPKDVQLCAEVATGVERMGQYQYQDLVMLDKETVGVIVRLERENVEVLSMHGKILRVNPQTIECKKNSRFVKALDSQKNTIQAGDTVKVVEGFLARKKETEEERQGEIKHLFRNWAFVFSRKYPQNGGMFVCKARNLALIGGSKASESQINTTILDNSQLMSPRPNPLESPRTIHGGMTPHSGSSVVGAQSVRGDHGFKAPSVVGSIATSATGVGRQHVRRNMEIMGKTVRVLAGPMKGYIGIVKDATESTVKVELHTMPKTVNFDINKVMEVGGAVPRELMDTAGAMTPGTATIGGRTPMYGGAQTPMYGGAATPMHDSFGARTPHYGSMTPAYDGSRTPSHQPSSSWDPALANTPAHSTAHFDNEFDTMGFGGGASTPAGSVRSRLGGANTPMGQMTPRDMFGDYSSSPYPNPSTNADSEIPTGSWCMVDLCVNVLPTCGKDQLLGLEGSIRSIREGECCLYFEELDDDFTIEHEHVVPIRPASGDQAKVIYGHDRGVSGSLITTEGEDGVLQGPNGAKLYSMSVLCKLV

SEQ ID NO: 1151 - protein, 556 aa, Heterodera glycines
  genomic DNA sequence=SeqID_417; coding sequence=SeqID_927
MDDLTTTELKWRPAERANDDSLPLKPLTDIERQMNEIRTELFMARQEEEAIISRIKDEFRQTQKRLFDQSVARINAEFERVGSNARQLANSLDSVSALAQNISCRVVALDLGKSRVVECLQRVNDLKDLGTCAFGVQEALRAEKYEEAAQHIHRFLTLDTAVFKMGDHRESKDAGYSVKNSYEILRNATSELKRIIEQRFDEAQSSGDVASMERFFKLFPLINEHNSGLQRFGTHLCGQIEALGDQNFRIMQAGGTDDKRKNVLYADTLTMLFEGVARIIELHQPIIENFYGPEKLLLLIELIQPECDKQCVRVLNTFIQRRHFEEKAQQQNSNATIDAIELDLLLSEVTLMHTRAELFWRFLRRRLEKGATERHMDESTDGFDEDEQQRRDHIEKLRKQREEHAIKLDAVLNRSGLSTKMQELMGKFVLVEQFYMTQSVRKAIDMDSIEEGALTSTLLDDVFFIVRKSIRRSISSSSVDCVCAMLNNGATLLETDFLKYISAPIKSGYPSTGWSAESAYQTAQNVMQGKGEVVGGLEKQRSAFITALNNLRSSID

SEQ ID NO: 1152 - protein, 286 aa, Heterodera glycines
  genomic DNA sequence=SeqID_451; coding sequence=SeqID_928
MDEEQLLDYEEEQEETQEQQSKNDAATNGDATKKIKGNYASIHSSGFRDLMLRPELLRAIIDCGFEHPSEVQHECIPQAILGMDIVCQAKSGMGKTAVFVLATLQQLTPTDGTVSVLVMCHTRELAFQISKEYERFSKYMPGVKVSVFFGGMPIKKDEEVLAKNTPHIVVGTPGRLLALGRTGHLKLKGVKFFVLDECDKMIGDADMRHDVQEIFKMTPQEKQVMMFSATLPRELRVVCKKFMQEVSSSVPSLLRLASSNRRCSDRPCFCINSSQQLPVRCLFNEP

SEQ ID NO: 1153 - protein, 284 aa, Heterodera glycines
  genomic DNA sequence=SeqID_468; coding sequence=SeqID_929
MANRTARDAHTIKGTNPQYLIEKIIRTRIYDSLYWKEQCFGLSAETVVDRATELRYIGGIYAGNIKPAQFLCLTLKLLQLQPDKDIIIEFIRQDDFKYVRALGAMYIRLVFNSVEVFKYLEPLYNDYRKLRYMNRMGKFELLYMDEFVDNLLREDHYCDIQLPRLQKRQALEEKDQLELYASALDEDLERLSTDSEDEQETRKARPNIVSRRRSRSRSRGRSRSKSRERRRRSLSTDGIKSTLRTNCQLDLDRRGGRSAAKDTEREIEENNALRKKLGLAPLER

SEQ ID NO: 1154 - protein, 514 aa, Heterodera glycines
  genomic DNA sequence=SeqID_378; coding sequence=SeqID_930
MRRDKKDDESAAGNPYDHLDKATVVQETRAFNETPVNARKCRPILCKLLYLLQHGETIGKTEATDTFFAITKLWQAKDMTLRMLVYLSIKELCQMSSDVIIVTSSLTKDMTGREDVYRAPAIRALCRILNDTGMLQAIERYMKQAIVDKTASVSSAALVSSLHLMRKSPEVVRRWANEVQEAVSAENHMVQFHALSLLVQIRANDRLAILKMVQKFSKSGLRSPLALCQLVRVAARLIAAEAEEHALGVDGGGSAESRSAFTFIESCLRNKHEMVVYEAASAIVRLPRISSGELASAVSVLQLFLSSPKPTLRFAAVRTLNRISMDYPQAVISCNVDLEQLITDSNRSIATLAITTLLKTGAEASVERLMKQIGTFVSEISDEFKIVVIEAIRSLCHRYPRKHATLMNFLASMLRDEGGFDYKKAIVDTIITIVEDNPSAKDLGLSHLCEFIEDCEHAALATRVLHLLGREGPTTANPSRYIRFIYNRVILESTQVRAAAVTALAKFGAECGAA

SEQ ID NO: 1155 - protein, 213 aa, Heterodera glycines
  genomic DNA sequence=SeqID_306; coding sequence=SeqID_931
MTSRDDEYDYLFKVVLIGDSGVGKSNLLSRFTRNEFNLESKSTIGVEFATRSIQVDGKTVKAQIWDTAGQERYRAITSAYYRGAVGALLVYDIAKHLTYENVERWLKELRDHSDQNIVIMLVGNKSDLRHLRAVPTDEAKAYAERNQLSFIETSALDATNVEAAFTNILAEIYRAVSTRQVPPDRMVPISSQNNITLSSTTANKEKKACCSST

SEQ ID NO: 1156 - protein, 188 aa, Heterodera glycines
  genomic DNA sequence=SeqID_453; coding sequence=SeqID_933
MKLIESSDIVKFPDNVTFALNNRVVTVKGPRGTLKRDFRHLNIEIMRENPKLLRVRKWFGIRKELAAIRTVCSHIENMIKGVTVGFRYKMRSVYAHFPINITLQENNTVVEIRNFLGEKFVRRVGLPQGVSAVMSTKQKDELIIDGTDIQKVSQAAARIQQSTTVKNKDIRKFLDGIYVSEKVAIADE

SEQ ID NO: 1157 - protein, 907 aa, Heterodera glycines
  genomic DNA sequence=SeqID_433; coding sequence=SeqID_934
FESDFLIASSVGSEEDFVAALGPSLDECSVLGIISRADALRYMTAKVRIEQTVRRKTFGGASATVRTSQEHDVLDFLANSMICHIQSSGGNMKMKAVFLGLMIRRLIEAEKGVCEADDRDFYGNKRIELAGSLLSLLFEDLFKRFNSELKRIADSHLNRNMAAPLDIVRHMRQDLITNGLVNALATGNWTIRRFKMERHGVTQVLSRLSYISVLGMMTRINSTFEKTRKVSGPRSLQSSQWGMICPADTPEGESCGLVKNLSLLSHITTDSDEAPILQLLYNFGVQDVRPLKFSVVHERRYHIVFLNGSIVGITDDVEKIIGTVRLMRRRGHLGAFVSVSFNTSTNALYLASDGGRLCRPYVIVENGRPCLTQSQIQEVRDGQKTFDHLLAEGCIEFLDVNELNSTRIAVYEHQILPQTTHLEIEPFSLLGVVSGLIPYPHHNQSPRNTYQCAMGKQAMGTIGYNQQKRIDSLMYLLVYPQKPLVKTKTIELSNFEKLPAGQNAIVAVMSFSGYDIEDALVLNKASLDRGFGRCLVYRFAKGTARKYANQTYDKIMGPSLDATTRKPIAKHAVLDQDGIVFVGAKIMPRHVLINKSMPIMQSEMLPAGNVAGFNHNFETKDVSIPYRGSMNAVAERVLLTCNDEEQYLAKVLIAQCRRPELGDKFSSRHGQKGVCGLISPQEDMPFDHNGTVPDLIMNPHGYPSRMTVGKLMELLSGKNALMGPCQKWRLHYGTAFGGDQVETVSKQLAAHGYNFLGKDMLTSGSTGQQMAAYVYFGPIYYQKLKHMVMDKMHARAKGPRAVLTRQPTEGRARDGGLRLGEMERDCLIAYGASMLLMERLMISSDQFSMDVCAECGLIGYLGWCQNCKSSAAMAKIKIPYACKLLFQELQGMNIVPRLKTAKYTDGL

SEQ ID NO: 1158 - protein, 346 aa, Heterodera glycines
  genomic DNA sequence=SeqID_372; coding sequence=SeqID_935
MTDADKINLDNIISRLLEGCFSNLVTKYFLNLVRGSKPGKNVQLTENEIKGLCMKSREIFLSQPVLLELEAPLKICGDVHGQYYDLLRLFEYGGFPPESNYLFLGDYVDRGKQSLETICLLLAYKIKYPENFFLLRGNHECASINRIYGFYDECLRRYNIKLWKTFTDCFNCLPVAAIIDEKIFCCHGGLSPDLQSMEQIRRLMRPTDVPDQGLLCDLLWSDPDKDVTGWGENDRGVSFTFGPEVVSKFLHKHDLDLICRAHQVVEDGYEFFAKRQLVTLFSAPNYCGEFDNAGSMMTVDETLMCSFQILKPSDKKGKFSYTGAGQNRPVTPPRATPAEQNKKAKK

SEQ ID NO: 1159 - protein, 560 aa, Heterodera glycines
  genomic DNA sequence=SeqID_401; coding sequence=SeqID_936
PGPDGLKGMDGLPGFPGSKGETGAPGRDGLPGMPGEKGDAGFPGAPGQDGLPGIPGPKGISGFPGTPGAPGQSVGGVKGEPGFPGIPGRDGTPGPMGPKGESGFPGLPGIPGQKGEDGMPGFPGQKGEPGIPGIPGKRGEDGLPGPAGFPGPVGMPGEKGDTCVPGAPGLPGLPGFPGPKGEVGLPGFPGQKGEPGFSGQSGLPGLPGAKGDSGLPGLPGLQGMPGPVGPPGPEGLPGAEPLRQGGQKGLPGPPGVPGLRGEKGQPGLDGLPGPSGIPGTTGQKGESGYPGQPGFPGEKGIQGLPGLPGLEGMPGSSGPPGLPGLPGPAGPSFRDGFIIVTHSQTAQVPQCPQDTTKLWDGYSLLYLEGNEKAHNQDLGHAGSCLARFSTMPFLFCDFNDVCNYASRNDKSYWLATGEALPMMPVNEQQIEPYISRCAVCEAPSNVMAVHSQSIQIPSCPAGWSSLWIGYSFAMHTGAGAEGGGQSLSSPGSCLEDFRTTPFIECNGARGSCHFFANKFSFWLTTIEDQQQFTIPQSQTLKAGNQRSRISRCQVCTKTTR

SEQ ID NO: 1160 - protein, 391 aa, Heterodera glycines
  genomic DNA sequence=SeqID_406; coding sequence=SeqID_937
FKESIVDVYGLVARTPQPVTACTQSDVEIKVHKFFIVSQAEPRLPLQLEDAVRPDNDQEELAVVKLDTRLDNRVLDLRTQTSQAIFRLQGGVCDAFRKILSSRGFMEIHTPKIISAASEGGANVFEVSYFKGHAFLAQSPQLYKQMAIAGDFGRVFTIGSVFRAEDSNTHRHLTEFIGLDLEMAFNFHYHEVLQTIAEMFIDLFKYLQCNYIAEIEAVRRQYPAEPFLFTQSPLVLQYPEAVAMLKKAGVEQGDEEDLSTPNEKLLGRLVREKYQTDFYVLDKYPLAVRPFYTMPDPNDTKYSNSYDMFMRGEEIISGAQRVHDSAMLTERAKLHGIDIEKIQSYIDAFRFGCPPHAGGGIGLERVTMLFLGLPNVRLASLFPRDPKRITP

SEQ ID NO: 1161 - protein, 180 aa, Heterodera glycines
  genomic DNA sequence=SeqID_392; coding sequence=SeqID_938
MGQLFSYFKSLFGHREMRILILGLDGAGKTTILYRLQVGEVVTTIPTIGFNVEQVTYKNLKFQVWDLGGQTSIRPYWRCYYSNTDAIIYVVDSADRDRVGISKQELVSMLEEEELKNAILMVLANKQDIHGCLSLAEVHKALGLEAIRNRTFQIFKTSATKGDGLDEAMEFLAASLQSAK

SEQ ID NO: 1162 - protein, 169 aa, Heterodera glycines
  genomic DNA sequence=SeqID_375; coding sequence=SeqID_939
MAGIAAGRLTEERKAWRKDHPFGFIARQCKKEDGTLDLYNWICAIPGPKSTIWEGGLYKLRMIFKDDFPSTPPKCRFEPPLFHPNVYPSGTVCLSLLDENKDWKPSITVKQLLLGIQELLVSPNPEDPAQAEAYQIYVQNRPEYERRVRKQAQQFSEDQVLKQLLTDDS

SEQ ID NO: 1163 - protein, 114 aa, Heterodera glycines
  genomic DNA sequence=SeqID_391; coding sequence=SeqID_940
MVGYPNVGKSMTINRLLGTKKTAVSSTPGKTKHFQTLIIDEGLVLCDCPGLVMPQFGISDADMILNGILPIAHMRDYFGPIQLLCERVPRQYFQQRYSVLLPKSIGSLNGHDLL

SEQ ID NO: 1164 - protein, 433 aa, Heterodera glycines
  genomic DNA sequence=SeqID_363; coding sequence=SeqID_941
MAKNNININRGVQDPFYRYKMPRILAKVEGKGNGIKTVIANMPEIAKALSRPPTYPTKYFGCELGAQTNFDLKNERYIVNGEHDANKLQDILDGFIRKFVLCPSCDNPETVLTVKRQVINGKCKACGHAFIVDPKQKLSTFILKNPPPPDNIESEKEVKSDGGLPAEESNDVPVVDNSGGCDAGSNGEDDEDWAPEPVEDEEKLSGQIGKLVIDKDLDKSVDERLDLLHQFFLKAVKNNTIQDSKMMLNEAERLELKSKAPLLLADVLFDTNVITQIKQHRNLLLRFCLKDEKAQRILLGGIEQLVQNNKDILMSKTAHIIKALYDNDICEEDVILAWGSKPSKKFADKEVVKEMIKVAQPVLKWLKEAEEGSDESEDDDLDVAFDDRSRNIGMTVEVEKGAKDGVTRVQNGQIATNGKMDDGNADDIDIDNI

SEQ ID NO: 1165 - protein, 201 aa, Heterodera glycines
  genomic DNA sequence=SeqID_495; coding sequence=SeqID_942
MTTPSRRRLMRDFKKLQDDPPAGVCGAPTEESIMRWEAVIFGPQDTPFEDGTFKLTLEFTEEYPNKPPTVKFVSKMFHPNVYADGSICLDILQNQWSPTYDVAAILTSIQSLLDEPNPNSPANSLAAQLYQENRREYEKRVQAIVEQSWMSFSDGNSEERNAAGTSNVVDTGRGTNPTNENAPVENESSSETPNDGSNMDE

SEQ ID NO: 1166 - protein, 184 aa, Heterodera glycines
  genomic DNA sequence=SeqID_411; coding sequence=SeqID_943
MVRTLKFHEKKLLKKVDFINWPAELDNSLHENKIMRRYHVEKREHYTLYNKLSREIREMAKRIRELDDKNPNKLVLARMLLGKLFDMGVIPTADTLERCDKVTASSFCRRRLPVVCHKMQMAPTVRKSSQLVEQGHVRVGVEMVTDPAFLVTRNQSDHITWTRESKVRRHLSTYNNELDDFEGC

SEQ ID NO: 1167 - protein, 300 aa, Heterodera glycines
  genomic DNA sequence=SeqID_446; coding sequence=SeqID_944
EEFTDHMTRIVSNVKDSKLGKDAIQQLKVATETAERVAQQVGEMQAYKQVSYMAKEIDRLADVRMYKRPGLLIFKCQRDATGIELHKESRWYAGWKTFTESNSYYNKIIDWKTRIDESENIFVRTVRGTFERVQLAFESKDNVSEVLTQISKIDPEFDKSEWLRFCEKEMIPNILESTYQMNFEILRDWCYEKAFNLIANSIKEYEKIGFNTRDSRIIDVSKVELVTGNMTDQGPTLVIQFQVFMTNVVKNSEGKIVQGDPEKAVRVRHIWVICRDMEEFNPATAWKLLELHMIKEDLFV

SEQ ID NO: 1168 - protein, 464 aa, Heterodera glycines
  genomic DNA sequence=SeqID_458; coding sequence=SeqID_945
KINDQESICGEIVAQESGENTANQQNQTQQNTTFEELGVNDELCNACESLGWTKPMPIQQKVIPLALKGRDIIGLAETGSGKTGAFALPILQALMDSPQHLFALILAPTRELAFQISEQFEALGATIGLNVCTIVGGIDMTSQTLSLAKRPHIIVATPGRLVDHLENTKGFDLRTVKFLVLDEADRILNMDFEVELDKILKVLPKARKTYLFSATMTQKVSKLERAHLKKPERIELSTKYQTVSTLIQNMLFIPFKYKEAYLVYLLNEKAGNTAIVFVSTCASAVKLSLLLRHLGFGAISLHGQMSQPKRLGALHKFKKKDRPILVCTDVASRGLDIPNVDMVINYDVPQSSKDYVHRVGRTARAGKSGIALTIVTQYDVEVYQKVENSIGKRLDVFEITHEDVERVSEAGRIAANVRVFKFKYSSYLSLFSGIKKCLKEKGIKEELGTKETNWNQRESIKKRQ

SEQ ID NO: 1169 - protein, 301 aa, Heterodera glycines
  genomic DNA sequence=SeqID_438; coding sequence=SeqID_946
MGFVKVVKNRAYFKRFQPKFKRRRQGKTDYYARKRLTVQDKNKYNTPKYRLIVRFTNKDIIAQIAFSRIVGDMVVCSAYGHELPKYGIKVGLTNYAAAYATGLLLARRHLNKLKLDSVYKGKENVDGEDFDVEQEGDNPNPFTCVLDTGLARTTTGAKLFGVMKGVADGGIHVPHSETRFFGYDPEEKKYSAEAHRDRIFGKHVADYMAHLKEEDEEAYKRQFSQFIKNGIESGTLEEMYKKAHEAIRADPSFTKKEPKKPKEQKHWNKKKYTLTERKHRVANRKAYLLHLKNQQEAALEG

SEQ ID NO: 1170 - protein, 436 aa, Heterodera glycines
  genomic DNA sequence=SeqID_397; coding sequence=SeqID_947
MGKKTKIGKQRKDKFYFLAKEAGFRSRAAFKLLQLNKRFEFLQRCRALVDLCAAPGGWLQVAEQQMPVSSLRIGVDLVPMKPIKNCITLQGDIIEEKTRHAVRKELGTWEADCVLHDGAPNIGTNWAHDAFQQNCLTLSALRLATQVLRKGGFFVTKIFRSADSQCLIGVFEKLFRKVHVWKPSASRLESAEIFVVCEQYSKPDKVPSELLDSKKVFSDQTDGGERKAKALGYGNDALLGQHSGLGATEFVTSKNALQLLSRASELVLDSERVLNSEHTTNEIKECLKDIKVCGPAELRSILKWRKKLVDEQKKEEKASKESVKSAEEMVEGDTGEELEENTEFKELEEIDDLIRTAKAEEKATLKKRKRKLLKAKRNLEERKKLKMVHEGDEPTIGEDLELFSLKTVKRLAERAAKAVKGIKEEEEEKESNDEDD

SEQ ID NO: 1171 - protein, 269 aa, Heterodera glycines
  genomic DNA sequence=SeqID_318; coding sequence=SeqID_948
VIDSSDVVIEVLDARDPMGTRCRQVEQFLQKEKPHKHLILVLNKVDLVPNWVTKKWLQILSKEIPTIAFHASIQHSFGKGALINLLRQFYRLHRKERQQISVGMIGYPNVGKSSVINTLRAKKVCKSAPLAGETKVWQYVMMMKGIYLIDCPGVVYPPHGDTETDLVLKGVVRVENVPDPENHIQTVLDRVRPNHLRRHYNFVKSEDCEDFMTKIALSSGRLLRGGEPDLNTVARQILNDYQRGNLPHYVVPPGCERTLADDDDTKPDE

SEQ ID NO: 1172 - protein, 728 aa, Heterodera glycines
  genomic DNA sequence=SeqID_307; coding sequence=SeqID_950
AIVPFDVEYQQLKKTNTPAKLYEFKLDMFQSQALKCLDNQQSVLVSAHTSAGKTVVALYAIAMALRDKQRVIYTSPIKALSNQKYRELVEEFEDVGLVTGDVTLNPNASCVVMTTEILRSMLYRGCEIVREVGWVIFDEIHYMRDKERGVVWEETLILLPKTTNLVFLSATIPNAKQFTEWICYLQHKQCNIIYTDYRPVPLQHLVYSAGSDGLWEVVNIKGEFKQDNFAKAMSCLEERQPMGGEVRPQHGRRSGANDATQKSNVVKIIRTIRERDMLPCIIFSFSRKECEAYASEIKDIDFNTEEEKRAIKLIFNNAIDLLSDEDKKLSQIRHVLPYLMRGIGIHHSGQLPIMKEVVEILFGEGLIKTLFATETFAMGINMPAKTVLFTSARKFDGVSNRWITSGEYIQMSGRAGRRGKDEKGLVILMVDQQMSAETAMQIIKGTSDPLNSQFRLTYNMVLNLLRVPDINPQFMLGNSFYQWQNYSRLPDLLQKLNTKRQLFLSAHVDHLSELEGLFRLEKQIEQQRNAIKALVLKPAKVIRFFQPGRMLKLKCFDKDFGWGVLLRYTKKPNPLNPLSPEMLYFLDVAVFVSRESENCAQNLCAVKPPPPGENGVVVVLPFAFDCIQAVSTIRLKIPQELKSKEAFQAVAKTILETKKRFDQLIPELDPIEHMNISDPQLKKSLEELKRCEERFTEHPLRNRRDFDEIWEAFMKRQKLEDEYKQAKK

SEQ ID NO: 1173 - protein, 308 aa, Heterodera glycines
  genomic DNA sequence=SeqID_459; coding sequence=SeqID_951
MEVVDSMSVQIPKSSGAKIEVINDPQCIARVAAHSHVKGLGLNVETGEALQKACGFIGQCEAREAAGIVMELVRQKKMAGRAVLLAGPPGTGKTAIAMALAQELGDKVPFVPVVGSEVFSSEVKKTEVLMEHFRRAIGVRIKEVKEVFEGEVVDLAPVEADHPIGGFGKTISHVNCVLKTTKGSRELRLDPTIYDSLLKQKVTPGDIIYIEAGSGTVKRMGRSDIFANEFDLDADEFVPMPKGDVHKQKEIVQYVSLHDFDNANASPQGKTGDFISMLSKFMKPKKTEISEKLRSEVNKVVNQLIESV

SEQ ID NO: 1174 - protein, 159 aa, Heterodera glycines
  genomic DNA sequence=SeqID_353; coding sequence=SeqID_952
FESLTQTTKYNFDFLVQVLELALFYHFLKLIFSIFHPLPKKTENSVVMAGIVAIYGLVVAVIISGRLEAAGPGYTIDRGFSQFAAGLVCGLCGLGAGYAIGVVGDAGVRGLSQQPRLFVGMILMLIFSEVRRRDGPRILAWGGGVPPPGRRPFLRQFSQ

SEQ ID NO: 1175 - protein, 246 aa, Heterodera glycines
  genomic DNA sequence=SeqID_434; coding sequence=SeqID_956
EPKGNKFCVLVAVGQKVTPLIYRLDHGKPTPQLIGKIEPANGLNTAMWAPQGGWVVVMGVNTSSGIVSFIDATGAEANKAKTIEHTSLSQGSWDPTGRYFATCTFAGKSRYETGYRIHSFQGRELRRKAVDALLRFKWRPRPPVSLSEQKVRETRKSLKQLSAKFEEEDKREMLKVSKEIIEQRKKALELFSNIRVAAAKTYEEEREKRTELRGGIDQEIGEKDLVEETITVALNTEKEKIRDESK

SEQ ID NO: 1176 - protein, 335 aa, Heterodera glycines
  genomic DNA sequence=SeqID_479; coding sequence=SeqID_958
MADDKSCDGASSALPPCLIVLGMAGSGKSSFVQRLASHLHSKKVFPYLVNLDPAAATVPFPANIDIRDTVNYKKVMQEYGLGPNGAILTSLNLFCTRFNQVLDLLDRRKGSIPYAIFDTPGQIEVFTWSASGTVITDSLAASFPTVVAYVMDSARSTNPTTFMSNMLYACSILYRTKLPFFVVLNKSDVVDPAFAVEWMRDFEQFQTALDQSSSSFMNDLTRSLSLVLDSFYENLNWVSVSAKTGQGFDKVLELIEKCRLEYWEVYKPMCERVAQERAAETANDGTTDAMPTEKLANLEIRENDVPSDEKGQTEEAQITETNGEEHSTEESEAQK

SEQ ID NO: 1177 - protein, 459 aa, Heterodera glycines
  genomic DNA sequence=SeqID_423; coding sequence=SeqID_959
WPFRRLFWHLCLSIPLRQGDVLLRVNEVDLQNSTHAQAAQTLKAIPNYSEVQLVLQHLPQEYQRFEEKLERARAEMAQLQQNPQQPPYLPPDAMPPPQQIMPMPIRQDFYVRALFDNDPSRGDAVLPHRSLAFRYGDILHVTSVADDDWWTARRVAENGDEGPEGIIPSKKRVEKRERQRRKQVNFNAGSQSLGRNASVSAGGFGGGGLDGRRGSRSQLSFSRKFPFVKSTEKLNEYPSDGGETGGGTIADEPIHSYVTVELRTVNYVRPVIVLGALKDRINDELVSRHPDRFSSCVPHTSRPPREGEVHGRNYYFVTKAEMERDVKSNLFIEAGQFQNNLYGTSVAAVMEVAESGRHCILDVSGNAIRRLQNTAHIYPVSVFVKPLNYQQLREWDSLLSEEDALKQFERCQRQEQNFGDLFTGMVTGHSPDDIFARVIHIINEQSRPEVWIPTNEQLP

SEQ ID NO: 1178 - protein, 648 aa, Heterodera glycines
  genomic DNA sequence=SeqID_387; coding sequence=SeqID_960
PAKANAIGIDLGTTYSCVGVFQHGKVEIIANDQGNRTTPSYVAFTDTERLIGDAAKNQVAMNPSNTVFDAKRLIGRKFDDPAVQSDMKHWPFKVVQGEGARPKVMVEVKGEDKAFFPEEVSSMVLIKMKETAEAFLGQTVTDAVVTVPAYFNDSQRQATKDAGTIAGLNVLRIINEPTAAAIAYGLDKKGQGERHVLIFDLGGGTFDVSILTIEDGIFEVKSTAGDTHLGGEDFDNRMVNHFVAEFKRKHKKDLSSNPRALRRLRTACERAKRTLSGSTQASIEIDSLFDGIDFYTNITRARFEELCADLFRNTMDPVEKALRDAKMDKSQIHDIVLVGGSTRIPKVQKLLSDFFSGKELNKSINPDEAVAYGAAVQAAILSGDKSETDLLLLDVAPLSLGIETAGGVMTSLIKRNTTIPTKTSQTFTTYSDNQPGVLIQVYEGERAMTKDNNLLGKFELSGIPPAPRGVPQIEVTFDIDANGILNVSAQDKSTGKQNKITITNDKGRLSKEEIERMVQEAEKFSKEDEVQRDRVSAKNALESYCFNIKQTMEDSNKLKDKISEDDKKKVLEKCGEVLAWLDANQAAEKEEFEHQQKELEGICNPIITKLYQAGGAMPGGPMPGGGMPGGGGAAGAGGAGGPTIEEVD

SEQ ID NO: 1179 - protein, 128 aa, Heterodera glycines
  genomic DNA sequence=SeqID_308; coding sequence=SeqID_961
ITLCLGKVADVYLIDEPSAYLDSEQRLHAAKVIKRFILHSKKSGFIVEHDFIMSTYLADRVIVFDGQPAIKATANAPQPLVNGMNRFLSQLNITFRRDNESHRPRINKLNSQLDVDQKTSQNYFYLDN

SEQ ID NO: 1180 - protein, 299 aa, Heterodera glycines
  genomic DNA sequence=SeqID_485; coding sequence=SeqID_962
MRPPVDEDYRPIRVLGQGAYGEVWLVTSKENEREQFAMKKIPVKATEEGIPQSVVREVASLVALKQMKHPNILRLHDAFIRRKGGTISLNIVCEKCDWDLCDFLRKIPKNMCDAQCKYFARQIMTGIDFLHANSIIHRDLKPQNILVNKDHTLRIADFGLSRNYGLHATFTTEVVTLWYRSPELLLQCKYGTAVDLWSAGCILAELYTRDALFRGDTEAEQLRIIFEKLGTPSVSVWPADAIVPHSFYAENSPHITPPFANQMPQYLPASGVELLTAILQFNPHERPTAVECLQHKYFV

SEQ ID NO: 1181 - protein, 548 aa, Heterodera glycines
  genomic DNA sequence=SeqID_305; coding sequence=SeqID_963
MASVPTQKDEKTKRNEELATAILKKMPKPNRLIVDQSPKDDNSSVLMAQTKMDDLGLFRGDSILLKGKKRRETTSIVIASDTCPPEKILMNRVVRQNLRVKLGDVVSVSSASNTPNGLRIHVLPIDDTVEGLTGNLFEVFLKPYFLEAYRPVYKGDTFTVNAAMRTVEFKVIETDPAPACIVVPTTIIHCEGEPIKREDEENNLNDVGYDDIGGMRKQLAQIKEMVELPLRHPMLFKSIGIKPPRGMLLFGPPGTGKTLVARAVANETGAFFFLLNGPEIMSKLAGESESNLRKAFSECEKNSPAILFIDEIDAIAPKREKTHGEVERRIVSQLLTLMDGLKQRSNVIVIGATNRPNSIDPALRRFGRFDREIDIGIPDAIGRLEILRIHTKNMKLADDVDLEKIANECHGYVGADLAALCSEAAMQQIRQKMELIDLESENIDAEVLAQLAVTMDDFQFALGKNSPSALRETVVETPNVTWEDIGGLENVKRELQELVQYPVEHPEMFLKFGMQPSRGVLFYGPPGCGKTLLAKAIARECQANFISI

SEQ ID NO: 1182 - protein, 157 aa, Heterodera glycines
  genomic DNA sequence=SeqID_470; coding sequence=SeqID_964
MTTTKEGSIKREQFYVRYYVGHKGKFGHEFLEFEFRPDGKLRYANNSNYKNDTLIRKECYVGKSVMDELKRIIEDSEIMNEDDANWPEPDRVGRQELEILSGNDHVSFTTSKIGCLVEVNDSKDPVGLRSFYYLVQDLKCLVFSLIGLHFKIRPIAQ

SEQ ID NO: 1183 - protein, 344 aa, Heterodera glycines
  genomic DNA sequence=SeqID_455; coding sequence=SeqID_965
TGRTFFRAPGLEAPDENSGDFPTNALVCPDCGFSCSSKFHYNSHRNTHSTHQCPICKFETRTEGRLKKHMLQSHKREQRLAAGINIQSPPPTPTTLKQNSPPSNGDLTAGDNSNGTLALESIQSMLTNTNSVAFSNSTDALLKICTDVIANNGPNKKMLNSSPQVGDFGHIPLEQLRALTERHTALLNTSTAGTLNIAELQIGPEAVSSAKQTEKETRKSASGKPKQYKCKTCQNISRSKEEQWAHARLHIPKQKQLTCELCDFVTEYKHHLEYHYRNHNGQKPFKCSICDYTCVNKSMLNSHMKSHTPVYQFRCQDCTYQTKYCHSLKMHLKKYSHKRAPGPS

SEQ ID NO: 1184 - protein, 429 aa, Heterodera glycines
  genomic DNA sequence=SeqID_374; coding sequence=SeqID_966
MIISSKAVQLLTCYRNRITRKLQYSTTENVPVNVPEPVISSSNMAQFRKGAGGRSSFSGNVITVFGNTGFTGRRVVNRLARHANQLILPYRCDSYFLRELKVPCDLGQVLFFPFQLDDDESIRKAVKYSNVVINMIGTYVDTPNYSIYDANVEGAWRIARICREMGVERLIHVSALNADPSYKTQFIKNGAFLKSKGMAEQAVRAEFPSATIIRPSVMYGDIDRLIYNLITRWRVDPFGNVYTFNAGEGIYKMPLFVNDFADGVNRVAMDSSTAGKTYEFVGPHCYEMCELFDFIFIKGGLVADITSRYRRVGIPIWFLFTSFLCHSYTKIYRRPGVINWEWFDFMEATSDVLSAGDTYLLKDLGVSLTDFEDMGGYYAMQISFQRPYQPRMADYPQCPLPLRSPPLYKRKPITFKKQNIVTEQRAFGL

SEQ ID NO: 1185 - protein, 719 aa, Heterodera glycines
  genomic DNA sequence=SeqID_365; coding sequence=SeqID_968
MAHLIQDGFVVNDATWKLGIFITDMNISRELFVRGDMTIGSLMMQLVGQIGETQDWSDHYMWWPDRRKWLKHTRSTLDQIGITAATYLEFTPMHKHAKVQLPDLQIIDARLDFSVPILKVTQKICQELAIRHPEELSLKRDIPPDILRKGASVESEAQIQPYMKPGEESIGPGTLRTAKPIRASTVNLTSGRGSPALSQASAMGPGHLFNASEIGTLPKMGTIPRGMSPGPAAYREVLGRTPEPGYSEGGGLECDQFDENLINSPKITPGRETFRPQNYLEKAALNRGWLDSSRSLMEQGICEGDVVLLRFKFMQFFDMNLRYDPVRINQLYEQAKWSVLLEEVEHTEEESSLFAALQLQAALQRNSPDRESPERDEVDVLLDELEQTLDTTASLSRRDLTYVPELTEYLKYLKPKKLGFNNFKRAYFTFRDLYLSYYNTAQDANGPPLGHYYLKGCEVSQDLSVSQGKFNIKLQVPSSEGMSELILKCDTEQQFAKWMAACRLASRGKTMADSSYNSEVESIKKVLQMQAGRAAAAQNGAQNKKKSQPVQLPTDFNSEEFVCQRYWKRSGNKSMQQRISDAHSNVKTLSCTEAKLQYIRNWEALPEHGLHYFIVKFRNGKKAELIAVAHNRMMKVNSDNGESSKTWRFSGMKKWHVNWEIRHLKIQFDNEDVEFKPLSADCKVVHEFIGGYIFLSMRSKDQNQTLDEEGFHRLTGGWG

SEQ ID NO: 1186 - protein, 685 aa, Heterodera glycines
  genomic DNA sequence=SeqID_385; coding sequence=SeqID_969
HPRVRYAVCNAIGQMCTDFQPTIQKKCHERIVPVLLEAMADMSVPRVAAHAAAAMVNFCEDCPKSIISIYLPSIMERLESVLSQTFQQMMTNGKKLVLEQIITTIASVADAAQDHFAKFYGNLMPPLKYIFENAKDDNLKLLRGKTIECISLIGMAVGAELFETDADSVMQVLLSSGVKFENNDDPQISYFISAWARICKILGKGFAKYLDMIMPAVLSAADFKPSVALVDGKDTDDNEDWDYMPIDENRSLGVHTAGLEDKVTACEMLCCFARELKDSFAAYVERVMQLMLPLLSFLFHDGVRSAAAECLPCLLVCAKGYGDEYVRQMWSVILSNYIIAIGKETDLEVLCEMLNGIAQCVEDFGGNDAIVTDQDVANIFCVIYQQIENFDKRRAEREKKSKEEEHDEEDQERLDEIIELETSVLARVSDIIHYLFLTKREAVIPHFDKMAQIFAALLNPRRPFHDRQWGLCIFDDVIEFGGELSMRYQNIFFQPMVTALADKYPEVRQAAAYGCGIMGLKGGQNYAKHCAQMLQPLINAIEKNGSRSTEEDTRATENAISAVAKILKYNATEVNFNEVVPRFVGWLPIWNDEEEVPYVFDFFCDLVESQHDAVREDPSRVFHIILNAFSHGAFEDDSAEEMRLVKSRMKGIMAHIRANEQLFTQIVQSLQLNTHQRTVLEQILA

SEQ ID NO: 1187 - protein, 385 aa, Heterodera glycines
  genomic DNA sequence=SeqID_462; coding sequence=SeqID_970
MGIKDLSKVIADHSPFAIKTNEMKAYFGRRIAIDASMSLYQFLIAIRQDGAQLTTEEGETTSHLNGIFYRTIRMMDNGIRPIYVFDGKPPELKSIELDKRMERRAEAEKQHLEATERGDKADIDRFGRRLVKVTKEQSDECKHLLSLMGVPVVEAPCEAEAQCAELVRAGKAYATATEDMDALTFGSKILVRHMTFSEAKKMPIKEFSLERALKDWEISHDEFVDLCILLGCDYCATIKGIGPKKAFELIKKYKSIETILESIDQKKYAPPDNWLYKEARQLFLRPDTTPGEQFEFTWAEPKVPELVDYLCGQKGFNEDRIRSALDRLQKSRKMALQGRIDSFFKPQGTANKAITEETKKKRKAEEEEKTTTNKKKSTVKKTKKK

SEQ ID NO: 1188 - protein, 246 aa, Heterodera glycines
  genomic DNA sequence=SeqID_366; coding sequence=SeqID_971
MVALRAQFEASNDVGVFCKLTNAYCLVGIASSENFYSIVEAELADVIPVIHCTVAGCRIVGRVTAGNRHGLLVPNATTDQELQHIRNSLPDSVQIRRVDERLSALGNVIACNDHIAVVHADISKETEAALAEVLKVEVFRLSLGENALVGSYAAMTSNGALVAAKTPPEVQREFASLAQVPVVAGTVNRGSELIGAGCCVNDWIAFTGLDTTSAELSVLESIFKLGDAAPSAISTDLRDTLIESML

SEQ ID NO: 1189 - protein, 318 aa, Heterodera glycines
  genomic DNA sequence=SeqID_454; coding sequence=SeqID_972
MANKMKKKKKNAVATTTAGPQKDGGKFKQKGIKFNTEKGQHILKNPGVVHAIVEKSAVKGTDTVLEVGPGTGNLSMKLLDRAGRLIAYELDPKMVAELQKRVVGTPVQYKLRIIAGDVIKAAEWPPFDVCVSNLPYQISSPFIFRLLLQRPLPRYAVLMLQKEFADRLLAKPGSKVYCRLSVSVQLLATVEHLMRVKRSEFVPPPKVDSAVIRIQPRNPPPAINYKEWDGMLRIAFMRKNKTLSALFKQKQVVDVLRKNYAVVCGTRGKEVPTDFCMTSHIERVLEEAQFAKRRARTMSIEDFLALMLTFNKADIHFC

SEQ ID NO: 1190 - protein, 130 aa, Heterodera glycines
  genomic DNA sequence=SeqID_334; coding sequence=SeqID_973
MVRMNVLADALKSINNAEKRGKRQVIIRPSSKVIIRFLTVMMKHGYIGEFEIVDDHRAGKIVVNLTGRINKCQVISPRFDIRMADLEKWTSNLLPSRQFGFLVLTTSAGIMDHEEARRKHVGGKILGFFF

SEQ ID NO: 1191 - protein, 229 aa, Heterodera glycines
  genomic DNA sequence=SeqID_413; coding sequence=SeqID_974
MDNETSLMDQQQKRYDRQIRLWGDDGQLSIQQARVCVFGSNSLAAETLKSLVLAGIGSFHIIDKALVDHADFGQNFFVEEGSLGSSRAECLVKALKELNHSVHGQHHPISFGEFKRQDFQMLLQFSLVIGTSLTANEARQLDQFLFEHAIPFVYANVCGMMGHLRLSFREHYIFENHAENAAYDLRLDFPFPELLQLANETNLESMTHEQHSHTPFLLLYLKAIDIWRK

SEQ ID NO: 1192 - protein, 1050 aa, Heterodera glycines
  genomic DNA sequence=SeqID_361; coding sequence=SeqID_975
MNRSTGEAQKAASDILARFKESADSWTKVDTILEFSDLLETKYFGLQILEHLIQTRWKALPRDQCEGIKGYIVNMILDISADPEKSERMKLLLQKLNLVLVQIVKHEWPRLWPTFISDIVGSSRNGQSLCMNNMAILRLLSEEVFDFGTGLTSSRAIQLKQQFCGQFEEVYRLCYEILENSDNAQLVYATLYTLHGFLDWIPVGYVFENNLIDLIIKQFLPFPAFRSIAVQCLVEVSSISIDDNPQYGGKLVFLLRKVIEIISEQLPLSFDIATSYANGTNEDQKFVSNFAQLLSTFFKEHSALVEITFPHPDEEQKAVKQAHLMALKYLLKISSEVEDIEVFKICLDYWNWLCMELFRESPFEQSEHSIIDALKRYNRQESPKRKLYIEVLSELRLLMISRMAKPEEVIVVVNENNEAVRELVKDTDSVVLYKTMRETLVLLTHLDYRDTELKMTEKLQNQVNGSEWSWKNLNTLCWAIGSISGAMHEDDEKRFLVTVIRDLLGLCEQKRGKDNKAVIASNIMYVVGQYPRFLRCHWKFLKTVINKLFEFMHESHEGVQDMACDTFIKIVIKCKSHFISIQGGETMPFIDEILQNLNSIICDLSHPQVHVFYEAVGHIIYACTSREVQEDLIDRLMTLPNSIWSEAIDHASRDVNILSDQDVLRNLAHILKTNVAACKSIGAPFFSQLKRILNDMLSVYQVISGNLNKAVNEQGEQALKWPLVKQMRIVKKEILTLLSTWISRAFEPRLVIENVIKPLFSTVLVDYEMNIPQAREPKVLSLLSITIVSLKEDASAQVPAILDAVFTCTLEMINKDMEAFPEHRTNFFQLLKAINQHCFDVLITLPDEVFGLLIQAIVWAVKHTMRNVAENGIDILRELLTKVSTMTDKAQAQAFYKKHFMVIMEHVLGVVTDYNQVNFVGLTNLAESVCLLFQAAETIIEVPLNPTNPSQPNMEFVYEAIATLFTTHFKNLTEPQIRVTVKGFFSFNRTVTKMREHIRDFLVQIREEAGDDTADLFLEEKEAEIQRIQSLKQAIPGVRNPNELLEEDMV

SEQ ID NO: 1193 - protein, 768 aa, Heterodera glycines
  genomic DNA sequence=SeqID_319; coding sequence=SeqID_977
NQISGAIDVIVVEQPDGSLASTPFHVRFGKYGVFNYENKYVDIEINGEEIDLKMKLGENGVAFFLANDEEGIGETKNAEGKEFLRESQNKKWSEDTQQNNRPSAIDLENQRKCSFASSSSSTSSCTSQPQHNECPPTATTTAERKQSTPPKRSKMFNPSFLNHKASVQQNRQRLPFSSSIYSCRRNRSLPDLANLLSPSSNIYDSETVAEEEGMGRRKGTMSSRMDELRKSDGTPEVNNALKHSNSASVPLKSYYKHESAKTTQFSSPDSDKGRAEGEKGQRAEDDESKSCAPSTSELADGALSDSEVDRHGSIKDPEWKWGEIPKSNGKGSNKADGSASRKKVSRWDYWFGRWSRQNKEKETEGRTGGGENGLSLEDIGNNPVKFGLYIGPSKTEAICISSKSSDSGNGPSLGTSPTMSFSPVLTISEENLASEFAKGNVTIADRRPSNAMDFELFEEKAKEKRSLRLSRDQLDLLNLNYGSNDARFSITTKYQGTAWCSCHIYLLKWYDKLVISDIDGTITKSDVLGHVIPAIGGTWAHSGVAELYTGIKKNGYQMVYLSSRAIGQSHYTKTYLQNFAQGSRTLPDGPVLLSPSSVLMAFRKEVIERKPEEFKIACLTDLKSLFPVGQPFFAGFGNRETDVKSYLAVQIPPERIMIIDPQGSLRRADNKAGGYVSDYPTLAMDSVDYVFPPRVDMDGIDIRTKEDGILSEFVAWRTDAEQFDALVDAELEQYEERSKRAKAIVAGTTDGRGADGKKKMYRNGRRAK

SEQ ID NO: 1194 - protein, 338 aa, Heterodera glycines
  genomic DNA sequence=SeqID_483; coding sequence=SeqID_978
NTSCLDDFDRIKTLGTGSFGRVMLVKHKQSGIYFAMKILDKQKVVKLKQVEHTLNEKRILQAIDFPFLVNMQYSFKDNSNLYMVLEFISGGEMFSHLRRIGRFSEPHSRFYAAQIVLAFEYLHSLDLIYRDLKPENLLIDSNGYLKITDFGFAKRVKGRTWTLCGTPEYLAPEIILSKGYNKAVDWWALGVLIYEMAAGYPPFFADQPIQIYEKIVSGKVKFPSHFSNELKDLLKNLLQVDLTKRYGNLKNGVADIKNHKWFASVDWISVYQRKITPPNFNASFSAKYPAEMPRVFEALYPKVSGPDDTRHFVEQIDEADELLQSHGDSQGDAPDAHA

SEQ ID NO: 1195 - protein, 878 aa, Heterodera glycines
  genomic DNA sequence=SeqID_386; coding sequence=SeqID_979
LVAAALDSLREIYFKRNISAEQQRDAALLSLVAHPKQMLYAAQTGTIACEYLSLDTMDQWIIFGLTVCHRLLVDPAHSANLGPLYQRAVQHCLVVHLFRDECIVVQPLVHTVLEHIKQQQQHNHQSQQQHQQQYGMVKQLVGELKDGVHTLHAAGHLHAHRRHFLRMALRELCLLIGDQPGLLGPKCLFVWMGLAYARDEVLWLLRHSELWPQLMQAAFSSKKAMARSGLATIVVDKFLPELLFYMCELRNLVLKHADIIAHYHAEYVAGYDAPLLAEQLHQLSADGAELSDYEALLLRACADALESVKGMAWIGHYNSENNSPWKFCPVDGIVVDSRAVRLDWFRFQANSSVSRSAFKLHTHANLAVALNTAIFHLKQIDDLHALLGETSDLSIYCFHAHLFDAHLRHALDFPVQSRFSIAFAHIATNFENALHEMCPEERDLVIEKGLKTCNSALDELSKKVIEVFGKLCTDKHQMELNQSPHTCARILAATYKLLAAAENDGGHIFVPREFLYQNLERHLKTSLSNTTTANCPMSPHPRRPSEMLAFLCAQMHALQDLDTFLAYDIVCLFRDAMLQQSQREDAHGQETLAEVYSKWYLEVLLRKASTGQLLYSDHLQAFVTSEQPQQQQTTESYTDPRELRALAQLIGPYGIKAMEERLVWQIASQITELFKLVRENRETLHAARVNFDKPAKLREVPSVCTASTCASTATAAPSAIESLLQRVIIIGEIIAFRDLLFGALNDVLRQRCPFLISSLGSLIDSAADELQKINIGEACAASGFKLDVDLALVNACKQQANNNGLNDHYNIACLLIVFIAIALPKLAQSPHSFFRASLMVTKNNSHTIPLAVNTLVGALFFLHQRGDTGDRMREFLAV

SEQ ID NO: 1196 - protein, 700 aa, Heterodera glycines
  genomic DNA sequence=SeqID_389; coding sequence=SeqID_980
FSCTLNGVPESHDLLEKCRLPFGLHLQPFRDLRGLKVLQTVITRCRYCRTYINPFVFLMDARHWKCNLCYRANEMPEDFAWDPQTKTFGDPSRRPELQETTIEYIAPSEYMLRPPQPPIYLFVFDVGSAAIDCGYLNTFAEQLSLDIDKLPGQERAFIGFIGFDSALHFFQFDENEREPRHIIEFDVEESFAPVFSGLFVELNVFKEIIKKFIYNIPSIFERSMSSSNCLGSALTVAKNLINEIGGRITVFTASMPNLGIGALKCLEFNTAKKIAFTPQIDFYKSLALECTGKQIAIDLFVVGCQNVDLRTLSDMSRFSSGTVYHFPEYHFLRDQVEVKRFQMILRRYFIRKLGLEAVLRIRCSRGLSLHTFYGNFFVRSTDLLALPNVSPDSAMGVQIKHDEVITASQVCFQAALLYTSTKGDRRIRVHTLCLPVLTQAAHVFSSLDINSSISLLSKMGYDRALQGASLSDCREALINAVVDPTVCYQRSHGQVGSMLRMPPEGGLQYMPIYILGLLKNRAFSDSLQRVTIDERVATFLLFKNAPLEVLLLELCPALYAFHQILYCEPNQFPDRLPPTYEHISQNGIYLLDIGTFVYVYVGSALNVCILRSLFGTDSFAKLDSDVIIEIDTSQSKHLHAFLRHLQEQRGNMYAPAKIIKDDSPRREAFTRRLIQDRSDSSHSYNEFMQFLQREVSKASK

SEQ ID NO: 1197 - protein, 891 aa, Heterodera glycines
  genomic DNA sequence=SeqID_396; coding sequence=SeqID_981
GCRGFGKRIMNCPEDLIVGGIRRDAQGVQIRHAEAFQTVFLVASAGDVYQRLIRSKNHRMEKFGVSFTQAHAGAIIAAWQRNFTKSIYDHTLNKPAQGIRVVHPLASTSIQDMLEQFSEFQFFVIFIGYVLMIIYAGWSQVHWQGWWFSVKSSCLLAIIGVLVITLASVAGLGLSTAMNIHFNAATTQIVPFLTLGLGIDDMFLLLHNYNDVLEAVRQKEVAVLLKETGMSVLITSINNILAFLTGCILPIPALRSFCGQVAILLTSNVLCIILLFPAFIALDLRRRKAGHRDMSFCSSRNQLVKTDSTVTTHSSEIDLQQMSAAVPVTSSATKSLHKWYTLVGFLHGYYIPLLRRPIAKTVVLLVCAAMFLFGCFGLYYSRIGLELADVLPEHTAPAAFLKARERYFSFYPMFIVPKGPMVDYANQQHKLEQLRRDIGRSNFVIKVDGEPEQWWMMFMRTWLHSLQSSLDRAAKIGIFPDDDLKKMAADALARNFTLSDDFLLARKLLCSAGQRFNCTEMRGAKLIEDGRINPRGFYNYLTAWFYQDNMMYYVSQAAFFPTPLPWHFSAADESVVPPADPLLYSQIPFYMNGLTDTQSIVQMIKEIRAICDRYSADGLPVYPSGIPFTFWEQYLKLTFYLVSAILIIGVAVLLVISIIIFNPWAAAMVAIIVVTMTVELAGFMGVFGVKMNPISAVTLITAVGIGVEFTAHVVLAFLTSLGSRDERMVACLEHMFIPVIHGGLSTLLGIVMLAFSEFDFVVKYFFVVMTALVIIGLINGLALLPVLLSLIGPPCEITPVNGSNLLPCPASERYRPEDSPNCFTTPSSTHHQQSDEQKRRRGCKRMLAVDDSSSASSTEDGAGAPAFSKSDEDGEHQKQQQSVDWDNTVTN

SEQ ID NO: 1198 - protein, 396 aa, Heterodera glycines
  genomic DNA sequence=SeqID_327; coding sequence=SeqID_982
MLVVIIHPEQWNGGSDRCTIGLLRHFVQAGHKVFWLTTMIDTYWASEDFHGVGTLFAHMPLHPGDWYTQNTALALYYLFSKRGMGSPDLVVVDHSASCVPLLKWFFPRCRVLFYCHFPQQLVTPSRFFLYRWYAYLMGLVEGRLFEYVDIVLVNSEFTGRQFRQVMPTVSNAKIRVVYPPCDVDSLRCGWVRPISRADRPPNERYLFLSMNRFWPEKRLEIIIEAAAELKRRGLRPRIQMAGSVMPHIPESRIYYQELQSHCKQLELDDLIEFLPDPTDERKFELYRQCDSVIYTPPNEHFGIVPIEALEQRRPVIVNNSGGPAETVLEDITGTRIADTCGVLLANAMASHMGRKEWPQLDKDELYAKQRIRFDEKFSWKGFGRRVDEAIAELFSV

SEQ ID NO: 1199 - protein, 291 aa, Heterodera glycines
  genomic DNA sequence=SeqID_388; coding sequence=SeqID_983
YMVDESGASLTLRVLEHKQFVRFVNIWARGFWTIGRAEDGRLFVCGLNNFGQLGVPPQSPAHRKSAAGTSDEDDGGIGPPKPKSPATIAAGQEESNKVALLTCATAFPAEKRWTHVAGVQHVICRSGDDSQIYGIGKNTDNALGLDTWQGNHDEEHWRYDTLQHIPLPDGVNTVAGVDATLGATIFWTDDGRVFGFGCDTVGQLGLGIKEEDEKVVSKPRQITSAHLDGYRVLGVSIADNHALFLAASIDQQPPLSSASPPPPPQQQKAQQQKQLQTNGNGILETPIDGKA

SEQ ID NO: 1200 - protein, 869 aa, Heterodera glycines
  genomic DNA sequence=SeqID_328; coding sequence=SeqID_985
DEESCAPREGHCAQDQFKCHTSGICIPGTWKCDGQLDCDDGSDEPRATCEEMHSTCPAGHFRCNNGRCIFSTWICDGENDCGDNSDEQNNCPNSAATFKCPFETISCKSAPEQCIPFHQLCDGKQHCIDGSDEGGRCSRDLCVADRAGCQYKCHNSPEGPICSCPLGEQLINKTKCEPENECLDPRTCSQHCTDEKHGFRCSCDPAYELEPDKRTCKVTENRADMRVYVSNRNRIYWSDSSLENWRTFAAQVENAVALAWDSVDDRIYWSDIRDKRIYSATRNGTDVQTFIGIGLDITEGIAVDWVGRNLYWVDSSLNTIEIASLQKPGVRAVLLHDDIDQPRGLAVDPRVALMFWTDWGQHPRIERANMDGTGRTILVNTKIYWPNSIALDFTTNRVYFADSKLDYIDFVNYDGKGRTQVIANSKFVQHPHAMSIFEDFIYYSDRRLQRLQLYPKYPNGTNQDYPSHTFSKALGVVTVHPVLQPKLMTTSACSVSPIPCSHICALGNNGTYTCICPSGMVLDTDKHRCVADHRPFLLMVFKTMITGTSLAGGAKDSTAKQRAEMAGITPISGLQNAHDADFDAQTQKLFHLEHGSMARLVMATVISDARIYKSGFLGNNRTQLLTAQIPNDPFCMAYDWNGRNLYVGNKISQTIEVVRTEGEQFRAVILHNDQTPTAVAQPIAIAVDSDRGLLFWLDQGKGGVATKVARADMDGGNPLVLVNIDLAELDHLALDTVNHRVYFTEAKAGRITSVSYEGQDKHYLLNDPAKQPRAIAFFNNRIFYSDSAFDKIFAGEFVGDEQPPEFSEFRANVEQLNNLKIIHPSTEKHPCHENNGNCDQLCIPGQHKKFTCLCGTSFTLDEDNKCKVF

SEQ ID NO: 1201 - protein, 428 aa, Heterodera glycines
  genomic DNA sequence=SeqID_444; coding sequence=SeqID_986
MVETAEQPAKKEDEKMETAEDEIDAEILQMSTDQIRERSLLLDNEIRIMRSEIQRISHSMQTLKEKTKENNERIKINKTLPYLVSNVIELLDLEEQQEEEGANIDLDAHKTKCAVIKTSTRATYFLPVVGLVDPEEMKPSDLVGVNKDSYLILEKLPPEYDSRVKAMEVDERPKETYSDIGGCDSQIRELVEAIVLPMTKKDLFINIGIQPPKGVLMYGPPGTGKTMLARAVAAQTKSTFLKLAGPQLVQMFIGDGAKLVRDAFALAKEKAPSIIFIDELDAIGTKRFSSEKAGDREVQRTMLELLNQLDGFQPNDDIKVIAATNRVDVLDPALLRSGRLDRKIELPAPNEKARAHIVRIHSRNMNVDKDVNFDELARCTDDFNGAQCKAVCVEAGMIALRRESHIILHEDFMDAVQAKKKTSLNYYA

SEQ ID NO: 1202 - protein, 441 aa, Heterodera glycines
  genomic DNA sequence=SeqID_424; coding sequence=SeqID_987
MENESQGAHLMDQLDSVIPSLVNPSECQSEKDLALFRQLFRQFLEDPHKVNWQEIQPMAKEKQMPYEHLPKVEGSEERRAILERIAVIKLNGGLGTTMGCSGPKSLVQLRDGLTFLDFALQQHRILLNCADLRSPVPLLLMNSFNTDAQTKAFLWAQNANSVAAVKCFCQSKCPRIFADSLRPVPNSWDDRAEEGWYPPGHGNAFHALDQCGMLDELLANGRDLAFFANIDNTIIADGKADYVMEMTERTQADVKGGTLVELDGGKRLMHLECPQVPSDRLDEFCSLRTFKMFNTNNIWVNLRVVKKRLDKFKMEILANEKRLSDGQRVVQLEQSIGGAIRNFPGRAWAIYVSRQRFLPVKSTRDLFRVRSSDLFEFWADSFVLRQRVSLLPNVCLSDHFSSLIDFERRIPQIPKMEKVKSVRLEGDVWLGKSITMRVFNS

SEQ ID NO: 1203 - protein, 311 aa, Heterodera glycines
  genomic DNA sequence=SeqID_309; coding sequence=SeqID_988
MIGEELTDVDKARIASDILLQSPPGEFNEVFNDVRTLLQNDALLEKGVCLEAVRRYNKAQFVPVNPEPGAEHPTLITEHNELPDGRFVDPKTGRVFKYDHLRKEAADAQPSGPKEIDEKLEPWRKALQKELDEYIYEHFHLTGVATVFTPLQHQKEPKLILCIESHQFQPKNYWNGRWRSEWHFPNFDGSSKTAGTLQKCTGKLRLQVHYYEDGNVQLISEKEATVEVKMTNDRETSARELLRAICEAESAYQTSIQESQVQMESTFKALRRQLPVTRSKLNWLNFHSFRITQQDMKQPPTPTVAVQQQSQ

SEQ ID NO: 1204 - protein, 190 aa, Heterodera glycines
  genomic DNA sequence=SeqID_486; coding sequence=SeqID_989
LPFFVSQKRPFKTLRCPCQIRLAPPSTTSPSSSPSRTSSTPLAMGRPLPWPAKFCSTGYSSSSAKTSAASTSSSAAAKSQDRKRPYLCPTCDSRFGSKMELEEHQNSHTGLKPFQCDVCQSRFNRRSTLWNHKRIHSDAKPFKCTVCQMQFKWKNSLKCHKEMHLRKNELSQGTMPDTDSQLLTYATAAK

SEQ ID NO: 1205 - protein, 322 aa, Heterodera glycines
  genomic DNA sequence=SeqID_440; coding sequence=SeqID_990
MDEPLLQENPNRFVIFPIKYHDIWQFYKKAVASFWTVEEVDLSKDISDWKSLTDNERFFISRVLAFFAASDGIVNENLVERFAQEVQVPEARCFYGFQIAIENIHSEMYSLLINSYVKDSDERAKLFNAIFEFEFIKKKADWALRWIASSDASFAERLVAFAAVEGIFFSGSFAAIFWLKKRGLLPGLTHSNELISRDEGLHRDFACLLYTHLKNTPPKERIYEIISDAVKIEQEYLTDALPVYMIGMNSDLMCQYIEFVADHLLVELGYDKKYNVLNPFDFMENLSIQGKTNFFEKRVSEYQKMGVISTEEQREFRLDADF

SEQ ID NO: 1206 - protein, 519 aa, Heterodera glycines
  genomic DNA sequence=SeqID_465; coding sequence=SeqID_992
MDHQALIDELPEVEKMPAQQRIALARERREQQLRLCQQREGHLPQPAPRRPRLRFSSDIALLETTVRGDAQEVELMLMDGVNPNSHNEDGLTPLHQCAIDNNERIVRLLLRFGADVNAKDTENWTPLHAAACCGYIEIVRLLIKHSADLLAVNADGNMPYDICDDEQTLDLIESEMAGQGITQEMIDERRQLPEREMLSDMKLLHQQGIPLDQRMPDESTYLHIAAANGFYDVAAFLLRCGVSPASRDKDSWMPIHAAASWNQPDLIELLCEYGADISAKTRNGETPLDLTEDPQTQLVIRTIAQTEARRKRIGHFGVRDSRRQSRKRKKFESPQAVPPAANTDFIQTARGAIRRQSLRDRSGMTLARLDSQREGSDLIRSWSKEDVSNEEMSAHHFGNGGPSTSHQPTANQQRRDSPPKRMQKQSQQKQKQMSPDEWLKKLEAESGGLRDEEEEQAEKDVLKGSAGESMRKGAKAQKGNGVIRRDQQQQQQHDMNGMNLKGSLGGQNRRRKKSCCCII

SEQ ID NO: 1207 - protein, 122 aa, Heterodera glycines
  genomic DNA sequence=SeqID_335; coding sequence=SeqID_993
MKLVRFLMKLSHESVTIELKNGTQVSGAIQGVDVAMNIHLRSVKMTVRGREQISLDTLSIRGNNIRYIVLPDSLPLDTLLIDDEPRKKPTQRRFGGRGGRGGPRGRGRGRGGPPRGGGGGRR

SEQ ID NO: 1208 - protein, 114 aa, Heterodera glycines
  genomic DNA sequence=SeqID_359; coding sequence=SeqID_996
MQDNEPLMRALSKLIHMNKPDLVLFVGEALVGNEAVDQLVKFNQALADNSAVGEQARLIDGIVLTKFDTIDDKVGAAISMTYITGQPIVFVGTGQTYHDLRTLNANAVVNILLK

SEQ ID NO: 1209 - protein, 132 aa, Heterodera glycines
  genomic DNA sequence=SeqID_487; coding sequence=SeqID_997
MATYNPNYESIGQAFVQHFYTKFDVPDGPTRTVGLHDLYDAEHSFMTFEGNQVKGRQAILDKYGALPFRTIQHGITKTDSQPLPDGSILVTVIGQLKTDDDPVNSFNHCFILRPNSSGGFFISNEVFRLVLH

SEQ ID NO: 1210 - protein, 216 aa, Heterodera glycines
  genomic DNA sequence=SeqID_360; coding sequence=SeqID_999
NNDVERTWKNYKEEQLKNGLLDWQDYRNLIYGKPQEGQEISPEYVKMIERDERRWKVADYNSDGKMDRTEYGCFMHPEDCDHMRDIVVQETVEDIDKDKDGFVDMAEYIGDMYRPDDYPELKGKEPEWVESEREMFREHRDKDKDGKLNKDEMRDWVMPLNFDHADAEAKHLIHIADENKDGKLSPEEILTHYDTFVGSQATDYGEQLQKHDPADL

SEQ ID NO: 1211 - protein, 471 aa, Heterodera glycines
  genomic DNA sequence=SeqID_350; coding sequence=SeqID_1000
MVSVVAGRVHLLPRTASFGKSFLSSDATKKPDKTSFGNLNDSDRIFTNLYGRHDYRLKGALARGDWFKTKEIILKGPKWILGEISTSGLRGRGGAGFPSGMKWGFMGKPFDGRPKYLVVNADEGEPGTCKDREIMRHDPHKLIEGCLIAGVAMGARAAYIYIRGEFYNEACILQESIHEAYKAGYIGKDCLGTGYNFDIFVHRGAGAYICGEETALIESLEGKQGKPRLKPPFPADIGLFGCPTTVTNVETVAVAPAICRRGGAWFASFGRERNRGTKLYCISGHVNDPTTVEEEMSIPLRDLIERHSGGVIGGWDNLLAIIPGGSSVPLLPKSICDDVLMDFDALVQVNSGLGTAAVIVMNKQCDVVKCIARLAEFYKHESCGQCTPCREGCNWLNKIMWRFVQGKGVPSEIDMLWELTKQIEGHTICALGDAAAWPVQGLIRHFRPELERRMAKYAESHPEIKETLATA

SEQ ID NO: 1212 - protein, 225 aa, Heterodera glycines
  genomic DNA sequence=SeqID_354; coding sequence=SeqID_1001
MSLFGKIFGGKKQEAAPSTQEVLQKLQEREDMFQKKQEFLEKKIETEIATARAQAANKRVALQALRRKKGYEKQLEHIAGVLNTIHHQKTALENASMNSDVLGVIGESAKALKKAHNEMDADKVHDMMEEIAEQQEVGNEIATAISNPVGLQNDIDDEELLKELEEMEEEDLSGKLLDAGIVPAHSVPSVADKLPSAPKELPKKTVAKKQQEDEDLAELEAWANA

SEQ ID NO: 1213 - protein, 1280 aa, Heterodera glycines
  genomic DNA sequence=SeqID_339; coding sequence=SeqID_1002
APSGQPRNVRVSSITATRAELLWNEIDCELRHGRILGYDYELDDLGGEGQNTSGQSSTHRVSLDGLTPWTEYRARVRGKNSRGEGPFSEYVRFRTLPAAPPPPTDLREEQQLAHALEISFLPPYPPNGILDQYRIRWTVHGKFNYREQRVPAFELECSDSRMRGRLCYRISGLEPEQEYEIQAAAHTERGDWSDWSEPLVTKTTEQDIPVLEHPLELEFAKSTSIGVRWRGLEENLAEHITGYALEYKSETDTDWKEWNGVVRHRARQPDYRAHVKGLTESTEYFFRLRVVGKGDKRGGPGPELKAMTKCGKPEEPPGNVHIEPVDFQQVRVSWEPPDELTWKCDSVELVLHYSNGTGAPRTQTFAVDGPREALFDSVPGTRWEAKMLTQSVEPGEEPQRSKWSPRAVLLTRSSPTEIFLKVTPRDDPTQADAFWDLPADYEDWPWGVDLQYRLTRLGSCRKLSKADTEPVIMENVQDKQVLLDNLHPGSEYEVTVTLRQPPGVDRRVAPKKAVQRFQTADQPPSGAPNKLRVEGRWDTKLAFGWEPPECLEQNGEISQYEYELNGLDEWNQGTRQGVSPRTRADIGELLPGSLYRFRVRAFTSAGPGPWSEPIDARTTGSELGPPRDLSPIKSLQNAIQLAWLPPHPETSPVVAYRLRYGPAAGTYRPQEVILQGDELSCADYESRILTGEHLCTSATGLKPATMYRFAVQAQSSSGNWGPFTSDSFGTTEPELKAVEGGQLRLIGAGHDFLRVRWTAPPVIVAHIEQYELHIQPTERLVQAPQRHEVPDSQTDFQFKGLVPVTVYNVTVQGLAQQGKSLWRISDNFATTDISEPSLAWLSSWCSPLTLVEKSDSMLHVTWTPPDVYEPEYRDLLTHYRVTIAPVDSLTMKAGGRKNYTVMVPGNSIKFTELQPDTIYNITVQGGTDSGYGATVWGSWATLSLGKTWILRLKDRTPGSLTVEWDPVWGIAHRGYILTAKAIHSTHPHLRIGSMRTVDVPSTATELTIRGLEPTSTYNVTLQLKDQMDGAWSIYSTLQPGCFLPGDIRHCDQTPHATSMSWEPVLGAAATHYQVRYIHLHQIRTLWVEEPERHRKELLCPKDPCNRLCYLVFNLANPPEEYAFMVRAKVDGRWNNWKLAGRPTVAEAPEVKENCCIVPPPYHVDNIGQTDTQWQYAIAPSPTDRNITRYYVVVDERDPPGDTNWTQLTDKVTAHRLHIPYYVTASFSTETLVGPTHVKIGDGQVIGGYLNYPLHKDKKYNYEVYTKWMMHGDQPVIARLR

SEQ ID NO: 1214 - protein, 133 aa, Heterodera glycines
  genomic DNA sequence=SeqID_494; coding sequence=SeqID_1003
MNMNQLLVGRSLFPKIIRPFSHTKPLAKSEADPDDYGYFPDPIEHSWGLERKMLIARLKGDDRYEPKVYFRAEHTTRDYPNLVPVHLQDKVVGCLCEPDAEYVNYWHIRKGQMKRCECGHWFKGVQADPDSFA

SEQ ID NO: 1215 - protein, 88 aa, Heterodera glycines
  genomic DNA sequence=SeqID_496; coding sequence=SeqID_1004
TIYSPISFFARFVDWFSYHLSNFEYRWSWSDWIECVELDSLHPKRIFVREVIEKCLRFSYHKKLVEFLPSELAPIIPGELNIIYILDD

SEQ ID NO: 1216 - protein, 205 aa, Heterodera glycines
  genomic DNA sequence=SeqID_425; coding sequence=SeqID_1006
MVTAEDTVKTKEEDPKKTTTDDGSSSEEEVPELEEGDVTEEQKKVAEAAGLSEQVAEKGSKQSRSEKKARKLFSKLGLKQVHGVSRVCIRKSKSILFVINKPDVYKSPGSDTYVVFGEAKIEDLAQHAQITDVENLKPPSIIRDVRNRITPAEEESDGEEADATGIEEKDIELVMSQANVSRNKAIKALKKADNDLVNAIMALTM

SEQ ID NO: 1217 - protein, 405 aa, Heterodera glycines
  genomic DNA sequence=SeqID_329; coding sequence=SeqID_1007
MSAVSPSSVVHLGLPRPVDASQLFSLERHFLPLGKCGGHPAWLNPATIPQSAELACQVCGSPMAFLLQVYCPDEPSHAFHRTIFIFVCRKGNCSKINATPNFAAFRCQLSRENAFFSAESALCPSVVGEVSDPFFDPSLFARLCVVCGCRAASRCARCARRWYCGREHQIIDWNTAHKGKCEQKSTENGATAKDGDERDGFTLKEFGIELEAEEEEKSGDGEENEGDEESEEESESEEEGEEEENRRKMAEFEKFGIVKKMAEANGVSARDVDGLEESRRDGAFARFSAALALRPEQILRYRRAGVPLLATDHSPGPPSVVPACERCGEPRQFEMQLMPNLVALMELDSVGQSVDWATLLVYTCGDSCPGEEYAREFVFKQDFVIPAETEENGAKTKERRNKKKC

SEQ ID NO: 1218 - protein, 189 aa, Heterodera glycines
  genomic DNA sequence=SeqID_498; coding sequence=SeqID_1008
MSGTDRLPSISANESFSIDSDVARRFCQENREIVQICALLAYNKTYIELLDELIAKADEAVRHNRDAQKVVKDKLLRPDNKPGKRRRRKDFGLHYRYPYFRDASGMVPAQNMESLELSRVCSFNPLTEEEKKCQFIKKLIIVFAGPVRAQLIVTLKLINFKGTEKELRGLREAVAQSLNEQQIIKLDAK

SEQ ID NO: 1219 - protein, 246 aa, Heterodera glycines
  genomic DNA sequence=SeqID_402; coding sequence=SeqID_1010
MNCGTVLRLSTSTDNITSVSRQHYSIHRRRRRQNQRTRRQPSRTSSLSSMTETSMALEVITVTLNMNTVNFLGISIVGQSCPRGDSAVALDGRIEPGDMILQVNDISFENFKNDQAVEVLKRALTVAKSFDANRTNYFSVPSREPVRPIDTHAWVQHTNAVRGMTSTLNSGLDIRDRTWLKIPIPRSFLGSALIDWLIGNVDGLDDRKEARKYASGLLKDKFIAHVVNKVTFTEQCYYIFGEQSAG

SEQ ID NO: 1220 - protein, 433 aa, Heterodera glycines
  genomic DNA sequence=SeqID_421; coding sequence=SeqID_1013
MWTLKNLGDSFIVKRIGRRPIVLGAFHRPPEEQNVRGHFAVLQFLGDVRQTHALFCVSEGKDSKKVLSEAHIERIHQGKRAANDICAWGGHLAECQLADGTAESIRDHSIEVPLEKPLHFGPKKFPLVVCVAPMYTYTEWQIMVTGIEVWLALGASKMVFPIQSASADTIQILTEYQRIGIVHLRVWPKWPVLSDANPNGLVLSRGIEESHVNCLHFVKPFAEMVVITDIDDMLMPLDPMKVRPGINVDILKDLFHQHPNAGSLLFEHRDVQFVLPDPSTQNTLRSFNFEFLAHSKWKTSCKVWRMKTRVAVNASRVDTVNMHESGIHRFGFVQVRVPCRQAHFYHLRHSYKNIAINEWPIDMSKLRQMLNERWHFRAESNFSSEMQSKMLARSSVESFEDFDKCMSAINEEHWRLRVSRCLTPHVCFSRLAK

SEQ ID NO: 1221 - protein, 257 aa, Heterodera glycines
  genomic DNA sequence=SeqID_501; coding sequence=SeqID_1014
MAATSLQQQLKRLKSAPTGALAVERDYSSLLFTKKAAAALDRDEFYKIGLAGLSGMKKIDNAFDTYAPELFWKDKKRFNRAMLQKDEAEQFDRRIETFLLRLAAHFHHQCCRQVLEWLIHNYQVLDIHTYNAEALLLAFLPYHSVNSFGRLLHILKFNSTAWDWLTEYQRDAAPIPMNILCRACQVGRSYGLVSTLSNFVQMAIEQLGSTYANDKMQNYFTFLVSLFGILIENSTADGTVDDQLLARLMPFLSVALK

SEQ ID NO: 1222 - protein, 136 aa, Heterodera glycines
  genomic DNA sequence=SeqID_467; coding sequence=SeqID_1015
MAISKGTKITPKGGKGGKGKKKKLTLKFVIECKNPVEDGIMKTATFETFLNERIKVGGKTNQLAANGVKVEATKTKLVVTSEQPFSKRYLKYLTKKFLKRNALRDWLRVVASAKDTYELRYFQINQEDEDESDNEA

SEQ ID NO: 1223 - protein, 188 aa, Heterodera glycines
  genomic DNA sequence=SeqID_320; coding sequence=SeqID_1016
ELLEQREKLERAEQNLDTIHHTTQHTQRSLNSLKSWFGGLVRNKLSRAPKGLGTANANANNQQQQPEQTVQQQHQQRPLHAHLVQSSADEFAGAIGGGGGGVQPPQQHSLNSSSRAYIQGTRWEAMDDEIDNNLDLMSAHLGRLRTFGVALGDEVQDQNLMLDRIQKKTERNDGVIRSQEDQMRKLLG

SEQ ID NO: 1224 - protein, 115 aa, Heterodera glycines
  genomic DNA sequence=SeqID_474; coding sequence=SeqID_1017
MNTPAAYEPFLLADGEKKVVIEKDTKVPNAAVFTFNKEDHTLGNLLKHQLLKDPKVLFAGYRNPHPLEHKILLRVQTNPETTPMEALNNAIEDLVAEFSLLEERFRDAIREKREE

SEQ ID NO: 1225 - protein, 291 aa, Heterodera glycines
  genomic DNA sequence=SeqID_373; coding sequence=SeqID_1018
MTLLITGILRKFALTKFPFTASNSSLSSWCKAESPLSHLNGEQLESLFVDERVQRLLLSLTGHDTDKILRHRRINQTERKHYALMTDGMVKEFMSRLDQRAGKFLRIVPFKEPRSNRTEVLARDAEIDGFDTAKFVFTDISFDATDMDRTVVVREQDGTLRTALPEEHDRMNRLFFVQPNRPVNEPPLFAMTDEWLQKTLDRDEHEFVLDWACHFYEPDAPKFVELCKYIFDHTLENDKLDVLYSTRHFGTLAFYLVINGKMDKLLEFYEQKNRNDGVDQTRQLWQILSCY

SEQ ID NO: 1226 - protein, 228 aa, Heterodera glycines
  genomic DNA sequence=SeqID_404; coding sequence=SeqID_1019
PYFVKMPNFLNVVSKKFDPETYEDEVEEDDALDEEGRRTRLKVKMENTIRWRIARDSQGEEKRESNAKIVRWSDGSMSLYLGKEIFEIEKQRLMDNNHLYTRQGTALQAQALFREKLIFRPHSTETMTHRKMTMNMAEKTNKAQKVKVLAQVGDNPEAERRELIRTEEEKLRAAAQLTDMAPNGQKHSHLFFPKNCRKESNICKKIGANTQHKQQQTSASTEEENCHR

SEQ ID NO: 1227 - protein, 267 aa, Heterodera glycines
  genomic DNA sequence=SeqID_352; coding sequence=SeqID_1020
FQKNYILSGGVDKTIAFIRFDADTQRRTFLGHSSKISKVHLHQNLETFVSGSFDSKVKIWSTEQPNALHTIAIHGKAVTDVSLHPTGDYVLCSSEDSHWSFIDLHAGRPLVKSNDDLLGICCGQIHPDGLIFGTGGKNAIVKIWNIKEQTSLVQFEGHKEAVGAISFSENGYYLATGSTDGEVKIWDLRNQKTVTCFAPYDINCLTFDQSGKYLAIGGESVKVYGVEEWKQILEMKAHTQEITGVAFSEDARMVISSSLDGNISTFF

SEQ ID NO: 1228 - protein, 127 aa, Heterodera glycines
  genomic DNA sequence=SeqID_381; coding sequence=SeqID_1021
EGVTLPDFYPLTKSEERELKRIRRKIRNKMSAQTSRRKKQDYIEALQERIFMSDSENRELKKQIEVMAAENRQLAAQLRNMQASIGQSSKRNAQTGTCLAVLLLSVCLIVTPNSRHLGMRSNSREGE

SEQ ID NO: 1229 - protein, 345 aa, Heterodera glycines
  genomic DNA sequence=SeqID_357; coding sequence=SeqID_1022
MGRARRKKGKTARRARQGLLGFTRIAREGKKPKQFEKRVNQRLDRKDDVRTEEILRENIAGQKTQEEPRTPHAFVIHSAGVGRYVRQLEMDLRRVMSPNTSKALRVLKRNKLKDFVVHSQFLGVSHLIILSRTELSTHLRIIRNPQGPTLHFRVEKYSLARDVLSVQKRPVIYEELFQHAPLVVMNGFSSEDGSKKHLQLVQTVVQNMFPSIDVDRVKLASIRRTLLLNYDTEDGLMEFRQYSIKSVPAGVSRSAKKLMQSKVPDLSKYKDISDFMLKPEQLSDSEFEGEQTELELTQDIGGRGKKRGQQTKLRLMEIGPRMTLRLMKIEEGVNAGTALWTHSST

SEQ ID NO: 1230 - protein, 160 aa, Heterodera glycines
  genomic DNA sequence=SeqID_441; coding sequence=SeqID_1023
VCEICDLAQLTDREQYRVHLQSAHRQLLGKNNAEMASGAPLACSRCRDRFWTYEGLERHLVMVHGLVTADLLAKAQRKADSGRCKLCSKQYAFNILQHLVSDHQIKLCSAEIMYSCDVCSYRCTSYQKLERHLETEHPNTGANKQQQQHQQQQQQQQQQR

SEQ ID NO: 1231 - protein, 207 aa, Heterodera glycines
  genomic DNA sequence=SeqID_472; coding sequence=SeqID_1024
FAINVTCPRGAKASGGCIRERGGSGNWVVYTSAFGWKPSGEQRTQIAKDPPRLVHGDIILAKLRPGQEIEASCHCVKGIGRDHAKFSPVATATYRLLPQIKLKKDNFDEEQAARLQSSFSTGVIGRDEQTGRVYVRDARADTSSRNVFIHDDLKDAVEMGKKKTHFIFSVESVGALPSHKLVIEACKVMREKVDHLREQISSRLEML

SEQ ID NO: 1232 - protein, 692 aa, Heterodera glycines
  genomic DNA sequence=SeqID_321; coding sequence=SeqID_1025
MGSDSLEFSNIFQEEMGGFNEGFLKLSRQNVQFKNKGTGKVLTITESDIDHLGWQKLGNKPGLKVVTNSGVHHRFGGLKENDYERVSAFTNAKWQKTLKKNELSLKGWNYGDAEFEGQNLVFNVAEKVAFEIPLSNVMRCQTAKSEAIVEFHPNEECPVQLTEMRFHIPYDPENEDQDVVEEFRKEVLRFAEVESEAGQAIATLSDILLATPRGRYEIKVFQNHLSFHGKSYDYKVPLKTITRMFLLPHKDGRHMYFVLHVNPAVRQGQTRYPFLVLECSKEDYIELELGCTEEQLAQQYNNKLDMHMKGYLFEIMAKIFRVIVNSRIIVPGNFTGASGTPAISCAVRQSMGFLYPLEKGFVYVHKPALYMRFEEVDNVHFARSDVSLRSFDFEIVQKSGQSIIFSNIGKEEYNSLFDYVQTKGLKIRNAQRLGEKAYKEADKFAGSSDEELDPYKEKLKDDARERAAGSESDSEDEDFNVEKEMKKRKADKDSSEGSGSEPDEEYSDDGTDVSDDLMGTDKGKEKEKEGAKKRKKDREEGKEEKGKKEKRKEKEGKKGEKKKDPNAPKRNQSAFFIWQIENRPQIKKPGDSVTETAARAGQMWKALSAEEKQPYEQKAKEDKERYEREMSEYQSKKKEAGEGPSSAGQTSSQNQPKKSQSSPSKKPISKEFVDSSNSSDSDECINPKKDDK

SEQ ID NO: 1233 - protein, 899 aa, Heterodera glycines
  misc_feature (600)..(600): Xaa can be any naturally occurring amino acid
  misc_feature (618)..(618): Xaa can be any naturally occurring amino acid
  misc_feature (834)..(834): Xaa can be any naturally occurring amino acid
  genomic DNA sequence=SeqID_511; coding sequence=SeqID_790
LLSECPAGDSPVFLLHHNTSVASGTVPLRSAPVPGGFLECTELCSVARQCQLVGPKSASEGAVAEFGEEMATRTVTKNCVKSERICSSPFHFDVHEQKILVGFAREVVSADSVHRCLSACLNAFDTFGFECESVMYYPVDAECILNTEDRLDRPDLFVDEHEDTVIYLDNNCAGCECHWHFDNFKTSGILNDQQFAIAAQCYAPYVTQYVAVEGRQLSDELDHSFEGLELSECEELCTQRLSVTANDFNCKSFMYSNLTRSCVLSDERSRPLGRANLAEVPGWTYFEKKCFASPRTCRGVPSFTRVPQMLLVGFASFVMENVPSVTMCLDQCTNPPPETGQNFVCKSVMYYYNEQECILNAESRHSKPDLFIPEEDDFVVDYFDINCRLESEQCSAGEGARSPKIVRTLNAALPEGDGAIHVVETVQANVRECAQKCAAHSPDKCRSFNFDKSSGICNLLYLDGRGSLRPEPKGQVDLYDLHCLETSPEGQSMGCVDPEGAAFSRHLYSQWVGGELSKELHSVPLSKCLNLCAGAGHCEGLNYNRRNGTCAVIGQLGTVSGAMQKSEQVDFYRNVCALKEVQSEESSAANVPKSKRDMGXRRNERDQIKNWEINVKKXKKALVSGTSEGKGAKEDKKVGPPIQIPGSEVHTICNYEGISVQIKHSEPFSGVMFVKNKYDTCRVEVGTENSVTLVLGLPANFGMKPITLTSPEGKGSFGNREKQCSKKAFASFAIMFRQRRQSQRDCGLVDMDNGTYKTVVVVQTNNLGIPGLVTSMDQLYEISCNYSSMLGGKVTAAANLTLQGPQPSLIQPRGKIELGNPVLMQMMPMREANXNVPQAKLGDILELRWELMAMDDELDFLVKDCYAEPGIVPPKGASAPKLAMEKLQLVQGGSVGTAF

SEQ ID NO: 1234 - protein, 357 aa, Heterodera glycines
  genomic DNA sequence=SeqID_336; coding sequence=SeqID_803
AGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGLVLDSGDGVTHTVPIYEGYALPHAILRLDLAGRDLTDYLMKILTERGYSFVTTAEREIVRDIKEKLCYVALDFEQEMATAASSSSLEKSYELPDGQVITVGNERFRCPEALFQPSFIGMESAGIHESTYNSIMKCDIDIRKDLYANNVLSGGTTMYPGIADRMQKEMTALAPSTMKIKIIAPPERKYSVWIGGSILASLSTFQQMWISKQEYDESGPSIVHRKCF

SEQ ID NO: 1235 - protein, 94 aa, Heterodera glycines
  genomic DNA sequence=SeqID_540; coding sequence=SeqID_818
AQIEVIPCKVCGDKSSGVHYGVITCEGCKGFFRRSQNAPVNYQCARQKCCTVDRVSRNRCQFCRLKKCLELGMSREAVKFGRMSKKQREKVEDE

SEQ ID NO: 1236 - protein, 992 aa, Heterodera glycines
  misc_feature (10)..(10): Xaa can be any naturally occurring amino acid
  genomic DNA sequence=SeqID_420; coding sequence=SeqID_840
PIKACADKLXREIEQFGNPPVFGYQSSEEMSKNGTELAKQEEEVDQIIKDKSKGKKSKALAKTVAAKFQWQIMQSLGLNDAEIAEFSKSEHWLTYFPPKCMADLRKMGLAVDWRRAFITTEANAYFDSFVQWQFRKLRSENLIQFGKRYTIYSPKDGQPCMDHDRSTGEGVGPQEYTLIKMQILEPKPKVLSNVSASNGKPMFLVAATLRPETMYGQTNCFIHPDITYSVFFVGTNDQEIFIATERAARNMAYQGMTAENGKIRFVPGVERVKGAELIGCALKAPLTSFERIYALPMLTIKDDKGTGIVTSVPSDAPDDFAALMDLKKKKPLREKYGILDEMVMPFEPIPILEIPEYGRLAAVHMCEKLGINSQNDRLKLEEAKKELYLKGFYQGVMLVGNYRDQKTEVVKKLIQADMIRDGQACKYVEPEKKVISRSGDECVVALCDQWYLNYGDPAWKEATRKCLASLNTFSDEVRRNFEHTIEWLHEYACSRSFGLGTKLPWDPQYLIESLSDSTIYNAYYTVSHLLQNDIYGAETGELGILPPQLTDAVWDYIFMGNLYDSTKMPIEEAKLKRMRHEFEYWYPVDMRVSGKDLIQNHLTYYIFNHVAIWRKQPQFWPQGIRANGHLLLNNEKMSKNTGNFLTLFDAIELFSADGMRFTLADAGDGIEDANFMYEMADAGILRLYAFLSWASEMVEACAKGELRKDGIETFADKIFNNEMNRLILVTGDHFERTLFKEALKTGFFEYQLARDNYRQLCGSDQAMSAVLVLRFIETQAIILSPICPHVSERAWELLGKPGLLVTDARWPVTAPAIPLLVDQSNFIHNTVHEFRLRRDAKLCPKKKDPKKQLQPPKSATIYIAKRYPSWRGKLILELGQMYTVNNGTLPDNRTLLEKLSKPESAEEKKERMSFVQMFRDRIAQRGIFAVTSEEEFDQKAALSQISDFLLSTLQLEEVKFADSANAPSDVIRNSCCPGAPLIMYDFVETTNN

SEQ ID NO: 1237 - protein, 543 aa, Heterodera glycines
  genomic DNA sequence=SeqID_342; coding sequence=SeqID_846
MTTTAPIATEEGEDSLYPIAVLIDELRNEDVQLRLNSIRKLSTIALALGVERTRKELIQFLTDTIYDEDEVLLALAEQLGNFTPLVGGPEYVHCLLPPLENLANIEETVVRDKAVESLQKIAEKHSAAQLEEYFIPMVLRLSAGDWFTSRTSACGLFSVAYARANPAQKTELRAAFRCLCRDDTPMVRRAAASKLGDFAKVQEEDYLKNEITQMFEDLAKDEQDSVRLLSVEAGIVIVGLLSEDSAKLAQVKPIAVSLVQDKSWRVRYMAADKIVQIQQAFGTKIGIEEIVGWYTGLLKDCEGEVRDAAAEKLQSFCAALSEEGRKKGIIEEILPVIRPLTTDANQHVKIALAQVVMGLAPLLGNQCTIEHLLPIFLSMLRDDTPEVRLNIISSLEKVSDVIGADELQYSLLPAIIDLAQDGKWRVRLAIVEYMPLLAKQLGQKFFDEKLLKLCMNWLTDHVYAIREAATNILKELAQKFGAEWAVTMVLPRVIELASDSNYLRRMTCLFCFNTLCEALNNDAIMKELFPTIKALCHDQVSNV

SEQ ID NO: 1238 - protein, 1178 aa, Heterodera glycines
  genomic DNA sequence=SeqID_330; coding sequence=SeqID_856
YFIVEVNARLSRSSALASKATGYPLAYIAAKLALGESLVTLRNTVTRDTTACFEPSLDYCVVKVPRWDLAKFADVNRKIGSSMKSVGEVMAIGRSFEEALQKAFRMVNDHNDGFSPHIFKEKVTEKDLWDPTDKRMQAVARALYTNDEFVHFLHQCTRIDKWFLYRMKTIVDMYRTLEGQEMEYVSPDLLLRAKQLGFSDAQIGTCIGRNEDEIRKLRHLHSIVPMVKRIDTVAAEWPAKTNYLYLTYNGAEHDIEFEQKKSNSVIVLGSGVYRIGSSVEFDACAVGCVQELKRLGFKTVMINCNPETVSTDYDMCDRLYFEEISLEVVSGIYENEHPNGIILAFGGQAANNIALSLQLASPNLTVPIKVFGTPPKFVDEAEDRFQFSRALDELDISQPKWKNAKSVEEAVGQCAAEVGGYPCLIRPSYVLSGAAMKVAHNEEDLSNFLSEAALVARDKPVVVSKFIENAKEIDVDAVAIGGRVLVSAISEHVENAGIHSGDATLITPPQDLNAFTTRKIHEIIRHIARRFNVTGPFNLQLIAKDDNLFVIECNLRVSRSFPFISKTLDIDFVALATRAMMWTQEPTKFIQSFTRPEQSNNKVGVKVPQFSFSRLTGADVVMGVEMLSTGEVACFGRTRREAYLKALLSTGFQLPKRVIFLSIGYKQRAEMLESVRMLDRLGFTLYGSKGTADYYASENIKIKNLEWPFEEKDNYHVYGAKMNTVAEFVEKKIIDFMIILPIRGSGAYRPGAYRTHGYNTRRMAIDNGIPLITDIKCAKLFITVMSWMSRLPPMDASVDCLSAESLVRLPGLIDVHVHMREPGGEHKETWESGTRAAVAGGVTMVLAMPNTQPPLVDEQSFAIVEQLAARAALCDYALYMGATEQNVALGPTLGPKCAGLKMYLNETFAALRLSSVEQWMEHLHHFPAHRPIVVHAEGQTLAALLFAARLCERSVHVAHVARAEEIALIRAARRNGQPGVTCEVCPHHLFFTADDLPEGMREVRPRLATARTDCEALWRHIDDIDCFATDHAPHTRAEKCSDNPPPGFPGIEFMLPLLLQAVADGRLTMQQLVEKLHDNPRRIFGLPEQPDTYIEVEMNEVWTIPESGGWSKAGWTPFAGLQARGRVCTVVIRGQRVYDEGQFLVGPGFGHNVRLLPGAMAATASNLPSPSPAAELTA

SEQ ID NO: 1239 - protein, 391 aa, Heterodera glycines
  genomic DNA sequence=SeqID_323; coding sequence=SeqID_859
MIGGLFVYNHKGEVLISRIYRDDVNRNAVDAFRVSVIHARQQIRSPVTNIARTSFFHIKRGNVWMCAVSRRNINASMVFEFLNRFADTMQSYFGKLNEENVKNNFVLIYEILDEILDFGYPQNTDPGVLKTFITQQGVRTASKEEQAQITSQVTGQIGWRREGIKYRRNELFLDVIEYVNLLMSQQGQVLSSHVAGKVAMKSYLSGMPECKFGINDKLTIEGKGRTGTDDPSKTSRASVAIDDCQFHQCVKLTKFDTEHAISFIPPDGEYELMRYRTTKDIQLPFRVIPLVREVSRNKMEVKVVIKSNFKPSLLAQKIEVIIPTPPNTSGVQLICMKGKAKYKAGENCICWKIKRMGGMKESQISAEVDLLNTGNAEKKKWNRPPVSMNFE

SEQ ID NO: 1240 - protein, 134 aa, Heterodera glycines
  genomic DNA sequence=SeqID_450; coding sequence=SeqID_860
RQINNGVFVKLNKATIQMLRIADPYIAWGYPSQKIIRQLVYKRGYAKESGQRIPITDNAIVERNMGKSDVICVEDMIHQIWTVGPHFKQVTNFLWPFKLSNPVGGFKKKSNHFVEGGDYGNREDQINKLLEKMI

SEQ ID NO: 1241 - protein, 538 aa, Heterodera glycines
  misc_feature (335)..(335): Xaa can be any naturally occurring amino acid
  genomic DNA sequence=SeqID_364; coding sequence=SeqID_861
ILPSPIQNEGKDEWANVVTRDPWFKGHENAASKTVAIKEPPPYGHRKGFVPRTPEDFGDGGAFPEIHIAQFPLGMGMERAVGRNKDKTVALQFDEEGKLRFDEIARIGHGKDKIVHSRLSDMKSKIIDEEDESFHKPTEDEVEQTTEATRMALEKITTAKIAAALPVQHAKKTAPAQYIRYTPSQQSGLNAGGAQQRIIRLVEEQKDPMEPPRFQINQKIPRAPPSPPAPVMHSPTRKVSAKEQADWKIPPCISNWKNPKGYTVALDKRLAADGRGLQQVHINENFAKMAEALSIAERKAREAVETRAQMERRIAQNKKTEQEKRMRELAQNARXKKPIKKNDDTNALEEAKEREMIRRDRIEDHRRDRNIARSRPDKLEKLKRDKERDVSEKIALGLPDSRARESGETQFDSRLFNQTGGLDSGGIDDETYAAYDKPWRPQDGIQQHIYRPRKDIDSSIYGADLDRIISTNRFVPDKGFSGADGAGKEGGQRSGPVQVREEEDIFGLGELLQTTSSSAKRKATESEELPSGIKKSRR

SEQ ID NO: 1242 - protein, 590 aa, Heterodera glycines
  genomic DNA sequence=SeqID_448; coding sequence=SeqID_866
MDPYLQELINKWLCWDKNETTRTEIERLVKENNVHELRLRMVGKLSFGTAGVRTHMEAGFARLNELTIIQLSHGMARHLTSEMGEDGKKKGVVIGFDGRHQSKRFAELAANVFVLNGLSAFLFSAVVPTPVVSFAVVSLGCAAGIMITASHNPKEDNGFKAYWANGAQILSPHDTEICRIVAEESKPEEAYWDTVQLGTSAFLHSADSVLEKYFAGESAICCHHKSLNQTSSLRLTYSAFHGVGSKFVRRMFAEFGFPSENISYVKEQDEPDADFGTVPFPNPEEGHRVLKLCIETANANDSTLLLVNDPDADRLQLAEKEANGEWRVFSGNEMGILLTWWAWTNWRAANPTADSSRVFVLHSAVSSQMVATMAKKEGFKAAHSLTGFKYIGNLAHKLRSEGNTVIAAWEESIGFTPGTTLDKDGVSSAAVFAEMANWLRTQKGVSLREQLFRLFSIYGFHLQRNSYWGVKSTEVTKKLFADLRSDYPETIGQNFDVKFVRDLTTGYDNAQPDDRAILPLSTSSEMVTFTLVDGSAVTLRASGTEPKVKYYIELRTEPGKEEKDLSSMLEQLDQLESDVVEVSSSRPNTD

SEQ ID NO: 1243 - protein, 423 aa, Heterodera glycines
  misc_feature (66)..(66): Xaa can be any naturally occurring amino acid
  genomic DNA sequence=SeqID_463; coding sequence=SeqID_870
PLPTCREEFPQEPISLCPSVGRSFPSSATRPNPWSISFFTSTPRRSVAFCAFEPPMMEMDNDGLMXACTVRRQSEQIKTGTENPWDEEKRNQILQTAHVMVESHAFMEKCPRFELNRTIHLGGESFSIEDLLGQGGFARVYRANSREDGCTYAIKYESPACPWEVYICSALKRRIPSQFAAYLMEVRDAYIFKNASAIVYEYFPKGTLLDLTNVYKKNGTVVGGLLATFFGIHLARALRQVHETANIIHADVKPDNVMLLTAALNAHDSLDNLLKTPVLKLIDWGRSIDMNHFQGVEFHGKAGTENFDCVEMKTGMPWTFQTDFYGFCATMYVMMNGEYLVTFKYSQTDKVVPVKQLKRRMALYDVWTQLFDQFLNIPNCKQLPKWLNTLDQMESRLAEAVKTEPLEWKRAIERFNEFVKQRG

SEQ ID NO: 1244 - protein, 311 aa, Heterodera glycines
  genomic DNA sequence=SeqID_393; coding sequence=SeqID_879
MAEYDLIKRLIPFFDLHLVIPLLEYIEQQKIYDEESFKKVHLAVLQKTNMVDSLIEGWGKDERLLEQFQAKKQQVLEERERLKDMCDSAAEILDHKDVKEMTESTTRDREGNNKVLEYIGERFGFTMEMLDSLYKYGKFLYECGNYLAASTYLDFYRNLIPQHDPNYLNAQYGKLASEILLQSWDHAKDDLNRLRAYVDSEPFGSELELLQHRAWILHWSLYIHFNYPKGRDEVIDLCLNQQPYLNTIQILCPHLLRYLAVSVITSKNKQKASLKDLVKTIEVVSGGEYCHNNWNWDVFICHFRVLQHKMF

SEQ ID NO: 1245 - protein, 217 aa, Heterodera glycines
  genomic DNA sequence=SeqID_426; coding sequence=SeqID_893
KKYFFCSKDQATRAISQSWRQPKNGEDALEFQHKFYRELYPKITADIRQIEQNWREGRHRLERINCQSENSKGVYCLQYDDEKIISGLRDNTIKIWSRPSLGCVQTLSGHTGSVLCLQYDNQMIASGSSDATVRIWDVNTGEQLKTLVHHCEAVLHLRFQDGMLVTCSKDRSIAVWDMASPRDIEVRRVLVGHRAAVNVVDFDHKYIVSASGDRTIK

SEQ ID NO: 1246 - protein, 187 aa, Heterodera glycines
  genomic DNA sequence=SeqID_347; coding sequence=SeqID_894
AERERLLQAEREYITRRVLKIVELKETVCAGGDQGFVVINQKGIDPPSLDLLAQHGILALRRAKRRNMERLQLACGGEAVNSVDDLTPDVLGWAGSVYEHVLGEDKYTFVEECKSPKSVTLLLKGPNKHSITQLKDAIYDGQRAVANALKDGAVLPGAGAFEIAGYCALKKLADNVKGRAKLGVLVP

SEQ ID NO: 1247 - protein, 164 aa, Heterodera glycines
  genomic DNA sequence=SeqID_471; coding sequence=SeqID_902
QRLHEFMEGFREIATELRITYQMITIQGDVSLGNVPPFIYFFTVFHPELVDSLDPFAEGIAFNVRPPKKSWKQITNLSGGEKTLASLSLVFGLHKYKPTPLYVMDEIDAALDFRNVSIIANYLLERTRNAQFIVISLRNQMYEKANRLIGIYKVRDCTKNVVVN

SEQ ID NO: 1248 - protein, 477 aa, Heterodera glycines
  genomic DNA sequence=SeqID_315; coding sequence=SeqID_916
PNAVVIFDRPENSQMNLIGHSKGKSSHRALVNPDWDFQQLGIGGLDKEFSSVFRRAFASRVFPPEFIEQMAMKHVRGILLYGPPGTGKTLIARQIGKMLNAREPKIVNGPEILSKFVGESEANMRKLFADAEEEWRRCGPNSWLHIIIFDEIDANCKQRGSMGGSSTGVHDTVVNQLLTKMDGVEQLNNILVIGMTNRKDIIDEALLRPGRMEVQLEISLPDKQGRIQILNIHTAPMREHNKLDSDVNIEQIAKRTKNFSGAELEGLVRAAQSSAMNRLVKPGGKVQQVKDTNGRKKEKPKGQFRWTTKQLTLNRLLYGGLCLWGDCVSRVLEGGRLLIKETAAPDTRGFVRALLAGPPNTGKSFLAAQIAKDSEFPFIKVCTPEEMVGYSEAEKCAKIRKIFEDAYKSPLSCVIIDNIERLMDYSPIGPRYSNMVLQTLLVLLGKRPTQNIVCLSWPPRRMSSFCTRPTCSACSAK

SEQ ID NO: 1249 - protein, 748 aa, Heterodera glycines
  misc_feature (134)..(134): Xaa can be any naturally occurring amino acid
  misc_feature (180)..(180): Xaa can be any naturally occurring amino acid
  genomic DNA sequence=SeqID_326; coding sequence=SeqID_920
MGVLTLNIECREKGVKKTMQFEPRTLVHDACRLIRDKLGHMPGNPNDYGLFRLEDNPTKCVWMENGRTLEYYLIRNGDTLEYKNKIRPLRVRTLDGGAIKTVFVDESQPVSQLMVVICSKMGIANHEEYSLVRXSIAGGDGQRSGERNGQGRKGKDAVLKRRNGRSAAETAQRVGAHVHXTIGRKKERQIQQLRAKLHTDAEINWVDHSKTLREQNIGEEEELTLRRKFFFSDTNVDTRDPVQLNLLYIQCRDGVLRGLHPVSRDTAIKLAALQCYIEYGPYRWRTLAFSAKNLLPKEYAKAKELEKNIIQEYRELMYEDSAAPKKKYCELCQSLPTYGVTFFLVKEKLPGKNRLIPRLLGVNKDSVMRVDERTKAVLKEWPLEQVRRWAASFKTFTLDFGDYKDGYYSVQTLEGERIGQLIGGYIDIILKKKRIVDSGGIEGDEGATMVEDIVAPAKATLLAHSDLAPPYPAPEGYLPHGAFRPTAETPAGAPQYGGVSGMIIAQEIPKGERIRYLDARERSQKALVGTIEATIRAVEEAEEEIQKPPQIELPQFGETQRHWRVEVEKEAVSDRLAAMGAATAEVVQLTAIPEETLDTRVGHAIATIGSNIPEMGRGVRQLAAIMPDESRAGDLMDAARKLCNAFGDFLEKVHPEKQEKRATILSAASRVGELSHDMISTMHEQTEEERTFHEELNRRARAVATSTAQLVLQAKTVSAECEEPALKDQVIHSAMKTAFATSELVACT

SEQ ID NO: 1250 - protein, 157 aa, Heterodera glycines
  genomic DNA sequence=SeqID_439; coding sequence=SeqID_925
NTHETARAIKHMPLKRAIRFLENVREKKEIVPFRHFNGGVGRKAQAQAWGTTQGRWPKKSAEFLLQLLRNAESNAEVKGLDVDHLVIDHIVVQAAAKMRRRTYRAHGRINPYMSSPCHIEVILTEKKDVVAKPAGALVKVKKESKKKQRRQLARGEF

SEQ ID NO: 1251 - protein, 564 aa, Heterodera glycines
  misc_feature (63)..(63): Xaa can be any naturally occurring amino acid
  genomic DNA sequence=SeqID_449; coding sequence=SeqID_932
LQYQRELELLEKENKNLKQRLLLKDAGELKRQKKIKRSLIELYSEMLDILIEFDSSYGTADNXPRVVVVGDQSAGKTSVLEMIAQARIFPRGSGEMMTRAPVKVTLSEGPYHMAQFRDSNREFDLTNASELEQLRNEIELRMRNSVRDGKTVSNEVISLTVKGPSLPRMVLVDLPGVISTVTTDMARETKEDIAKMCKQHMENPNAIILCIQDGSVDAERSNVTDLVTNVDPDGQRTILVLTKVDLAEKNLSNPHRIKKILDGKLFPMKALGYFGVVTGMDKRDASIAEIRKYEEDFFESSKLFRDGVLKATQMTTRNMSLAVSDCFWRMVRESIEAQADAFRANRFNLETEWKNTFAHQRDLTRDELFDKARGEVLDEVVNLPYFKVESTSSFNTVVDIKLKHWAEKELANRSVQVGWETLSQIFRRQVSGEERGGQTLKSNRTHGSQKSPDGGNLLKALKAAVVSAVLEQHRWDSKALDYLRVIQLNAVADQVVPDRRAWDQSCAFLANAASDRIRELKKTLEESRGPSGWSRWFGWGSPTPEQLVNQTVQDELRALLVNNP

SEQ ID NO: 1252 - protein, 156 aa, Heterodera glycines
  misc_feature (109)..(109): Xaa can be any naturally occurring amino acid
  genomic DNA sequence=SeqID_493; coding sequence=SeqID_949
MRIKKIEIEGFKSYSQHEAVRDLDPEFNAITGLNGSGKSNILDAICFLLGITNLAQVRVHSLNELVYKQGQAGISRATVTITFDNDVPPDKQPAGYNKYKEIVVRRQVXYQINGTSATNQRVSDMFRQVGINVNNPHFLIMQGRITKVLNMKPMEV

SEQ ID NO: 1253 - protein, 460 aa, Heterodera glycines
  genomic DNA sequence=SeqID_461; coding sequence=SeqID_953
HYERDTSNRACTVIDECQFPQLNDCHPSAECTDLAQGYTCKCRSGFRDVSPSKEKPGRVCRAMVNECQFAHLNDCHQNAQCLDLEDGYQCKCENGFKDVRPERPGRLCQQMVNECARADTNSCDKNAKCVDEENGYRCECKSGFADVSPTPTLPGRACRPIVNECAESKLNDCDRLAKCVDMEDGYRCECPANSRDISPSPAFPGRVCHIFENECLTGKHDCDPQAQCHDNEQAFTCECPEGFTDRSPNKQHRPGRVCVKLVDECKEDHDTCSPNAECRDLEEGYTCECRDGYVDRSPNLAVQPGRVCGAPETCPANHDCSAAAVCEPQGGNKYTCTCIQGYVDQSPDGLQGRICVRNSFCRDPKLNNCSRKAVCYEEGQGYRCECARGYVDKSPDGTPKGRVCELPPAPAQPQRHPCQDGSHDCHTKASCRAVGATGFVCECLPGYEDKSPDPKNKGGR

SEQ ID NO: 1254 - protein, 671 aa, Heterodera glycines
  genomic DNA sequence=SeqID_460; coding sequence=SeqID_955
MVSPDEVAEEYRAALSELTRNDKTQINLLTILAEDYASYASAIVAVIEERLFKCPSPMKIVMLYVLDSIVKNIPATSGAYRDLFAKRIVDMIVHVFKEGDEKTRASVYRLRSTWSEIFRQSCLYAIDMRLNRIDKAWPILTPRGVVHVNPLFLNGKPQQQVPSQPVSLPPPVVTSVPPPVSLPPPVVTSVPPPVSLPPPVVTSVPPPVSLPPPVVTSVPPPVSLPPPVANPPPMVQNGGPLLVEQKPPPLFFPRGPIQQQQQHHIQNVTPKLPGVPENNRIFVDGKAYEVFYLDDVAAIERNGLPHRVSFAGPDRDVVIDGTAYRMAFGQHKQVLIDGDLHTLRFGAPSRELFMGNFPFKGAFGGPPIIATINQRRHEIRLCGPPPEVRIDPEPSYELMRYMPAVRQQQPTMVQPTKTDGTEGDRKRKRESPPIDVSRLLKRLKETGLLTQPPNEAERNQRKKQVEIEANAAPIPSNHRLDNIERRATPMSGLEQFSMRSLIMSVFGVCRYDSVIDAIHRPRVVCQYCGIAFQKLYNEAYQRHADWHLQKTIRIEGGADKSAVEDEKGTAAVSHQHTAGTNRDAPSEIVESKVGQKRICQFDANIAFSFHRNAKFAMNNSRSIGTRRRTCGAFGTAYFRMGRCAKEGKNRCHFVVLGISYFLQRGRHPRGS

SEQ ID NO: 1255 - protein, 376 aa, Heterodera glycines
  genomic DNA sequence=SeqID_333; coding sequence=SeqID_957
IPFSYRMRYLDLIVNPEVRDKFVTRAKIITFLRKYLDALGFLEVETPIMNPIAGGATAKPFTTHHNDLDMKLYLRVAPELYHKMLVVGGIDRVYEIGRLFRNECIDQTHNPEFTSCEFYMAFADYEDLMRITEDLLSKMVHSIFGTHKLTYHPNGTDKEPVYELDFTPPFKRINIYDELSTILGVQLPDADKLDTPEARDFFDRIATEHGVDCTQPRSCARLLDKLIGEFIEPKLINPTFLTGHPQIMSPLAKWHRSRPGLTERFELFACTKELCNAYTELNDPLRQRELFEQQAKAREAGDDEAQAVDENFCTALEYGLPPTAGWGMGIDRLTMMLTDSHNIKEAKIIFENEKFVKKNFIEILQKKKKNYVGFEF

SEQ ID NO: 1256 - protein, 391 aa, Heterodera glycines
  genomic DNA sequence=SeqID_481; coding sequence=SeqID_967
SLKSYIYHQLVKVEYTGAVDDIFYAGTGLLLLKNADSVQMYDLQQKRVLASVKATKVKYVIWSKNMECAALLSKHTVTLVTKRLEVLGTVQESTRVKSGAWDAGNEAFLYTTSNHIKYALTTGGDHGIIRTMDIPLYILAVRGSRLYCLSREASPVELSIDLTEFRFKLALTHRRYDEVLNMVRNANLLGQSIIAFLQKKGYPEVALHFVKDEKTRFGLALECGNLQVALEAAKVLDDKTIWVALGEAALLQGNHQIVEMAYQRTKDFERLAFLYLITGNREKLQKMLKIAQIRKDVHGQFQCALMLGDAQERTKVLKELGQLPLAYLSSVTHSLDEDAEQLRAELEQRQIAVPETNTSATPLLPMTPLNPLVDNWPQLTVSTGPFDAQQL

SEQ ID NO: 1257 - protein, 252 aa, Heterodera glycines
  misc_feature (32)..(32): Xaa can be any naturally occurring amino acid
  genomic DNA sequence=SeqID_369; coding sequence=SeqID_984
EDNLFEQFILSTQISYCYYADSHRILGNTFGXLVLQDFEALTPNLLARTVETVEGGGLVVLLIQSVTSLKQLFTMSMDVHKRYRTEAHADVVGRFNERFILSLASCANCVVMDDCLNVLPISSSVLNMANLPPVVAQQKSAAGGDVSSELARLQQSLADTKPIGPLLHRCRTLCQAKALLRLLDLVTDKMSNSMCAITAARGRGKSAAMGLAVAGAVGCNLTNIFVTSPTPENVRTLFEFVLRGFDAIGYQV

SEQ ID NO: 1258 - protein, 130 aa, Heterodera glycines
  genomic DNA sequence=SeqID_376; coding sequence=SeqID_991
MIYHRFVEIGRVVYIAKGKDQGKLAVIVNVIDGNKVLLDGPSSGVPRGVWNFKDLQLTKFTLPLRIGQRTKGVREAYETAKINELWQGTEWAKRIDRKQKRAGLNDFERFKVFKAKQHPKPVWSALRWLN

SEQ ID NO: 1259 - protein, 396 aa, Heterodera glycines
  genomic DNA sequence=SeqID_340; coding sequence=SeqID_994
GTASYYASLSIRARDPDARVLIITDEHETPYKRGPLSKELWWFADEASIDSLSHTNPTSSTGRRRYAFYEADGFYLPPDKLDEWEHGGVGLIRGAKVVKVDTEGSFVLLEDGRKIEFGKCLIATGSDAWLHTQLEHLPELDDFVTTLGKASDFRKIYSKVDKMAVAENGTQNVIVVLGGGLLGTELAYSLNRRYARDQENPALKIVQLCQEPGILSEILPDALSDYSTDMLRYQGIEVLTDTRIDSASVKGRDEKRRRICLNTTAATTSDGPKERKQVMADFVIIALGAEPNIELVDEKSSIKLDKANGGVMTDEHLRVCDNVWAAGDVCSFVDPVLKRRRRCTHWQHAQITGRIAGENMTDGHKTYTHQVIDTFGIRERSSQCSAHMLMSVELAT

SEQ ID NO: 1260 - protein, 91 aa, Heterodera glycines
  genomic DNA sequence=SeqID_395; coding sequence=SeqID_998
SNKPPPQKRQYSSTSKNFCDLCNKEVCNKYFLRTHMLKMHNIIIDENKQLIANIDTVDKERKGEVKFRCDICHTSMNTREELKLHKRESHG

SEQ ID NO: 1261 - protein, 544 aa, Heterodera glycines
  genomic DNA sequence=SeqID_480; coding sequence=SeqID_1009
MFFSAPNPNGQFTIVIPPPNVTGTLHLGHALSTAVEDTIARWHRMCGRTVLFVPGCDHAGIATQVVVEKKLKRERGLSRHDLGRADFVKEVWKWKNEKGHIIYDQLKKMGAGVDWDRVVFMMDPKIMRAVTEAFVRMHEKGVIYRSKRLVNWSCALSSAISEIEITGRTLLSVPGHAEKVEVGVLVLFAYPLEEEVVEEDGSKTREIVVATTRLETMLGDVAIAVHPEDARYKRIIGKHCVHPFFPDRRLPIIADSAVLPDFGTGAVKITPAHDQTDFDIGQRHGLPLINIFTDHGSCAPCCGPFAGMHRFSARLAVRGRLKAMGLYRDTKENPMQLRICSRSKDIIEPIIKSQWYVRSSEMAKRAKAAVVDGRLRLIPEYHVNTWNAWLNDIRDSVHLLVSFGGVTKSRPLLSPLTAIILRHRRETMKSVDDEESRGRAGHVVLRRHRGPFSVDGLGPKQNGGQAPLFSPALWLETGHDISFFWVARMVVIVAGTVRRATAVLRKVRCNNFIFIPHQYKLQRASRSPFPPNYSFEFPNQLKKT

SEQ ID NO: 1262 - protein, 170 aa, Heterodera glycines
  misc_feature (154)..(154): Xaa can be any naturally occurring amino acid
  genomic DNA sequence=SeqID_383; coding sequence=SeqID_1011
EQEAQKIREMQNEMEKQFQSGTAVTGTGSPVIPNPMSLEEKQLVDARSIYVGNVDYSATPDQLEEHFRGCGAIERVTILTDKFTGHPKGFAYIQFADVDAVNTSTSLNDSLFLGRQIKVVPKRTNVPGLSSTNRPPRGMRGGRGSGRARVIVKXIYSERRSRGRPPRWQT

SEQ ID NO: 1263 - protein, 155 aa, Heterodera glycines
  genomic DNA sequence=SeqID_367; coding sequence=SeqID_1012
PCIDVGNLLLIDVETDAEGLASSNSERINELTSKNAQLLFNEIWKLPRKIVQDATCSQLPEYTYGLPREKPIPKPKEPTKWEKFARAKGITKKKDRKVWDKTTQEWKPKYGYRRAENQSKEWLIEIPDQKAHTKIILLRRRRKSGKRITSRSCNG

SEQ ID NO: 1264 - protein, 501 aa, Heterodera glycines
  genomic DNA sequence=SeqID_528; coding sequence=SeqID_817
AYFVMAADNFDAQRILNILAERDNFQSNELADQLAIDHQRLIGAIKSLQVKEGLVCTSEVKIKRIELTTEGEEIIQKGSHEFNVYKIVGEKGISKSEIEKTSFGPIGLGKAMQCGWVGMDTRDGVPLVVRKVANAEDGAKEQLKLVKNGKGDQLTAQCVAQLKKRKWIMESAIKALSVAKGPNFTTTVQKQELDLTSEMIASGSWRGKQFKQYNFSAMGVPPPSGHLHPLLKVRAEFRDIFFQMGFSEMPTNRFVESSFWNFDALFQPQQHPARDSHDTFFLSKPALSTEFPEDYLESVRKVHSEGGFGSIGYRYDWKLEEAQKNLLRTHTTAVSARQLYLLAQKPFQPSKMFSIDRVFRNETLDAAHLAEFHQVEGVVAERNLSLAHVIGLFTEFFRKCGIENLRFKPTYNPYTEPSMEIYAFHTGLNKWVEIGNSGMFRPEMLLPMGLPEDVAVAGFGLSRTRPTMIRYGISNIRELFGHKIDLEMIYRNPLCRLEQKN

SEQ ID NO: 1265 - protein, 133 aa, Heterodera glycines
  genomic DNA sequence=SeqID_410; coding sequence=SeqID_954
HMTEEERRNYLRMNPKIITNQQNKGKYKFLQKYYHRGAYFLDKEDDVLRRNFAEATGEDVFDKSVLPKVMQVKNFGKASRSKWTHLTAEDTTDHQGVWATPTPLSAKFVAKHAAGMKNVFEKPSAKKRKIGGD

SEQ ID NO: 1266 - protein, 129 aa, Heterodera glycines
  genomic DNA sequence=SeqID_491; coding sequence=SeqID_976
QQMHNQFLPLATALSYIRQYHSPSVYGKSDELLQLRIELNMTTEKATKFVSDSRQLVVLPHPFQHSEKRTILAFAGTKEAQQEVMLNGADIAIGPEMVKKILKGQFNMDDYDFCIAHTDMAKHILPLRG

SEQ ID NO: 1267 - protein, 326 aa, Heterodera glycines
  genomic DNA sequence=SeqID_403; coding sequence=SeqID_995
LLLPTEMPFRDRTAEFRTVAKSCQLRQQPNGYMGKSEREKIVNSSIQFNQLAKRIGRDLSMTCAKMEKLAQLAKKKSLFDDRAGEVEELSQIIKQDITGLNKQIANLQQLATHRTSGGSSVSLRQEQQSQNHSKLVVVGLQSKLANISKNFQNVLEIRTENLKFKRERREKFSQSAAIPSNLPPSTSNGQMGSLLLHDEMASASSGSSTFALDMDKLEQQRVQEQTTLLLDDTEQFHQSRFNAMESIESSISELGTIFRQLATLVSEQGEMITRIDSNVEESSLNVEAAHHELLKYFNNISRNRWLIIKVFGVLMAFFVFFVIFLT

SEQ ID NO: 1268 - protein, 680 aa, Heterodera glycines
  genomic DNA sequence=SeqID_408; coding sequence=SeqID_1005
KCFRNNRRPLSHLCRNSPRLFLPCRNNNNNNNRVSLPCRNSPRLFLPCRNNKPPFHPCRNNSNRLFHLLFLPCRNTNNRLFHPCRNSKPCRNNNRIFLQCRNKTLLLKCRNNRPLFHLCRSSNRLFLPCRNNNSRLFLPCRNNNSRLFLPCRNNNNRVSLPCRNNNNNRVSLPCRNSPRLFLPCRNSLRLFRLDFTVQVIWLPFAMTKNRFRSLSSRDFCFSLKSPFWMYGPQTSSRKINGNLKKMFFLKQGSAFPPGQPPQPQRQRLDPDMMPSLVQVAEDDQSTRSGLFPTGFPQAESPPLVSTEIIAQDQGNANPKFMRSTLYAVPQSQDMVKATQLPLSLAICPFAKLHQSEYPPPVIDLGEIGPVRCQRCKAYMCPFMEFIDGGRKFRCPFCRASTPVEDGYFAHLDHTGRRTDIQHRPELYLGSYEFVATKQYCKNGTPPKQPAYIFMLDVSYNAVRTGLVELFCRNIKDMLRELPRNFRAGASSMRIGLATYDQTVHFYNLSQPGRAEMLVVSDIAEVFVPFVDGFLVEFEQAENALTVCLREIVNNFAHTRITETALGPTIQAGLDALRSADRAGKLFIFHTSLPVLDGAPGQLKNREERKLLGTDKEKTMLTPSIDFYAKLGEECVKWGCAVDLFLFPNAFVDVANIAPAVTTTGGIIYKYQYFDVRFCNI

SEQ ID NO: 1269 - DNA, 443 bp, Heterodera glycines
  coding sequence=SeqID_1493; coordinates=27-374
  peptide sequence=SeqID_1706
gggtttaattacccaagtttgagaatatgaatactcctgctgcctatgagccgtttctgttggctgatggagagaaaaaggtggtcattgagaaggacacaaaagtgccgaatgcggcggtgtttacttttaacaaggaggaccacaccctcggaaacctcctcaaacatcagctcctcaaagatccgaaagtgctttttgccggctaccgaaacccccaccccttggaacacaaaattttgctccgtgtccaaacaaatcccgaaacaacgccaatggaagcattgaacaatgccattgaggatttggtggcggagttttcattattggaagagcgatttcgagacgcgataagggaaaaacgagaagaatgagaaattgttcttgtttacggaactgattattttattttatttttcaataaataaataaaagtaaaaaaa

SEQ ID NO: 1270 - DNA, 708 bp, Heterodera glycines
  coding sequence=SeqID_1494; coordinates=75-518
  peptide sequence=SeqID_1707
gggtttaattacccaagtttgagtacgattattatcttgcacgaatccaattgtttcctatcttagacacttaaatggcactgaaacgtatacaaaaggagctgcaggacctcggccgtgacccacccgcccagtgcagtgctggccctgtcggcgatgaccttttccattggcaagccaccattatggggccaccagaatcgccttaccagggcggcgtcttctttctgaccatccacttcccggcagactatccgtttaagccaccgaaggtggcgttcaccactcgtatttatcatccgaacatcaacagcaacgggagcatttgccttgatattctgagatctcaatggtctcctgcactgactatctccaaagtcttgctttcgatttgctctcttctctgtgatccgaatcccgatgatccattggttccggagatagcacgcatctacaagacggatcgtgaaagatacaatacgttggcgcgggaatggactcagaaatatgcgatgtgatcgacggacattggcacccgggaagaataccctcacgaccatcccttacatccaccactgaattttcttttggagtcttctctattgtgaaagcgaactttttggaaaatcggcctctcctttattatgtcgcccaagacaaatgtttctcggtaacaagtaaataaatggttgaaacacaaaaaaaaga

SEQ ID NO: 1271 - DNA, 314 bp, Heterodera glycines
  coding sequence=SeqID_1495; coordinates=39-314
  peptide sequence=SeqID_1708
ggtttaattacccaagtttgagcatcgttttcaatattatggcaacttccgaagcacccaattatgcattgtatgaacatgcagtgggttacacactattcaagatcaaggaatatgaagacattggtcaaatacaaccagaggtgcaaagtgcgatgacagatgctcagcgttttcaaacgattgtccaagttcatgcatttgacccattcagaaacactgaggcggcgcttgaaaatgcgaatagcattgcggaagggattatccacgttgatttgctgaactttttggaggctaatctaccgaaaaaaaaa

SEQ ID NO: 1272 - DNA, 1110 bp, Heterodera glycines
  coding sequence=SeqID_1496; coordinates=2-910
  peptide sequence=SeqID_1709
aatggcatcgaatttgacggttaaagttcaccccatcgtttacatgtccatcgtcgacgcctatgagcgtaagtcatcttcgaacatcaacagtcgcgtgggcaccgttcgttccgtggaaacaacggaaaaccgagcgttgggcacgttgttgggattttacgagaagaatgtcgtccaggtgacaagctgttacgccgtgccgttccgcgagacctccgacgacattcccgaaataaatgatgcattgaacagacaaatgtggcacatgtccaaaaggacttcgccgtccgaacaaatcgtcggatggttcttcactgtgcccgacctttctgaaatgtgtccgcattatcacggctattacacggggttagtcaatgaaacgccgcgaaaagagccgccgcccattattctgatcaccatggatttcaccttttcgggagagagcgccgaccgacttccgatcaaagcatacgcggcacgcgaggcgggggtcccggggaaaggagcgactcaagcgacgattttctacccgttaaaagttgaaatggacgtgttccctggcgaatccgttgcactttcatttataatgaggggtttggactcggaacggcgcgagattaaatttgccaacagtcaggagcaattattggagaatggggaacagatggtcgactggttggagaagatgctcggctacgtgaaaagggtgttggacggaggagagaccgccgacccactcatgggacggaagttaatggagattgtttcactggcgaacacgcaattgcccgccgagaagatgaagtgtttggtggagcattcgctccgagattatcttatggtctctctgctggccaatttggccaagactcagttggccctgcaggaaaaagtcacttcctcgtaaagttttgaccagtcaaaccgttgcggaaagagggaaagcgaaccaataaacgtgattcgagattattgctttgtgtccattctatcattgttttgttactccattttcgttattcgcggaactgttatcagaaattcatgtatcatatatcatcattttgacaaaaattgcctaaggacaaaaaaaaaaaaaaaaaaaaa

SEQ ID NO: 1273 - DNA, 1662 bp, Heterodera glycines
  coding sequence=SeqID_1497; coordinates=33-1559
  peptide sequence=SeqID_1710
gaatttatttttaaatagcttcattttaaaaaatggcttcttaccatgttgccattgctgctgatgaacgccaaaaatatcgctctttttgggaccaattttcgggaagagcagacaattcggcaatgatgctaaatgctaatgcagatcaaattgagtcattggacagagaaaatattctcgccctgttaccatcggtcaaaggcaaatttgtggtggacattggtgccggcattggccgtttcaccacagtgtttgcccagtcggaagcatcaaaagtggtggccactgattttgtggcctcatttgtggacaaaaatcggcagcgaaacggcgcatatgcaaatgttgttgagtggcgggtgggcgatgccaccggacttcagtttgacgagggcagtgttgatttggttttcactaattggttgttgatgtacttggctgatcaggaagcggtacaatttgttgccaatgctcttcaatggcttcggcctgacggttatctccatttgcgcgagtcgtgctcagaaccttcgacaaaaaaatctgctgatcactcaaccaccacaaccactaccagcacttcatcatcctcatcctcgtcgttgcacaacaattcgaagccaaatccgacccgttaccgcttctcatccgcctacatccaactgttgcgctccctccggcacacagacgtgcaaagcggaacccagtggcgcttcgatgtgcagtgggcgtgctcagtcggcgtgtacattgagcgacaatcaaactggcgtcaagtgcattggctggccaaaaaagtgcgtgtaacatcagcagaaaacagcatcccaaaatctattggatcgttggccacccaatttgctgaccaatggcccacggaacagcgacaatttgacggacgaatggacgaacaaaagccaggatggatgcaaaatgtgttggacaaatgcgttgctggcatcaaattgagcggcgatggaatcgttttcggtttcaatggcaggcaaacaattaaagaatttggtgttgatccacaaggattggcaaagcactttgatcgccgagtttgggttgtcgaaatggatccatttgcatatcgaaatgcgttgtcgcgcgcaaatcaatacgctgatcgacgagtccgtcacgcatggcactcaaattttgtcagtgcattagatttttggcgaaatgttggacaacggatgccaatgtttgccgcagttattggcactgaattgttggcacaactgcaggatgagcaagtgtttggcaaatttgcacaaatgctcgaaaatggagcacagtttgccaccgtggaagtgctgggcactaaccaaactcaaagcatcgacgacaaaaagctcaaagccactttggatttgcttcgttctcatttcgatgttgttgaacttgaacagatgcagcaacttgaaaatggcattaatcttttggtgataaaagcgacaaaacatcagtcattggcgtcaaaaatttatgaggacggaatgatggcgcattgccaaaagcgccacctgttaatgggcggattttgagatgacaattaattttatcagtttttgaaaaagtgttcaaatccgaattatgtgatttattatgaaataaattatgccaagcaaaaaaaaaaaaaaaaaaaaa

SEQ ID NO: 1274 - DNA, 1179 bp, Heterodera glycines
  coding sequence=SeqID_1498; coordinates=25-1077
  peptide sequence=SeqID_1711
ttagattagagtgggttgagtgatatgcatatttacaaagatccttatgctcctccgttggctccaaaagtgcctgttgatccaccgccatggtttccttcgtggaaagaatacaaagggcgaaccgaatggtgggcttctcttggatacaaagaccttgacctgaagcgtggcttgacaactggtttttatcctttttttgaggaaagggacattcgttatgttgattcgaaagtgcctgatggaacttcgatggtcgggccgcaagggaaggacagtcgctaccaccaaagtaaaatggtcaaatggggaattcccggaaagtttgaagacttccagaagcagatcagggagaactgttcgcaatacaaacaaatcgctgaaaaatgggacctcagtgacgagcacccgggcattgcggtcaacccttcgctcgactcgatcattcgccaaaaataccgtccaattggcacggtgttccctctatttcctaaaatattggcttggccgcgtttttgggataaaccaatgaatgagggctgtttcgaaaagggacttgcactggccaaatattcgctgccgatcacttggattgcttatgcaggagcacttcgtggatatgatccgccagccaccaatgtcggtcgctttgaagcagtggagtttatcatccaatcgttccggggatggctatttagtagtaggatgattctgcccgcgttttattcctttacctttggccttacttcatgcacttcggctacatttcgcgatgaggacgattcgtggaattggatcgcagcaagtgccatttgcggactcgcccatgccactataagaaataacataccgcaaggatttgctttggctgctatcggctctttgttgggcgtctcctttcaagctgttcgaatcagtcacaacggctttggaatggtccacaaccgaatgactcaaggctttcttccgtttactggcccattggactggaagcatattccaacggatgccgttgatgtgttcttcgaatttggcgcagaatcattcacttttaggcattttttgcccaaagcttaaaaagaccaagtcaagttcattgactgtatttgtatggatttaggaaatggtacaataaagtttaatgtaaaaaaaaaaaaaaaaaaaaaaaaaaaaaaaaaa

SEQ ID NO: 1275 - DNA, 1493 bp, Heterodera glycines
  coding sequence=SeqID_1499; coordinates=1-1388
  peptide sequence=SeqID_1902
tatttctaaacattatgaagaagtttgactatctcgtcattggcggcggttccggtggcatcgcatcggcacgccgtgccgcggaattcaaagtgaaagtcggactcatcgagtcggagcgccttggtggcacatgcgtcaaccttggatgtgttcccaagaaagtgatgtacaacaccgccatacatgccgagtttctgcgggaccatgctgactacggcttcgactcaatgaacgtaaaattcaattggagcaaaatcaaaaattcccgtgacgaatacatccgccgtctgaattccatgtatcagaccaacttggaaaattccaaggtggaaatagtccgtggacgggccaaattcaacaaagacggctctgtcgaagtctccagaagtgatggctcaaaagagacatgtcagggtacgcacacactgatcgcagtcggcggtgcgccgcggattccgaaggacgtgccgggcgccaagtacggcacgagcagtgatggattttttggctttgagcaaatgcccaataaaacagtcgtggttggtgccggatacattgcagtcgaattggcatcaattttggctgaccttggctctgaaacccatctgctgatccgttatgatcgtgttctgcgcaattttgacgacacaatgtcccaggcattgaccgatgcgctcatcgctggaccagttaatctcaaacagaaaacgctggtgtccaaagttgagcgttcagaaacgaccggcaaactgactgtccatatgacggacgaaagcaaattggaggatgtagacaaactgatttgggcaattggacgtgacccgttgacagctgagctgaacttggccgatgttggggtcaagctaatagctggcgactacatcaaagtggacgattaccaaaacacgaccaaggagggcatttacgcggttggcgacgtctgcacaccgaaattcgaactgacgccagttgcaattgccgctggtcgccgtttggcccatcgtttgttcaacaaggaagcggagaaccgtctcacctacgaaaacattcccactgttgtgtttagtcatccgccgcttgccacaacgggcctcagtgaaaaggaggcagtggagcgcttcgggcgtgaccaggtgaagacgtacaatgccggcttcacgaacatgtactttgccatgactcaacacaaagagaaaacccacatgaaaatcgtgtgccacggaaaggatgagaaggtgattggattgcacattttgggcatgggtgcggacgaaatgttgcaaggcttcgctgtctgtgtgaaggcgggtcttaccaagaaagactttgacaattgtgtcgccattcacccaaccgcctcggaggaacttgtgacaatgcgctgacaatcggttgacttatttttgtttgtttttggtggtgaactgctctaatgaatttctcttatcacatggacacatagttaggttaatgaatttgcatattttttt

SEQ ID NO: 1276 - DNA, 1134 bp, Heterodera glycines
  coding sequence=SeqID_1500; coordinates=1-899
  peptide sequence=SeqID_1891
tgcggccaccggttgacgaggattatcgcccgatccgcgtacttggccaaggcgcgtacggcgaagtttggttggtgaccagcaaagaaaatgagagagagcagttcgccatgaaaaaaattcccgttaaagcgacggaggagggaattccgcagagtgtcgtcagagaggtcgcttctctcgtcgcactcaaacagatgaaacacccaaatattctcaggctccacgacgcattcattcgccgaaagggcggcaccatcagtttgaacatcgtctgcgaaaagtgcgactgggacttgtgcgactttttgcgaaaaattccgaaaaatatgtgcgacgcgcagtgcaaatattttgcacgtcaaataatgacgggcattgatttccttcatgccaacagtattattcaccgtgaccttaagcctcaaaacattttggtgaacaaagaccacactttgcggatcgccgatttcggactgtctcggaactacggtctgcatgccaccttcaccaccgaggtggtcaccctgtggtaccgtagccctgagctgctgctccagtgcaagtacggtactgcggtcgatctttggtccgccggttgcattttggcggagctgtacacgcgcgacgcgctcttcagaggggatacggaggcggagcaattgcgcatcatttttgaaaaactcggcactccgtccgtctctgtttggcccgccgatgcaattgtccctcattctttttacgccgaaaactctccgcacataacacctccgtttgccaatcagatgccccaatatttgcccgcctccggtgttgagttgctcacggcaattttgcaatttaatccgcacgaacggccgactgcggttgaatgtctgcagcacaaatactttgtctgatcactgatcgcgggaaatgttcatttccgctttgttttccgcccatcccttactaattaatgatttgactttatcccccattgatgaccgatcacagccaatggccttgcttcacttttttttagttttgccatacatttaatcacacatttttaaaccaaaaattttgtaaagctatttgatttgtaatattaaattctctgtattatgaaaaaaaaaaaaaaaaaaaaaaaaa

SEQ ID NO: 1277 - DNA, 3625 bp, Heterodera glycines
  coding sequence=SeqID_1501; coordinates=1526-3361
  peptide sequence=SeqID_1712
ttttaaaaagaagtaaaatggtcgatgcgcaacattttacccaactgctcatcggaatgatgaactccgaaaatgaaattcgaagtgaggctgaaaaacagtacgaagcgattgcactcaaagacaaaggaccacttttgtttaaacattacttgatttcctctgcggatgttgagtctcgctctttggctttggttcttctgcggcgtttgctgtcgaattcctacgaagaattcttcacagaaactcaaattcaaaaggaccaatttcacaacgaattcattgtgtgtatcaatggtgaaacggagcccgttttgcgcaaaagactcaccgatttgttggcggaacttgcgcggaattccattgacgacaaaactggcaaacagacgtggactggcatcatgcagttcctggacatgtgcgcaacttcggacaatcccacctttcgcgaggctggcatgtcgctcattgaaagtgtgccaaatgtgttcggctccgactcgttcaaatacattgccgggattaagacaatgttccattcttcgctgctttacggtgccgacagttccgtgcggactgccgctgtccgtgcctatgtcgcgtttgtgtgcgacaatgaggagaacgacgctgtgatccgccaactgtccgacttggtccctgccgtcatcaaagtgtgccaacatgtcgtggacactgaggacgacgacgatgtgcctttgcaatgtttgggcgatttggcctccactcttcccaaaattctcgcccctcacatgagcgacattttttcgctttgtgcagggactgtggccaataaagaaaaggacgaatcgtacagacatagtggcctggaagtgatggtttccatctgcgaaagttccaacataatgcgaaaaaagggagcgctgtatttgccaccgctgatccagcaatgtctgcagttgatgaccgagttggacgacgaattggacgagtggttgcaaatggacgacgccgaggacgaattggaggaggaaacggcaacaattggggagacttcactcgaccgaatcgcttgtgcactcggcggaaaggcggtgatgaaccacgcgttgcaatgcatcaacgaactgttgaacaacggaaattggaagtgtcatcatgcggggctttgcgctctttccacgattggcgagggatgcaagcgccaaatggaaccactgatccccgacattgtgaacaattttgtgctgccgaaaatggccgacccgcatcctcgtgttcgttacgccgtttgcaatgccattggccagatgtgcaccgacttccagcccaccatccaaaagaaatgccatgagcgtattgtgcccgttctcctcgaggccatggccgacatgtccgtcccgcgagtggctgcgcacgcggcggccgcaatggcatgagacgcattcgacggtggttttatacggccaaattttcattggtttaggtgaacttttgcgaagattgtcccaagtcaatcatcagtatttatttgccatcgataatggaacgattggagtcagtgctttcacaaactttccagcaaatgatgaccaatggcaaaaaactcgtcttggaacagataatcaccacgatcgcttcggtagctgatgccgcccaggatcacttcgccaaattttacggcaatttgatgccccctctcaaatacatttttgaaaacgccaaagatgacaatttgaagttgttgcgtggcaaaaccatcgaatgcatttcgctcattggaatggcagtcggcgcggaactgttcgagacggacgccgacagcgtaatgcaagtgttgctcagctcgggagtcaaattcgagaacaatgacgacccccaaatctcctacttcatcagcgcgtgggcgcgcatttgcaaaatcctcggcaagggtttcgccaagtatttggacatgattatgccggccgtgctgtccgccgccgacttcaagccgtctgttgcgcttgtggatggcaaggacacggatgacaacgaggactgggattacatgccaatcgacgagaaccgctcgctgggcgttcacacggccggactcgaggacaaagtgactgcgtgcgaaatgttgtgctgtttcgcgcgtgagctgaaggacagttttgccgcttacgtggagcgcgttatgcaactgatgctgccactgctctcctttctgttccacgacggagtccgttctgcggctgccgagtgccttccgtgtttgttggtctgtgtcaaagggtacggggatgagtacgtgcgccaaatgtggtcggtcatcctctccaattacataattgcgattggcaaagagactgatcttgaagttctctgcgaaatgctcaatggaattgcgcaatgtgtggaggactttggagggaatgacgccattgtgacggaccaagatgtggcgaacattttctgcgtaatttaccaacaaatcgaaaactttgacaagcgacgggcggagagggaaaagaagtctaaagaagaggagcatgacgaggaggaccaagagagattagacgaaatcatcgaactcgaaacttcggttttggcccgtgtgtcggacatcatccattaccttttcttgaccaaacgcgaggctgtcatcccccactttgacaaaatggcacaaatattcgctgcccttctcaacccgcgacgccctttccacgacagacagtggggcctttgcatatttgacgatgtcatcgaatttggaggcgaattgagtatgcgctatcagaatattttcttccaaccgatggtcactgctttggccgacaaatatcccgaggttaggcaggcggccgcttacggctgcggaattatgggactgaaggggggacagaattacgcgaaacattgcgcccaaatgcttcagccattaatcaatgccattgagaagaacgggtcgagaagcaccgaagaggacacgcgggcgacggaaaatgcgataagtgcggtggcaaaaatactcaaatacaacgcgacagaagtgaatttcaacgaggttgtgccgcgtttcgtcggttggttgcccatttggaatgacgaggaggaggtgccgtacgtgttcgacttcttctgcgatttggtcgagtctcagcacgacgcagtgcgagaggacccgtctcgtgttttccacattattctaaacgctttttcgcacggtgcttttgaggacgactcggcggaagagatgcgattggtcaaaagtcggatgaagggaataatggcacacattcgtgccaatgaacagttgttcacgcaaattgtacaatcgctacaattgaacactcaccagcgaactgtgctggagcaaattttggcctgaggggggaaagcggtgacaagcgacggaactgatcagagtgatcaatgaaggaatgataagacggacattaacatcggacgaaacggataccaattaaattcaccctttattatgcaaatgttgttttgttatcactatcgttatattaattatcaccatacaaatgcgcttttctgtttacgatcctttgcgctttgttatcgttttgcattgtgttagttgtttaactaagaattgttacaaaaaaaaaaaaaaaaaaaaaaa

SEQ ID NO: 1278 - DNA, 1576 bp, Heterodera glycines
  coding sequence=SeqID_1502; coordinates=19-1443
  peptide sequence=SeqID_1713
caagtttgagcgtggataatggtatcgacaacaaatgagcaagatgaagaacaacaaaattggttgatgaaacaagacttgcaaaagctcaatccggaaaaattgacaccgctgacagaagaagtgatcagtcggcaggcaaccataaacattgggacaattggacatgtggcacatggaaagtcaacactcgtcaaagcaatttcgggagtgcatacggtcaaattcaaaaacgaattggaacgaaacatcactatcaaattgggctatgcaaatgcaaagatctttcgttgctccaatatcaaatgtccccggccgcattgctacaggtctgctgggtccagcactcccgaccgtttcccatgtgaacggcccgattgcggtggtgactttgtgtgtgttcgccatgtttctttcgtcgactgtcctggccacgacattctgatggccacgatgcttaatggtgctgctgtcatggatgctgcgcttcttctggtggccggcaatgagccgtgccctcagccgcaaacttcggagcatttggctgctgtggagataatgaagcttaaacaccttctgatcctgcaaaacaagattgaccttatcaacgagtctcaagcaaaggaccagcatgatcagatcaagagttttgtggaaggcactgtcgccgactcggcccccataattccgatttctgcccaacttaaatacaacatcgacgtcatttgtgagtatttgtgtaagaaagtgcccattcctccgcgtgacttctcttctgacgctcgtttgattgttgtccggtcgttcgacgtgaataagcccggctccgaagttgagcatttgaagggaggcgtagcgggcggttcaattttaaaaggcattttgcgagttggccaggaaatcgaagtccgacccggaattgtcactaaaagtgccgatggttctgtgcaatgccgtcccatctactcgcgaatagtttcattgtttgccgaacagaaccagctccagtacgccgtccctggtggccttatcggagtgggcactcaaatcgacccgacaatatgccgcggggaccgtttggttggccatgtccttggcgctgtagggactctgcccgacatttttactgacatcgaagtttcctaccatttgcttcgacgtcttcttggagtgcgcactgaggcagggaaaaaagcggcgaaagtgagcaaacttgccaagggcgaagtgctcatggtgaatattggctctctctccaccggaggtcgtgtaattgcagtcaaaggcgatgcggcaaaaatagcactgactgatccaatttgcactgaaagtaaccaaaatattgcattgagtcgacgcattgaaaagcattggcgtttaattggatggggcaccatcagaagggggacgaccatcgcagtgccccaaccatcgatcggataatttaaaaactattccaattgtaaacggtttttaataatgtgcgtgtttttgcttcctttcatgcatcttgtttttgtggaaaggtactttgttgatcaaaatatacccataagaaaaaaaaaaaaaaaaaaaa

SEQ ID NO: 1279 - DNA, 1841 bp, Heterodera glycines
  coding sequence=SeqID_1503; coordinates=1-1722
  peptide sequence=SeqID_1714
catgatgatcgtgtgccagcatttacggaacttacgcttatcagacattcacccgactctgagaatattcaaatgcaattcgccgcgttttttatttacagcggccttggaagattgatgagaccagttaggaaccttttatttgatcaaatcgagcaaataggaatttttgaacaagtttacctttccattataattgaccccgaagaggcagaaccgggcgtaacaatgcaccaagaacttcatccctcgtctctgttctcattcgctggcaatttgattccttttcccgatcacaaccaatcgcctcgaaatgtgtatcaatgtcaaatgggaaaacagacaatgggggtcccagtccacgcttggcagacgcgtacggacaacaaaatgtacaaattgcaaactgcgcaaaaacctttactcaaattggaggcccatgacaaatacgaaatggacgaataccctctaggcacaaatgcgtgtgtggccgttatttcgtacactggatacgacatggaagatgcaatggtgatcaacaaggcttcgtatcagcgtggctttgcacatggaactgtcgttaaagtgcagaggatcagtttggttgatcgctccaccggtggttttggtcagaacaaaaatgcggaaatggtctttttggggaagccgaacgaacgcaattacggcatcggtgcggacggcctgcccattgaaggccgtctctaccagcagggcgactgctattacggcactttcaatttggtcagcggacaattcaacgagcacaaattcacgaacagtgagcccgcttattgcgggttggtccgaattgtgcaggaggcggaccacaaaaacaaaaacgtgcacgtgttaatccaatggcgaatccaacggaatccgatcatcggcgacaaatttgcttcacgtcatggccaaaagggcatcaattcattcctttggccccccgagtcgatgcccttttccgagtcgggaatggtccccgacattatttttaaccctcacggttttccctcccgtatgaccattggaatgatgatcgaaagtatggccggaaaggccgcagcaatgcacggcacttcttacgatgcatcgccctttgttttcaatgagcaaaatacggccattgaacacttcgggaaactcctggccaaatccggatacaattattacggcaatgaaacgatgtattcggggatcgatggacgagaaatgaaggtccaaattttcttcggcattgtctattaccagcgattacggcatatgatagcggacaaattccaagtacgctcgacggggcccgtcgatccaattactctccagccaataaaaggcaggaaaaagggcggaggcattcgattcggcgaaatggagcgtgacgcactgatagcacacggcacagctttttgtttgcaggaccgtttgttcaattgttccgaccgggacgaggccgaaatttgcgcccgctgcggttccattgtttcagttacgcgtcttcgtccgcacattgcgatgtccaaatataaaacgcggccccatcagactcaaaagttcacccggtcgcactgttccatttgcttgagggaagaccaagtgtttcaggttcaagtgccgcgggtgtttcggtatttatgtgccgaattgggtgctgtaaatgtgaaggtccaattgtctttgtcgcatctccgagaaaatcggcattaacataaagaataaaatgctgtttttatgatcattgtccatgatcactgatcagaaatctaaaattgttatttctttcaagaaaataaaggccttttataaaaaaaaaaaaaaaaaaaaaa

SEQ ID NO: 1280 - DNA, 3462 bp, Heterodera glycines
  coding sequence=SeqID_1504; coordinates=Jan-49
  peptide sequence=SeqID_1715
cgcaaaaaagtggccgaacttctgaaactcgaggagacaattcaaaagaaatggcaaaaggcaaaagtctttgaaaaagaggcccctgaagaagacaaatcatcaactccgaaatacgtggtcacttttccgtttccttatatgaacggccgcctccatctcggacacacattttcgttgacaaaatgtgaattttctgttggttaccatcgcctgcgcggccgtcgctgtctgtttccattcgctttccattgcaccggaatgccaatcaaagcatgtgctgacaaactgttgagggaaattgaacaatttggcaatccgccagtgtttggctaccaaagcagcgaagaaatgtcaaaaaacgggacagaattagcgaaacaggaggaggaagtggaccaaatcatcaaggacaagagcaagggcaaaaagagcaaggctttggcgaaaactgtggctgccaaattccaatggcaaattatgcaatcgttgggcctcaatgacgcagaaattgccgagttttccaaatccgagcattggctgacctatttcccgcccaagtgtatggcggacctgcgcaaaatgggccttgcggtggactggcgacgtgccttcatcaccacagaggcaaatgcctatttcgactcattcgtgcagtggcaattccgaaagttgcgctcagaaaatctcatccaattcggcaaaaggtacaccatttactctcccaaggatggccagccgtgtatggaccacgaccgttccaccggcgaaggggtcggcccgcaagagtacactttgatcaaaatgcagattctggagcccaaacccaaagttctgtccaatgtctctgcttccaatggtaagccaatgtttttggtggccgccactctccgccccgaaacgatgtacggccaaacgaattgcttcatccatcccgacatcacttactccgtgttttttgtgggtacaaatgacgaagagattttcatcgcaacggaaaggtttattagggccgctcggaacatggcttaccagggcatgacggcggagaacggaaaaattcgctttgtgcccggcgtggaaagagtgaagggcgcggaattgcttggctgtgcgttgaaggcgccgttgacgagttttgagcgtatttacgcactaccaatgctaacgatcaaagacgacaaaggtactggcattgtgaccagcgttccgtccgacgcacccgacgattttgccgcactgatggacctgaagaaaaagaagcctttgcgcgagaagtacggcatcctggacgagatggtgatgccatttgagcccatcccaatcctcgagattcccgaatatggtcgtcttgccgctgtgcacatgtgcgaaaagttgggcatcaacagccaaaacgatcgactgaaattggaagaggcgaagaaggaactgtatctaaagggcttttaccagggggtgatgttggtcggcaattaccgggaccagaagacggaggtggtcaagaagctgatccaaaccgacatgatccgggatgggcaggcgtgcaaatatgtcgaacctgagaagaaagtgatctctcggtcgggcgacgaatgtgtggtggcattgtgcgaccaatggtaccttaactacggggacccggcatggaaagaagcgactcgcaaatgtttggcttcgcttaacactttttcggacgaagtgcggcgcaactttgagcacaccatcgaatggctgcatgaatacgcttgttctcgctcgtttggacttggaactaaacttccatgggacccgcaatatttgatcgagtcgctttccgacagtaccatttacaacgcttattacactgtttcgcatttgctgcaaaatgatatttacggtgctgaaacgggtgaactcggcattttaccacctcaactgactgacgctgtttgggattacatattcatgggtattccatatgattcgactaaaatgccaattgaagaagcaaaactgaagagaatgaggcacgagtttgagtattggtaccccgtcgatatgagggtttccggcaaagatttgatccaaaatcatctcacttattacattttcaaccacgtggccatttggcgtaaacagccgcagttttggccgcagggaattcgtgcaaatggacatttgttgttgaacaatgaaaagatgtcaaaaaatactggtaattttcttacgctttttgatgcaattgaacttttttctgctgatggaatgcgattcactttggctgacgccggagacggaatcgaagatgccaatttcatgtacgaaatggctgatgcgggcattctccgcttgtacgcctttctctcgtgggcttcagaaatggtcgaagcatgtgccaagggcgaattgcgcaaggacggcatcgagacttttgcggacaaaatattcaacaatgaaatgaaccgtctcattttggttaccggcgaccattttgagcgtactcttttcaaggaagcactgaagaccggctttttcgagtatcagttggcccgtgacaattatcggcagctctgcgggagtgaccaggcaatgagtgccgcgttggtgttacgcttcatcgaaacacaagcgattattctttcgccgatttgtcctcatgtttctgaacgtgcctgggaattgttgggaaagcccggccttctcgtgaccgatgctcgctggcccgtcactgctcctgccattccgttgctcgtcgaccagagcaacttcatccacaacaccgtgcacgagtttcggctaaggcgcgacgcgaagctgtgcccgaagaaaaaggacccgaaaaagcaattgcaacccccgaagtcggcaacaatttacatcgcaaaacgctatccgtcatggaggggaaaactcatcttggaattgggacaaatgtacacggacaacggcactcttccggacaaccgaacactgctcgaaaagctgagcaaaccagaatccgcggaagagaagaaggagcgcatgtcgttcgtacagatgttccgcgatcgcattgctcaacgtggcatttttgcggtgacgtcggaagaggaattcgaccagaaggcagcgctcagccaaatcagcgactttttgctctcgactttacaattggaggaggtgaaattcgctgattcggccaacgctccctccgatgtcatccgaaattcgtgctgtcccggcgcaccgttaataatgtacgactttgttgagacaacaaacaattagggctttggttgagaattgaatgtttttgttgattaatttggcttgtaaaaatgcgtaagtacccaaatgatgagacatacaccgagctttatttgttgggtttttgctatttgtgttcaaagctcgttctattgtttgttttcatattatttttctcatttgtcaaacgagacgaattttcatgttgtaaaaaaaaaaaaaaaaaaaaaaaaa

SEQ ID NO: 1281 - DNA, 3257 bp, Heterodera glycines
  coding sequence=SeqID_1505; coordinates=27-3176
  peptide sequence=SeqID_1716
tttgagtaaaacaacaattttaaaaaatgggacgcatcaaattggacggtcgaattcgtgcacaaattgagcgcggcgtggccaaccgatggcgctcactgttcatcatcatcggggacaaggccaaggatcaggcggtcactttgcatcacattttggccaaggccaccaccggggggcgtccgtcggtgttatggtgctacaagaaggagacggagttcagctcgcacagaaagaaacgcatcaaagagttgaagaagcgcaaagagtcgggcctgttccagtcaaaggaggacaacctgttcgagcagttcatcctgtccactcaaattagctactgttactatgccgactcgcatcgcattctgggcaacacctttggcatggctgtgctgcaagactttgaggcacttacgcccaaccttttggcccgaactgtcgaaacggtggagggcggtggcctcgtcgtgctgctcatccaatcggtcacctcactgaaacagttgttcaccatgagcatggacgtgcacaaacgctaccggacggaggcgcacgcggacgttgtcgggcggttcaacgaacgcttcatcctttcgttggccagctgtgccaactgtgtggtgatggacgactgtctgaacgtgttgcccatttcctcctccgtcctcaacatggccaatttgccgcccgtcgtcgcccagcaaaaaagtgccgcgggcggcgatgtgtcgtcggagttggcacggctccaacagtcgctggccgacacaaaacccatcggcccgttgctgcaccggtgccgcacactgtgccaggccaaggcgctgctccgcctactcgacctggtcaccgacaaaatgtccaactcaatgtgcgcaatcaccgcggcgcgtgggcgcggcaaatcagcggccatgggcctggcggttgcgggcgcggtcggctgcaatttgacgaatatttttgtgacgagtccaacaccggagaatgtgcgcacactgttcgaatttgtgttgcgcggctttgacgccatcggataccaagaacatgccgactttgacgttgtccgctcgttggacccgcaaaccgacaaatgcgtgacgcgcgtcaacattttccggcgccatcgccagaccattcaatacatccatccgtccgagtttgtcaagttgggccaggccgaactgttggtgatcgacgaggcggccgccattccgatgccactggtcaaacagctcattcacggaaattttttggtgtttctcgcctcaaccaccaacggctacgagggcaccgggcgttcactgtcgctgaaactgcttgaacagttgcgacggggcggcggcggtggcgagcgcgggacgacgacggcggcgacgggtgccatcggtgatgctgctgagacggcgacaacggcacggcggcgaccgttgttcgaactgacgctggaggagagcattcgttacgcgatgaacgacccggtggaagattggctcaatcagacgctgtgtctcaactcgcagcagagtttgcccacgtctttgacggggacaccggcgcctgacaaatgcgaattgtattacgtcaacagagactcgctcttctcatttcacaaggcggcagaggtgttcttggccaatctgatgtccatttacgcggccgcccattacaaaaacagtccagacgacctgcaaatgttggccgacgcgccggcacatcacctttttgtgctgatggcacccgtgccggctgaccaaagctccgtgccacagattttggcggttgtccaactgtgcctggagggctccatctctaaacaaagtgtgacaaatgtacgggacaaaggcaaaaagcgggcggccggtgacctcatcccgtggacactttgccaacactttttggacgacgaattcccaactctgtgcggtgcgcgcattgtccgcgtcgctgtccacccgaacttccaaggcatgggctacgggtcgcaagcagttcgcctcctgctcaacttttacggacggaggccgcggcatgtttcaacgacaacggcggcggcacaatgccaaaatggggaggacaaaaatggtggaaatgatagggaggaggatgaagagatgtcgagggtccaacttgtggatgacggcgatctccaccaattgctgctccatgacgagcaaatttcgccccgtgccaatttgcccccgttgctcgtccgtctcgcggactaccgacgccatgctgaccaattggactatgtgggcgtttcgtttggccttacgttggcgctgctcaaattttggaaacggcttggctttgtgcccgtttatttgcgccaaaatacaaacgatttgacgggcgagcacagctgtgtgatggtgcgcaaaattgcaattgcagcagcagggggaggaggaggtgaacatggcgaagatgacggaaacggcaggatggacggggaatggaggcatcattatggcgtgctggcgagtgccggtgttgctgcttctgatgccacgctgaactcggacggcacttggctgtccgccttctttgtggagttccggcgacgcttcgtttctttgcttggcacttcgttcagcgcgttcagtccccacttggcgttcagtctgatgttcatggacagtgccagcatcatcggctgctccgtgcagcagcggcaggacgaacagcaggccgaaaatggcctgcttgaccgtgccgaactccgtctgcgcctgtccgacttagacctccgccgggttgcccagtactgtcgcaatttggccgacttggccttgatcagcgacctgttgcccaccattgccggcctgtacttcaccgcccgggtggacaccaaccgggccccgttggacctgtcccaggccgctgtactgctcggtgtcggcctgcagcgcaaaatggtcgaaacggtggccaacgaattggcactgtccaccagccaaacgcacgcgctgttgaacaaagcgatcagacgtttgtccgaatatttcgactcaatttgccgtgaggcgcttgaacagcaacaacaacaacacaacacaaatgatcgccaacagcacatagcaacagaagcagaaggaaaatttggggcaaaaacgaaaagcgacgaatgcccggcgattaaaaaattgaaaatttcacattttgtcaaatgatacaaattttgttttttttattcttgttgattttatttgttgaagagagattttcacccctaaaaaaaaaaaaaaaaaaaa

SEQ ID NO: 1282 - DNA, 944 bp, Heterodera glycines
  coding sequence=SeqID_1506; coordinates=19-813
  peptide sequence=SeqID_1717
gaacattagactgctaaaatgggtaaaaacaaaaaaccgttcattgaccgaaaaagtgccgtaaattacacactgaacaacagagagttggaggagacgcagcggatcagtgattacaagagcttttcgtttcgttcactcgacaaacgttttgagggtatttacgaggactatgcgaatgaagaggaggagggagcggaggaaatggacgacgaagaaggacaaacgggggctgattctgcgattttccgttctctgctggcggatgggcaatcccagcggagttgcgaagaacgttttcaccgggagctgcccgattccgagctgaagggcgcggtgttgcgttatgcaaaagcgatggaaattggcaaaggaagggccgagccgacggaggacattttggtggacagtgcgaagagaagccgctgggattgcgagtccattctctccatgcattccaccctttacaatcatccgaccgaaattagggagccgatgaaagtcattgggaggcgaagggggaggacgaccaaagagaaggaaatggccaatttggaggaaacggaagttgacggagaccaaagagacgggccaccggcgccgtccgtccgcacgcgcacttcgatggttagcgtaattcgaccgaagggggagacgacggaagagcggcggatgcgtaaaattgcagtgaaagaagaacggagagagcggcgtaaggaaaagaaggcgaacaaagaaacctttcgggcggagagactgaaattggaggcacagcgaaaaacgaatcagccgaagacgcgacaaattcattgaaaaggggggggggagagtgatcatcaaccgatgttgagacggcctttgttacttttatttgatttggccaaataaaggatttggaaaaaaaaaaaaaaaaaaaaaaaaaaaaaaaaaaaaaaaaaaaaaaa

SEQ ID NO: 1283 - DNA, 1376 bp, Heterodera glycines
  coding sequence=SeqID_1507; coordinates=1-1150
  peptide sequence=SeqID_1718
ttttgccggggagagtgccatttgctgccatcacaagtcgctcaaccaaacttcgtccctccgcctcacttattccgctttccatggcgtcggctccaaattcgtccgccgaatgttcgctgagtttggctttccctcggagaacatttcgtacgttaaggaacaagacaagcccgaccccgactttggcactgttccattccccaaccccgaggaagggcaccgggtcctcaaactgtgcattgagactgcaaatgccaatgactcgactttgctcctcgtcaatgacccggacgccgaccgactccaattggcggagaaagaggcaaacggagagtggcgcgtgttcagcggaaatgagatgggcattctgctgacgtggtgggcgtggaccaattggcgtgccgccaacccaacggcggactcttcgcgggtgttcgtcctccattcggccgtctcttcccaaatggtcgccacaatggccaaaaaggagggcttcaaagcggcgcattcgttgacgggcttcaaatacataggcaatttggcacacaaattgcggtcggaaggcaacaccgttattgccgcctgggaggagtccattgggtttactcccggcacaacgctggacaaagacggcgtttcttccgccgcggtctttgctgaaatggccaattggctgcgcacccaaaagggcgtttcgctgcgtgaacagctcttccgcctcttctccatctacggctttcacctccaacgcaattcgtattggggggtcaaatcgacggaagtgacgaagaaattatttgcggaccttcgctccgattatcccgaaacgattgggcagaatttcgatgtgaaatttgtgcgcgacttgacgacaggttatgacaacgctcaaccggatgacagggccattctgccgctgagcacctcctccgaaatggtgactttcactttggtcgacggaagtgcggtgacactgcgggcgagcggaacggagccgaaagtgaaatattacatcgaactgcgcaccgaaccgggcaaagaagaaaaggatctgagttcggtgcttgagcagctcgaccaattggaatccgacgtggtggacactctcctccagccgaccaaatacggactgatcagtcgaatttgattttgtgatcggaacgaatgaaaggcggacaattcctttttgggggtggtgtttttttatcataattggccattgcattccttcccataatgtttatttattcgatcgcttcttttcttgttgccttgcctctttcctagttattgtgactttattaatttatttataattttatcaattgcgttgataaaatttaatttggaaaaaaaaaaaaaaaaaaaaaaaa

SEQ ID NO: 1284 - DNA, 1505 bp, Heterodera glycines
  coding sequence=SeqID_1508; coordinates=24-1334
  peptide sequence=SeqID_1719
ttcctttttattttctggtccaaatgtcttctaagccggcatacaaagttgctgacatttctttggccgactttgggcggagggaaattacaattgcggagaatgaaatgcccggactgatggccatgcgggcaaagttcggtgcgcaaaagccattgaaaggtgcgcggattgccggctgtttgcacatgactgtccaaacggcggtgcttatcgaaacgctgttggaactcggcgccgaagtccaatggtcgtcctgcaacattttctccacccaagaccacgccgccgctgcgattgccaagcgtggcgtgcccgtctacgcgtggaagggcgagacggacgaggagtacgaatggtgcattgagcagacgctgattttcccggacggaaagccgctgaatatgattttggacgacggaggcgacctgaccaaccttgtgcaccaccaacacgccgaacttctgcccggcatcatcggactgtccgaggagaccacgacgggggtgcacaatttggccaaaatgttggcggccggactgctgaaaacggcggccatcaacgtgaatgactcggtgaccaagtccaagtttgacaatatgtacggcatccgcgaatcgttgccggacggaatcaaaagggcgaccgatgtgatgttggcgggcaaagtcgccgtcgtctgcggctacggcgacgtgggaaaaggttcggccgcggggctgcgcaattttggcgcgcgagtgatcgtcacagaaatcgacccaatcaacgcccttcaggcggccatggagggttaccaagtgagtacgctggacgaagttgctgacattgctcaactcgtggtcaccaccaccggctgcaagaacattgtgaggggtgaacacatcgaacggcttccggaggatgccatcgtttgcaatgttgggcatttcgactgcgaaattaacgttacctatatgaacgagaattgcgtgtccatggagcaggtgaagccccaggtggaccgctatttgatgcgcagcggtcggcacgtcattctgttggccgagggccgactggtcaatttgggctgtgccaccggacattcgtccttcgtcatgtccgctagtttcaccaaccaagtgatcgcccagctcgaattgtacacgaaatacggcactccggacgcttacaaaacgggactgtaccttttgccgaaacagttggacgaggaggtggcacggctgcacctggacaagttgggcgccaagctgaccaaattgagcaaggaccaagccgaatatttgggcattccccaagagggaccattcaaaccaggccattaccgttattgaaaagcagcggatggaaggagaaaagcggaaagaagacctttctatttgtcaatttcactttttgcaatttttttttttgtaatcattggcatttgacacgacattttgttggtttgccgttgtgggttcgtaaatcggttttgttaaaaaaaaaaaaaaaaaaaaaaaaaa

SEQ ID NO: 1285 - DNA, 1275 bp, Heterodera glycines
  coding sequence=SeqID_1509; coordinates=1-1160
  peptide sequence=SeqID_1903
gaaaaatgaatcctgatcttgaaatcgctcaaaaatttttcttgtgtaaagaaaacaaaaaagatgtcgcaacaatttttctcgaattgcttaagagcattactgacaacgaaatggcgcccttttacgaatacgccgcccctcaactcggcgtgcccattgacaaggctaaactgcaaacactgaaggcacttaatgagcaaaaattggacgaatttgaccgaaaaataaaggacgccgaggaaaatttgggcgagagcgaagtgcgtcagtctcacttggccaaggccgagtatttgtgcaaaattggggacaaagaacgcgcattggccgccttccaactgacatttgacaaaaccgtgggcatcggttatcgcatcgatttggtgttcaatgtgatccggcttggcttcttcttcatggaccatcagatcatcacggaaaacattgaaaaggccaaatcgctgatggaaaagggtggcgattgggaccggaagaatcggctccgctcctacgaggctctctacaaaatggcaattcgcgaaatgcgcggggcggcgcttctctttttggaggccgtgcccacctttgacgcctatgagctgatgagctacgaagacctgaccttttacactgtgatttgctgcgtttatgctttggaccgacccgatttgaaggagaaggtggtcaactgcagcgaaatacagcaacaattgaacgccgaaccgacagacaaaaatcgtcatttgcccttggccaaacaattgctgaccaccttttaccggtcggagtatgctcagttcttcacggcacttgccgagctggagcagtacatgaagcaggaccgttatctgaggccccactatcaattctactctcgtgccatgcgtgtccgggcatatcagcaatttttgtcaccgtacaaaacggtcggtcttgatgtcatggccaaatgctttggggtcagcaaagagttcatcgacaaggaactgttcatgttcatctccttgggtgcgttgaagtgtcgcattgacacggtgaaagatgtggtggaaatggggcaggccgacaacaaattctaccagtacaaaaagttgcttcatgacggggacattctgttgaatcgtgtgcagaaattatcgcgggttatcaatgtgtgaaatgaattggaaaggatacgatttgctaaaaatgatttttcttttttgttatgtgtgattaaatatagaccaataaaaaggattgtcaaaaaaaaaaaaaaaaaaaaaaaaaaaa

SEQ ID NO: 1286 - DNA, 1337 bp, Heterodera glycines
  coding sequence=SeqID_1510; coordinates=1-1164
  peptide sequence=SeqID_1904
aacccggtcaaattcggcctttacatcggcccaagcaaaaccgaggccatttgcatttcctcaaaaagttcggacagcggaaatggaccttctcttggcaccagccccacaatgtcattctcgccggtgcttacaattagcgaagagaatttggcctccgaattcgcaaaaggcaacgtaacaattgcggacagacgcccttcgaatgcaatggacttcgaactgtttgaggagaaggcaaaagagaagcggtcgttgcgtctctcccgtgaccaattggacctgttgaacttgaactacgggtcgaacgacgcgcggttcagcatcacaacaaaatatcagggaactgcttggtgttcttgtcacatttatttgctcaaatggtatgacaaattggtcatctcggatatcgacggcacaatcacaaagagcgacgtgcttggccatgtcattccagcaattggtggcacttgggcccattccggggttgcagagctgtatactggcatcaaaaagaacggatatcaaatggtttatttgtcttcgcgtgccattggacagtcccactacacgaaaacgtacctgcagaacttcgcccaggggtccaggactttgcccgacggacccgtccttctctcgccttcttccattctgatggcattcagaaaggaggtcattgaacggaaacccgaggagttcaaaatcgcatgtctcaccgacctgaaatcgctgttccccgtaggacagccattctttgccggatttggcaatcgcgaaacggacgttaaatcgtatcttgcggtccaaattcccccggaaaggatcatgattattgacccgcaagggtcgctcagaagggcggacaacaaagcgggtggttacgtgtccgattacccaaccttggccatggacagtgtcgactacgtgttcccgcctcgggtggacatggacggcatcgacattaggacgaaagaggacggcattttgagtgaattcgtcgcatggcgaactgacgctgaacaattcgatgcgctggtggacgcggaattggaacagtacgaagaaaggagcaaacgagcgaaagcaattgtcgcggggacgacggatggacgaggggcggacggaaagaagaaaatgtataggaacggaagacgggcaaagtgatcagagcaaaattatggatgattaattgacgaccataataggcggaatgcgggagaccaaccactcttttgtttggtttatgtaattaactagcctttgtgtcaactgttcagatggatttgtctcatatcattaaaatttaattgatgaaaaaaaaaaaaaaaaaaaaaaaa

SEQ ID NO: 1287 - DNA, 746 bp, Heterodera glycines
  coding sequence=SeqID_1511; coordinates=96-671
  peptide sequence=SeqID_1720
gggtttaattacccaagtttgagttttagtgctgcgaaggcgcgcattttccatattttattatctgctgtaaacgcttcacaacagaaaaagcgatgattccgctcaatttgcaaattgcagagtctgctctgaaggtcctccaaacaaaaacgcccgggggagaaattgagcaaagtgcgacggcgggagctcactgtacaaacaatacgtgcaaaaaagtgttcaccggtcccgagagcgatgccgaagagtgcgttttccacccgggcaatgccgtttttcacgaaggactcaaatactggtcgtgttgtgggcgcaaaaccaccgattttaccacatttttggaccaattgggttgcactcggggcaaacactgctggaaaaagaaagaaattgtcacaaatgcgcgcgaggattggtttcaacgaggtggccaagtgcacatcacaatttactgcaagggagcacttccgagcgaaacatccgccaaatcggacggtctgacattggaagtgaccatcaacgggtccaccaaacggtacgaactgttcggggaaattgcgccgtccgaaagtgtggtcattatcagcgaacgcaaagtggaaattgtgttgaagcaagtggccaaaattgggtggccaaaactttgttatgatccgccaaactgatcacaccgatgtttaaattttgttgtgttaattttattgcctcatgataaatacacctctctctaaaaaaaaaaa

SEQ ID NO: 1288 - DNA, 2097 bp, Heterodera glycines
  coding sequence=SeqID_1512; coordinates=29-1981
  peptide sequence=SeqID_1721
gcacgagggtcaaattgctttttcaaaaatgccagctaaagctaatgcaattggtattgacctcggcacgacgtattcgtgtgttggagtcttccagcacggaaaggtggagatcatcgcgaacgaccaaggcaaccgcaccacgccgtcctatgtcgcgttcaccgacaccgaacgtttgatcggcgatgcggccaagaaccaggtggcgatgaacccatccaacaccgtgttcgacgccaaacgtctcatcggacgcaagtccgacgacccggcggtgcagtcggacatgaagcactggccgttcaaagtggtgcagggagagggtgctcgtccgaaagtgatggtggaagtcaaaggcgaggacaaagcgttcttccctgaggaggtttcgtccatggtgcttatcaagatgaaggagacggccgaggccttccttggccagactgtcacggatgcggtggtcacagtgcccgcttacttcaacgactcgcagcgtcaggccaccaaggacgcggggaccatcgccgggctgaacgtgttgcgcatcatcaacgagccgacagccgccgcgattgcctacggcttggacaagaaggggcagggtgagcgccatgtgctcattttcgacttgggcggtggcactttcgacgtgtccatccttaccatcgaggacggcatcttcgaggtgaaatcgaccgccggtgacactcatctcggtggcgaggacttcgacaatcgaatggtcaaccactttgtcgcggagttcaagcgcaagcacaagaaggacctcagttcgaaccctcgtgcgttgcgtcgtttgcgtacggcctgcgagcgcgccaagcgcactctgtccggttccacccaggccagcatcgaaattgactctctcttcgacggcatcgacttctacaccaacatcacgcgcgcccgcttcgaggagctttgcgccgaccttttccgcaacaccatggaccctgtggagaaggctttgcgcgacgcgaagatggacaagtcccagatccacgacattgtgttggtcggcggctcgactcgaattccgaaggtgcagaagcttctctccgactttttctccggcaaggagctgaacaaaagcatcaacccggacgaggcggtggcctacggagcggctgtccaggcggccattctttccggcgacaagtcggaaactgttcaggacttgctgctgcttgacgttgcccctctctccctgggcattgaaacggccggcggcgtgatgacttcactcatcaagcgcaacacgaccattccgacaaagacgtcgcagacattcaccacctattcggacaatcagcctggtgtgctgattcaggtctacgaaggcgagcgcgcgatgaccaaggacaacaacctgctgggcaagttcgagctcagcggcattccgccggcgccacgaggagtgcctcaaatcgaagtcactttcgacatcgacgccaacggcattctgaacgtgtcggcccaggacaagtctaccgggaagcagaacaagatcaccatcaccaacgacaaaggccgcctttccaaggaggaaattgagcgcatggtgcaggaggcggagaagttttccaaggaggatgaggtgcagcgtgaccgtgtgtctgccaagaacgccttggagtcctactgcttcaacatcaagcagacaatggaggactcaaatctgaaggacaagatcagcgaggacgacaagaagaaggtgctggagaagtgcggtgaggtgctggcatggctcgacgccaaccaggcggcagagaaggaggaatttgagcaccagcagaaggaactcgaagggatctgtaatcccatcatcaccaagctctaccaagccggcggcgcaatgcccggcggtccaatgcctggcggagggatgcccggaggtggcggcgctgctggtgcgggaggagccggtggaccgaccatcgaggaagtggactaagcgagtcgatctcttcgcgatcatttttttgtttgatcgattatttaattttatttttttctcgcgtaaattgtttgacatataaaaaaaaaaaaaaaaaaaaaaaaaaaaaaaaa

SEQ ID NO: 1289 - DNA, 1808 bp, Heterodera glycines
  coding sequence=SeqID_1513; coordinates=40-1380
  peptide sequence=SeqID_1722
gcacgaggtctatttgttttttattcaatttcgacctgaatgtcagctgcggtttcttcttcgcgtccgatggaagattggaaatctgagttagctatgccagacaaggaccttcgatacaaaacatctgatgtgactgcgactaagggcgttgaatttgaggaatttgggctcactcgcgaccttcttaaaggcatttttgagaagggttgggagcatccaagtccggttcaggaagcgtcgattggaattgcacttacaggccaagacattctcgctcgcgccaaaaatggaactggcaaaactggcgcatattgcattccctgcattgagaaaattgacccatcaaaagaatacatccaagcaatgataatcgttccaactcgggagcttgccttacaaacatctcagatttgcgtagaactcagcaaacacttgaagattaagattatggtgacgactggcggaacagatcttcgtgacgatattttgcgtctcaatggtattgtacatcttgttgtggcaactcctggccgaattttggatcttatggagaagggagttgcgaatgttgcgtattgcaagacgatcgttctcgatgaagcggacaaactcctttcccaggacttccaaggtgtgcttgaccgtcttgttcagtttctacccaaagaccgtcaaattatgctgtactccgcaacatttccgcgcactgtcgcgacttttatggaaaagcacatgagcaagccgtatgaaatcaatctgatggaggaactgacgctgcttggcattacacagttttatgcttatgtccaagaaaaacagaaagtgcactgtctgaacacgcttttccgcaagctccaaataaaccaatccatcatcttttgtaattcgacacaacgggtggagttacttgccaagaaaatcacagaattgggctactcctgttactacattcattccaaaatggctcaacaccacaggaacagagtgttccatgaatttcgtcagggtcattgtaggaacttggtctgttccgatctgcttactcgtggtattgacatccaagccgtcaacgtggtcattaactttgacttcccgcgcaattccgagacatatttgcacagaattggacgttctggccgttttggccaccttggtattgctatcaatctgatcacctttgaagaccgttacaacctgcgacgcatcgaaaaggagctcaagacacacattgacccaattccaaaggaagtcgatccgaaactctatgttgctgaatttcaaatggatcacaccaaattcgactgtgggaatgtcgtcgatggtgcggtgctgaacaacggagtcgaccaacaacagcagcctcgggcttcgtcgtagttgcggtgggagcacggagcgaaaactcccacagaatttatcagctcgtccatccacagtaaattgaccctaataaaaatgctgcgctgctctccgatctctcatttgttgttaattttcggattttgttatttaaattctctcatccgcacacgtccgtcacaccattcaaatttatcgtccattcattgtgcgaatttggtatttctctgcgaacacattgtgtggatttctatctttgtgaccttttaataaatgtgagagggttttgtctttgttcgttctcatcattcacctctttctctccctcacctaaccaataatcctccaatttactgcttgtctattaactttgttacgggtaaattccaactatgcctcaaaaaaaaaaaaacaaaaaaaaaaaaaaaaaaaaaaaaaaaaaaaaa

SEQ ID NO: 1290 - DNA, 953 bp, Heterodera glycines
  coding sequence=SeqID_1514; coordinates=52-795
  peptide sequence=SeqID_1723
cccttgggtttaattacccaagtttgagttgttgaatgcaataatcctaaaatgttccgcaaccaatacgatagcgacgttactgtgttcagcccgcagggccgtcttcaccaaattgattatgcagtcgaagcgatgagacagggcagtgcagcagtagcaattcgtagcaaagattatgctgttgtggtcgcacttatgcgtgcacaaaacgagctttcttcatatcagcagaaagttttcaaattggacgatcatctcggcttgtctatgtctgggcttatttcagatggacgcattttggcacgctttatgcaaagtgaatgcgccgagtttcgctggaactatcataatccaatttcggttgaactgctcaaccgtaaattaggcttgaaacttcagtccaatacccaatattacggacgccgcccatttggtgtgggactgctcatcattggatatgatgacaaagggcctcacgttgtgaaagccgaaccctcgggggacgtgtccgaaatgtttgctgcttcgattggcgctcggtcacaaagtgcgcgaacttatctcgaaaagaacctaccagaatttgagacggctgacagagacgcattgattcgccatgcgattcgctccctcaaagagacgctgcaggcggacgctggcagtttggatgagaataacacgtttattgcgatcatcggattgggacaaccttttacctttttggggaaagacgccacgcgggcgcatattcgttcagttgaagaagaagcacacagggaaatggacgaatagaggggcacttttgtcgttttgtccccgtgttattcttttaattattcttggattacaaaacgatgctatttcattgttgtaatttcataaaaggtgacccaaaaaaaaaaaaaaaaaaaaaaaaaaaaaaaaactcgagactagttctctctcaaggg

SEQ ID NO: 1291 - DNA, 2190 bp, Heterodera glycines
  coding sequence=SeqID_1486; coordinates=1-844
  peptide sequence=SeqID_1888
gcacgaggacaaccaagagcccgtgaccaagcgaggcttctgccaatttgtgttggacccgatcttcaaagtgttcgacgctgtgatgaacatcaaaaaggacgaagtggcgaagttggtggagaagctgaacatcaaactgaccttggaggagaaggaacaggagggcaagcccttgctgaaaacgatgatgcgcaaatggttgccagccggtgacactatgcttcagatgattgtcatgcatttgccatcgccagtcactgcgcagagataccgcatggaaatgctgtacgaagggccgcatgacgacgaggcggcggttgcaatgaaaaactgcgaccccaacggaccactgatgatgtacatctcgaagatggtgccaacctctgacaaagggcgcttctacgctttcggtcgcgtgtttgctggcagagtcgccactgggatgaaagcgcgtatccaagggccgaattatgtggtcggcaagaaggaggacctctacgagaagaccatccaacgcacaattttgatgatgggccgttacattgaaccgattgaggacatcccggctggaaacattgcgggactggtcggcgttgatcagtacctggtcaagggtgggaccatcaccacctacaaagacgcacacaacatgcgcgtgatgaaattctccgtgtcgcccgttgtccgtgttgctgtcgagccaaagaatgcgggagatttgcccaagctggtcgaaggactgaaacgtttggccaagtcggacccgatggtccaatgcattttcgaggagtccggtgagcacatcattgccggcgcgggcgaaatgaaagcgcgcatctaagggccgaattatgtggtcggcaagaagtacacctctacgagaagaccatctaacgcacaattctgatgatgtgctgttacattgaaccgattgaggatgtcccgtccggaaacattgcctgagtggtcgacgtatacaatgtcccgaagcggctgttggtggcattcgcgtagtgttgaaccgtcgccgtagtgtcgtgtttgaagagaaccaaattgccgacacaccgatgttcatcgtcaaagcacatttgcccgtcatggtgttccgtgctcgctgtgttttgtttcgaagatgactttatacacattcgcttcttcaccctgttttctttttctgactatccattttctttatccatgtaggaatggatcacggaatcttttcatctgtcaattaggtgctgagttcctcgttaagccaatagaataatggggatgtttcccgtaatcagtttggttgctttgataagttcagtttaactgttagatcgctcaacattatttgttatatatcattgaatcaaatcttatatttgagttgtcctcttagaaagtcagtttgttttcgtgtgttcttcatcaagttatgcgtatctcaactcagctttctgatcttcaattggagcgtgtcctgcgacctattgaatgtctcactgcgttgcgtctccaaattgatccgcctgcggacaggaacagcattcaaatcttgtcttttctccgcaacctcagccgtgatgtcacagttgtacgccgcgccacactcgttttgaagacaatcgcaaatgggtggggaatcgacgttggctttgacaacgctctgaccactcgccttcacacgtggtcatcaccgaagcgggcggttgtgccgaaattatccgacacatggacgaattcactgttgtccggatgccgaacaaatatgagtacgcggtgcgtaaggaatgcatggcggttgttggaaaactgtcacacgtggactgggaaaaaaagcagtggggctctgcccaaatgcatcgtcggtttggctttcgcatggccagcgggcccagcaaacggcgccgtgaccaataccagggcaagaaacatccgcgtaatccgcccctgtgcaccattgacggagtgcgaccgccgccggcgccgttgcagaagttcacgctcaccaagcggcagttgagccacaactttggcagtgcggcggtgccacaactggtggccgagttcaacaatttggtccgactttaagcgccagagagacccaattgtggagcatagggatggatttttattaatgacgaaaaaaatttatcatgaaaaaaaaaaaaaaaaaaaaaaaaaaaaaaaaaa

SEQ ID NO: 1292 - DNA, 947 bp, Heterodera glycines
  coding sequence=SeqID_1515; coordinates=26-790
  peptide sequence=SeqID_1724
gcacgagggtttgagcaaataaactatggagcattatgatcgtgcaattacgattttttctccggatggcagactttttcaagttgactatgcgcaagaagcagtgaagaagggctcaacagcggttgccgtgaaaggaaaaaattgtgttgtaattggagtcgaaaaaaaatctatcccgactctgcaagacgaacgtaccattcgtaaaatacatgcattggattcgcatgtgatggtcgcattcgccggactcagcgccgatgcacgcgtccttatcgaccgtgctcgagttgaatgcgaaaattacaaattgacgcttgaggaccgcgtatctgtcatgcatatctctcgcatcatagctgatataaaacagagatacactcaaaccactggccgtcggccttttggaatttcaatgcttgtcggaggcttcgattctgatgggacccctcatcttttcaagacggaaccgtccggagtttactacgaattgttggccggttcaatagggcgaaatgaaaagattgtgaaggagtatctggagaaagaatacggcaacgacaacacagctgatgaggagtctacgcttaaactgatgctcaagtctttagccccagtggtccaatcgggggcgcagaatatcgaaattgcggtgctcaaatgggtggatggcaccaatggggagcctgggtattgtgagcagcaaattttaaatgtcgaagcgattggagcgctgttgagtcaaattgggcctatcgaacaacagaaaccgatggaaacttcttgatgaattcaattatttatcagctgttgtttagaaaatgattgaatttggatctaaatgtttgatataaatttgttttcttatttggattacagcaacatattttgaaaaaaaaaaaaaaaaaaaaaaaaaaaaaaaaaaaaaactcgagggggggccc

SEQ ID NO: 1293 - DNA, 946 bp, Heterodera glycines
  coding sequence=SeqID_1516; coordinates=30-785
  peptide sequence=SeqID_1725
gcacgagggaattttcgacttacctataaatgtttctgacccgcagcgaatacgacaggggagtgaacactttttccccggagggccgtctgttccaagtggaatatgccatcgaaactgtcaagcttggttccacaagcatcggaattcacaccaaagaaggcgttcttttggctgcggaaaggcgttcaatgagcaaattggtggtggacgactcaatgagcaaaatttcggaagttgagaagcacattgccgtcgcctcggccggtctcatcgcagattcacgcacttgggtcgaacacgcgcgggtggaggctcaacacttttggtttacttacggtggcaaaattcgggtggaagacattactcaaaaggtctcaagattggcactgcattttggagacgacgactcaactatcagtctcggccgtccgtttggagtttctatgctttttgccggcattgatcacacgggtgcgcatctcttccatttggacccgtccgggacgtacattaaatgtttggccaaggccatcggtgccggctccgatgcagcggaacaaacgctgcaagagcactgtaaaaactgcgacaaaaaaatggaaatggccgaggcaaaacaagtcgcactgaacacactcaaacagctgatggaagagaaaatcaattccaaaaatgtggaaattgttatgattaagccgcagacggacaaggaaggcaaaacgttgggcaaaattgtgtggttagaggaatcggagttgcaagaaatcatttcgcgattgtagtcgaaggggacggattagagaaggaaaatgggctttgcactgccccttttatgattggatgaccttttgttattctctgcctttttgtgacttttcagtgtataaggcaaatgaaagcaattaattgagaaaaaaaaaaaaaaaaaaaaaaaaaaaaaaaa

SEQ ID NO: 1294 - DNA, 1469 bp, Heterodera glycines
  coding sequence=SeqID_1517; coordinates=10-1317
  peptide sequence=SeqID_1726
gcacgaggcatgatcggaggtctttttgtttataaccacaagggtgaggtgcttatttcaagaatttatcgcgacgacgtgaatcggaatgccgttgacgcctttagagtttcagttatacatgcaaggcaacagattcgttcaccagtgacaaatattgcaaggacttccttttttcacatcaaaaggggaaacgtttggatgtgcgctgttagcagacgaaacattaatgcatcgatggtcttcgaatttctcaatcgttttgcagacacaatgcaatcttattttggaaaactgaacgaggaaaatgtgaaaaacaatttcgtcctcatttacgaaattcttgatgagatccttgattttggttacccccagaataccgacccaggagtattgaaaacatttataacacaacaaggcgtccgaacagcgagtaaagaagaacaggcacaaatcacttctcaagtaacaggacaaattggttggcgccgagaaggcataaaatacagacgcaatgaactctttttggatgtcattgaatatgttaacctcctcatgtcgcagcagggtcaggtgctttcatctcatgttgcgggaaaggtggccatgaagtcttatctcagcggaatgccagaatgtaaatttgggattaatgacaaattgacgatcgaaggcaaaggcaggactggcactgacgacccctctaaaacatcccgcgcttcagttgcaattgatgattgtcaattccaccaatgcgtgaagttgaccaaatttgacaccgaacatgctataagctttatcccaccggatggcgagtacgaattgatgagataccgcaccacgaaagacatccaattgccattcagagtcattcctttagtgcgcgaggtgtcaaggaacaaaatggaagttaaggttgtgatcaaatcgaacttcaagccgtcgttattagcacaaaagattgaggtcatcattccaacgcctccaaatacaagcggagttcagctcatttgtatgaaaggaaaagccaaatacaaggctggcgagaattgcatttgctggaagattaagcgtatgggagggatgaaagagtcgcagatttctgcagaagtcgatttgctgaacaccggaaatgctgagaaaaagaaatggaaccgtccacccgtctcaatgaactttgaggtaccatttgcaccttctggactaaaagtgcggtatctcaaagtattcgaaccgaagctgaactactcggaccatgacgttgtaaaatgggtgcgttatatcggacgctccggcttatacgaaacgagatgttaagctagcaataaatgtgactcttgtcgaattaattaatgcattcccataatttgaaaattaataattttacagatatgatttgttttttatccttttgtaataaaccaaagaaggaaaaaaaaaaaaaaaaaaaaaaaaaaaaaaaaaaaaaa

SEQ ID NO: 1295 - DNA, 1246 bp, Heterodera glycines
  coding sequence=SeqID_1518; coordinates=1-1153
  peptide sequence=SeqID_1727
gcacgagggtttgtttggttcgtccatcggcacttcttcgccttttggcagcaagccgagtggtggtctctttggcgctgcgaacaccgcagttgtgcagcccagcacttcgaccacaacgcagcaggacatcgaggttccacaagctcccgatgacactgtgcaggcaatgaaattcaatccgctggtggccgggtctcccatttttttggctgctggttcctgggacaacacctgtcgcatttggcaggtcaatgaaaatggaatggttgaaccgaaggcaatgcaaaatgttggagcgcccattctttcgctggattggtcggaggacggctcaaaaatattcatcgctggtgcagacaaacaagcgttcgcctgggatttaggctcaaaccaaatggctgttgttggcacgcacaatgagccagtgcgaagttgccattggatagcgacaccccaatattcgtgtctaatgacgggaagttgggaccggacgctgcgtttttgggacatgcgccaattgcccacccaaaactccctggcaaccatccaactgcctgaacgcgtgtactgctccgacatggttttcccgctgatggtcgttgctttggccgacagacacatcaaaatgtataagttggacggaacaccctctgaaattcaagacgtggaatctcagttgaagtttcagagtcgttgcattgcgattttcaaagacaaaatgacgggacagcccaatggattcgctcttggctccaccgaaggacgagtggcgattcaatgtttgcagccaaaggacccgaaggacaatttcactttcaaatgccatcggtcagccgaactcatcaacaattaccaggagatttacccggtcaatgacgtcgcttttcatccgacccaccaaacattggccacggcgggcgcagacggaaaatattccttttgggacaaagacgcgcggacgaaattgaagggttccgatgccttgccaatgccaatcacaaaatgcgccattcattcgggtggaaacataatggcctatgcgatcggttatgattggagcaagggcttcgaatacagcacggcgaataatgtgacgaaaatctttctgcacgggtgtgacgaggagatgaaaccaaagccgaagaagtgatctccgtgagtgaccgttttttaatgttctctcaattgtttttttataaattttttacacttaaaaaaaaaaaaaaaaaaaaaaaaaaaaaaa

SEQ ID NO: 1296 - DNA, 1611 bp, Heterodera glycines
  coding sequence=SeqID_1519; coordinates=22-1474
  peptide sequence=SeqID_1892
gcacgaggagcgtattttgtaatggccgctgataattttgacgctcaacgtattttgaacattttggccgagagagacaatttccaaagtaatgaactcgccgatcagttgtccattgaccaccagcgactgatcggtgccatcaaaagtctgcaggtcaaagaagggttggtttgcacttcggaagtcaaaatcaaacgcatcgaattgaccgcggaaggcgaggaaattattcaaaagggttcccacgagtttaatgtgttcaaaatcgtcggagaaaagggcatttccaaatcagaaattgaaaaaacttcctttggtcccatcggattgggcaaggccatgcaatgcgggtgggtgggcatggacacgcgcgacggagtgcctttggtggtgcggaaggtggcaaatgccgaggacggggccaaggagcaattgaaattggtgaagaacggaaagggcgaccaattgacggcccaatgcgtggcacaactgaaaaagcgcaaatggataatggaaagcgcaattaaagccctttccgttgccaaagggccgaacttcacgacgactgtgcagaagcaggaattggatttgacttcggagatgattgcctcgggttcgtggcgtggcaagcagttcaaacagtacaatttctccgcgatgggcgtgccgcccccctccggccatctccaccctttgctcaaagtgcgtgccgaatttcgcgacattttcttccaaatgggtttctctgaaatgccaacaaatcgtttcgtggagagttccttctggaactttgacgctttgttccaaccccaacaacacccggcacgcgactcacatgacaccttttttctttcaagaccggcactttcaacagaattcccggaagattaccttgaaagtctatcgctacgattggaagttggaagaagcgcagaagaatttgctgaggacgcacaccaccgccgtttctgcccgtcagctttaccttctcgcacaaaaacctttccaaccgtccaaaatgttcagcatcgaccgcgtgttccgcaacgaaacattggatgccactcacttggccgaattccaccaagttgaaggcgttgtggcagaacgaaacctctcactggcgcatgtcatcggacttttcactgaattcttcaggaaatgcggaattgaaaatctccgcttcaaacccacttacaacccgtacaccgaaccatccatggaaatttacgcttttcacaccggactgaacaaatgggtggagattggcaattcgggcatgtttaggcctgagatgttgcttccgatgggacttccggaagacgttgccgtggctgggttcggtctctccctcgagcggccaaccatgatcagatacggcatttccaacataagagagctttttggccataagattgatctcgaaatgatctacagaaaccctttgtgcaggttggagcagaaaaactagtgacgaaatgggagtgccaataaacattcgatgacttttttatgttgacagagctttttgtttgttttgttgctgattgtgagtcatgagtgtaattagacatttttaaaaaaaaaaaaaaaaaaaaaaaaaaaaaa

SEQ ID NO: 1297 - DNA, 666 bp, Heterodera glycines
  coding sequence=SeqID_1520; coordinates=31-666
  peptide sequence=SeqID_1728
cccttgggtttaattacccaagtttgagaaatggttacggaacagaatggcgctacttttgctgttgacgttgaggaaattgcggctgggcatcacgttacgcctgtggacatgacaacagctaccagcaaacttcagcttgaggctgccgaagtgcgaaatccggcgaataaaccgaattggtcatcgtatttgcgctctcaattggtgcctcaaaatgagtacaatttcattattgaattggaaaaggccaaaaacaagcaggagagggacgaagcgttagccaaggacaagacgaattcggcacggagtattatcaatttgatcaccgaagttgcgaaggatcagctgatccgttacgttctcacccttttcgacgaccttttgcaggaggacaaatcccgggtagagattttccatgattatgcaagacggcaaaaacgaactatttggtcgtggttccaagggattttaacgcgaaatgacagtttcattgtcaaccaaatgtctgcaatattctcaaaattggcttgctatggctctgtgcttatggatggacaagaactgcaagcttatttcaatttccttcaacaggaaataaaaaactcgagactagttctctctcaagggcgaattctgcagatatccatcacactggcggccgct

SEQ ID NO: 1298 - DNA, 1028 bp, Heterodera glycines
  coding sequence=SeqID_1521; coordinates=1-767
  peptide sequence=SeqID_1729
ccgacacggtcggttgttgctcgttgcgttgtgagcacatcaaattgcacgatgatatggacgacctgaagtatgttgtggaattcgacttcctcggcaaagactccatccgctattacaaccgtgtgccggtggaaaagcaagtgttcaaaaatctgaagctttttatggaggagaaagacccgggggacgatttgttcgaccgattggatacgagttcgttgaaccaatacctgaaggaactgatggacggactgaccgcgaaagtgtttcgtacgtataacgcgtcgatcactctccaagaacagctggacaaactgacaaatccttccgattccgtccacgagaaaatgctttcctacaatcgtgcaaatcgtcaggtggccatcctttgtaaccatcaaagggcagtgccaaaaacgcacgaaaagtcgatggaaaatttggagaataaaataaaagagaagaagcaggagtacaaggagttgaaggatcagctgaagaagagcaaatcggtggacgagaaaatggcaaaaaaatacgaaagattgaaggaacagatcgccaaactgaacacacagcgcacggacaaggatgaaaacaaacaaattgcactgggaacctcaaaactgaactacttggatccgaggatttcggttgcatggtgcaaaaagaatgacgtgcccgttgagaaaatattcagcaaaacgcaacgcgacaaattccgctgggctctcgacatggcgaaggaggacttcattttctgacacttcctcgcaaccctttccgatttcccttcacccccttttactcgctgttccttacttttggagagtgcccctttcctctcaatcactctcttctgctggacctaaactagtagttgtttatatcttgtcatgcctagtttgtgtgagcgtttgttttcatatgtctgatgattggttcgtattttattaataaaggaagtgttattgaaaaaaaaaaaaaaaaaaaaaaaaaaaaaaactcgagggggggcccggtac

SEQ ID NO: 1299 - DNA, 816 bp, Heterodera glycines
  coding sequence=SeqID_1522; coordinates=1-726
  peptide sequence=SeqID_1730
gaattcggcacgaggattgctcacacccagatgaaactgatgaagcaccgcaacaagaaggcacacataatggagatccaaatcaatgggggtaccgttgccgaaaaagtggactgggctcgtgagcactttgagaagcaggttcccgtggagcaagtgtttgagcaggacgagatgatcgactgcatcggtgtcaccagaggaaagggtttcaagggagtgaccagccgatggcactgtaagaagttgccgcgcaagactcacaagggtctccgcaaggtggcttgtatcggtgcatggcatccgtcgcgtgtctcattcacagttgcgcgtgccggtcagaagggctaccaccatcggacggagatcaacaagaagatctaccgcattggcaagtcgtgtttgacggccgacggcaagaaaaacggaatgaccgacttcgacatcactgagaagaacattaacccgatgggcgggttcccccactatggtctggtcaatcaggactttctgatgatccgtggctgttgcattggttgcaagaagcgtccgatcacattgcgcaagactttgatcaagcagaccaaacgttttgctttcgagaagataaacctgaagttcatcgacaccagctccaagtttggccatggacgcttccagacgagtgcggagaagaaaacattcatgggcaaattgaagaaagactttctggcggaatcggcgtaaaattggccaatttcattgtttattattttgttgaaagtaaagaattgttgtgtaaaaaaaaaaaaaaaaaaaaaaaaaaaaaaactcgag

SEQ ID NO: 1300 - DNA, 791 bp, Heterodera glycines
  coding sequence=SeqID_1523; coordinates=44-676
  peptide sequence=SeqID_1731
gaattcggcacgaggcattgaaaataattaattagacttcaaaatgggtatttcccaagacagatggcacaagcggcgaaagactggggggaagcgaaaccccattcacaaaaaacgaaagttcgaaatgggacggccggcagcaaatactaagattggtcctaaacgaattcatttggtgcgttgtcgtggcgggaacattaaacatcgcggacttcgtcttgataccggaaactttgcttgggcttctgaagggtgcactcgcaaaacgcgtatcatcgacactatgtacaacgcttccaacaacgaattggtgcgcaccaaaacattggtcaagggaatgatcgtctcaatcgatgccattccgttccgccaatggtatgaagcgcattacgcactgccattggcgcgcaaaaagggacaaaagttgaccgaagatgaggaggcgcggattggaggagcacagaaacgctcaaagtcgactctgaagaaatacacggaacgccaaaaaaccgccggggtggagccgcatcttctggaacagttccaggccggacgacttctcgcttgcataagctcacgaccaggccaaagcggacgctgcgatgggtacattttggagggcaaagaactcgagttctacaacaagaaactgaaggctaaaaaggcgaagtgatgccgcaccgaagcttggaattgcgtttccaattttgttgtccgttccttttgagtgaatgataaattttgttgttttaaaaaaaaaaaaaaaaaaaaaaaaaaaaaaactcgag

SEQ ID NO: 1301 - DNA, 2294 bp, Heterodera glycines
  coding sequence=SeqID_1524; coordinates=1-980
  peptide sequence=SeqID_1905
gcacgagggattgcgttatgtggttcatcgacgaaaacaccggcaaattcagtgaccgtttttccgatgatcagttctcattgttcgatgcgatccatcaacctcgtccgctggtcaaaaacaacgtacgagaaatcattgacatggcaaacaatcgacggcttactgttgtggaggcggaggatgcgaacattttgcgtatgcgggtgggaagattcatcgaattgaacggacgcaccgaaatgtctctgcatgatgcgtaccaactcaaattggttcaaaagccgcagactttggccgaggtcattgatagtggctcgctggacaacaatggtcgtttcatcgatggtgttaaacctcgcactctgctcgaggcgatttgttcgggaatgctcgacccggatgtggcgcacatcaaagcgggaccaggcgatgagctgatttccatcggagaggcgctgaagcgaggccgattgacgccgaaaggagaaattgtgttgactctgggtgaagttggcatacacagaggagagaaaattaatttgttcatggcgcacgaacggggccttttgaccagccgtgttcgacacaccatcttcgatgtaaaaggagtgagaaatgctgcggatggttcaattatgagcttcaaggaagctcgtgatgcgggaatccttcagcttcaattcgatgggctggaaaccagactgagcgaagcatcggcccggggagagatcaattcgggactcgccgaaattctcgtcgctccatgcagcttgtccaacaatggtctgccattgtcattggtccgcgcgtttctcaaaggtcgcgtggacgatgtcaatggagaagtcattgatccggccaccgggcttggaaagtccattctcgaggcgtacaatatcggctccgttttctccacgttgcgtgccgccatgcgtcttgctgcactgctcgacgttcatccgtcgctttgtcagtgaaagggcgagaatggttgagtcatctataccatcccactttaattgattctcaatttgactttctgtttatttttaaattgattcttactttgacttaaattatctgtttatgttttactgtattcgttgatttattaattttttgcttaaacttgatatggaaaaaaaaaaaaaaaaaaaaaaaaaaaaaaactcgagcctcgtgccgaattcggcacgaggttgagcgctaaaatgcaagagactcacattgttctcgggattgcctcggtgtgctctctgttggctatcatcgccacagtcgtcactctgccatctctgtactcggagatgagccaaatgaacagcaaagtgcgcgacggagttgaggccttccgcgtcaacaccgactcggcctggactgacttgatggacgtgcaagtggtcgtgacgccgccgtcgaagccccgtgataaccccttcaactccatcttccgtgccaaacgtcaactgcccggacactgccagtgcgctggcctccaacagccaagctgtccccctggtccgcccggcccgtccggaccgcctggacagcccggacagcctggaggcgcaggacagcccggacagcctggacagcctggccaacccgctcctccttgcccgccccagaacatcccctgcccacgctgccctgctggcccgcccggccgccccggaggacagggaccgcccggacagcaaggagcccctggacaacctggtacgcccgctcaaggtggaggacctggaacgcctggcgcgcccggaccccaaggacagcctggacagcccggacgccccggagccgctggccaacccggacagcctggagcgaacggagttgtctcacgcccaattcctggcccgaagggaccgcctggagcgcctggccagaacggaaaccccggaagccaaggtcagccaggacagccaggaggccaaggaccgcccggacctcctggcgcgcccggtcagcccggccagcctggaaactctggccagcctggacagcccggagcaccgggacagcccggcaaggacagcggctactgtccgtgcccgccccgctcttccgtgttggcagtcaaaaagaagatggcggcagccaagaaagcataagcgacaagcgcagggagaagagaaccgaaagacaaaggaccgacgcgaaagcgaagctgaagatgatcataattgggtggaagttgttgtcggaatttgtgttcaccagcgcatttcccacacgaataaagggcattcactaaaaaaaaaaaaaaaaaaaaaaaaaaaaaaaaa

SEQ ID NO: 1302 - DNA, 3516 bp, Heterodera glycines
  coding sequence=SeqID_1525; coordinates=59-3334
  peptide sequence=SeqID_1732
gcacgagggtttgagtgatagtatccttattttataaactcaaatttgctgaagtatcatgggagttccagcctttttccgttggctttcacgaaagtatgtgtcgatcattgttgacgcggtggaacagcgcagaagagaaattgacggagtaaaaatcccaatagatgcaactcaaccaaatgagaattaccaagagtttgacaatctttacttggacatgaacggcattatccatccgtgcacacatccggaagaccgacccgcaccgaagaccgaggaagaaatgttcattttgatcttcgagtatattgaccgcctcttttccatcgttcggccaagaaaacttctctacatggcagttgatggggtcgcccccagagcaaagatgaaccaacagcgaagtcgtcgatttcgagcagcacaagaagcggcggagaagcgcgagctcatcgaaaatgtgcgtaagcggttggagtcggaaggaattccgttgccgccaccgcgaaaggaagaggaacactttgactccaattgcataacacccggcacgccgtttatggcccgtctttctgttgcccttcgctattacgtgcacaaacggatcacctacgacccggcatggcaaaagatccaggttattctttccgatgcgaatgtgccgggtgagggcgaacataaaatcatggactacgtccgacgtcagcgcgcttcgccggcgcatgacccgaacaccgttcactgtctttgtggcgccgatgccgaccttatcatgcttggattggccacccacgagtccaatttcaacataattcgagaagagtttttgccgaatcaaccgaggccgtgcgaactttgcggtcaatacgggcacgaggtcgaacattgtgaagggttggcacgtgccgagaccgggccggaccaagcggacccgctgaagaaggagaagaacttcatcttcatacgtctgccagtgcttcgggaatatttggagcgtgaactttccatgccaaatttgccatttccgttcgatttggagagggccatcgatgattgggtcatgatgtgtttttttgtgggcaacgattttctcccccatttgccatcgttagaaatccgtgaaaatgccatcgaccgtctcgtgaagttgtacaaggacatggtttatcaggctggcggctggctcactgaaaacggcatagtgaatatcgaaagagtgaagaagatcatgggcggacttgggaaggttgaggacgaaatattcaaacaaagacagctcaaagaattgcgcttcaaagaatcaaagaaacagcgaaagcagcaacaacggcaggcaatggcaaaaattatgccgtacaatgccaatttgatagcaccaatgccacttggacagcaaaagcgaatgtcgggcgaggaaatgcgcagattggcggcgggagaccgacaggagttcgtcagacttgcggatgtcgccagttcgcacaaattgcagtcgctgttgacgcctgtcgaccgacgaaaggccacggatggcggtgatcggaagcgcaagttggccccaagttcagtcgacagtccgaacggagcaccaccagctaaatcgtttaaggagggagtggctgctgcttccgtttcctccgaaacggccttgaaaccggagataaaactcgtaactccctctgggaagacggcgcctttggccaagggggcggttggggcactggcatacgactctgacgaggaggaggaagtgctcgacgaaatccgtctatgggaaagtggatggaaggaccgctactacagagccaagttccaagtgtccgagactgaccttgaatttcgcaagaaagtggcatgtgcttatgttgagggactctgctgggtgttgcgttattattatcagggatgtgccagctggaaatggtactacccttaccactacgcgccgtttgcctccgattttgaactgatcgccgatttccaacccgacttcaacatgcccacgaaaccgttcaagccattggagcagttaatgggtgtgtttcctgctgctagcagagctcatattcctgacgggtggcgttggctgatgaccgactcaagttcgccgataattgatttttacccggaaacttttgaaattgatctgaacgggaagaaatatgcttggcaaggcgtcgctctgcttccatttgtcgaggaaaaacgtcttttggatgcacttgactcggtgtacgccactctcacaaccgatgaaattgcgcggaatgccaccggaccagaccgtctttttgtcggcaataaacacaacttgttttcgctcgtttatgaggtgcactcccaaaagacgacaattccgataaaagatgaactaacaaatgatgacacaaaagaaacaagcgaagggacgcgagaaactgaaggagaagccgaggaaactcaacaggcggaaaatggtgaaagcgaacaaatagcgaaagccgaagaaacgacggcacaagaggaacaagcgaacgaagaagctatctcaaaacctgaacaggcaccgaaacaggaattcgagactgaaattgaatttgtcgatgacgaagaaaagaaatgggtgcacatcgacgcagtcaaagcgtatgggatgtctggcgaagtgtcttatgacgtcgaagcactcgcttttggtgaggcgcatcggtcgctgttcagaaattcgttggagtttggcgacatcaaagagaatacctgcattatggttgagttccgagatccccaattcccaatgcacttcatcttcaaagccaacaggctggacggcatcaaggaattgcctcgtgtgctcaaaccgaacgattgggaccaacgacggcacggctccttccaaccccaaatcggattcagtcgtgacatcccacgtgcaaatctctccatggcgggccatcgtacgctcaaccaccacataaacgacaaccgtcgcagttgtccggcctctcttttctcagtgcaaacatcgccaccagcgcacacacttccatggcacatgagcacaaactcaccacaacaacaacatcaaatgcagtaccaacatcagcaacaatggcagcagggtcaattttacaacgggcaacagcagcagcagcccgtgccgttgttcagttttgggcagatggcaatgcccccgcctccgccgctcccaccgcaaaattggattactagtcacccgccaccacaaatccagtctcacgtgccgtacgggcagcccccacctctaatatcacagccacggaatactcagcatcaccatcgcagaaacgacaacaacagaacttacaataggaaataattttcatcaaccgctgaatagcggtcacgatgtgattaattttctacgaaaatggtgttgccagaccctttctgaataaaagcatttaatccatttttgtttcaaatattttgtggtgtggttaaacacaactaagttcaaaaaaaaaaaaaaaaaaaaaaaaaaaaaaaaaaaaaaaaaaa

SEQ ID NO: 1303 - DNA, 1751 bp, Heterodera glycines
  coding sequence=SeqID_1526; coordinates=44-1549
  peptide sequence=SeqID_1733
gcacgagggactgttctttttcaccttccttcaattcaacaaaatggcgaaatctgcaattgatgttaatcgcggcatcacagaagaccaaacagctaccataagaaattatttcacacaaccgcacttaatttacaaaactgtcactggagtgcgcgggcctttggtcatattgggcgatgttaaattcccacaatacgctgaaattgtgaaacttacactgcctaatggagaaaaacgcatgggacaagtactcgaagtaacgaaggacaaagctgtcgttcaggtgtttgaaggtacgtcaggtatcgatgcaaaaaacacaatttgcgagttcactggcgatattatgagaacacccgtttccgaggatatgcttggaagaatattcaatggatccggcacacccatcgacaaagggcccaatgttttggcggaggattacttggacatcgatggacagcctatcaacccatggtccagaatttatcccgaagaaatgattcagaccggcatttccgcaattgatgttatgaatagtatcgccaggggacagaaaattccaattttttctgctgcaggtcttccgcataatgagatcgctgctcaaattgtacgccaagggggcctcgtcaaacagccgaacagaaagaaggaaaatgaggtggagggtgacgacgactttgccattgtgtttgctgcaatgggtgtcaacatggagacggcgcgctttttcaaacaagactttgaagaaaacggttccatggaaaatgtgtgccttttccttaacttggctaatgacccaaccatcgaacggatcatcacaccacgactcgcgctgacttgtgcagaatttctggcttaccaatgccaaaaacacgtcttggttgtgctcactgacatgtcttattacgctgaagcacttcgcgaagtgtccgccgcccgagaggaagtgcccggtcgtcgtggttttcccggttacatgtacactgacttggccagaatatacgaacgtgccgggcgtgttgaaggccgaaaggggtcaatcacacaaattccaattttgtctatgcctaatgacgacatcacccacccaattcccgatttgaccggttacataacggaaggccaaatttatgtggatcgccaacttcacaatcgtcagatttaccctccaataaatgtacttccatcgctgtcgcgtctgatgaaatcggccattggcgagggaatgacccgtgccgatcattcggatgtgtccaaccaactttacgcatgttatgccattggtaaagacgtgcaagcaatgaaagcggtggttggagaggaggcactgtcgtcggatgatttgctctacttggagtttctcacgaaatttgaaaagaatttcatttcacaagggaattatgaaaaccggacggtgttcgactcactcgacattggttggcagctgttgcgcatttttccaagagaaatgttgaagcgaattccagcgaaaacattggataaatattacccaaggggaggcactggggcgaggaacgaatgagcgaagagttgttaattagtctgacagatatccacttaaagattccataattattcacttgtgtgatttacgttatgtcattgactggatttttgcatatttgcggatagtcattattgcttgtattgtattagtatcagtgatgataacaatatactttacctactttaaaaaaaaaaaaaaaaaaaaaaaaaaaaaaaaa

SEQ ID NO: 1304 - DNA, 1040 bp, Heterodera glycines
  coding sequence=SeqID_1487; coordinates=1-824
  peptide sequence=SeqID_1889
gcacgaggcgcgaatatcttcctaaagtgttgggctcgtccttcgccgccacaattggcccttaccgcggctatgacccgaacatcgatccgacggtggccaatgaattcacttcgcaggcgtatcgttttggacatggaatgattcaggagttttacccgcgcttggacagtgccgggcgcaccattccctcgggcggatttgccttcgtcgacggcactctccactcggaccacttcattttccagggcggtccggacccgatcattcgtggaatgatgtctcaacagttgaaaaggccacaacgattgacgcggacgatcaccgaacaaatgtttggcaccaccgacttgggcacaattaacatccaacgagggcgcgaccacggggtgccgtcgtacatgcgctttcggcaattgtgcgggctttccaccgcgacgacatttgaccaactgagtcgtgagataatgagtgtcgaggcacgacagaatttgcagaggatatacggcacgccagaccgaattgatctgttcgtcggcggaatgctcgaagacccggtggtgcgcggtttggtcggtccgacagttgcctgcattattggtcctcaatttgcacggactcgcgacggggacaggttttattttgaaaatccgggcattttcacccgcgcccaattggccgaaattcgccgttcgtcgctcgcccgagtgatttgcgacaacggcgacgactttcggacagtgccgcgcgaagccttccgcacggggccaattgtccagtgcacagagataccgcaaatggacctgagcaaatggaaggagtgaacgaggagaaaggaatgttcagctgattgatcagaaagggacaccgtacgaatcattggacataccgtactctcttaccgtattgtattttggaaatctccgccttttctatggtccctttgccctcctcatttttctgtatttgcttgcatcaaatttttgcatttcaaaaaaaaaaaaaaaaaaaaaaaaaaaaaaaaaaaaaaaaaaaaaaaa

SEQ ID NO: 1305 - DNA, 1863 bp, Heterodera glycines
  coding sequence=SeqID_1527; coordinates=35-1747
  peptide sequence=SeqID_1734
gcacgaggccttaagccatacaatatttgcttagatggatttgttaaaatcttacgacggctcttcatcatcggacaatgaacaagaattggcagatataccttcttcgtccaatcacaacaaattgctcgctttgaaaatcccatccatcaacttaacacccaacgtgattgaacaacgcgccattcaacaggttgcggttgtggatccaaaaaccaaagagttgtatcacaatccgcgcttcgacgaattgtttaaaccagagagcggcccacaaaatccgtttaaaagtgaacatcaacgagcagaaaagaacacactgaccggctatgtggagccagcgcatttcaacgccttccattttgagcgttcacttcgctcctacgatacgcttggctatgcggataatccaacggcagacacaaccagcgcaaagttcgttggtgacgttggacaagcgcaagaaaaggccggcgagtcgctttttgaatcagtaaaaactggcggacagaagcgaaagagagtgataaattacgacgcatcaaacgttgacggatatacgggaccgtgggcaaggtttgaggacgagaagacaattgctcgaccggacccagaattgcagaaggaaatggacgaaattgtgcggaaacggaaactgaaaagtcgtgctggccgaagagcggccatcgcggaattgcatttggcagaagagagcaccaaattgcacataaaagatgacactgactatttgggccgttcctttatggaaccgccgaaatacacgggcaccaatctgcgcgaggactttgtgcccgaccgctgtttcccgcccacaaaacaagcacacacctacagcagtcacaccaaaccggtgaccgccatccgatggtttcctcgtagtgcgcacatgtttatctcttgttccatggacggaaaagtcaaattgtgggaagtgtacggcaaccgtaagttgatccgcacatacactggacacaaagtgcccgtgaaggacatttattttaacaacaccggcactgaatttctaagtgccgcttatgacaattacatcaaattgtgggacactgaaaccggtcaggtgaaaaaccgctacacaattggaggccatcgggcgtatgtggtcaaattcaacccggacgatgataaacaaaacattttcatggccggaatgtccaacaaaaagatcatccaatgggacacgcgaactggcgaaatcgaacaagaatacgaccgtcatttgggtccagtgaactcgatcacctttttcgacaaaaaccgtcgtttcgtttctacttcggacgataaatctcttcgcatttgggaatttggcattcccgtggatacaaaactgattcaacatgctggactacactccattccttcaatgactagggcaccaaatgaaaaatggatcgttgggcagtccatggacaatcgaattgtccttttccaaatcgtcgatgacaagttgcgattcgctcgtaaaaaggccttccgtggtcacaatacagcagggtacgcctgctcaactgatttttcgccagagatgagttttctcgcttccggtgatgcggacggtaaaatcacaatgtgggactggcgcacacacaaaattgtctccacgtggaaggcacatgataatgtgtgcatttcaacactgtggcatccgcacgagaaatcgcggatgatttcttgcggatgggacaatgtaatcaaaatgtgggtctgacaatgaagtaaagctgacgacgattcagtgatttaaagtgaatttatttgtaatgtctcaaccgataaaaggaaaaacgtcctaaaaaaaaaaaaaaaaaaaaaaaaaaaaaaaaa

SEQ ID NO: 1306 - DNA, 1094 bp, Heterodera glycines
  coding sequence=SeqID_1528; coordinates=34-987
  peptide sequence=SeqID_1735
gcacgaggcatttgttcactttaatattttgccatgtcttttcttgtcacattagccggctatttgacaattgccatttttctccagaaactctttcgctctctgtacaatgtggttttcccctatttgttcgctgttcctcagaatatcaaggtgctcgcgggtgccgagtgggcagtggtcaccggcagcactgacggcattggcaaggcgtacgcgctcgagttggccaagaaaaacttcaacgtggtgctcatctcacgctccatggacaaactgaacgcagtggcggaggaaatcaaacagaaatatcccaatgtggaagtgaagtgcatctcatttgacttcaccaacgcaaatctgaaggactacgagcagacaattttctcccaactttccaccatcgaagttggaatgctcgtgaacaatgtcgggatgagctacgagtaccccgagcgattggaccgtattgagggcggactgcaacgcgtttccgacattaccgtgatcaacaccctgccgactacggtactctccgcttttgtgctcaaacagatgagggaacggggacgcggcgtcgtcgtcaatttggcctcctcggcagcgtatttcaattggttttacctggccgcttattctgcgtcgaagaaatacgtgtgttggttgtcctccattctgcgcatggaatacgccgacaccgacattgtcatccaaacggtgtgcccgatgatggtggccaccaaaatggccaagattcgcaaggcttccttcttcacgcccagccccgaggaatttgccgcccaagcgctccgcagcattggcttggtcgacgagaccaccggctgtttgtcccaccaaattcaggccgagctgatgttcggctacgtccccgccccgttgctgaacaaattcgtgcgcgacaactcactgcagacgcgcaagcgcgccctgaagaagaaagaagcgacggtggcgaagagtgaatgatgagaaaaaagaaagaaaagtgatgtgaaatattgacattcattgaaacaaccaaagtaaattaaagttatttaataaaaaaaaaaaaaaaaaaaaaaaaaaaaaaa

SEQ ID NO: 1307 - DNA, 872 bp, Heterodera glycines
  coding sequence=SeqID_1529; coordinates=63-713
  peptide sequence=SeqID_1736
gcacgagggtttgagcacttttgaaaattttataattgaattttgctcatatttttgcataaatgaaccaagaacaagacaatatcccaactttcaagcttgtgttggttggtgacggtggtaccggaaagaccacttttgtgaaacgccatttgactggagaattcgagaagaaatatatcgctacgcttggtgttgaggtccatcccctcacttttcacacttcgcgaggtcaaatccgattcaacgtttgggacacagccggccaggagaagtttggtggacttcgtgatgggtattacatccaaggccaatgtgctattgtcatgttcgacgtgaccgccagagtcacatacaaaaatgtgccgaattggcaccgcgatttggtccgagtttgtgagaacatcccaattgtgctggtggggaacaaagtggatgtcaaagataggaaagtcaaggcgaaaagcatcacttttcaccgcaagaaaaatctccagtattacgacatttccgcaaagagcaactacaatttcgagaagcccttcctttatctggcacgaaagctgatcggcgaccccaacctcgaattcgtggcgatgccggcactcgctccacccgaagtacaaatggatcccgctttggctgccaaatacgagcaagaagtggccgaggcagcaagcgctgaactcccggacgatgatgaggacatttgaagagatggaaggacggctgggacagattcctgggacagcaatttccgagcagacaaagttatgtccattgttttaattgattgtttgatgagtaaaggaaagcgaatgaaaaaaaaaaaaaaaaaaaaaaaaaaaaaaaactcgagggggggcccggta

SEQ ID NO: 1308 - DNA, 1202 bp, Heterodera glycines
  coding sequence=SeqID_1530; coordinates=1-1024
  peptide sequence=SeqID_1893
gcacgaggcccgtcatcagggcgtcatggtcggcatgggacagaaggactcgtacgtgggagacgaggcgcagtccaagcgtggtattctgacgctgaagtacccgattgagcacggcatcgtcaccaactgggacgacatggagaagatctggcaccacaccttctacaacgagctgcgtgtcgcccccgaggagcacccggtgctgctcacagaggccccgctgaacccgaaggccaacagagaaaagatgacccaaatcatgttcgagacgttcaacacgccggccatgtacgtggccatccaggccgtgctgtccctgtacgcctccggccgtaccaccggtctcgtgttggactccggcgatggtgtcacccacaccgtgcccatctacgagggttacgccctgccccacgccatcctccgtttggacttggccggccgtgacctcactgactacctgatgaagatcctcactgagcgtggttactccttcgtgaccacggccgagcgtgagatcgtccgtgacatcaaggagaagttgtgctacgtggcactcgacttcgagcaggaaatggccactgccgcctcctcctcctcgctggagaagagctacgaactgcccgacggccaagtgatcaccgtcggcaacgagcgcttccgttgcccagaggcgctgttccagccgtccttcatcggcatggagtcggccggcatccacgagtccacctacaactcgatcatgaagtgcgacatcgacatccgtaaggacctgtacgccaacaatgtgctgtccggcggcaccaccatgtacccgggcattgctgaccgcatgcagaaggagatgaccgcgctggccccgtccaccatgaagatcaaaatcatcgctcccccggagcgcaagtactccgtctggatcggcggctccatcctcgcctccctgtccaccttccaacagatgtggatcagcaagcaggagtacgacgagtcgggcccgtccattgtccaccgcaagtgcttctgagcagcagctgcacgaccgcacggaggaggaggagaagaccaacgaagccgggacactcgccatccgccgacccattcgccaccccccaccaccatctgttttttgctgaaaattatgcaaaaatatttttgaataaaatctatgaacaaaaaaaaaaaaaaaaaaaaaaaaaaaaaaa

SEQ ID NO: 1309 - DNA, 2217 bp, Heterodera glycines
  coding sequence=SeqID_1488; coordinates=671-1819
  peptide sequence=SeqID_1703
gcacgaggcacaatatacctatatgttaattatgtcatttcggtcagcagcggcattagggcttaacttgcgtaaagcatccaaatttgtgttgttcggcgcattggccaccggtggcagtgtgttgctgtactcgttggagaatagcggtgcgcgtgcctacgactttgttgtgcacccgagccattttttttgggttcgtcgcggttaccaagtgtacaagcaagtgtgtgccgcatgccattccttgaaattcatccgttacaaccattttgtcgacaatttcatgacacgggatgaggcgaagacggaggctgccgagaaaaatgctttcacaagaagaaatttttcgaaatacacgaactgttgcccaaggattggatgcattgagggaagaaaatgaggccatcaagaacaaattgttggtagggatggacgtgttgacacctgatgaacgtcaactcatcgatgagaaggcgtcaattgtggaaaaaaatcttgaaaacatccaactcggactggaagaatcgcaggtgatgttggcattggcatcgcatttacaaaatttggaggcggaaaaacaaaaatataaggcgcaagtgcgtcgtctttgtcaggaaaatgcgtggattcgggacgagctgaactcaacgcaacaacagcttcgccaatgcgaacaagacaaggcacaactcgaggaagagaacaagcacttgaaatttatgaacagtatcaagaagttcgacgaggatttgccggacagatcggagaacgaagaaaacaatcggagcaactgcgatccaacgaagtgaacacgtcgacgactttgcaagagcttggttttggaccggacgaggacgacgatttgcacaatgccagtcacttttcacaaccgactccggcgaatgcgatggctgccagtaccagcgcgggttacgatattccgcagcgtttgaaaacgctccacaatttggtcattcaatacgctgcccaggggcgttacgaagttgccgttccgttgtgcaagcaggccctggaggacctggagaagaacaacggccacgaccaccccgacgttgccaccatgctgaacattctcgcattggtttatcgtgaccagcgcaagtacaaagaggctgccgccctcctcaacgaggccttggccattcgcgagcgatgcctcggcgaggaccacccggcggttgccgcaactctgaacaatttggccgtcctttatgggaagaggggcaagtacaaagaggcggagccactttgcaagagagcgttggaaatccgagagaaagttttgggcaacgaccatcccgacgtggccaaacagctgaacaacctggccttgatttgtcaaaaccagggaatgtacgatgaagttgaaaaatattatcgtcgagcgctggaaatttacgagtcgaaattgggaccggacgattcgaatgtggcgaagacaaagaacaatctttcgtcggcatttctgaagcaaggcaaatacaaggaggcggaaatgttgtacaaacaaattctgacacgggcgcacgaacgacagtacggccgagtgaccgatgagaacaaaccgatttggatgatagcggaagaccgggaggacagtaaacaagcggacagcggaatttaccacgagaatttgcaagtgtcgatgaaagttgacaagtattcaaagtcattatggcggatgtttggcctaagacggttccaaaagagcagcaccctttttacgtcctccaccccgagcctattcgaatctctccgctgctccgatttgctcgttggtcggccctcggcctaggcattgtgtatggtttcgtccgtcttcgtatggtcagcaaataccacgcggacatccgcgaatgggaagtgcaaaagaccatccacaagaaggatgcggataagaaggagtcactgagagtgctgcgggagcaaaacgaatggattatgaagatcaccgacatgaatttggaggagggaaagtcgcaattgggcgtggagcatttgtacgatttgaaatagaaagcgaagaatcgtctcacaacgacaaattgcgattagggatttctttgtgttatcagtcacagttgacgaacctttcaattgttttgtttggaaaaacaatgttattgtagatttcgtaaaaataaagaaatttcattaaaaaaaaaaaaaaaaaaaaaaaaaaaaaaaaaaaaa

SEQ ID NO: 1310 - DNA, 1045 bp, Heterodera glycines
  coding sequence=SeqID_1531; coordinates=1-935
  peptide sequence=SeqID_1737
gcacgaggcacgaaaatgtggcgcccactgacattgaggagggaatgcgagtgggtgtggaccgcaacaaataccagattcatttgcctttgccggcaaagattgacgcgtccgttacgatgatgcaagtggaggacaagccggacgttacctacgcggacattggcgggtgcgaagaacagatcaaaaagttgcgtgaagtggtcgagtttccgttgcttcagcctgagcgtttcacgagtttgggcattgagcctccgaagggcgttttgttttttggtccgccgggcaccggcaaaactttgtgtgcccgcgcggtcgccaatcggacggacgcgtgtttcatccgcgtcatcggttccgaattagtcaaaaaatacgttggcgaaggcgcgcgcatggtgcgcgagctgttttcgctggctaaaacgaaaaaggcgtgcattctcttcttcgacgaagtcgacgccatcggcggagcgcgatttgacgacggaaaagggggcgacaacgaagtgcaacggacgatgctcgagttggtcaaccaactggacggattcgactcacgcggggccatcaaggttttgatggccaccaacagaccggacacactcgacccggcgctcattcgtcccggtcgcattgaccgacgcattgaattttccttgcctgacctcaaggcacgaggaaacattctccaaattcacaccaaacggatgagcgtcgaccggaacattcggtacgaattgattgctcgactctgtccaaacacgacgggtgccgacttgcgcagcgtttgcactgaggcgggaatgttcgctttgcgtgcacgtcgaaaggtcataacggagcaagactttctcaaggctgttcagaaagtggtgaaaagctacgccaagttcagttcaacgccggcgtatatgacgcacaactgacaacacagttcttacaaaacggacttttttatatttgtgcacttttgtttcattacaatataaatgaggaaaccaaaaaaaaaaaaaaaaaaaaaaaaaaaaaaaaaaaa

SEQ ID NO: 1311 - DNA, 834 bp, Heterodera glycines
  coding sequence=SeqID_1532; coordinates=65-637
  peptide sequence=SeqID_1738
gcacgagggaagtctcaactctcagacgagcctgtcccgcacactttgccttccgcccttcaccatgcaaatcttcgtcaagaccctcacgggcaagaccatcacccttgaggtcgagtcctcggacacgatcgatgccgtcaaggccaagatccaagacaaggagggcatcccccccgatcagcagcgcctcatcttcgcgggcaagcagctcgaggacggccgcacccttgccgactacaacatccaaaaggagtcgaccttgcacttggtgctccgtctccgtggtggtggcaagaagaagaagaagaagacctacaccacccccaagaagatcaagcacgtccacaagaaggtcaagcttgccatcctcaagttctacaaggtcgacgacaacggcaagattacccgtctgcgtcgtgagtgccccgccaagacctgcggcgccggtgtcttcatggcctggcacgtcgaccgccagtactgtggcaagtgcggcttgacctacaagctcgaccccgccaccatcaagaagaacatggccgctgccgccaaggcctccaagcccgccgctgctgccaagcccgctgccgaggctgccgctgccgctggcaagggcaagggcaagaagaagtaaaccttgttgcttcccactcccttggttctctctggtgtgtgcccttggcacctccacgattgttgctcggttgggtcggtgttgtttcttggatgtcaactttgtgtgttcaaggaatgtatatatcgcccatcttggtttcttgaaaaaaaaaaaaaaaaaaaaaaaaaaaaaaaaaaaaactcgagggggggccc

SEQ ID NO: 1312 - DNA, 1188 bp, Heterodera glycines
  coding sequence=SeqID_1533; coordinates=1-1074
  peptide sequence=SeqID_1906
gcacgagggtttgaggtgcctttggctgtggtaaaactgtcatttcgcagtcgttgtccaaatattccaactccgatgccattatttacgtgggctgtggcgagcgtggcaacgaaatgtcggaagtgttgcgcgactttcccgaactgacgatggaagtggatggagtgaccacgtccatcatggagaggacggcgctggtggccaacacttcgaatatgcccgtggcggcgcgtgaagcgtccatttacacgggaattactctggccgaatacttccgcgacatgggtctgaacgtggccatgatggccgactcgacctcccgatgggccgaggcgctccgtgagatttcgggccgtctcggggaaatgccggctgactcgggttaccccgcctatttggccgcacggctcgcttccttctacgaaagggcgggaaaagtgaaatgttttgggtcgcctgaacgcgaagggtccgtcactattgtcggcgcagtgtcgccgcccggcggagacttcgccgaccccgtcacatcggcaaccctcggcattgtccaagtgttttggggactcgacaaaaaattggcccaacgaaagcacttcccttcaatcaattggctcatttcttacagcaaatatatgcgtgcgttggacgattattacgagaagaattttgccgaatttgttccactgagaacgaaatgcaaagaaattttgcaggaagaggaagatttgtcagaaattgtccaattggtcggcaaagcatcgcttgccgaggccgacaaaatcactttggagctatgatcgcttctgtcccttctacaaaactgttgggatgctcaaaaatatgattggcttttacgactttgcccggcactcggtggaaacgactgcacaatcggacaacaaaatcacgtggaatcagatcagagatcacctcggggacatcattcacgaactttcttcgatgaaatttgaggacccatccgaaaaaacggaagatcagatcaaaaaggattacgaagaactgtatgaacggatgcagaacaaattccgagcgttagaggatgaatgaacaaactgtgatcaatgataacaatttctcaaaattttccctcatttctcttagtgtagtgatggaaaaaacgtctcagtgaaaaaaaaaaaaaaaaaaaaaaaaaaaaaaaaa

SEQ ID NO: 1313 - DNA, 721 bp, Heterodera glycines
  coding sequence=SeqID_1534; coordinates=1-601
  peptide sequence=SeqID_1739
gcacgagggcaagatcagaggtctcgcttacgtatgcaaagtgacgccatcaatcgcatctcgaatgattgacggagctaaaaagatgcttcacggaaacatttctgacatttacattacgattgaccagaggaagggcccccagggcggactatctcccggctttggaatcttcttgacggctgaaaccaccgaaggcgtatttttccatggagaagcgatgtcgcgccctaagggccaaaacgaagaccaaacagtgccggaagaaattggggaacaggcggcaagacgtttgctggatgaaattcatatgggaggctgtgcagattcgtcctgtcaatctttggccgccactttcatgactctctgcgacagagatgtttcgaaatttctccttggtccactcacaattaacagcgtacacacccttcggaatttgcaaatgtttttcgagcaaatgtttaaattggaggaatggtggaaggttatgaaagaaatcgtcggaaaaggcggaaatgcgatgaaaaacggaagtgaggacaaatgtttgatgacctgtgttggggttggtttcttcaacatcaacaaagaccaactttaattgttcttttttgttaattttatatttgtttttatttattgtaataagactgaccgattgaattcggcaaaaaatacatttcttattttaaaaaaaaaaaaaaaaaaaaaaaaaaaaaaa

SEQ ID NO: 1314 - DNA, 863 bp, Heterodera glycines
  coding sequence=SeqID_1535; coordinates=1-749
  peptide sequence=SeqID_1740
ttcgaacacctcaaatcggggacaaatttgcttcacgtcatggtcaaaagggaacaatgggaatgatgtacagacaagaggatatgcctttcacatgcgagggcataacgccggacattatcattaatccacacgctgtgccgagtcgtatgacaattggacatttgattgaatgcctccaaggaaagctttctgcaaacaaaggcgaaattggcgacgccacccctttcaacgacacagtcaatgtgcagaaaataagtgctttgcttgagggctacggctaccaattgcgtggcaatgaaataatgtacaacggatttaccgggcaaaagttgagcacacaggtgtttctgggcccaacttactaccaacggcttaagcacatggtcgaggacaaaattcactcacgcgcccgagggcctgttcaggggatgaaccgacagccaatggaaggcagggcacgtgacggtggactgcgatttggtgaaatggaaagagattgtcaaatttcacacggcgctgctcaatttttacgggagagactttttgaggtgtccgatccatacacagtttatgtgtgcaatcaatgcggattggtggtgattttcaatcaacggactaacactttcgagtgcaaagcatgtcaaaataaaacgcaagtgtcagctgttcgaattccttacgcgtgtaagctgttgttccaggaactcatgtccatgtctatcgcaccgcgaatgatgaccaaatagtctttgtttttgtttgttcatttttttttatttttgaattgaataaatttaaaaagattaaaaaaaaaaaaaaaaaaaaaaaaaaaaaaaaaactcgagggggggcccggtacc

SEQ ID NO: 1315 - DNA, 2081 bp, Heterodera glycines
  coding sequence=SeqID_1536; coordinates=Jan-70
  peptide sequence=SeqID_1907
gcacgaggcagaattttccctcattccctgtttttgttatggcttcaactcataatcattgttacattgaaagcctcaggacgaggcagacagcttcgctcaagcaacttctgaacctcaaccagcccctgaacgtttctctggcggttgaacccgtgtggaaattgctgatttttgaccgctactgtcaggacatcatttctccgctgctcagtgtcaaacagttgcgcgaactcggcgtcacactgcacttatcggtcgactcgccgcgtgagattctccccgatgttcccgcagtttattttgtgtcgccaaccgaacaaaatgtgcagacaatttgtgcggatttgaagcgtgccatgtatgacagcttctacttgaacatggtcaggcccatcccacgccctttgcttgaacaattggcggaaagcgcagtggccggtggcgcaacacaacaagtgcagaagttgactgatcagttcctctccttcatttcgcttgaagatgacctcttcatgctcagccgttacacaaaaagcagcccattctctttttacgcaattaatgacccgtcgataaccaccgatcaaattgacgcgttggtcgccgacattgccaatggactgttcgccgtctgtgtgacgcttggtgttgtgccggtgatcaaatgtccgaaaaacaacgcggcggagagagtggccgaaaaacttgatcaaaaaattcgtgacaatctccgcgacgcccgcaacaacttgttcgtccaggaaaacattcgggcaggccatctgagcattcatcgtcccgtgttggtcatcgccgatcgtaccaccgatctgtccacgatgttgcaccacacgtggacttaccaggcgatgatcgcggacattttggaaatggaattgaacagagtgcggatgaaagacaaaaatgggcgccaaaaggactacgaatttggcacggaagacaaactgtgggccaactacaaaggcagcccattcccattggtggcggaagccatccaagaggatttggaggcgtacagacgcaacgaagacgaaatcaaacggctaaaggaatcgatgggactgtccgacggcgactcggccgaaatggccgtcgacatttttggcactgccgccacggcgaaactttccacggcggtcggcagtctgcccgaactgttggagaagaagcggctgatcgacttgcacacgaacgtggccaccgcactgctggacaacatcaaaacgcgaaaattggacgtattgtacgaaacggaggagaaacttttgacaggccaagaaattccggtcattgaaacattgcgcgactgtccggacaaagacgacattttgcggctgattttgatcgctttgtgttctcggaatatgccaactgctgaacagcgcgaacttcaggctttcattgacgaacgtgcaattagctcggatgcgctgcattttgtgcggcaactcagggctttttcccatttgggtgccgaggcggaacagcaccaaggggccggcaccaagacggtcagcatgttctccaaactgctcagccactcatcgcgctttgtcatggagggcgtcaaaaatttggtgcccaaaaagcacaacttaccactgacgaaggtggttgaccagctgaccaccgatgtgaaaatgggcgttggagtggccggcattacgggcagttcgtccgactttgacccggaccaattccgactgttcgaccctaaactattgcagggctcggccgtaaacagagatgttcgtcccacccaagcagcagccgacgtgatcgttttcgtgatcggcggtggtaattacgtggagtatcaaaatgtgcaggaatgggccaaggcacggggcctccaacggtgcacctacggatgcacggagatggtcaacccgaagcaattcgtcgaacaactgaccgatttgggtgccaaatcacgggcaatgtgatcaaagcagaaaaggttgtgatctgttcgtccttggaatgcgctgtgcataatttttgtgatattataaattttttgttcaaaaaaaaaaaaaaaaaaaaaaaaaaaaaaa

SEQ ID NO: 1316 - DNA, 1176 bp, Heterodera glycines
  coding sequence=SeqID_1489; coordinates=1-1176
  peptide sequence=SeqID_1890
gcacgaggcggaaattgtggccactctgttctttgccgaaatgcgttatgacgtgaaggacccgcgcagcgcatccgccgaccgtttcattctgtccaagggtcacgcttgcccaattctgtacgccgcttgggaagaggcgggcctgctcagccgtgaccaagtgctctccctgcgcaagattgactccgacattgagggacatccgaccccgcggctcaacttcatcgacgtggccaccggctcgctgggccagggtctgtcatgcgctgccggcatggcgtacactggcaaatatgtggaccattcgtcctaccgcgtgtactgtttgatgggcgacggagagagtgcggaaggctccgtgtgggaggcggcagcatttgcaagtttctacaagttggacaatctggtggccattgtggacgttaaccgacttggacaaagtcaggagacccaactgcagcacgacattgaagcgtatgtgcaacggtttgccgcgttcggttggaatgccatcggattggaggacggacacgacattacggcacttttgaatgcttacgccaatgccaagaacgtgactggcaaacccacggcaatcatcgccaaaacgctcaagggcaagggcattgacggcgttgccgacctgaacaaccagcacgggaagccggtgtcgaaggacaaggcggagcccatccgggcattgctcaaaagtgacaaaccggcaaattggaccatcccggcaccgattcgggacgcaccggcggtcgacttaggcatcggtgccatcgcaatgagtgcaccgccgcagtacaaaatgggcgaaaaggtggccactcgacaggcgtacggaaacgccttgctgaagctggcggaggccaacaaacgcgtcattgccttagacggtgacatctccaactccaccttctccaacctggtgcaaaagaagctacccgagcagtttgtccagtgttacattgctgagcagaacatggtcggtgttggagttggcatggcgtgccgtggacgtgtgcttccgcatgtcagcacttttgccgccttcttcacccgtgccggtgaccaaattcgcatgggcgccgtgtccttcacaaatgtcaaattcaccggctctcactgcggcgtttccatcggcgaggacggtcccagtcaaatggc

SEQ ID NO: 1317 - DNA, 565 bp, Heterodera glycines
  coding sequence=SeqID_1490; coordinates=244-423
  peptide sequence=SeqID_1704
ttcgccgcgtcttttttttttttttgtaaataaacaggcgaagcacttcgtctgctcatcgctgagccggaacgaattgaacggttgcactcaaatgcaattgtgttgcatcagctgatccggaatgctctcgagggcacaaaatttggactgatcagtattgactgtgccccgcagaaacacatcgaatatcgaacgaaggacggggagggaagggaaattgtggagcagaaattggaccgaatggtcaacaggcttctcgaccatggcattttggtgactcgcgcccgataccttctcgacaaagaaaaattctgtcccaaactgacaataaaagtttcgtgccgtgccgatttgaatggcgacgaattggaaaatttgggacagaaactgcgtctgacttttgccactttggaattttgacggaatccatcactttttgaaatacatatgctcaattgtttgtgataataaattcgataattgaaattagtatacaaaaataaacgataaaaagttaaaaaaaaaaaaaaagtactctgcgttgttaccactgctttagtag

SEQ ID NO: 1318 - DNA, 1745 bp, Heterodera glycines
  coding sequence=SeqID_1537; coordinates=1-1629
  peptide sequence=SeqID_1741
gcacgagggtccccttctctttccgtcgccaactcaaatgtctctcgacagcttggccaaccaaaagtagcgggcttcaaagataaggataaaccggaaagtgttcgtaccagcaacatcgtggcagcaaaggctgttgcggatgcggtgcggacgagtcttgggcctcggggaatggacaaaatgatccaatcgggcaacggagaagtgacaattaccaatgacggggcgactattctcaaccaaatgtcggttgtgcatcccaccgcaaaaatgttggtcgagctgtccaaagcgcaggacattgaggcgggcgatgggaccacaactgttgtggtgttggccgggtccttgttggacgctgcagaaaaacttcttgccaaaggaattcatccgaccaccatttccgactcattccaacgggcggccacattttctgaaaaagttctcgaggaaatggccacacccattgacattaacgatgacgacgagttggtgaagctcgccatgacgagtttgaactcgaaggtcgtttcgcaacattcccatcttttggccccaatggcggtgcaggcagtgaagaaactgatgagttcaccggaggactcaagtgtcaatctgaagctgatcaaagtcgtgaaaaagttgggcgaaacggtggaggagtcgcagctcattgagggagcgctgatcgatcagaagtcgatgggccacggaggcccggcgcgggtggagaaggcgaagattggcctcatccaattccaaatctcaccaccaaagcccaacatggaaaatcaagtggtcatctctgactatgctcaaatggaccgtgcgctgaaggaagaacgaaattacattttggagctgtgcaagcaaatcaaaaaggccgggtgcaatgtgttgctcatccaaaagtccattttacgcgatgccatcaacgaaatggcgctgcactttttcgcaaaaatgaaaattatggtgatcaaagacatcgagcgggatgacatcgaattctatgccaaaatcctcgggtgtcgcccggtggcatccgttgaccattttgtgccggaatcgctcggaacggccgatttggtggaggaaattgagacggctgatgggaaagtcctcaaagtgaccggccttaaacagagtgggtgcgctgtgtccattttggttcgcggctccagcaaattggtgttggacgaagccgagcgctctctgcacgacgcattgtgcgtcattcgctgtttggtgaagaaacgcgcccttctttccggcggcggtgcccccgaaatggaagtgtccgtccgcgtccgcgcagctgctcagacaaaacacggagccgaacagtattgctggaaggcatttgcggacgcactcgaagtggtgccatacactttggcagaaaacgctggactgtcgcccattgaaacagtgacggagatgcgcagtcagcacgcaatgggaaacaaagagcacggagtgaatgtgcgaatgggtgccattacggacattcgtgaggaaaatgtggtgcagcctcttttggtcagttcgttcgccgtcaaacaggcggctgaatgtgtgcgcagcattctcaaaatcgacgacattgttctgtccgtgcgttaaagtgacggaaatgcaattagaaatttgtggacagccatttttgaatgttatgacgttctctcgcataaatcgctttttactaaaaaaaaaaaaaaaaaaaaaaaaaaaaaaaaaaa

SEQ ID NO: 1319 - DNA, 837 bp, Heterodera glycines
  coding sequence=SeqID_1538; coordinates=1-691
  peptide sequence=SeqID_1894
gcacgaggtaaacattggcattcagccgcctaagggcgttcttatgtatggaccaccaggtacgggtaaaacgatgttggcacgtgccgttgccgctcaaaccaagtccacttttctgaagctggctggtccgcaacttgtccaaatgttcatcggagacggcgccaaattggttcgagatgcttttgcactggccaaagagaaagcaccgtccattattttcattgacgaattggacgcaattggaacaaaacgattcagttcggagaaggccggcgatagggaagtgcagcgtacgatgttggaattgcttaaccaactcgacggcttccagccaaatgacgacataaaagttattgctgcgacaaaccgtgtcgatgtgctcgacccggctctgctccgttccggcagattggaccgcaaaattgaactgccagcgccaaacgagaaggcccgggcgcacatcgtccgcattcactcccggaatatgaacgttgataaggatgttaatttcgatgagttggcacgttgtaccgacgattttaatggtgctcaatgcaaagctgtttgtgtggaggcgggtatgatcgcgcttcgtcgtgaatctcacatcattctgcacgaagattttatggacgctatccttgaggtgcaagccaagaagaaaacgagtctgaattattatgcctgatcctttgtccgaacctgccctaaatggcgaaatatattgtttttttttgtgatttggcgaaaatgaatttgataaagcgtttaattattttaaaaaaaaaaaaaaaaaaaaaaaaaaaaaaaaaaaaaaaactcgagggggggccc

SEQ ID NO: 1320 - DNA, 1632 bp, Heterodera glycines
  coding sequence=SeqID_1539; coordinates=73-1029
  peptide sequence=SeqID_1742
gcacgaggataagattaacccccttttttgaactgtttgaattttctgatcagtttgtttttacatcattcaatggacatcgttgacgaccctttgtccgagccttgccatgtttgtggtgacaaatccaccggcacacattacggcacggtttcctgcaacggatgcaagggcttttttcgccgtactattttacgaagtcagaagttcacttgtcgtttcaacaagcaatgcgtcatcgacaaaaactatcgctgtgcgtgtcgcttttgccgcttccaaaagtgtctgagtgccggcatgaaaaaagaagcaattcaatttgagcgcgatgcgattggttcgccgcttccgttgaaaaggcggcgcgtcgccgacgacggccgggccgaccattccccgtcaccgaccggtggacggacagcgaccgatggcattgggacggcggtgggccgacccgtaatggcacaaggggacggaaagggtcagatggaaagtcctcccgagatttacgttgacatcatcggcacattggtggagatggagcaacgcgtcaattacgaaatgagtcttcgctatcgttctctgtgcggcgccgtctttccctcctccgtcggcactgacaacgcatcgtttgccggcgacgcttcgtccgttttcaatctttcgagtggacgtggggcggcactttccgtggaggaattgaatgaactttcgcgtacgacgctccttttgatggtcgaatgggccaaaggcattgagccgttccctgggctgagcatggaggacaaagtcattctgttgaagaattacgctcctcagcatctcattctgatgcccgccttccgctcgcccgactccacccgcctttgtctcttcaacaattcgctgttgggcaatggcgcggagggccaagcggcagacggcggagaagcgccgttgggctgctccttcgccggtttaaaaacggctaatataatgcaagagtcctcgacgaaatcgtgtggccaatgcggcagctccaaatgagagaggaggaattcgtctgtctgaaggctttggcctttctccatcccgaggccaaaggactttcgctgaatgcgcaagttttgatcagggaaacgcgcaacaaaatacttaaagcgctttattccatcattatgtcgtccaatcccatcgaagaaacgcccatgcgatacggcaacattttgttgctggcgccggcactaaaagcactcactcagctgcttattgagaatatgaccctgacaaagtttttcggactcgccgaggtcgattcgctgttggccgaattcattttggacgatttgagtggcggcgggggtccctcttctgcgccaaagtcaatcaaagagcaactgagttcgagtgcgccttccttttccaacttcatcagcacgccctcggccatgggaatgggcggacagtgaaaaaagagaaaaacgtagtcaatcccacacattccaacgatatttcaacattttaatcttgtgtttcaattgcggtgattttttttagcaaatcttagtcaattagcaaatgcattaattaaaggaagcaatttataaaaaaaaaaaaaaaaaaaaaaaaaaaaaaaaaaaaaaaaaaaaa

SEQ ID NO: 1321 - DNA, 964 bp, Heterodera glycines
  coding sequence=SeqID_1540; coordinates=78-629
  peptide sequence=SeqID_1743
gcacgaggatttttttgtttttgtcacgccaaaacgcagcaatttggtgaaccgttcgacagaaaaggcataagcaaatgacagaatataagttggtcgtcgtcggtgacggcggtgttggcaaatcggcgctgaccatccaattaatccagggccaattcattgaggagtacgacccgaccattgaagactcgtatcgaaaacaggtacttattgacggtgagacttgtttgctggacattttggacaccgcaggacaggaagagtattcagcgatgcgggatcagtacatgcgcacgggtgagggctttctgctggtcttcgcgctgaacgagtacaaatccttcgagaacatccatgcctaccgtgaacagatcagacgggtcaaggacagtgacgaagtgccgatggtgttggtgggcaacaaatgtgacttggcacagcgcgccatggaccagcgctccatccaggagttggcccgctcatttggcattccgttcattgaaacgagcgcaaaaacgcgacggcacgttgacgaggcattccatgcattggtgcgcgaaattcgtaaacacaaggacaaacaccgggagaagccgaaacggagaaagcgctgtgccgtcctctgacgaaagaaggggaaaatttaaaccaaaaaaagtcgtccaagtccaaacttccttttcctcctgaagcccttctcctctcctcctaccgtacaccaccgcctataatatcacattcattgtgggacattttttccgtttttcttgtcttctctttttctttctttttgaaaatccaaattcatcgacgcctcatcatcccggatcaaaaaatgagacagcattttgcataaatattattatttaaaaaaaaaacaaataaatattgaaaaagttaaaaaaaaaaaaaaaaaaaaaaaaaaaaaaaaaaaaaaaaaaaaaaactcgagggggggccc

SEQ ID NO: 1322 - DNA, 1487 bp, Heterodera glycines
  coding sequence=SeqID_1541; coordinates=1-1319
  peptide sequence=SeqID_1744
gcacgagggatttctttacttcattttaccaaatgcttaaagaggatgaaaaaacggcggacctccacaaagttgaggacgccttcgtacctctgatcaaactgcgctacgatggcattgaactcgacattttattcgctcgtttggcgttgaaagaaataaaggaagaccaggaactctcagacgacaatttgcttaagaacttggacgagaagagcattcgttctctgaatggttgtcgtgtggccgatgaaattttgcgattggtcccaaatcgactgaatttcattttggttcttagagccgttaagctttgggctaaaaaccatggcatttattccaatgtgttgggctttcttggcggcatttcttgggcaattctcgtcgcccggacctgtcaattgtatccaaatgcaacaccttctgttttattgcagaaatttttcctcgttttttctgcatgggattggccacatcccgtcattctgaaggatgtcgacgctaccccgcggattgacataccctatttcattgacatgatttgggatccgagaacacgcgcatcggaccgctaccatttgatgccaatcattacgccagccttcccagaacagaattccacatttaatgtgacaaggtcaacgagacaagtgatgaccaatgaattcaaagaaggcctagacaatatgctagaaatattcaatggacatgccacttggaaaaagctattcgaggaagtcaattttttcactcgctacaaacatttcattgcgctgctttgtctcaccgaaaatgaggaggaccacctgaacttttgcgggttggttgagtccaaaatccgccatttggtggcgtccttcgagcggaattcctgcgtgaatctttgccatgtcaatccccggcagtataaacccgcatacaaattggagctcgacatcgattacgagaaccccgtgtgcactttgtggttcattggattggacctgaacaagcaacttacgaaaaaaattgatctcacagaagagttgcagggatttacggacaccgtttacaaaagtgcgtccgtgctgaaggacttcaaagaaacgatgagaattcacccctcttacacgcgccaaaggaatctcatcaaatggctttccaaggaggacttggaccggggtagacgagcggaacgacgctgctccgccgcggcggcttctccacgcgtgtccatgctaaacaattccctggactcaaccggaaaatcattggacaccagcggaagcaattcacccgcttctgccgaagagccgtccctgaagaaactaagagtctaatcaattctcacatcatttgatgtcttttattttgtacttcctttgtatattgtaacttatttacgatgcatattgttgtttgtactttactcgtttaatgtgattgaaaacaaaaaaaacaaaataaaaaatggtaaaaaaaaaaaaaaaaaaaaaaaaaaaaaaaaa

SEQ ID NO: 1323 - DNA, 1521 bp, Heterodera glycines
  coding sequence=SeqID_1542; coordinates=1-1384
  peptide sequence=SeqID_1745
ttcggcacgaggcaccactgtggtggaatgtctgaaggatgccgacatttccatcaaaaagagggctcttgaactttgctttgcccttatgaaccaaacgaacatcgcgagcatgtccaaggagattataattttcctcgaaactgccgactccgatttcaaagctgagtgttcttctaaaatgtacgttgcgacggagcgcttctccccgagtcttgtttggcatttggacacaatgataaacgtgctgcaattggcagctaaccatgtacctgatgaagttgtcagtgcgatgattcagctcatctcttcccagcaggaactgcagcattacgcaaccgtccaattgtttcatgcctccaaacgggaacacatagtaaatgctcagcccttaatgcaaatcgcattttggagcattggcgaattcggtgatttgcttgtcgctccgggaaatacggaggaggcaaatataaaagtgagcgaggatgaagtggtggaattgttcgaacttttgatgcctcatccacagctcactgtgccaacccgtgagtatggactaactgcacttgccaaacttagcacgcgattcgactcgcacgccgaacaaattcatgcgttaatacgacaatattcggcacacatgaatttggagctgcaacaacgttccgttgaattctcacgattactgtcaaaggatgaactgaggaatgggctgctggagcgaatgcccgccattgaacacaatgcccttcacaccgcagcgacgccaattgaaatggacgataatcaccaggaattaatagtggcgcaaaaagaacaccaaagccaaaaaccgaaggccgatgaaattgacttgctcgggttgggcaatacggattctcctgctttggttgacattctcttcggcggggttccaaatgtgcagcccctttcaagaaatattggcaaagaccccatcgacgacctttttagttttgagtccagtaataaaaacggtgcccttgtggaagatgatcagttgaaaacgggtcaaatcgtgctcaaccagcgtggtatcgagatgcaattattcgtggattccaacggattcgactccaatggattggcacaattgcggtttcaaacagttaacaatacccccgctggagtagaagatttcaatttggcagtggccgttacaaaagcttatcaaattgaattgcttccggcgaattcgacgagtcttcaggccaatgctttgtccacgataagccaaaaggcgaatttgcggcggctggcaaattcgaaagcgcctcgtctacgactcagaatcagttatcggttggcgggtgccttgaatacaattgacgctgaagtgacgagcatcgcctgcctcgcctcctaacaacagtcccttcccactctaatgatctgtgacattccatttgttcattctgtcattagtccacttttaattaatttatagtaacaatgtaaatcattctttgtaaaaaaaaaaaaaaaaaaaaaaaaaaaaaaaaa

SEQ ID NO: 1324 - DNA, 1826 bp, Heterodera glycines
  coding sequence=SeqID_1491; coordinates=1-1586
  peptide sequence=SeqID_1901
gcacgagggacgactcgcacattcgcgaccaggcaatttccatgagggcgcaacttgcagaagcggacactttggtgctgggacttcgcgacagactccagcaaatcgacacgaatgctgcggtgattgaacagcaattgggacagtttagcacggacaaggaaaccacccataaagagctgtctgttggagtgaattatgtgcaaacacaaggagaacagcacttggcaaaagcgcaggaggcgttcgaccgttacggggaaaagagtcagcaattgtcggagatcgctggcgaatccaagcagttgtctgatacgcaggagcagcgtcgccgggagatcctttcgttggctgagcaaattcggaaggagtcgcggcaatcgctcagcgacgccaacgaagcaatttttggagcttcaagcaccagtctgcaaatttctgctttgttgaccgaggtccacgagttggaacagcgactgaaagccatccaacaaatggcgacggaacagtccctcgagacaaaccaaacacacgacggggccgccttcattctgagcggagtggacagtatccgtctgccgaacgttttttctgatgagttgatggagaaagtcaaaagggcacaggaagagggtttggaagcgctgtctaaaacacggtcggaggcggaaaagcaagcggaattggtagaaaaagtggataaattagtggaggaagcgcgcgaacagttgcgaaatgcgcaacagaagcaaatgagtgtggacaattcctttgacgaagccgagtcttttaatgcgcgcacccaaacggctttcgaattggccacgaagacgtggaacgatgcgaaggattcgcacgacgcgctttccgactttcatagtaaaatcgaacaaagccgcgcggaagcgaccgaggaaatgaccaatttggcggatatcgaaaaggaaatcgaagaggcgcaggcgatgacaaaggaagccgaagatgcggtcggagacgcgagtcaaaatgcaaaagaagcggcggaagtggcggaggaggccaaaatgaaagcgcagaatttggccatggaagcggccaatttaacagacgccactgaacaaacgatggctggggccacagaaacgaaaagtgcgctggacactctcagcagcgaattggactccgttttgaccacaacaaaggattttgagaaccaagcaatttccgacgcggaacgttccaacgaagtcgcgaaaaaagcgactctctccgaagcgactgcaaattcactgcaggaaaagctgagtgactcggacacaaaacttacggaagcattggcccaactcagttccttagacaatgtggacgatgcgcaattggacaccgtggagaaactgctgaaagaagcggaaaatcgtttcgattcgagcggcaacgaagtgaaaatgcgagaacggatcatacaagcggagaccaaagcggtgaagcagaagagggaaatcgatacattggcaaaagaattggagaatttgcgtcaaatcagagattcattgccgactcgctgctacaattatgtaaatttggaacaggagggacaacgatgaaaaggagcaattgggccagaagggacggttcatcacaagtggaataatcccggcttttttaaacacattccccgtcagaagcaattttttttgtcaaaaaaccatcttccgatcgttgccttaatatttttgtctttctttttatgcattgagcaatcagatttattaagattttcatgctgttcttttttataaacaaacaaacaatcaaaaaaaaaaaaaaaaaaaaaaaaaaaaaaa

SEQ ID NO: 1325 - DNA, 769 bp, Heterodera glycines
  coding sequence=SeqID_1543; coordinates=32-586
  peptide sequence=SeqID_1746
gcacgagggcattttccattaaaaaaataaaatggtgcgcacattgaaattccatgagaaaaagttgctgaagaaagtggacttcatcaattggccggccgagttggacaacagtcttcatgagaacaaaatcatgcgccgttaccatgtggagaagcgcgagcactacacactgtacaacaaactgtccagagagatccgagaaatggccaaacgcatccgcgagttggacgacaaaaacccgaacaagttggtgttggcacggatgctgctcggcaagctgttcgacatgggcgtgattccgaccgcggacacactcgagcgatgtgacaaagtgacggcatcgtccttttgccgccgtcgcctccctgtcgtttgccacaaaatgcaaatggcaccgacggttaggaagtccagccaactggtggagcagggccatgtccgtgttggtgtcgaaatggtcaccgatccggcctttttggtcacgcgaaaccaatcggatcacatcacatggacgcgggaatcgaaggtccgaagacatctcagcacttacaacaacgaattggatgactttgaggggtgttgatttgaagaagccaatgaaataaaaatacatgaaaaagacgcatataaaccatttttttttgtttcactgcaatttgtttgttttgttttgttttttgctttttattgttgttgaactgttttctcatggacggtaaaactaaggaaccataaaaaaaaaaaaaaaaaaaaaaaaaaaaaaaaa

SEQ ID NO: 1326 - DNA, 1550 bp, Heterodera glycines
  coding sequence=SeqID_1544; coordinates=28-1356
  peptide sequence=SeqID_1747
gcacgaggccaagtttgagcaggcaaaatggcctccaaatttgtattcagtcttcgcttttcctacccgaggcttttaaccagcagtgccctcaacaacaaaaaatcgggcccaaatttccttcagtctcgatcaattgtaaccaaatttgacctggaattgcctgacgattacccggagccttggccctacaaacaatggggcttcaaccaatttatgcaacattttgacaaaacgctgaagcgctggcacatcaactcgaaactgatcgttttcgaaagcaacattggcgtgggccggtcgtcgatcgcaaaggaattggccgatgcgttgggcttttattatatgccggcctttaaaatggacgacattttggttgaccgttacaacaatgacatgcgcgactattatcatttgtttccgaaacgctttcggttcccggacatcaacatgttctacaaggacccggccgacgaccaaacggctgtcatgcaagatctgatgtacgactgccgttgggagcagtacctgaacgcacaggcacaccttttcaacacgggccaaggcgtcgttttggagcggtgcgtccacgcggactttgttttcgcaaatgcaatgcgtgccaaggattggatcagcagagaatacttcaatttttacatgtacaagcgcaagcaatcgctgttattcaccagaatgtatccccatctgatcatctatttggactgtccgcctgaaaagtgtttggaaaacattcaaaaacggggcaatcccgctgaagtcaatgccgtggatttggaatatttggtcaacattcaaaattcctacaaggatttttttcgggaaatgagggacgaatgtgaaattctcgcgtacgattggacaacgccccaagtccttgacgttctgcttgaggacattttggagattgatttcgaaacactcgatttttattcctccggcaaacatcgcacttggtcactgatgggaacggacacaaaccactgcttttggcgccatatggtcaccaccaaagaccaactgaaggaaagggcgatgaacaaacttggcttgctgcaaacggaggtgtccgagctgtacatttaccccatggacggtattcatcatcggaatgtgattatgcatgaggtgctaaaagatcgttgcacccacggctacacaaagaaggacccgatccaggggctgacacgggccaattaccgcaatctcgaaatgccggaaagatggactgaatacttctggaaagaggaatggattggctcttcctgttcccttcacacactgttcgacccgaccgccaaggactacgacccggagtatttgtccaagcattagcaacgcccatcacgcagaaagagagagggcggcaccacaaaatgccggaattgaattgaaatggagcagattcacatttaggaagaacaaaacaaaaacactcttttcgctgccgcacccattcatgtgttcctttttaggaaaataaattgtttttattgtaaaaaaaaaaaaaaaaaaaaaaaaaaaaaaaa

SEQ ID NO: 1327 - DNA, 1083 bp, Heterodera glycines
  coding sequence=SeqID_1545; coordinates=1-960
  peptide sequence=SeqID_1748
gcacgaggattaaaattgaaagttccaattctgctgtattgttttgttcaatgtttaagtgctgtcaaagtggacaatgccgagcaatccgaccaaccaactggcgattcttcctccggacaattcccaatttcgtatcctccaataaaatatgaaaacgatttggcctatgtggagaaaccgagtggcaacgagcgttgtctattctacgcggaaggactttctgtcgtcgtttttgccactaaaaaaagtcaatcggcgtgggcggactatcgctctgacaccaaagaaagtccgaagtataccgcgtcaattgaatgccaaggcaatatgaatgtgggcagcagctttgatgtctatttgaaaattgacggcaaagcggaaggagttgtgagagctgacattggaaaaaaggacgcaaaaagtgtcttcactgttgaaggagccgaatttatactcaacttcaacgtcacacaagtcggcttttggcaattggttggtgccaccgtggaaagaattgaagtgaaaggctcttcggatttcctgaacaaaaatttgaatgtcgacaaaaaatggactttggagccttcagttgttccatccacaaacattaacggcttcaaagactacagctttgcttgtggtcagaccaacccgatagtgtgggccctaaaggactcaaatgattacgcagtcggaattacgctgaacaatgtgcagttccaaccattcaatgcaacttacactgccggtggaaaagaagctgaccgtttaaaatttgggtggaaagtcaacgattgccaggggctgttcagcattggcacttggatgggcttggtagttgccactctgctcatcggcgtgctctttttcggctttctgatgcttaattctgtgcagacaatggacagattcgatgatccgaagcagaaacagttgataattagttcgaaagagtgaatttcatcattttcttttattacatttccctcaaaatttttcattctttgtagctttataaatataaattttttccttgaaaaaaaaaaaaaaaaaaaaaaaaaaaaaaaaaaaaaaaaaaaa

SEQ ID NO: 1328 - DNA, 783 bp, Heterodera glycines
  coding sequence=SeqID_1546; coordinates=23-643
  peptide sequence=SeqID_1749
gcacgaggatttaaaagcctcaatgctgataaaacgcgcattttcattctcttctcgtgcattgcaacagcacagtgtcgtcaggcctcccgtccaagtgacaggcattgagggaaaatacgcgtctgctctgtactcgtccgggataaaggagaaaaagctggaaaacatcgagaaagagttgcgtcaagtgaaggagttgtacgacaccaacaaagagtttaagtctttcattgacaacccaattctgaataagcaaaagaaaaaggaggccgttgaggatgtgctgaagaagcagggcgtctcacaacaagttcagaacttcttcggccttttggcggagaatgggcgaatcaacaaattgaccggtgtcgtgagctccttcgaaacaataatgcgagcgcatcgcggagaacttcacgtggaagtcgcaagtgccgagcccctcgacaaaaaacacgaacaatcgctgaacgacgccctgcaaaagtttgccacgcgtggacagaagctgaacttgactttcactgtgaagccggacttggttggtggactggtggtgaacatcggcgataaatatatcgatttgtcaatggcaacacgccttaagaaaatggacgcggtggtaaagggatcgatctgatcaatttttgttagcacgacagaattagccgatgacttgacagttccgaatgttcttttgtttttattgtctcaaataccatattattactataaataggatttttgaaaaaaaaaaaaaaaaaaaaaaaaaaaaaaaaa

SEQ ID NO: 1329 - DNA, 804 bp, Heterodera glycines
gcacgaggtggaggagtcgccgctcgaagctcaaaagcgtgaggaaatcctccgcatgtaccaatcgtgcaaggaggcgctgcgcatcatcagcgacgtgaacatggccacgatggccaccgatttgccccctccggtggtgtcaccggcgaacgatttccgcaacaattcctcgccagtgccacggcccgccccggcgcctcctggccaaattccgacaaatcggccagctcctcagcctccgatgggtgcccgtccgattggcatggtggccggggcacagccaataatgccaatccaaaaccgaccgctccccgggccgccgggacaagcgccaatgcctccgatacatgccaacgatttgaacaaaccgcgaattccggagagaccgcaaataccaagcagacccttttgactgtgctgaagggaattcactaatttctaactaatgagtgtgttttctgttttaatgccaatttcggaaggcccggcattgtttcagtgctgcccttccgttcataatttgtattgaccatttatttctttattttttgtcggacttttccattttctaatttaatttaatttaatttttgtcattcgttgtcagttcatttgtgcttcgtacgtttagtatttattgtgattatatctattaatgatcaatacatttgttatcaaaaatcccagtaatctcatcccctccctccatccgccgattgtttattttattgtgaccaataaaaaataatgaaaaaaaaaaaaaaaaaaaaaaaaaaaaaaaaaaactcgagggggggcccg

SEQ ID NO: 1330 - DNA, 1452 bp, Heterodera glycines
  coding sequence=SeqID_1548; coordinates=1-1283
  peptide sequence=SeqID_1751
ttcctctctttgggataatgtccacggacagtgctgaccccctctattggctccgtgtgatcatggcttccaacagaggcacactgatggagttgggcatttcgcccattgtcacttccggtctcataatgcaacttctcgctggtgcgaagattatcgaagtgggcgacacgccaaaggaacgggcattgttcaacggggcgcaaaaactgttcggaatggtcatcactattggacaggcaattgtctacgtggcttccggaatgtacggaaacccacacgaaatcggcgccggaatttgcttgcttatcgtaattcaactcgtcgtggctggtctcattgtccttctgctggacgaattgcttcagaaagggtatggacttggctcgggaatttcgctgtttatcgccacaaacatttgcgagaccatcgtttggaaggccttttcaccggcgacgatgaacacgggccgtggcacggaatttgagggggcgatcatcgcacttttccatctgttggccactcggaatgacaaagtccgtgcacttcgtgaagctttctaccgacagaatttgccaaatttgatgaatctgctggccactgttctagtttttgccgtcgtcatttatttccaaggttttcgtgtcgatttgcccataaaaagtgctcgctaccgcggccagcacagttcctatccgatcaagctgttctacaccagcaacatccccatcatcctccaatctgcgctcgtctccaacctttacgtgatctcacaaatgctggcggccaaattcggcggcaacattttggttaatttgctcgggacgtggtccgactcttccggcacatatcggagcttcccaaccggtggtatctgctattatctgtccccgcccgagtcgctctcccacattttggaggaccccatccactgcatcatttacattgtgttcatgcttggctcgtgcgccttcttttctaagacttggatcgacgtcagcggctcaagtgccaaagatgtagccaaacaactgaaggagcagcagatgatcatgcgaggccatcgcgagaaatcgatgatccacgagctcaaccggtacattccgacagcggctgctttcggtgggctgtgcatcggcgcattgtcagtcacggcagattttttgggcgcaattggaagtggcacgggtattctgctggctgtcacaatcatttaccagtactttgaaattttcgtcaaagaacagcaagaaatgggcggagttgccggactctttttctgagccaatttttcttgcgcagaatttatacatatataaacgacacattcactcatttccatctaaagttgaactttgttgttttccctcacttttggcatcacataattctcttttgttcaaaaaaaaaaaaaaaaaaaaaaaaaaaaaaactcgaggggggggcccggta

SEQ ID NO: 1331 - DNA, 603 bp, Heterodera glycines
  coding sequence=SeqID_1549; coordinates=39-431
  peptide sequence=SeqID_1752
gcacgaggattaagtttttaaagcttatattaatagcaatgactgaaggaggtgaagaagtgaatccaaaggcctaccctttggcggatattcaactttctcagaagttgcttgatcttgttcagcaggcaacgaactatcatcaattgaaaaagggtgctaatgaggcaaccaaaacactgaaccgaggcattgctgaggtgatcattttggcagctgatgcagaaccattggaaatcattttgcatttgccattgttgtgcgaagacaaaaacgtcccatatgtattcgtgaaaagcaaggctgcacttgggcgtgcatgcggtgtgactcggccggtgatcgcaacttcgatcattcaaaatgaaggatctcagttgaagtctcagattcagaagattaaagaagatgtggaaaagttacttatttgattaaaaatttgcaagcttatcactgttttgttattccatcttgttttgttgtttcatgatttgttcgacgacaattaaaatgactctgaaagcaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1332 - DNA, 844 bp, Heterodera glycines
  coding sequence=SeqID_1550; coordinates=1-394
  peptide sequence=SeqID_1753
gcacgaggaaatcacccgcgagttggtaaccaccattttgtcacggaagcccaaaatgtgcgcattcctcgagtataaggacacgaaagttgtgtacaaacgttacgcttcgctttacttttgctgcgccattgagcagacggacaatgagttgctttgtctggaggtcatccaccgttatgtggagctgttggaccgttattttggcagtgtttgcgagttggacatcatcttcaacttcgagaaggcctacttcattttggacgagtttttgttggccggcgaaattcaggagaccagcaaaaagcaagtgctgaaggcgatcagtgcgcaggatttgctgcaggatgaggagacaacgcaaggattgtttgaagacaacggacttggctgatgatcgaccacactctaatcagatcagcagaaaaagcagtagcatcaatcatttttcaaaactttttcttccctaattaacccatttttcgtttcaatgtccaacaaaagttgtatttgtgccaaaacaccttaaattttcgtttatggcacaaaatgacaaaagcattttgttcaccgtcccttaattacctgaaaatgtttttagttcacaccaagcctaatgatcactaattctaattacctatcatttcttttttccgtgatataattgcactgtcttttttattttattctgtcgatcagtctcagatgagccaaaatatttgtttttcttgtaattctttcctgtccattttgttcacttcatttttcctttcgatttcattcctcctaaaataaaaaaaaaaaaaaaaacaaaaaaaaaaaaaaaaaaaaaaaaaaaaaaaaa

SEQ ID NO: 1333 - DNA, 1951 bp, Heterodera glycines
  coding sequence=SeqID_1551; coordinates=1-1711
  peptide sequence=SeqID_1908
gcacgagggtttgagacatctctttcgcgcctcattaaatgcatattcaaacggtcccgtaattgcagaaaacattataaattcgttgaaaagaaatcgagaaatggggaaggagcaacagaaacaacaaaacaaagaaaaaaaggttgccgcacaacagcagcaaaacaccggagatgaagcggggactaagaaacagacaaggcttgggttggatgtgacaaagacggagaactattccgaatggtattcccaggtgatcgtcaaggcagaactaattgagtattacgacgtgtccggctgctacgtcatccgtccctgggcgtattccgtgtgggaacacatccaagcattcttcgacgctgaaatcaaaaagctgggcgtcaagaactgttactttcccatgttcgtctccgctgctgcgctcgaacgcgaaaaaacgcacgtggccgactttgccccggaggttgcttgggtgaccaaggccggaaactccgacttggccgttccaattgccattcggccgaccagtgaaacggtgatgtacccaacctttgccaaatggtgcaaatcacacagggatttgcctatcaaaatcaaccaatggtgcaatgttgtgcgatgggaattcaaacatccgactccatttttgcggacccgggaatttttgtggcaggaaggacacacagcctacgcgacaaaagaggaggctgaggaggaagtgtacgacattctgaatttgtatgcccgcgtctacacggatttgttggccattccggtggtgaaagggcgcaaatctgaaaaggagaaatttgctggcgcagattttaccacgacggttgaggcgtatgtgccggtcaatggccgaggcattcagggcgggacttcgcaccatttgggccaaaacttctccaaaatgttcaacatcgaatttgactcactcgtcaaagggcaagtggagttcgtccaccaaaacagttggggtctttccacgcgaaccatcggcgccatggtgatgatccacggggacgacaccgggttggtgttgccaccacgcgttgcggacattcaggtcgttgttatccccgtcggaattaccgttaaattgtcggatgaaaagcgggtcgaactgattgaaaagtcagaagcacttgtcaaaatgctgaaggaggagcatggagttcgggcagttttggaccaacgtgacaatgtttcgcctggatggaaattcaatcattgggagctgaaaggtgtgcccatccgtctcgagttgggccccaaggatttggccaaggaacaagcgcttgcggtcattcgtcactcgggccaaaaggtgcctttgccattgtccaatttgggcgaaagcatcaaacaattgttggacaccattcacggcgaaatgtacaagaaggttgaacaaattcgagacgaacacatggtcatttgtctcgacttggaggaaatgacgcctctgctcgacaaaaagtgcgtcgttttggccccattctgtggtcgcattgaatgtgaaacgtcgatcaaagatttcaccgttcgcgaggagcctgcggatttgggcactgcccaaatgggtgccaaaacgctttgcattccgttggaacagccgaaggatgtccaactgcctgaacaatgcatcaatccccgctgttcgcaaaagacgcaatttttcgcgctgttcggtcgaagttattgagaaaacgggggaaggagaattcttcgatatttggtactactttttggacattatgctgcttattatgtgttgttttggatggactgcgttttaagttatttttccacaaatccgtgcataaaggccccatttgtttctgtttattcttccaaatgctctatgcgtgttgtattctgatacattttggcgaatgagattaaagttgttaaaaaaaaaaaaaaaaaaaaaaaaaaaaaaaaa

SEQ ID NO: 1334 - DNA, 2551 bp, Heterodera glycines
  coding sequence=SeqID_1552; coordinates=30-2456
  peptide sequence=SeqID_1754
gtttgagcgatatttctgagactctcaaaatggcttctgttccaactcaaaaagatgagaaaacgaaacgaaatgaggagttggcaactgcgattctcaagaaaatgccgaagccgaacagactcattgtggaccaatcgcccaaagacgataacagcagcgttctaatggcacagactaaaatggatgacctgggattgtttcgcggcgattcgatccttctcaaaggcaaaaaacgtcgtgagacaactagcattgtcatagccagtgacacttgtcctcccgagaaaatcttgatgaatcgagttgtgcgtcagaatctccgcgtcaaactgggcgatgtcgtcagtgtttcgtccgcttcaaatacgccaaatggactgcgcattcacgtgcttccgattgatgacaccgttgaggggctgaccggaaacttgttcgaggtgtttcttaagccctactttttggaggcctaccgtccggtttacaaaggcgacacgttcactgtcaacgcagcaatgcgaactgttgagtttaaggtgattgaaactgatccggcgcctgcttgcattgtggtcccaacaacgatcattcattgtgagggggaaccgatcaaacgtgaggacgaggagaacaatctgaacgacgtcggctatgatgacattggcgggatgcgcaagcagttggcgcagatcaaagagatggttgaactcccgctccgccacccgatgcttttcaaatccatcggcattaaacctccccgaggaatgcttttgttcggtccgccaggcactggaaaaacacttgtggcccgtgctgtcgcgaatgaaactggcgcattctttttcctgctcaatggacctgaaataatgagtaaattggctggtgagtcggagtcgaatttgcgcaaagcattttccgagtgcgagaagaattcgcctgccattcttttcatcgatgaaattgacgcaattgccccgaaaagagaaaagacacacggcgaagttgaacgtcgcattgtttcgcaattgctcactttgatggatggactgaagcagcgctcgaatgtcattgtcattggtgcaacaaatcgtcccaattccattgacccggctcttcgtcgctttgggcgtttcgatcgcgagattgacattggtattcctgacgcaattgggcgtttggaaattctgcgcattcacactaagaacatgaaattggcggacgacgtcgacttggaaaagattgctaatgagtgtcatggctatgttggtgccgatttggctgcactgtgctctgaggcggcaatgcagcaaattcgtcaaaagatggagctgatcgacttggaatcggaaaatattgatgcggaagtcttggcgcaattggctgttactatggacgactttcagtttgcactcggtaaaaacagtccgtccgcgttgcgtgaaaccgtcgttgagactccgaatgtcacttgggaagacattggaggccttgaaaatgtgaagagggaattacaggaattggtccagtacccggttgaacacccagagatgttcctcaaattcggaatgcaaccatcccgcggtgtcctcttctacggtccgcctggttgtggaaaaactttgcttgcgaaagcaattgcacgcgagtgccaagcaaacttcataagcatcaagggccccgaactgttgaccatgtggttcggcgagtccgaggccaacgtgagagatgtgttcgacaaggcacgtgcagctgctccatgcgtgctgttttttgatgagctggactcaattgctaaatctcgtggtggaaacgttggtgatgcgggaggggctgccgaccgtgtcattaaccaagtgttgaccgagatggatggaatgggatcgaagaagaatgtgtttatcatcggagcgacaaatcgtcctgacattattgactccgccattctgcgcccgggtcgtctggaccaactcatttacattccgttgccggacgagcccagtcgcctgcaaatctatcgtgcttctctacgcaagactcccattgcaaaggatgtggaattggaatacttggccaaagtcactgttggcttctccggagcagacatcactgagatctgtcaacgcgcttgcaaactcgccattcgcgagtccattgagaaggctgttgccatcgaaaaagatcgccaggccaaggaacagcgtggcgaggaagttatggacgtggccgaggatccggtgccgcagctgactcgcaaacattttgaggatgctatgaagtttgctcgtcgcagtgtttccgacaatgacatccgcaagtacgaaatgttcgctcaaactcttcaacagcagcgcgggtttggcaccagcttcaaatttcctggagagggcaaaaaatcgtcaagtggcagaggcgggaatgaggccggaaatgatgacgatgacctctacagctaaagtgtgaacattgattattcggaagtgatatcatcagatgatgagtaaaatatgtcattgtttaaaaaaaaaaaaaaaaaaaaaaaaaaaaaaaa

SEQ ID NO: 1335 - DNA, 1801 bp, Heterodera glycines
  coding sequence=SeqID_1553; coordinates=29-1573
  peptide sequence=SeqID_1755
ttgaggttcatatttctcggctatctaaatggcaatgctgaatgcgtccttcgataaattcaatatttctaattcggataaaatccgaacccagcggctcatatcaatgagtgaaagttgcgaagagtggaaaacatgcaccaagcgagaaacatatgcacttctcgaccaggagctgaacaaactgttgaccacgtcaccccccgagaaaatggagtattggaaaaaggaactcgatggatttatggatctttttgctcgtttcttgcgcgccaaaaccaccgtcgaatggtccaaaattgagccgttgcccgaaggggcaataacgccgtattcgaagcttgaacaaacaccgcgggaccgtgtccgtgaactactcaatgggttggttgtggtgaagctgaacggcggactcggcacttcaatgggctgcaaagggcccaagtcgatcatttccgttcgcaatgagctgaccttcttggacttgaccctgcagcagattcagagtttgaatcgtgaattcgaagtcaacgtgcccttggtactgatgaattcattcaacacggacgacgacactaagaagctgctcaagaagtacacaaatgttcgggttgaggtgcactcttttgcccagtcgagatacccccgcattgatcgcgaatcattcatgccgctggcaaaggatttgaaggacatggacttggaatgttggtacccccctggccacggaaatttctacgagtcgctcattaattccggtctgttagacaactttttgagtgaaggaaaaaagcatgtttttttgagcaacatcgataatttgggcgctaccgttgacccaaacattctcaattacatggtggccagaaaggcggaattcataatggaagtaaccgacaaaacgcgggccgacgtcaaaggagggacactgattgaatacgaggggaaactgatgctgttggagatcgcccaagttccgcctgactatgtggacgagtttaaaagtattagcaaattcagaatttttaacactaacaatttgtgggccgaattggaagcgatcaagcgggtggtactgaacaaagagctgaacatggaagtgatcgtgaaccccaagcatttggatcgcggtgccaatgtgattcagctggaaacggcggctggcgcggcttgcaaatgctttcgtggtgcctgtggcatcaatgtgccacggtcgcgtttccttccggtgaagaaaacttccgaccttctgctgctgatgagcaatctgtacgacattgagaatggttacgtgacactcagcactctccgctccttccctaccacgccattggtcaaactgggcagcagttttgacaaagtcaaagagtttgtgaagcgattccaaggcattcccgacctgctcgaactcgatcatttggccgtttccggcgatgtgtggtttggacgggacgtaacgcttaaggggacggtcattataatagccaaccatggagaccgtatcgacattccggcaggcaccattcttgaaaacaaaatcgtctctggaaacctgcgcattcttgaccattgataaaagaataggctggagaatttggcacatgacagataaaaacgaatataccaaaatataataaaatttctatttatttcccacataattccccatcggtttgcttgttatgtttgtcgttctattctctctttttccccaaattcgcttaaatggaagatttataagaaacttaataaaggattgattcattaaaaaaaaaaaaaaaaaaaaaaaaaaaaaaccccg

SEQ ID NO: 1336 - DNA, 592 bp, Heterodera glycines
  coding sequence=SeqID_1554; coordinates=43-441
  peptide sequence=SeqID_1756
gggtttaattacccaagtttgagttacatataaccatatcaaatggctacttacaatcccaactatgaatccattgggcaggcctttgtccaacacttttacaccaaatttgatgtgcccgatggtccgactcgcaccgtcggccttcatgatttgtatgatgctgaacactcttttatgacttttgaggggaaccaagtgaaaggtcgacaggccattttggacaaatatggagcgctacctttccgaacgattcaacatgggattacaaagactgacagtcagccgcttccggatgggtcaattttggtgacggtgattggtcagcttaagaccgacgatgacccagtgaattcattcaaccactgcttcattctgagaccaaattcttccgggggatttttcatttcgaatgaagtgttccgtcttgttttgcattgaagtgctgaagccgttctctcgtggacatttgcaacctgttgttgttctttttcctctacaatttccattgattgcgcagtttgatttgtttcgcctttgtttcagcttttgccctcaatatgactcggataaactggtgttctaaaaaaaa

SEQ ID NO: 1337 - DNA, 536 bp, Heterodera glycines
  coding sequence=SeqID_1555; coordinates=62-454
  peptide sequence=SeqID_1757
gggtttaattacccaagtttgagatagtatttttgtaatcaaaaataaggcaacattcacaatggtgcgaatgaatgttttagccgacgctttaaagtcaattaacaatgctgaaaagcgtggcaagagacaggtgatcatccgaccgtcttcaaaggtgatcatccgtttcctcacggtcatgatgaaacacggctacattggcgaattcgaaattgttgatgaccatcgtgccggcaaaattgtggtgaatctcactggacggatcaacaaatgccaagtgatcagtcctcgtttcgacattcgaatggccgacttggagaaatggaccagcaatttacttccatcgcgtcagttcggttttttggtgctcaccacttcggctggcattatggaccacgaggaggcacgtagaaaacacgtgggagggaaaattctcggtttctttttctgatatgaccgacgtttgttgtttaagaaaatgtctttgttcgttattgctgttgttggtttgataaaaagatgttaaaaaaaaa

SEQ ID NO: 1338 - DNA, 921 bp, Heterodera glycines
  coding sequence=SeqID_1556; coordinates=47-817
  peptide sequence=SeqID_1758
ggggtttaattacccaagtttgaggcaaagtttagttcatcttgtcatggcaaatcgcacagctcgagacgcacataccataaaaggcacaaatcctcaatatttaattgaaaagatcatccggactcgcatctacgattctctttactggaaggaacagtgttttggactctcagctgaaacagtcgtcgaccgtgccactgaattgcgttacattggtggaatatatgctgggaacataaagccggctcagtttctctgtcttacactcaaattgctccaattgcaacccgacaaagacataataattgaatttataagacaagacgacttcaagtatgtccgtgctttgggtgccatgtatatccgtttggtatttaattccgtcgaagtcttcaaatacttggaaccgctgtacaacgattaccgaaaactgcgttacatgaacagaatgggaaaattcgagttgctatacatggatgaatttgtcgacaatttgttaagagaagaccattattgtaatatacagctgcctcgtctacagaaacggcaagcactcgaagaaaaggaccaactcgagttgtacgcttccgccttggacgaagacttagagcgtctttccaccgactccgaagatgagcaggagacgcggaaagcacggccaaatatcgtttctcggcgccgaagtcgctcgcgcagccgtggccgaagtcggagcaaatcgagagaacggagacgccgatcactttccacggatgttggatttagaccgtcggggaggacgaagtgccgcgaaagacaccgaaagagaaattgaggagaataacgcactgagaaagaaattgggattggcaccattggagcgttaaattgtttatttattcaatcatcaaaaatttgattataaatattaaaaaaaaa

SEQ ID NO: 1339 - DNA, 990 bp, Heterodera glycines
  coding sequence=SeqID_1557; coordinates=122-649
  peptide sequence=SeqID_1759
agaaatgcagtttcttcttttggattaaactacctaggtatccaacaaaaaaacattttagtccgcttttaaaaaaattaattgaacccctaatcttattagtcacagaaatattgcaagaatggctccaaaagagaaagaggttggaaagggatggagctttgctcattttttttggcatctaattaaaaaggaaacacgcaatgagaaggagagacacattttggcaaacggacgattggcactttcgtttttggcagttgcttttgccggatttgcccttctgtacgactacttttttccatttccaaagtcaaaaattattcttgcggtttgctccattagctatttcgtcatgattatggtcctccaggcgtaccaatggtacgttgagaagctgacattctttcaagcggaggagaaaaccactgacaatggcgaaccacgacattggaaatggtcatcggatatgaaacgctatgatgacaaatatgtgttgatcgctgagtactcccaaggcactcgtactggctcaatgaaagtggtcaaatcggtggctgcttatatcacggaggatggcgaggtgctcgtcccgttgatcaagagggaagtcgatctgctgataaagaatctgctcaaggccgactgattgaagctttacaggcgattctcgcataaattatttatattttcttctttcctgtccttccttttggcatctgtgaagaactgtccttttaccccattaaaagcttaggcccatttttggcacatgaaattactaagtcacggaaaccaaatcaaaaattggcaaaagtttgttgttctcttactatcgtgtctaaatctgaaactccatgtaaattttcttttatacattcactctctttttctgactgatcatcgtttatttcattttttgtttgaatgatcatcttttctctccgtgaactattggataaaggaagttgttgaaaaaaaaaaaaaaaa

SEQ ID NO: 1340 - DNA, 1228 bp, Heterodera glycines
  coding sequence=SeqID_1558; coordinates=1-1120
  peptide sequence=SeqID_1760
tttccaggaggtaatttctccgaatatttataacgcaaagctgtgggagcagtccgggcattggcaccattatgcggagaatatgttccggttcgaaattgagaaggagcagttcggactgaagccgatgaactgtcctggacactgtctgatgttcgactacaaaccgcacgcctacaacgaattacccatccgttatgccgacttcggtgtactccaccgcaacgaaatgagcggcgctttgtccggtctgacgcgcgtccgtcgctttcagcaggacgacgcccatattttttgccggaaggaccaaatattgtcggagatttcgggctgtttggattttctgaattttgtctacgtggaagtgttcggcttttccttccgtctccatctgagcacgcggcctgaagagggctatttgggcgacttggccacttgggaggcggcagagacacagctgaagcaggcattggacaacagcggactcaaatgggagctgaacccgggcgacggagcattctatgggccaaagattgacattcaaatcaaagatgcgttgggcagacattggcaatgtgccaccatccaattggacttccaactgccccaacgcttcgacctttcctattacgatgagaacaaagagcgtcttcgtccggtgatgatccatcgtgcaatttacggttcaatcgaacgaatggtggcaattttggcggaaaattgtggagggaaatggcctttttggctgtcgcctcgtcaggcaatgattatcgttgtgcaccattcggtgagtgactacgcgagcaaagtgttccgccgcattttcgacgcgggcttcgaggtggaatttgacgaggacagcccggacacgctgaacaaacgcattcgcaatgcccaactcgcccagttcaacttcattttggtgatcgggcaacaggagaagaacaacggaacagtgaatgtgcgcaccagggacaatcaggtacgcggtgagattgctgtcgatgcgctcatccaaaagttccaaattttccgcgacacttttgcccaagacacagaaagtgcaggatcttttgaaggcccgaaggaacaaaaagaaattttggatgacaaaaaatgaacaatggcattgcaatttcattttcgacgggtttttgttgttaacaaattgtgaaatgttccatctggttttttgtttgtttgttaattacaacttgtgagcccaaaa

SEQ ID NO: 1341 - DNA, 1350 bp, Heterodera glycines
  coding sequence=SeqID_1559; coordinates=1-1245
  peptide sequence=SeqID_1761
cggcacagcaattacgaattggcaactgctttgcttcgtcgtgccactacgcctccaccagtgcgtcgtgacagttactttgatgattcggccaaagtgcaaaaccgcgtgttccgatccctgaagttgtggtcgttgtacgccgacattgaagagtcgatgggctcactggaaagttgcaaggcaatttatgagcggatgttggagttgcgaattgcaacaccacaaatcgtgataaattatgcactgtttttggaggacaaccaatactttgaggatgctttcaaggcgttcgagaagggaattgggcttttccggtggccgctcgtatttgacatttggaacgtttatctgaccaaattcatccaacgatatggtggcaaaaagctggaaagagctcgcgatttgtttgagcaatgcttggacaaatgcccacccaaatatgccaaaaatatttatctgctttacgcaaaactggaggaagagcatggattggcacggcacgcaatggatatttacaatcgggcaaccggagcagtcgaaaaggaagaaatgcatctgatctacaatgtgtatgtcaaaaaagcgatgcaattttacggcatcaccaaaacgcggccgatttttgagtcggccattgaacgtttgcctgaggagcgttctcgggagataagtgtacgctatgctcaaatggagcggaatttgggtgaaatcgatcgcgcccgagccatttatgcgcattgtgccgaaatttgtgacccccgggtccaatctcagttttgggagagttggaaggagtttgaagtcaagcatggcaatgaggacacaattcgtgaaatgttgcgcgtcaaacggtccgtccaggccacgtacaacaccaacgtgaactacgtgagcgcccaaatgatggccacattaggcagccagactgaaatggccggtgaactcagtgctgccgactcaatggcacaattggaggcgcgcgcagcacaaattgcgcaggaagaggcattgattgcagcaaaaaaagtgttgccggcgacggacggacgaatttcgtttgtacgtggcgaaggtcgcacaacgacagaagcacgggctgaaaatccggaagaaattgacattgatcaaattgttgatgatgagcgaggggaggaagaggacgatgaaaacgccatggatcacggggatggcacagcggcgaaaagtgcagacgatggacagagggaaacggcggaggcgtaatcgcgagccaattgtccactttggctgtcgttttgcactcatttattttcaaagtgttcataaatttgttttcttttaaaaaaaaaaaaaaaaaaaaaaaaaaaa

SEQ ID NO: 1342 - DNA, 1000 bp, Heterodera glycines
  coding sequence=SeqID_1560; coordinates=1-862
  peptide sequence=SeqID_1762
cgcaatgaagtacacaatcatcgtttccgccactgcttcggatgctgcgccgctgcagtttttggccccctattctggcgccgccatgggcgagttttttcgcgataacggcaaacacgcgttgattatctacgacgatctctccaaacaagcggtcgcttaccgtcaaatgtctctgctgttgcgccgtccacccggtcgtgaagcttacccgggtgatgtcttctacctccactcgcgtctgctcgaacgtgcggccaaaatgaatgagactcatggcggcggctcaatgaccgctctgccgatcattgagacacaggcaggggatgtgtccgcctacattcctacaaacgttatctccatcaccgatggccaaatcttccttgaaaccgagttgttctacaagggagttcgtcctgcgattaacgttgggctttccgtgtcacgtgtgggttccgcagcacagacaaagtcgatgaagcaggtcgccggttcgatgaagctcgagcttgctcaataccgcgaagtggcagcctttgcccagttcggatccgacttggatgcctccacgcagcagttgttgaaccgaggagttcgtcttactgagctgctcaagcagggtcagtacgtgccgatggcgattgaggagcaagtggcggttatctacgccggcgtgaagggacatttggataaaatcgacccgtctcaaatcacgcgcttcgagcgtgaattccttgcgcacattcgagcgcatgagcaggaattgctgaaggtcatccgagaagaaggccaactcacaaccgcgactgacgaaaaactcaagaatttggtgacttccttcttgggaggtttcaaggcttagatgataaaggaaatagatgtgcatcctatgtttgtttatgtttaggcgtaatcagaaaatgactgctgttttaattgtttttgaaattatggttaaattcgagtcaataaatataaatgaagacaaaaaaaaaaaaaa

SEQ ID NO: 1343 - DNA, 968 bp, Heterodera glycines
  coding sequence=SeqID_1561; coordinates=1-558
  peptide sequence=SeqID_1763
gtccaaacactcgtcaaagccgcttcgtctgcgcagcaggaattggtggcccaggggcgagtggccgacccgggcccagcaaatggcagcgaagagcagcaatggactgcaggtttggtctccgccgctaaactcgtcgccgctgcgactaaccaactttgtgaagctgccaacggattggttcaaggccattcgacggaggaaaagctaatcgcagcggcgaaacaggttgcttcttccaccgcccatctgttggtagcgtgcaaagtcaaatgcgacttgaacagccgagcaatgcaacgactccaaagtgccggtcatgcggttaaaacggcaacagaacatttggtgaacgcggctcggcaagcgattacgcaagaggactgtcgcgggttggtcatctcggaaaagattgtcacgggcattacacaaatgatggacgcgcacgaagaagtgctgagaaaggaacgcgaattgaaagaggcgagaaaccgactggcgcagctgaacaggtctcggtatgaaaagtcgccggagccctcgccagaaaagcaataattcccaaaagaattcattttaaaaattaacttaacttttcctttttttctgtcaaatttgtctcaattttttgttttattttttaagccaacctttgcaattgccttaatttccgaagctttctccgtcttttgcttgctcatttatttttcaatttatcacagccatcgctattctttctttcttttttttctgtttgtcattttccccaatttcactttcatatcaaaatgtgccgtttatttgtttcttcaataaaatgctctatttttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1344 - DNA, 844 bp, Heterodera glycines
  coding sequence=SeqID_1562; coordinates=1-701
  peptide sequence=SeqID_1909
attccgattttttaaaaatgtcactcactggtgggactgtaattgcgttagcctacaaaggcggagttgcgatggccactgaccgtacagtttttgcatccggtgttcatcgttttcagaacaatacgcgccaatatcggttgaataattattgtctgatttctttctccggagactttgccgaattccaatggttgcaaaatttgctggaacgccgtcagatggaattacagatcgacgcggggatggaccatatgaagccgaagatggtgcacgcttttctcacctcactcttttaccaaagacggagcaaaatgaacccatttctgaacacaatggttgtctgcggcatgcaaccggtcgagtttcatgccggagaaattaagcctttcatcggcgtcatcgacatgcgtggcaatgcctatgaagttgaccatgtcgcgacagaaattggcaaatatttgcttcgccaaatgttggagacgcgacaaacgcaggcaaatggagcggaacaaatgagcaaagaagaagcacttcgaatggtcgcagcggcgttggaggtgtccgtcagtcgtaacagcagaacgggccaaatgttcgatgtttccactgtggacgccaacggagtgaaattccacgaccaattccaaataattggcaaatgggacgaaatcgaagtgtgtgacggcacttacaagtaaagcaacggaaaatgatggaagtgattggcacagaattttggatgttttggctcggatttggttgtcgatatgttaaaatgtcttttttgaatcaaatgttctcaataaaaaaaaaaaaaaaaaaaaaaaaaaaaaaaaaaaaa

SEQ ID NO: 1345 - DNA, 1134 bp, Heterodera glycines
  coding sequence=SeqID_1563; coordinates=1-881
  peptide sequence=SeqID_1764
atgggttcattaactacgggtcaatcgtcaaaatggtggatagtgtcagtggtttggctcttccgatgatgcgaatatgcaaagttgaaaaatgcaatgggacggacgttgtggtgatcaacgacggagacagcggggagcaagtcagccaactgcacaagtgcggcttccaaatgctcagcggagcggagagtcggcctttgtttatgtgtttcaacggcgaaaacatagtgcaacaagacgtgggcaatgatcggagttttgtggcgaatgatggccaatttatgacggatcgaaggtatccgatcagagacggcgcccaatggacaattatctcgaccgatacaatccaataccgtttctttgaggcactaaggccagttcagaatgaggttgctcctgtgccaattgtcagttcgctggacatgcactcgactgacccgacttcgtcttccggcgcttacgttgagcttaatgggcacgacttctaccccaatttgcaggcttggctcggctccactcccatgcccacgacatttgtcaacaaagagatgctccgtttcactctcctccctctcagtcagctgaatttgcaggagggcgtcgattatgtgttgggtgcccgctgctctcttctgtccgtcccctgcccgctcagttcgccctcccattctccgacaacggcctcgtctcccccattccttcacttcctcaatggcacaacaacagtttcttatgacagtgatcaggaattggagtttccgttgtcattggttcgcgatgacggagtcatttacgccactcagctgagtgtgtcttacacgagaccacgggaacaacagttcaggacgggaattcaaggaacacaaccgaacagctagccggggaggacctttatttggttggatgttccgttctgttttctatccattgttattctcaatccatttgtcttaagttttcttccttatttattacagcatttacacttgcatagtttcataaatgtcattctaaatctattcaataattattttcaactaatgataatatatggtgtcgattacttctgtgtctgtcattgtttatccgttatcttgtctgaaaacacgaataaatctcgttgtcgcaaaa

SEQ ID NO: 1346 - DNA, 669 bp, Heterodera glycines
  coding sequence=SeqID_1564; coordinates=1-580
  peptide sequence=SeqID_1765
agctacttttgagaaactcgtaaagactgatggcaaagcgcccgatgaccttgaaaaacaagttgcaacggctttgtctgaattggcacacaattcagagatcaaggctcagctcagcgaactttattttgttggagcacaggaatacgaatttggaaacaaaaagtgtattctggtatggattcctgttccgcaacttcgagactaccaaaaaattcacccaaaattagttcgtgagctggagaagaaaatgagcgggtgtcatgtcatcttcattgccaagcgtaggattttgccaaaacctcaacgaggtaaaaaccgtaagccattgggacagaagcgtcctcgttcgcgaacactcactgctgtgcatgactcaattctcgcagacgttgtattcccagctgaagtggttggcaagcgaactcgagtcaagcttgacgggaaacaaatcatcaaagttcacttggacaaggcacaacaaacgaccgtcgaacacaaggtggacaccttttcgcatctgtacaagcgactgactgggaaggatgtggtgttcgaatttccggagccgttattctgagaattgaaaataaagagcctctccgttatttcttttttgttgttacgctgttgagaagatgtgttaaaaaaaaaaaaaaaaaaaaaaaa

SEQ ID NO: 1347 - DNA, 1451 bp, Heterodera glycines
  coding sequence=SeqID_1565; coordinates=7-1296
  peptide sequence=SeqID_1766
ctcaaaatgattatcagcagcaaagccgtccaacttttgacttgctacagaaataggatcaccagaaaactacaatattcgactacggagaatgtgccggtgaatgtgcctgagccggtcatttcctcctccaacatggcacagttccgcaagggagcgggcggtcgttccagcttctcgggcaatgtcattacagtttttggcaacaccggatttaccggccgaagggtggtcaatcggttggccagacacgcaaatcagctaattttgccgtaccgctgcgattcgtattttctcagagaattgaaagtgccttgtgaccttggccaagttctgttttttcctttccaattggacgacgatgaaagcattcggaaggcagtcaaatacagcaacgttgtgatcaatatgatcggcacatatgtcgacacaccgaattattccatttatgacgccaatgtggagggtgcgtggagaattgcgcgcatttgtcgggaaatgggcgtggaacggctgatccatgtgagcgcattgaacgcggacccatcgtacaaaacgcaattcatcaaaaatggcgcctttctgaaaagcaaaggcatggccgagcaggcggtccgtgccgaattcccaagtgccaccatcattcggccctctgtgatgtacggcgacattgaccgtctcatttataatctgatcacccgttggcgcgttgacccgttcggcaatgtgtacactttcaatgcgggcgaaggcatttacaaaatgccactttttgtcaatgactttgccgacggagtgaacagagtggcgatggactcctcaacagcgggcaaaacctacgaatttgtcgggccgcactgctacgaaatgtgcgagttgttcgacttcatcttcatcaaaggcggcctcgtcgctgacataactagcagataccgtcgtgttggtattccgatttggttccttttcacgtcttttctctgtcattcgtatacgaaaatatatcgtcgtcctggcgttattaattgggagtggttcgatttcatggaagcgacgagtgatgtgctgtcggctggggacacttatcttctgaaggatttgggcgtttcgttgaccgattttgaggatatgggcggctattacgccatgcaaatttcttttcagagaccataccagccaagaatggctgactatccgcagtgtccgctcccccttcgttcgccgcctctttacaaacggaagccgatcacttttaagaagcaaaatatagtcactgagcaaagggcgttcggactttgagcggagaacggacggatgggaaaaagatggataacgatcgctttattcatccattgatccattaggaatgaacacaaacaattaagctgttgcgatgattggtggtgttatcgctgtgtaaaaaaggattgaataaaaaaaaaaaaaaaaaaaaa

SEQ ID NO: 1348 - DNA, 847 bp, Heterodera glycines
  coding sequence=SeqID_1566; coordinates=29-646
  peptide sequence=SeqID_1767
gcaattcgagtgctacaaatagttcgaaatggtaactgcggaagataccgttaaaacaaaggaagaagaccccaaaaaaacgacaacggacgacggatcgagttcagaggaagaagtgcccgagctcgaagagggcgacgttactgaagagcagaaaaaagttgctgaggcggccggactcagtgagcaggttgccgaaaagggctccaaacaatcgcgttctgaaaagaaggctcgtaaactattcagcaaacttggcctcaagcaagtgcacggcgtttcgcgcgtatgcatccgtaaatcgaagagcattttgttcgtcatcaacaagccggacgtgtacaaaagtccgggctccgacacatacgtcgtttttggcgaggcaaaaattgaagatttggcacaacacgctcaaatcactgacgtggagaatttgaaaccgccctcaatcattcgcgatgttcgcaaccgaatcacaccggcggaggaggaaagcgatggcgaagaggctgatgctactggaattgaagaaaaggatattgagttggtgatgtcgcaagcaaatgtttctcgaaacaaagctatcaaagcattgaaaaaggctgacaatgatttggtgaacgctattatggcattgacaatgtaggaggaagccagaggaattcagagaaaacattgttgaccttcgaatttttgcttcaatatttttcctacgggaatcagttcttttaccattgctgattatgttactttacgaattttgcttataaaaattaaaaagcgtaaaaaaaaaaaaaaaaaaaaaaaaaaaaaaaaaaaaaactcgagggggccccgcccaccgcgc

SEQ ID NO: 1349 - DNA, 940 bp, Heterodera glycines
  coding sequence=SeqID_1567; coordinates=1-640
  peptide sequence=SeqID_1768
ggcgcgaaggaagcgaatcggacactttggagtgcgagatagtcgacgacagtcgagaaagcgaaagaaattcgaatcaccgcaagccgtaccgcctgccgcgaacaccgacttcattcagacagcccggggcgcaattcggcgtcagtcattacgcgatcggagtgggatgacacttgcacggcttgattcacaacgtgaagggtccgacctgattaggagttggagcaaggaggatgtgtccaatgaggaaatgtctgcgcatcatttcggcaacgggggaccgtccacctctcaccagccgacagcaaatcagcaaagacgcgactcgccgcctaaaagaatgcagaaacaatcgcagcaaaagcagaagcaaatgtcgccagacgagtggttgaagaagttggaggccgaatcgggcggccttcgagacgaagaggaggagcaggcggagaaagacgtgctgaaagggagcgccggggagagcatgcggaagggagcgaaagcacagaaaggcaacggggtgattaggagagatcagcaacagcagcagcaacacgatatgaacggaatgaatctgaagggatcactcggtggacagaatcggaggcggaagaagagctgttgctgcattatttgatcacgccttcgccttctccccaatcgcttgttgcccctttttcgcattttggtcatcctttgattcgtgattaaatatatacgtaaattgtatcgcctctttctctatttctatccccaaatggtcattcgttcattcagctcacaattcctaccaaatctgcacatttaaagagtatttctatctgggaaatctgttcattgttacttctttgtttgttttatttagacagcgtacattcttttggaatcgttcgtcgacaaattattaacaatttataaaaaaaaaaaaaaaaaaaaa

SEQ ID NO: 1350 - DNA, 874 bp, Heterodera glycines
  coding sequence=SeqID_1568; coordinates=26-760
  peptide sequence=SeqID_1769
gcacgaggtacgaatttattgaaaaatgactgaagccaaaaaattgccggaagtgccggagacgctgctgaagcgacgcaaaatcagagccgcacaacgggctgccagggcgaagaacagcttgaacaccatcaaaaaagcgaaggccaaaaagacggaaatcttcaaacgggcggaacattacttggttgagtaccgccagaagcagcgccaattggtcgcgttgaaacgggaagcgaagaaagtgggcaattactacgtgccggacgagcccaaacttgcatttgttgtccggatcaagggcatcaacaagatccatccacgccctcgtaaagtgttacagctgcttcgtctgcgtcagatcaacaacggcgtattcgtcaagttgaacaaagcgacaatccagatgttgcgcattgctgacccgtacattgcgtggggctacccgagtcagaagatcattcgccagttggtgtacaagcgtggttatgccaaggagagtgggcagcgcattccgatcacggacaatgccattgttgagcgaaacatgggcaaatcggacgtgatctgtgtggaggacatgattcaccagatttggacagtcgggccccacttcaagcaagtgaccaactttttgtggcccttcaaactcagcaaccccgtgggcgggttcaagaagaagtccaaccattttgtggagggaggcgactacggaaaccgcgaggaccaaatcaacaaattgcttgaaaaaatgatctaatttcggaaacaattgcgatgagttgatgtgcagcggacggcacgcttttgttgttgttattttacagataaacttttttgttaaaaaaaaaaaaaaaaaaaaaaaaaaaaaaaa

SEQ ID NO: 1351 - DNA, 1665 bp, Heterodera glycines
  coding sequence=SeqID_1569; coordinates=1-1437
  peptide sequence=SeqID_1770
gaaaagggaggcgatcctgaacaaattcgcaaatctcaagtgggccgtttcgcagatgtttcattagtggacaaagtgatttcggcggactccgaatggcgaaaagagcgtttctttttggacggtttgaatcgtgcgataaaagtgtgcagtactgcgattggtgacaaaatgaagaagaaagagtcggctggtgactccgatgccattccggaaggacaaatcaaatcacttgcagaactgaaaatggatgacatcaaagaaatgaaaatttcgcaaattaaaacagtcaagggaatggtggacgaagaagtcagacggaccaaactcagaatggaaacgcttgagggggacagaaatgagcatttggccaaaattgggaatttgctgcataattcggtgcccatcagtgacaatgaagacgaaaatcgagtcgaacggacatttggcgactgcgcaagcagaaaaagttattctcatgttgacctcgtggtgatgtgcgacggatttgacggagagagaggcaccaatgtggcgggaggacgaggctattttctgaaaggaccgttggtgttccttgaacaagcgctcatcgcattggcattgcaaatgctcaacaaaaagggcttcacgccgctttacacgcccttttttatgcgcaaagacgtaatgcaggaggtggcacaactcagccaattcgacgaagagctttacaaggtgaccaccgcaaaaaagacggacgcagccaatgaagacggctctcccgacgagaaatatctaatcgcaacttctgagcagccaatcgccgcctttcatcgtgacgaatggcttaacccatcggatttgccaatcaaatatgccggaatgtccacctgttttcggcaggaggtcggaagccatgggagagacacccgcgggattttccgtgtgcaccaattcgagaagatcgaacaatttgtcatctgttccccatttgacaacgaatcgtggaagcacatggacgaaatgattgacaatgctgaagagttttgcaaagtgctcggccttccctaccgaattgtggccattgtttcggccgaactgaacaacgcggcggcaaagaaattggacctcgaggcgtggttcccgggcagcggtgcatttcgggagctggtttcatgctccaactgtacagattaccagtcgagacggttacgaatacggtacggacagacgaagaaaatggacggagaggtcaattatgtgcacatgctgaacgcaacaatgtgtgccaccacgcgagtgatctgtgccattctggagaacaatcagacggaggatggcattgtcgtgccggaacccctgcggccgtttatgccatcgcaatattcgcaacgaattccctttgtaaagccggcgccaattgagcaggaaaaagtgcagaaaaagaagaaatagtctcgcagacgctgatattcggaggcattctttgctttggcatttgttgacccatttttatttataagtgaatttgttaattgatggcaatggctttacaactttcgctgtttgtttttgttggtttattcattcattcgtttgtttcgaaaatagcatcagtttcattttgattgggtttagtcaaataaataaatgcatgattaaaaaaaaaaaaaaaaaaaaaaa

SEQ ID NO: 1352 - DNA, 1031 bp, Heterodera glycines
  coding sequence=SeqID_1570; coordinates=1-916
  peptide sequence=SeqID_1771
ttggaagctgagaagaccgactgctgtctgtcaattgaggggacatgacgaacatgtgatcacgtgtctgaagctgcgaggcgacctcattgtcactgggtctgacgactgcactttgcgcgtttggtctgctgcgacgggaacgtgtgtccacgtccttaacggacacattggcggtgtttgggcacttcagctctcacaggatggcaaaattgctgtcagtggttccatcaaagtttgggacattgttgcgggtcaatgcattcgaactcttttcgggcacgtggctgcggttcgttgtgttaaatttgacggttcagtgattgtgtcgggtgcgtatgacaacaatatccacgtgtggaatgctgcggacggttcgttaatgcacgttttggaagggcacacgaacagagtctattcgatacattttgtgagtgagaggaaattgctcatttcgggaagtctcgacacaacaattcgggtgtggaacgtggacaccggcgaatgcttacaaacgcttgtcgggcaccaatcactcacttctggcatgaaattacgagacaacattttagtgtctgcgaacgccgattcgactatcaaagtgtggaacatcaccgacggcacttgtgtccatacttttgccggacccaacaaacacgcgtcggccgtgacggggattcgtttcctggacaatggaatggtggcaacgagtggcgatgatggcattgtgaaactttgggacgtgatggaagggactttcgtctgcgatttgcttcgactcgcttcccagggcgccgggggttgcgtttggagaatgaaggcgacgccgactctgctgatgtgtgccgttggttctcgtaatgggactgaggacacaaaacttattctgatggatttcgatgctccctacccttaagaagaaaatgctcttttgaattctgtgtattctaatgtaaaccaacatttgttagaattgtaaatttaaatattcgagaaacaatttataacaaaaaaaaaaaaaaaaaaaaaaa

SEQ ID NO: 1353 - DNA, 795 bp, Heterodera glycines
  coding sequence=SeqID_1571; coordinates=2-682
  peptide sequence=SeqID_1772
catgaaaccaacaatcgatttgaagcaggacatttccaagtacaaggaacgcttccaaaaacttcatcataaaagagaagagtcaagaaaaataaaccacgaacacgtcgtggaggaggatcgacgtctgaagttgcccaacaattttgaggcaaagcgaaaacgacaagaatgggagttggaggagcttgtggcaagaaaggaagcggaggagcgtggcgaagattatgacagaataaaggcactgggaacgcaagcggacatcgccgacaaaatggaagcggcaaaacgaagaaaagcaaaccccgacacgggatttgcgagttatgaagcgatgtcaattcggcaatacgaaagaatgaccaatgggataaagccggacatggaatcttaccaaaagatgaaaggagtcgtcggagaagatcaattctacgcaagtgcaaatacgttgatccaaggctcgcattatcccaccgacaaggcactcgataaactttcggaggatgttcataaccagatgaagaaacgtgaccagtaccaccgccgtcggatgttcgaccctgatgccccgattgacttcatcaacgaacgcaacagaaaattcaaccacaaattggagcgctattacggcaaatatacggcagatattaaagaagatttggagagagggacggccatttaaaagaatagtgtaagcgaaagtattgacattgaaattggattaaatcacagataatctttgaaattggattaaatcgcagataaaaaaaaaaaaaaaaaaaaaaaaaaaaaaaa

SEQ ID NO: 1354 - DNA, 1143 bp, Heterodera glycines
  coding sequence=SeqID_1572; coordinates=1-1017
  peptide sequence=SeqID_1773
atggctgatgacaaaagctgtgacggtgcttcttctgcgttgcctccgtgtttaattgtgcttggaatggccggttctggaaaaagctcatttgtccaaaggttggcgagtcatctccactccaagaaggtgttcccctacttggtcaatctcgacccggcggcagcaaccgttccattcccagcaaacattgacatcagagacactgtaaattacaaaaaggtcatgcaggaatacggcctcggtccaaacggtgctattctgaccagtctgaatttgttttgcactcgcttcaaccaagtgttggacttgttggacagacgaaaggggtccatgccatacgccattttcgacaccccgggccaaattgaggtgttcacgtggtccgccagcggcactgtcatcaccgattcattggccgcctcttttccgaccgttgtcgcttatgtgatggatagtgcccgttcgaccaacccgacgactttcatgtccaacatgctctacgcctgctccattctttaccggaccaaattgccatttttcgtcgttttgaacaagtccgacgtggtggaccctgcttttgccgtcgaatggatgagagattttgagcagtttcaaactgcgcttgaccaaagttcgtccagtttcatgaacgacttgacccgctctttgtcccttgtgctcgattcgttttacgaaaatttaaattgggtgtccgtatcggcaaagacgggtcagggctttgataaggttttggagttaattgaaaagtgtcggttggaatattgggaagtgtataagccaatgtgtgaacgagtggcacaagagagagctgctgagacagcgaacgacggcacaaccgacgcaatgccaacggaaaagttggcgaatttggaaataagagaaaatgatgtgccaagtgatgagaagggacaaacggaggaggcgcaaattacagaaacaaatggcgaagaacattcaacgaaaccaacggaagaaagtgaagcgcaaaagtgatcagctgctggttgcgcgaccaaaccattttttgttgaaaaatctccacattttttgctgcggaatttcccgcattttcttgagtaaattttgcctcttttaaaaaaaaaaaaaaaaaaaaaaaaa

SEQ ID NO: 1355 - DNA, 674 bp, Heterodera glycines
  coding sequence=SeqID_1573; coordinates=108-488
  peptide sequence=SeqID_1774
tgcacaccatactcaaaaggttctttgcgcatgtttcgccttcgcttttaaagaagcccctcaacgacccatttccgattgctgcgtggcgctcgcacccggccaacatggccaaaggtgtgaagttcgatcacgacaacgcgttcgtgcgattctgccgctactatctatggcattactgttggagtgggcgtcagtacggtcttcaattctacgaccaggcattcgaaccgcatcccgtagtccaagaggcactgcgccggctccgtcttaaggacccctaccagtacgaccttcgtctgcagcgtattcttttggccagtcaattgggctcaaagaatgagcgactgccgaagaacatgtggacaaaatgggacgacgagacattctatctgaacccgtattttaacgaaattgaggaggaaaagctggagcgtgaagccagcacgggcatgaagccgggataccaactcaaagagcagatttaggggacagacattgtgttgtgaacgattaggcgcggaggaaaagcacattgcgtttgttgatactgttgccggagagaaattgatttgatgagtgattgttcacaacttttaggacgacatgtgttatgttcatttaacgtgaagtaataaaaccattttctttaaaaaaaaaaaaaaaaaaaaaaa

SEQ ID NO: 1356 - DNA, 1747 bp, Heterodera glycines
  coding sequence=SeqID_1574; coordinates=99-1511
  peptide sequence=SeqID_1895
ttaagcatcgtttgctcttcgattgttggccatattttgtttgatgagattcgatttctcgagtgttttcacccattttaacccatagtttcactgtcatgaaaattggacatcggaccccgccgaggcagaaaagagccactgaccctcccccacagttcgattcttccgatttgggctctccgcaaaaggtttggtcactgttatgcgagaaggacgagaaattgcgccgagatccgcacgtattttcgcgccagaagaaaataaacgccaaaatgcgtgccatgctgctcgactggctgatggacgtctgtgccgacaaacagctccaccgcgaaaccttccatctttgcatcgattacatcgaccgtttcatcgcattgagtgaccaccaaatgcagccccagcgattgcaactgttcggctccaccgccctggtaattgcgagcaaagtcgaggaaatttatcctccgaaaattgcggagattgccgaatacacggacggctgttgttctgaggctgacattcgaggcatcgaagagattatgctggagaagttggattggacgtgttatccggtgaccgctgtccattggctcgcacttttcatgcagctgatgagcacggacgaagtgatccccgcccagcgagtggtcatttcagccggcaaacggccgctagacactccgtcactcaacggcgactcttcgttcgtcatcggtaaaccgtcgctggaggtgagcattgagtcggcactgcccaacgacgagaacaatcagccggacgatgcccagcgggcggagtcgcgtccttccgtgccgtccgtttcgtccccgtgcccttcgccctcttcttgcgcagttggcgaagatgttcagctcgaggtttcgtccgtcgttttcgccggtgcgtcgcgcgtccgtcgcatttccttcagttgcgcctatccgcggatgcaactttgccacattggctcctccccacgcgtgctgctgcacaccacgcgagcggacattagttacgtcggccataattcgtacagcagcggccacatttacccggaccagcgctgcaccgtgccgaaacttatgcggggcgaattcgtccgaatggccgcgattttggacttggccatgctcgactcgggctgtcttcgcttccgttacagtgaattggccactgctgtggtcctttgctgctatgagcccgaacatttgatttgccaactcaccggtttttcgcctgaaaaggtgcgcgatgcccgcgcttacattgagccgttcgtccgcgtgttcgacctcagcgagcccaccggcacagccattccttgcctggcggacgtgccccacggcgaccgacacaacattcaaacgtacacatcgaagtgcctcgaacatttggagactgtgcagcaaattcgaaaagagactgaatcgcgtcgcaaggcggtggaattacgggtcgcggctcgggtgcgcaaacgcaaattcggctcggcaatgaatctctaatgatattcatcaataaatatctaatttattctcttatttcatctctttctcacacggaaaaatttgccatgtgtaaattgtttgtctgcgattgttttggatcgaactttcgctactggcttttgattccaatcccacagctacggaaattgtcaggctcacaaccagcagttttttattagtaaaatgcggtgattacaaaataaaatttacacaaaaaaaaaaaaaaaaaaaaa

SEQ ID NO: 1357 - DNA, 937 bp, Heterodera glycines
  coding sequence=SeqID_1575; coordinates=1-808
  peptide sequence=SeqID_1775
gcttggcatgcccggcttcccgggcacaaagggtgaaccaggagtgcctggacgagacggatttcctggcatggatggtgaaaagggcgatgccggatatccggggccagccggacccgctctcagagatggctttgttgtggtcacacattcgcagacgacgcaagtgccgaactgtccacaaggcactgaaaagctgtgggacggcttttcattgctgtacattgaaggcaacgaaagagcacacaaccaggacctcggcgatgccggctcatgtcttccccgcttctccacaatgccattcctgttctgtgattttaatgatgtttgcaattatgcttcacgcaatgacaaatcgtattggttatccaccggcgaagcacttccaatgatgccagtgaacgagcgcgaaattcagccatacatttcacggtgctcagtttgtgaaacgcctgcaaatgtgatcgctgtccattcccagtccatccaaattccaaattgtccaaacggttggagttctctgtggatcggctactcatttgccatgcacactggtgccggcgctgaaggcggtggacagtcattaagttcttcgggctcctgtcttgaggattttcgaacaacaccattcattgagtgcaatggcgcgaggggatcttgtcactttttcgccaacaaattcagcttctggctgactactgtggacgaaaaccaacaatttacgatacctcaaagtcaaacagtgaaggccggcgcacaacgatcaagaatttctcgttgccaagtgtgtatcagaaatgtgcgataaaaaagaaagaaaaattgttatggcaaaattttgatttattttatattattttatcactgccatttatttgttcattttcattaaacatttttagaaaataaaaaaaaaaaaaaaaaaaaaaaaaaaaaa

SEQ ID NO: 1358 - DNA, 1369 bp, Heterodera glycines
  coding sequence=SeqID_1576; coordinates=1-1190
  peptide sequence=SeqID_1776
gtcaaacttcgctgtcatgcccatcaaagtctcgtcctgaacatcttttctgtctcactccggagcatctttgcgatggcgtcacgcattgtgcaaacggagaagacgaagattctaagacctattgccgtgcgaaatgtgacgacaaaaaagaattctcgtgtcgcgtgtcggaaatttgtcttccgaaggaagtgttctgtgacggaataaaacattgtccttttggagacgacgaactgaactgcacggaatgtcgaggcgaagcaaagcgatgcggtgaccattgtctgccaaaacggaagttatgcgacggagaagtggactgtcaagtggacggagggagtgacgaaaaggactgcgattgtccttcttgttccggaatgaacagcgcgttgtgtgacggcgagcagaagttttgcgtggacaggcgacgattgtgtgacggacgagcggactgtccgggaggggaggacgaaaacgattgccatggcatttgtccatcattgcccaaaggagcgagcagaacggaggacaagaatacggatggaatggtcaaatgctccgatggagtcactcgcttatgggctgtcgcctgcggagggcttttccccgaatgcaacaaattctgtgatcggtgcaacccgcaaagcgcattccaatgtgtgggcagcacaaagacttccaatgacagcaacggcaatgaatgcattcatcgttcgctggtttgtgatgacaaaatggattgcctcgatggttctgacgagtcgaattgtgactgcgacgacgcgtttcagtgccaagaccacgggaaaggactgccgactggacgctgttattcagagtctcagaaatgtgacggatacacggattgcattggtggggaagacgagcgcgactgcgagacgtgcaaaaatgaagcatttctttgtcaaagtgagcgtcgttgcgtttcgagtatgggacgatgtgacggacacaaagattgtgaggacgcatcagatgagaaggaatgcacatgcgaagaatgcacgcgtttttcttcgcatccaatgtacatgtgtaaggaagcgcgacgttgttacccgctggacaaagtttgcaggcccagcagtttatgccctaaggtctccaaaatggacgaattatactgcgccgtgcggacccagcgtggcatcgaacttctctgagaaaatgaacgaaaaatgacgaattcgatttattgaaaatcttttttgacttaaacccactgacatcccaaattacctccaaattacttccaattttcaaagcttttcatatttttaaagaataatattgtgttaaataaacttattaaagaaaaaaaaaaaaaaaaaaaaaaaaaaaa

SEQ ID NO: 1359 - DNA, 1402 bp, Heterodera glycines
  coding sequence=SeqID_1577; coordinates=1-1260
  peptide sequence=SeqID_1777
gagacattgaaggcgactctcgacttggacgaaatatttggcaacgaaaacgaaggtggaaaatcggccggcagcagcagttcgtcgacgagttcttcgcgttcctccagccccgacttgaccaagtcacgttctccttctcccgaagtcaaacaagagattaaaacaagggatgaaattatccgttgccaacttttccggcgaaagctcgcgaaatttgttcatgctccgttcttcgctaaaacagtggtcggttgtttcgttcgcatttcaatcggtcccaacaaatcggatgggaagcaagtgtacagagcggctcaggtagtcgaagttgtggagacagcaaaagtttacgaagtcgagccgaacagtgacatccgtacaaacaaaggctttcgcctcaaggtgagcgatggcgagccaatgcgagtctatcggttggagttcgtctccaacagtcttattatggaaagcgagtttctgttttggttcaacaaaatgcggtcttcgaacacgcccatgctaaccgtcgactttgttgaccggaaaaggaaggaaattgtgaacgcactcaactacaaatacaatgaggcggagatcaatttgctgatcaaagaaaagcagcgcttcaaaagacaaccgaccaatttcgcctttcaaaaatcggaattgctcagaatgaaggagcaagcagaacaaagcggcgatgtcgcgagggtgcgcgacttgcagcagcaagtcaacgaattggaagagaaggccaagaaaattgaacaccaaagaacgaagaacttaagtgccatcagtgccatcaaccagcggaatagggaccatatgaaacaaacattccttggtgccggaatagtgcgggaagagcaggagaaggacgacgacccattcacacggaagtcggcgcggatgaaagtggtctcgggatccgtgaagtccaaaaccgccggcgaaggaagtggcgccaatgccgagttatccgttatggacacgatggtttcttcgttgggttcgttgtcgtcttcgtcggagtcctctccaaacaaaaaagtgcaacttccctcaactcacgatttattcaacgcacatggaatcgacataaatattgacataaaaatgcccgccgtcgtcggcggttcgttgagagcgccgccaattaccgactcacaggcaccacgaacacaacagaagacgagcagctcgcggacactcacattggaagaatacaaaaagaagagaggacttgtgtgagaatggacaaatgggggagcgacccactgtaaacaattcttacgtcattttgtttcacatgaaattcatacttttcgtatttgtgtgatcgaattttctataccataaaagataccaagacaaaaaaaaaaaaaaaaaaaaa

SEQ ID NO: 1360 - DNA, 1579 bp, Heterodera glycines
  coding sequence=SeqID_1578; coordinates=1-1497
  peptide sequence=SeqID_1778
gtgaaaacggcgtttgcggatgtggcggggtgtgaagaggcgaaaatcgaaatcatggaatttgtcaactttctgaagaaccccgcacaatacaaagcactgggcgcaaaaattcccaagggtgctcttctgactggccctccgggcactggtaaaactcttctcgccaaagcaactgctggcgaagcaaatgtgccatttatcactgtgtccggttccgagtttttggagatgttcgtcggtgttgggcctagccgagttcgggacatgtttgaaatggcgcggaaaaaggcaccatgcattctgttcattgacgaaattgacgctgttggacggaaacggggcggaaagggcgccatgggaggccactccgagcaggagaacacactgaatcaattgctggtcgaaatggacgggttttcaactgatgaatcgaacgttgtggtcatcgctgccacaaaccgcgtggacattctcgaccccgcgttgatgcgtccgggccgatttgatcgacaaatattcatccccgttcccgacatcaaaggccgtgcttccatcttccgcgttcatttgacaccaatcaaaacaaccttggacaaaatcgagctttcccgcaaacttgctgcgcacacgcccggattttccggcgcagacattgccaatgtttgcaatgaatcggcactaattgcggcccgagatgcacacgatgaggtgacttccaaggactttgagaatgccatcgagcgggtcatcgccgggatggagaagaaaagtcaggtcctgcagccggacgagaagaaaacggtggcgtaccacgaggcgggccatgccgtggccgggtggtttttggagtttgccgacccattgttaaaggtgtcaatcattccgcgtggaaagggcctcggctacgcgcaatatatgcccaaggatcaatacctttactcgaaggagcagctgctggacagaatgtgcatgactttgggtggcagagtgtcagaggaaattttcttcgggcgaattaccactggcgcccaagacgatttgcggaagatcacacagatcgcttactctcaggtggtcaaattcggaatgagcgagaaagtcggtccggtgtccttcgacactccggagcctggcgaaatggcattcgataagccctattcggaggctaccgctcagctgattgaccaggaggtgcgcgacatggtcagcgcggcactgcggcgaacgcgcgaacttttgatgtcgaaggtggaacagatcgaacgggttgctcttcgactgttggagaaggaaatcttggcaagggaggacatgatcgaattgttgggtccgaggccttttgccgagaagcacacttatgaggagttcgtggcaggcacaggatcaatggatgaggacacgacgctgccgaaaggacttgactcgtggaaccgcgaacgagagaaagaagagaaaaaggacggagagaaagagcaaaagaaagaagcagcctaagccatgttgttatttgtcattttgtttatttaattagagatgaacccgtaaaagacaaaaaaaaaaaaaaaaaaaaaaaaaa

SEQ ID NO: 1361 - DNA, 958 bp, Heterodera glycines
  coding sequence=SeqID_1579; coordinates=1-834
  peptide sequence=SeqID_1779
tccgtttatggcaaatcggatgaactgttgcagctgcgcattgagctgaacatgaccaccgaaaaagcgaccaaattcgtgtcagattcgcgtcaattggttgtccttccgcatccttttcaacactctgaaaagcgtaccattttggcatttgccggcaccaaagaagcgcaacaggaagtgatgctaaacggagcggacattgcaattgggccggaaatggtcaaaaagattctcaagggtcagttcaacatggacgactacgacttttgcattgcccacacggacatggccaagcacattctgccacttcgcggtgttatcaaaacgcgatttccgactaaaatcaacggaggaattggcgatgatctcaacgaaattttggaaagctttttgtccggaataaatttgaccgtaagaagggaccctaccaacaaggaatggggcctaagtgagcctttgatcggaagattgagcatgtccgatgagcaaattgaggagaacgtggcggtcattgttgacactctgtgcaaaatgcgcaaggccgtgcttggcccgttcatcaaccgcgcctctctgatcacagcctctgccggccctcaacagtcgtttttccctgtcgacgtgagcccttgggaagcgttgccgacggaagaggaaattgagaagcatgagaagacgaaaaagaaaaaggaccagaaaaagatgaagaagaagaaagagacggacgaattggaggaagaggaggacgaagaagaggaggcggaagaggacggacgaatattcccaaatttggacagaattgatcagaaaatactgatgaagcttatgtgatcgatcatcaatcaatcattgaatcctactaagaatgctttgaaattatgattgattttattttgatggaaaatacaacttaaaaatttaaaaaaaaaaaaacaaaaaaaaaaaaaaaaaaaaa

SEQ ID NO: 1362 - DNA, 1698 bp, Heterodera glycines
  coding sequence=SeqID_1580; coordinates=13-1419
  peptide sequence=SeqID_1780
gtcaattttgacatgagttcagaatcggacgaacagagtgccgatgttaacggactctgttcgcaatcgcttcgatcagatgaaaaagtgtgtcccgacccggacacaattaaaatgtttattggccaaattccgaaggcgtgggacgagttacaactgaaggaatactttgaggagttcggtccgatttatcagctgagtgtgctgcgggacaaagagacggcctccagccgtggctgttgcttcgtcacttattatcaccggaaggatgcgatcagtgcccaaaatgagcttcacaatgtgcgcactttccccggactcagtcacccgattcaaatgaaaccggcggatgtcgaaaacaaaaacgagcgcaaacttttcattggaatgcttcccaagtcaatggacgaagagagcgtccgggcgctgttcaaagagtttgggcaggtggaggactgcagcattctgcgagaggacggcaaaagcaaaggctgtgcttttttgactttggtttctcgttcctgtgcccaacaagcgattcgaaaaatgcaccattcgcagattttcgagggctgttccaaaccgttggtcgtcaaattcgccgattcctgtcgagaaaaaaacgcaaaaaaagctccagatgtcaaaaatgaagagggtccgaagccgaacggtgggaaaccgaccagtaataatcagaattcgcaattgctcactgcctcaggcaccgaaacattggccaatttggtcactttacttcagcagccaaatgtcatttctctgcttgaggccgcacgtgtcatacaatcggcacagaatgtgacttcgtccgctgatttactactcaaaatggaccaaaatcgtcaacagaatcttttcaaaatgcccacgctgcttccaccgaatttgaatcagggcgcactgctcggcctgtcacagggattgctcctccaacagtccgcggtcggagcctcaccactcggtcactctgcgctgaatctctctgtgcccagtgcaattcattctgtgctgccaacgactccaccgaatttgccaattatttcgccttcttgctcaattgtttcaaggatgacgccggcaaatccttcatatcccatcgacaaatacaaccggggaccggacgggtgcaatttgttcatctaccatttgccacaagactttgccgacacagatttatattcactttttgctcattttggacaaattctctcggccaaagtgttcatcgacaaacaaaccaatttgagcaaatgctttggttttgttagtttttccgatgaatcttccgctcaaaatgcaatttctggaatgaatggtttccaaattggcgccaaacggctgaaagttcagctcaaaagatcggattcgaagccctacgaaaaaccaatagcgtattaagcggcgtaaaatattaagagaacgtaccgacaatctgcaaattgacaaggctcatttattcattttcggttcacatttttatttcttgcctcctattcttagtattgccatttttgccgtctcgctgccataaattcttattttcaccatcctcttgatttccttagttttcctccatctttagctgtttgccatcgtcgttacttgccatattttcttgccatttctcccattaaaataaagagacgaagaacactgaaaaaaaaaaaaaaaaaaaaa

SEQ ID NO: 1363 - DNA, 1446 bp, Heterodera glycines
  coding sequence=SeqID_1581; coordinates=1-1240
  peptide sequence=SeqID_1781
ctccgaagttcaattagtgctccaacatctgccccaggagtatcagagattcgaggagaaactggaacgtgcccgtgccgaaatggcccaactccagcaaaatccacaacagccgccctatttgccacccgatgcgatgccccctccgcagcagataatgccaatgcccatccgacaggacttttacgtgagagccctcttcgacaacgacccctcccgcggggatgcggtgctgccgcaccgttccctcgcctttcggtacggcgacattttgcatgtgacgagtgtggcggacgacgactggtggactgcgcgaagggtcgccgaaaatggggacgaaggccccgagggaatcattccgtccaagaaaagggtggagaagcgcgagagacagcggcgcaaacaggtgaacttcaacgcgggcagtcaaagtttgggcagaaacgcgtcaatgagtgccggcggattcggcggcggcggcggattggacggccgacgcggttctcgcagccaactttccttttctcgcaaatttcccttcgttaaatcgactgagaaactgaacgaatatccctcggacggaggcgaaacaggcggcggcactatcgcagatgagccaattcattcatacgttacggtagaactgcgaacagttaattacgttcgcccggtcattgtgctcggggctttgaaggatcgcataaatgacgaattggtcagtcgacaccccgacagattcagcagctgtgtgccacatacttctcgcccaccgcgggaaggcgaagtgcacggacgcaattattatttcgttacgaaggccgaaatggagagggacgtgaagagcaaccttttcattgaagcgggccaattccaaaacaatttgtacgggacgagcgtagcggcggtgatggaagtggccgaatctggaaggcattgcattttggacgtttccggcaatgcgatacggcgactgcaaaacacagcccatatttatccagtttcggttttcgttaagccgcttaattaccaacaattacgagaatgggactctttgctcagtgaagaagatgccctgaagcaatttgaacggtgtcaacgccaagaacaaaacttcggggatttgttcaccggaatggtcaccggacattcgcccgacgatattttcgctcgcgtaattcacataataaacgaacagtcgcgacccgaagtttggattccgacgaatgaacagttgccttgagagccaaagaaaatgccaaaggacgcaaacaattccaaaaagaattcataattcacttatcgttttgaaatttatccgtttcattcagtgccgtcagttgtgctaaagcaaatttgccaaccttcgtttataaacttgctcataaatttaaaaaaaaaaaaaaaaaaaataaaaaaaaaaaaaaaaaaaaaaaaaaaaaaaaaaaa

SEQ ID NO: 1364 - DNA, 2029 bp, Heterodera glycines
  coding sequence=SeqID_1582; coordinates=30-1880
  peptide sequence=SeqID_1782
gtttaaagctcaaactttccttattcgtgatgaaaaagagtgctaagcccgaaattcaaacagcacagacgcgaatcgcaattgtaaacccggacagatgcaagccgaaaaattgtgggcagccgtgcaaaaagaattgtcccgtcgtccgcactggcaaacaatgcattgtggttgagccaacatcgaaaattgctgaaatttccgagatattgtgcatcggatgcggcatttgtgttaagaaatgcccttacggggccatccaaatcatcaatttgcccagcaatttggagcgcgagaccacccaccggtacagtgccaattcattcaaattgcaccgcctgcccacgccgcggctcggctcggtgctcggcctggtgggcaccaacggaattggcaaatcgaccgcgctcaacattttgtccaaccgactgaagccgaacttgggcagcttcaagagtccgcccgattggccctcaattttgcaatattttcgcggctctgagctccaaaattacttcaccaaactgctggagaacaaattcaaggcgatcacgaagccgcaatacgtcgaccaaatcccgaaattcctcgaaaaacaaccgctgaaaaaggttggcgaattgttggagaaacgggcggagaaggacaacgttggccaaatcatcaaagacatggaactcacacatctgttggatcgcgaagtcggccaattgtcgggcggagaacttcagcggttcgcaattgccattgccgcggtgcaacaggctgacatttacatgttcgacgagccgtccagctatttggacgtcaagcagcgattgactgctgcacgagtgatccgagaattgctgaccgaccaaaactacgtgattgtcgtggagcatgacttggccgtgctggactatctgtccgacttcatttgcttactgtacggtgtgccgggtgcttacggtgtcgtcacattgcccagcggagtgcgcgagggcatcaaccaattcctggagggcttcatcccggccgagaacatgcgtttccgggacacggcgctgtccttcaaagtgtccgaggagaaggaggaggtcaagcgcagttcctactacgaataccccaaaatggagtacactgtcggaggggaaggagggaagcagcaatttcagctgaacgtttgccgtggtgacttcactgactccgaaattgttgtgctgttgggagagaacgggacgggcaaaacgacatttatacgccttttggctggccaactgaagccaacttcgtccgacacggaggtgcccgagctgtccatttcgtacaaaccgcagaaaattgcgccgaaatttgagggcaccgtccgccaattgctccaacagaaaatcccggcaatgttcattcacccgcaattcaaaacggacgtgctcaatccgttgaacattgacaaaatcatcgactttgaagtccaaaatctgtcgggtggtgaactgcaaagagtcgcgatcactctctgtcttggcaaagtggccgatgtttatctgatcgacgagcccagcgcgtacttggactccgagcagcgcttacatgccgccaaagtcatcaaacgcttcatcctgcacagcaaaaagagtggcttcattgttgagcacgattttatcatgtccacttatttggcggaccgcgtcatcgtttttgacggacaacccgccataaaagccactgcaaatgcccctcaaccgctggtgaacggaatgaaccgttttctgagccaactgaacatcactttccgaagggacaacgaaagtcatcggccgagaataaacaaattgaattcgcagctcgacgtggaccaaaagacgagtcaaaattacttttatttggacaattgaattaccattttctctgttgttcttgtttttttggttgctgttcaattgcgccgttttgttgataatattaccaatttttaactttttaaaagtgcataaatgtgaatggatttgaaaaaaaaaaaaaaaaaaaaaaaaaaaaaaaaaaa

SEQ ID NO: 1365 - DNA, 933 bp, Heterodera glycines
  coding sequence=SeqID_1583; coordinates=1-598
  peptide sequence=SeqID_1783
gggatggtcacgttggtttggttggagttcgccgacgcctgagcaactcgtcaaccaaacggttcaagacgaacttcgagctttgctcgtcaataatccggagcataaacaatctttgctggacgacgatttgactgtgatccgacggaatttggagacacggaatttgccagggcccaacgaactttctgccgaaatgattcgtcagcaatggcggctcatttacagaaagcattttctcgaacgaatgctccaagctggtcacgattgccaaagtttttaccaaaattacaaattgggcgtacgctcggaagactcggacttggactgtcaagcggtggtgttcttctaccgaattaatcggatgctcgatctcagttgcaacgcgctcagacaacaaattgtgaacacggaacagcgacggttggaaaaggaagtgaaggaagtgctgaacgactggtcagcagacacggacaagaagaagcagtatttgaccgggagacaagtcgaattggccgaagaattggcccacgtgcgcttcatccaggagaagttggaggagttcattattcagcttcaccaggagaagccttggtagagcgactcgcattgccaacttatgttagtcacccctccatttgttatgcctctctctcttttacgctgatagccaaagaaagagtccgtttgtctgctctttttcaggtccatcaatctcatgtctcgcttttccactctcaccattatttgaggcttttctttctgtgtttaatatgtctccttttactttgcttccttgtcgttgatacgtgtgacaattcgttgttatcactttttgattttcctttgtttttccaccttttcctgtaattcaaaatataaatacaatttatttgaaaaaaaaaaaaaaaaaaaaaaaaaaaaaaaaaaact

SEQ ID NO: 1366 - DNA, 768 bp, Heterodera glycines
  coding sequence=SeqID_1584; coordinates=42-587
  peptide sequence=SeqID_1784
tttaatttattgtgcaaagctcttaaatctccgacttcaacatgggcaatatgttcgctaatctgttcaaggggcttttcggcaaaaaggaaatgcgcattttgatggttgggctggacgctgccggaaagacgacaattctgtacaagcttaaactgggcgagattgtcaccactattccgacaattggtttcaacgtggagactgtcgagtacagaaacatttcatttaccgtctgggacgttggtggacaggacaaaattcgaccgttatggaggcactatttccaaaatacgcaaggactaattttcgtcgtggacagcaacgaccgcgagcgtgtgggcgaggcgcgtgaggaactgatgcgaatgctggcggaagacgaactgcgcgacgcggtgctgttggtatttgcgaacaaacaggatttaccaaatgctatgaacgccgcagaagtgacggacagactcggactgcacactcttcggaaccgcaactggtacatccaggccacctgtgccacgtcgggcgacggactctacgaaggattggactggctgagcaatcagctcaagaacagaggatgaacagcgagcggaccatgcgaattggaagatgacggaagggaatttgtttttgcgcgcagctctgttttggggatggccgtttaatttcgataactatttaatgttttttgtgacaatccatcaaaatgacttctgacacattcgacaaaacctttgtgaaaaaaaaaaaaaaaaaaaaaaa

SEQ ID NO: 1367 - DNA, 890 bp, Heterodera glycines
  coding sequence=SeqID_1585; coordinates=1-638
  peptide sequence=SeqID_1785
gcctcgtcctggccggaagtgctgattttaagaatgaactcgcccagtccgacatgtttgaccaacgattacaggcaaaaataatcaaaactgtcgacatatcatacggcggtgaaaacgggttcaaccaagcgatagatttggcagccgatgctttggcggatgttaaattcatcaaggagaagaaactgatcagcgcctttttcgacgagatttcccaagacactaacaaggcaatttacggggtaaaagaaacactgacagcattggaaatgggcgccatcgaaactctgatttgttgggagaatttggatctgataagatacgcattccgaacaaccaatggtgaaaaagtcgttaatctgaagcccgacgagaaggaccggtcgaactttgtggacccggagactggaactgactacgagattgagtccagcacgccattattggaatggctcgctaacaattacaaacgattcggtgcggcacttgaaattgtcaccgacaaatcgcaggaaggagcgcagtttgtacgcggttttggaggactcggaggtgtccttcgttattcggtggacattccgcagttggatgagctcgagaacggagtagacgagatcgacctcagcgagtactgatgtgagaatgggttgtttgttgatcattgtcggtgcgaagcgttcggtaggattgtgcttcattactttgttattcgtgctcgtttaagagtctcgaagaaacgaaaacaattgtcgtatgtaattcattggtttttccatcccttttcttcgtgatttattgtttttgttgcgcgatatctttgctgtattcggctatccatcgcctaataaaacaaattgctccctaaaaaaaaaaaaaaaaaaaaaaaa

SEQ ID NO: 1368 - DNA, 1033 bp, Heterodera glycines
  coding sequence=SeqID_1586; coordinates=10-933
  peptide sequence=SeqID_1786
cgcgagtttatgtcggcagttaaaggacgacgtgagcaggacagaaaggaatgggcagcctattggaatattcgatggaaggaggtggagaattcattcgtcggcaaatactcttattacacaaaccgttttttggattggccggtcacttggttccgtgagaacattgtggaacggctgcacgacaagcacaagatgccgtattaccatcgcaaaatcagcagagtgcccgaaatcgacgaatgcggcgtcaacgaccgaatttgtctcttcgaagctgaagaacaattccgactggacaaattggtggaccattacattcgcgatattttgtaccaacgcttcactcagtgcgttcgcgccgaagggtacgaccatttgtacaaatgcgcaaagcacgttgacgactacgaaaatgccgagttgaacttctttatcaagtatggcgaattgggcagtgagcagactgtggtggcgtgttacatgaagcaaaagcatcggctgatttgggagcgtcgtcaccccgaaataatggaggagcgaaagcgagcgcatgaagaacacacagagaacatgaacaaggacaaattcaacatgcacttttggatcaaggacaacatttaccgaaagaagcaggattacccacccggcctcttcttcggccccaattgggacggtatcaaattgccgactgaaggagaccatcccatttcgagagattggcgttactaccaaaagttggaggaggagccggactttgacaaaccaaactacccgaagaaatggaacgaaatggccaaggcggccaaagaagccaaagatcagctgaaaatggcaaacaatggcaccaacgaaaacaacaaaaatggcggagcaaatggcaacggtgccgccaatggaaatgccaaaaatggaagtggggcgaccgaatgaataacggacgattcgcaagtgacaggcggaaattagggaccaatgcttttctgtttgttctgataaatgttttatagcaacaaaaaaaaaaaaaaaaaaa

SEQ ID NO: 1369 - DNA, 985 bp, Heterodera glycines
  coding sequence=SeqID_1587; coordinates=1-829
  peptide sequence=SeqID_1787
ggttcggaaactgcacgcggaattggattatgcaagacattttccgaaggcttatctggacaaagcgcaaaggcatgtccctatgaaagtgtacgacaatcgctttggcgctccgccggtcattcgttgggcaattcgacccgatgattgggcgatgagaacgaaacgtccgtgggagtacggagaagtgaaaaatgtgatcagacaggagaagatgtaccaaaggcaactgttttccacaaaattctaccgaaaaaattggaacaaaatgccgataattccggcagaaaattggacaattttccccggcgacactgtccaagtgatggtcggcaagcacaaaggccgcaaaagcaatgtatcccacgtgatcaaagaatcaaatgcggtttttgtggaaggattacacactaaactcgtggacaaattcaacaaggacagaatgaaagaaatgggaattggcgatgtgttcttcgaccagtgggaggagcagccactttttctgcacaaaggcgaagtgcaattggtggacccgagcgacggtgaaccgtgcatggccaaatgggtgctgaacgactcgaagacggaataccagcggatcagctcccgcaccggcttcctcatccctctgcccagtcgcgccttcaccacttacgattacgtagcgcctgaaacttatttggaagtgccgggaaaggacacatcagccgaagctgtgctaaaacggacctacatgccgaagttgagcacatttgagcaagaaattgaggaggaaatgaaattggagaagcgccccgagggcgacagaatgccgacctattggtactaaatggcaattagtacaattgtgtgattcccagtttaatgaatgactttgatttaacgatgtaggatatttttcggtttactgttattttctgatttaccattttattttatcattaaaatgtttttttgtttgaaaaaaaaaaaaaaaaaaaaaaaa

SEQ ID NO: 1370 - DNA, 1536 bp, Heterodera glycines
  coding sequence=SeqID_1588; coordinates=45-1106
  peptide sequence=SeqID_1788
ttaattgaactttgtttcctcatttaatcaattgttgttgtgaaatggaggcaatggaagttgacagcaaagcatctggaggtggcgaaccgatgaataacaataacaacgccaattcgtcgtcaaatccgcgcaccgttctcgatgagagtggtggaccgaaaaagatgagccatgaactaagccgagagttcatcaaagacattgacgaatggatagcgcagttgtacgagtgcaagcagctcagcgagacacaagtgcgactgctctgtgacaaggccagagagatactcaaaacagagtccaatgtgcaggaggttaagtgtccggtcacagtttgcggcgacgttcatggccagttccacgacctgatggagctgttcaaaatgggcggcaaatcaccggacaccaactatttgtttatgggcgactatgtggaccgaggctactactccgttgagacagtgtcgctgcttgtttgtttaaaggtacggtatcccgaacgtgtgaccatcttgcggggcaaccacgagtcgcgtcagatcacccaagtgtacggcttctatgacgagtgtttgcgcaaatatggcaattcgaaggtgtggaattatttcaccgatctgttcgactattttccgctgactgcgttggtggacggccaaattttctgtcttcacggcggtctgtcgccgtccatcgactcgttggaccacattcgatcattggaacgtctccaggaagtgccacatgaaggcccaatgtgcgatttgctgtggtccgacccggacgatcgtggcggttggggcatttcgccgcgtggtgccggttacacttttggccaagacatctccgagacgtttaaccatgccaacggcatttcgctgatctcgcgagcacatcagctcgtcatggaaggctacaattggtgccatgaccgcaacgtggtcaccgtgttctcggcgcccaattattgctaccggtgcggcaaccaggcggccatggtggagctggacgacgagctcaactactccttcctgcagtttgacccggccccgcgtcggggcgagccgcacgtgacacgccgtacgcccgactatttcctctagaaaagggacagcgccagggaccgacagacgaccaccgactgactgaccaccaagcggacgatttgtgaatggatggatatgattgatggataaatgatgatggtgtatttgatggatgatggaatattcttctcccacttttttcgttccttttttatgtttttggtcatggaaaagcaacaacaaacaaacaaaaacacagcagcaaataaatgtcaaacaaatcacagtaattttattaattacaattggtgggtgatggatatgatgagatgacttctttttgatggatgttttgcaaatgtgtggaatgttattttctccattctctcctccaccctatctcttgtctttgtttttctcctctttttttttgtcatttcgatcttttataaacacgtacaatcggaaaaaaaaaaaaaaaaaaaaa

SEQ ID NO: 1371 - DNA, 770 bp, Heterodera glycines
  coding sequence=SeqID_1589; coordinates=86-544
  peptide sequence=SeqID_1789
tttgagatttgtttttgtgctttggtattccacgggttgttctccactcaatttgtgaagaaactgcacagcaacagcagtgaaaatggcctccggcgtgaaagtggacggcgagtgtaagcaggcatacgacgagctgcacaacaagcaccagttctcctttctgatcttccgtatttcggacgacgacacgacgatcattgtggagaagaaaggcgagaagaacgcgccgtactccgattttgttgaggagatgaagaaagtggtgggcgacggcaaacagtgccggtacgcggcggtggacgtgcacgtggaaattcagagacagggcaccgaagggtcgtccaacctgtccaaagtggtgttcgtccaatactgtcctgatgaagctccggtgcgtcgtcggatgctttacgcctcttccgtgcgggcactgaaggcgactttggggctggagagtctgctccaaatccaagcggccgaactgtcggacattgacgaaaaagtggtcaaacacgaagtgatgggtcgtcaacgaacctaaaattgccccgccgttactttcaacaaaaatgcgtctgattttctcttttcgcgcataatgaaggaaagttcgttaaaattctctgctgatcgatgataatcttcgcccatttttgcattttttgaaattgataattaattaattgttcgctatgccttttattgtgcgccatttttgacacaaattaatgaataaatagcgctacaaaaaaaaaaaaaaaaaaaaa

SEQ ID NO: 1372 - DNA, 1922 bp, Heterodera glycines
  coding sequence=SeqID_1590; coordinates=27-1823
  peptide sequence=SeqID_1790
gtccaattaaggcctcagtgattattatgcattttgtcaaaagaacgccattcgccaaaaaaagtgaagagcaaagagaagcagaggaaaagaaacgcgctgaaaagctgcaacaatttgttgattcaagaaatttggtctttcagaagagaaaatccggtgaatacgacgacgaagtgttgacggtttgcggagaacttctgaagaataacccggacatttacacactttggaatgtgcgacgggaggccattgaaaagcgagcgacgaaatgtgaggacgaaagtgacgaggaattggccaaacgaatctccgagctgatcaatggcgagttgaagttgacgcaaagttgtttgttgcgaaacccaaagtcatattcaacgtggcaccaccgctattggtcctgtcttcgccaccccacgccaccgttgcgacaagaattggcactttgcgaaaaggcgttgggccaagactgtcgcaattttcactgctgggaccacagacggtccattgcacggacggcccaactaagtgccgaggaggaactcagattttcggacactttggtgggccgtaacccgagcaattactcagcttggcattatcggggcactttgttgccactgatgaagccgaacaccgatcggcctgaggctgtgataagcgaccaatgtttggttgacgaaatgcagaaaattttgtcggtttgcggagtgaattccgaggaccaaactggatggacgtattgtcgctggttgacggatttggcttcggccaaaaattttgatcacaacaatgacaatctgattaccttcacacatttcgatgtggacatggctttgttggtgttttcggaggctgtcgacgcaacttcggttatgtccctaattggaacaacggcgcattcgttgcttgcgatctctccgttttccatggctcctcagtcgtccaaatggtgccgtgccaaagtttggcttgcctctggcggcatttccttttctccgtccgccggtgtttttcgtgccggcagtcctcgctttgtgaacgctgattttctgaccaagtacttttcgtcgtctccaagctgtactcggacattgccaagaaaagcactcacttcgttagtgtcaatgtgcgaggaattaattgcggaggagaacaatccgtgggaagtgtcggcactgacgagtgcccgtttagcacttgacggaattacgcaggaaaccttcaaattgacggaacaaaattgcgagaaattgaagcagttcgacccgcaacgttcggcaatgtatgacgaaatgtttgacaaagtccgaattatccacgaactgaccaaaaacacttccgacacacccgagcaaagccaattggatttgcttatggaggcgaaaagcgatcggcttaatctgaatggaattggactgatcagcctgctccatcttcggcctctgtccggcttagtccaggaactcaatctgcagaacaaccgggtcacttctgatcagatcactcaactctgctcatttgctgcgctcacttccctcactttggatggcaatcccatcgacagactccctctgatcaatccccgttggttccctcgcttggaattcctttctttggctcagaccaaaattggacaagcatcggtcttttgtccttcattgccctcgggcgctttccccgcgctgaagcgattggtcctttgtgagacaccgttggcggagagtgaaaaagaacggagggaaatgtacgcgttaacagagcagagagcgaaaggaacggaggacaaaatcagactgataatggactggacacgctgagaaaatactcaaacacttgcacacttcattatccaataattatgtcacttacaatgcatacgaaattaaatatctgaaaaaaaaaaaaaaaaaaaaaaa

SEQ ID NO: 1373 - DNA, 984 bp, Heterodera glycines
  coding sequence=SeqID_1591; coordinates=1-584
  peptide sequence=SeqID_1791
gtttgttgttgttggctgtcccattgttggtggtggacacaaagcaagaggtttccgaggcacaacagctgatccaaatttgtcgtgaatatttggtgggccttctgttggagacggcacggaaagaattgccacgcgactccgtggaggatgctaaacgcaacttggagatggccgcctatttcacccattgcgacattcagccggtgcacaagattttgacactgcgcaccgccgccaatctgagcttcaaaaacaaacaaatgcgccactgtgcttcgttctgtcgacgctgcattgaattggctcctaagccggaaattgccgcccaaatgcgcaaaatgttagcggtggcggaacgcgacaacaccaacgcgttcgagctcaactacgacgagcacaacccgttcgtgctgtgctcgcgctccttcgtgccgctgtaccggggcaagccgcagacaaagtgtcccttctgcggcgcttcgtatgcgcccacatttgccggctctgtttgcgacgtgtgcgaagtggcggaaattgggcgagagacgtcgtcgaatttgatgatttctaattttaaataattcactgttaggcttttttcatatgtcccactaatattggtgataattggcggttgtttttttccctctcccaacactttttcgtgatgttttccattcctgcgttttctctgtttttttttgtgtgtgatttgcaaaactaaagaaaagtgttccaagcaccgaattgaaaatgaatgatattattcaaatttaattgcaaaattttttatttgtcaaattaattctttcaatttaccatttctgtcgttgtttttattcatttttgggctctctaattttcatttcgatcaaatattaattattacatgtacccatggactaacgcactaattgcatggcaattgttcagcattataatataatgttttcctctgttaaaaaaaaaaaaaaaaaaaaa

SEQ ID NO: 1374 - DNA, 928 bp, Heterodera glycines
  coding sequence=SeqID_1592; coordinates=1-769
  peptide sequence=SeqID_1910
gctgtgcacgctgaacatggtgccgggcgagtcggtgtacggcgagaagcgcatctcctcccagcagaccgaaaatgcgccgattgctgcaataacgccgaagacggaagagacaacgaatggcagcaacggtgtctcagcacccaccgccgcggctgccggcccggcaccgccagtcgagtaccgggtgtggaacccgttccgctccaaactggccgccgccgtcatggccggcattgaggacacgcacatttacccgggtgcccgtgtgctttatcttggcgccgcttccggcacttccgtttcccatgtgtccgacatcgttggacccgaaggcatggtctatgcagttgagttttcacatcgcagtggacgtgacctgctcggcatggccaagaagcggtccaacgtggtgccaattgtggacgacgcacggcacccgcacaaatactccatgatgattggcattgtggacacaattttctcggacgtggcacagccggaccaggcacggattgtggcacacaatgcgcacaaatttctgaagaacaacggccatgtggtcatctccatcaaggcgaactgtgtggacagcacggcggagccggaggcggtgtttgccggcgaagtgaacaaattgcgcgaggagcagttcaaacccattgagcaggtaacactcgagccgtacgaacgtgaccacgcggtggtggtggccgagtaccgagccgccaaaaagaaggtcaagaaggaaaaaatggaggaggagtaaaggggggcggaggacgtcaaaatgcgttaatggtggatcctcactttttgttatttgttgtttttttcttgttttgcacgccgatatttaaaaaaatttcacatttgaaaaaaaaaaaaaaaaaaaaaaaaaaaaaaaaaaaaaaaaaaaaaaaaaaaa

SEQ ID NO: 1375 - DNA, 2450 bp, Heterodera glycines
  coding sequence=SeqID_1593; coordinates=Jan-77
  peptide sequence=SeqID_1911
gggagttggaagttggcatcgaacagcttgaacaaaagttacgcgcccttaactttgatccgcagttggaccaccagcttgagcaggagcgtgttcaattggccagagaaagagggcaatgtgcgcaagaattggaccggtttgaggccagaaatttcaaactgcgctttgactatacaatgccttacaacggattcgaccggaacaaagtgaagggcgtcgttgctaaactgtttaaaatgaacgaacaaagatatgccacggcattggaagtcgttgcgggtggtcggttgtttcacgttgtgatcgacaaagtgaagaccggcgaggatttgcttaaggcggggctgccccgtcgggtgacaatgcttccgctggacaaaatcagtgcaaatgttctcgaccagcggctaattgggcaggcaaaacgaatggtgggcgaggagaacgtgttcttccccggagagctgatcgaatacgaacgggaaattgagctggccattctcagcgtttttggcaattgcctgatttgcggggacatggaccaggccaagcagctgacattcgaccgggccataaactgtcgtacagtgacattgtccggtgaggatttcaagccgaccggtgtgctgactggcggattccggaagccggacgcgtcaattttgactgcgctcaacgaaatcagtggacaatatgaacggatccgagagcttgaccaccgaattggcgcaattgaaagggaactcgcaagactgaggcccctccgtcaacaatacgaccaattcaatggccaactcactgctcagcggaagcgactttacgcaatcaatgaacagttgcgcaacagtccgggggaagtgattcgggcagaaattgcgcaattggaaacggaagttggcgaagcgaatgcaacgattgaaacagcgaagccggaaattgaaaaactgacgaaaagagtcaaagagtttgaagaacggaagaccaatgaaagagcattccaagagagagaacggaagacggcccaacaagaattggcaaatgcgcagaaagagttggaacagttgaagggcacattttcgggcattaaagagtcattggcagggctaagagaagaaattaatgcattggaaaactcaattgggcaggacgaggaagaaatagtgcagatgaatgagaggattgaggaaatcagcactgaaatagccaaatctaacgcattcgtcatggaagccaaagaaaaggtcagaaaagcgcaacaaaagttagagacgtacaacaacgaagtgcgctcgcaggagaagcaaatccgtgtgaaaactgccgaaattgaggacttgaagaagcgcgttcgccatttggaagccaaaatcgagtcaaaaacacgggacagggaggaagcactgaaaaatgcgaaggatttcgagaaaagagcccaacagttggagaaggcgcacaattggatagccgaggaacggaaacacttcgccgtggagggcacggcgtacgattttcgcaattacagcttcgaaatgggcaagcgcgagtacgacgagcgcaagacgcgcagcaaagacttgctgagaacggtgaacccaaaggcgatggaatcattggcaacggcggagaaagagctaaacgaacttctcagcaaaagacagcagctcgaactggacaagaaaaagctgtttgatgccatcgagcagcttgacgacaagaaacgcactgaactgttggcagcgcataagcaaatctctgaagatttccgttccatttattccactctgttgcccggtgcgtctgccactcttgaacctccgtccggtgccgagaattgcctttccggtttggaagtgagggtggcgttcaacggcaagcacaaggactctttggccgaactgtccggcggacagcgttcactggtcgctctgtcgctgattctggccatgctcaagtacaaaccggccccgttctacattctggacgaaattgacgccgcgttggacatttcccacaccgaaaacattggcaagatgatcaagaagcatttctgtcagagtcagttcatcgttgtctctctgaaacagggcttcttcgacaacgcgaatgtggtgtaccgtgtcaactttcgcgatggtcgctctgtggtgacgcggacagaaaacaggcacaattaacaacacaatgaatgaattgtctctctttcattacctgaaaattcgatcatttttgaccactcattttgttgcatctcattgcttcgcttttgccacctcttctgctgttcgtttgtttttcacctctgccctttgctccgcttttgttttggtcattttttacatatacactcatcaatctcaacacaaacacatgtgtaacttattgtttcgagttgattttgctcctgattatatataaatattggtgataaaaaaaaaaaaaaaaaaaaa

SEQ ID NO: 1376 - DNA, 1835 bp, Heterodera glycines
  coding sequence=SeqID_1594; coordinates=55-1656
  peptide sequence=SeqID_1792
gtttgagcttcaataacctttcaattggaagccatttgtctgcttacctgttaaatggcttccatcgcatgtttgaacccaaaagcggagttggcccggcacgcggccgcactggagatgaacatcagcggtgctaaagggttgcaggaagtgatgaagaccaacctcgggccgaagggcacgctgaaaatgcttgtctccggttcgggtgaccttaaagtgactaaggacggcaatgttttactccatgaaatgcaaatccaacatccgactgcttcactgatcgccaaggcgtgcaccgcgcaaaacgacgtcaccggcgacgggaccacgtcgaccgttctgctgattggcgaactgctcaaacaggccgagaattacgtcagcgagggtgtccacccccatttggtcaccgagggtttccaattggcccatgaccatttgctccaactgttggccgtctccaaaaaggcgttgctcatcgaccggccgctgctcatcgaagtggccaggacgactttgcgcacaaaattggaccaaaagttggccgaccacgtcacggaatgtgttgtggacgccgttttggcaattcgtcgggatgaaaacgacacggagcccgacttgcacatgattgaaattcagcaaatggaacacgagatggagacggacacgcagctgatccgtggcctcgtgcttgaccacggcggccgacacccggacatgccgaagagtgtgcgaaacgtgcacattttgacatgcaatgtttcgttggagtttgagaaaactgaggtcaactcgggcctcttctacaagacggcagctgagcgtgaacgtttgctgcaggcggagcgcgaatacatcacacgacgagtgctgaaaattgtggagctgaaggggacggtctgtggcggcggagaccaaggctttgtggtgattaaccaaaagggcattgatccgccgtcgttggatttgttggcgcagcacggcattttggccctgcgacgtgccaagcgtcggaacatggaacggctgcagttggcctgcggcggcgaggcggtcaattcggtggacgacctgacgcccgatgtgctcggctgggcgggcagtgtttatgagcatgtgctgggcgaggacaaatacacttttgtggaggagtgcaaaagtcccaagtcggtcactttgctgctcaaagggccgaataggcacagcatcacgcagctgaaggacgccatttacgacggacagcgggcggttgccaatgcgttgaaggacggtgccgttttgcccggcgccggtgcatttgaaattgcgggatattgtgcactgaagaagcttgccgacaatgtgaaagggcgtgccaaactcggcgttttggcttttgctgaggctttgctggtcattccgaaaactttggcggtcaatgccggattcgacgcccaggaggccattgtcaagctggtggagacgttcagtgctgctgatgagctggtcggattggacttggagagcggagagccgtgtgttcctcagggcgtttgggacaatgtgtgcgtgaagcaggcgagtctgaacgcctgtcagaacatcgcctccaatctgctggaggtggacgaggtgatgcgtgccggcatgcgcgacttgaaggggggacagtgaaaatgaacggaacggaaatgaaggagcaacaccaataaatcacaaaatgttaatggctttttctttgttgaactctgcgctttattgtttgaatcagaccactgctgtttttgctttttcaatctcgctttctttaacgaataaaaattttgatttaaaaaaaaaaaaaaaaaaaaaaa

SEQ ID NO: 1377 - DNA, 1061 bp, Heterodera glycines
  coding sequence=SeqID_1595; coordinates=1-738
  peptide sequence=SeqID_1793
ggcaagttcaaggagccggtcgccgtattttactctgctgagatcgcctgcggattgttctacctgcattccaagggcatcatctacagggacttgaagctggacaacgtgatgttggagagggacggacacatcaaaatcaccgactttggcatgtgtaaggagggcattcagggcgacaccaccaccaaaacattctgtggcactccggattacatcgcaccggagataattctctatcaaccgtacggaaaatctgtcgattggtgggcttacggcgtccttctgttcgaaatgctcgctggacaaccgccgtttgacggggaggacgaggacgaattgttcacagcgatcaccgaacacaatgtctcttaccccaaatcgatgtcaaaggaatcggtgctgatttgtaaaggatttctgagcaaagcgccctccaaaaggttggggtgcagcgcggacggagaacggcaagtcaaagagcattgctttttccgtcggatcgattggcacaaaatcgaaactcgccaagtgcagccgccgttcaagcctaaaattcgatccgccgacgacacttccaatttcgactccgaattcactggcgaagcgcccaaattgacgccggtcgaccgattgttcctaatgaatttggaccagaacgaattcgaagggttcacttttgtcaacgcggaatttacgccccagggcgaaaataaaacggcggacaaaacaatttgaaggggcggaggacgacgacgaaacgaaagatgacgaggacggaccaacagcagcgagtgttcattggcactgatcaccaaaatgccattggcagttccaaagtcgccctctctcttctcgcacattcactcacccaagcgaaatgttcgcattccctcaccactcgccatttcttcccaattagctgctttattattggaaagtttgtatttgtgttttagaaatgtctatgattaattgatacatttcatcattttatacggtgattaattttttaattgaaagaataatatgtaaataaaaaaaaaaaaaaaaaaaaaaaa

SEQ ID NO: 1378 - DNA, 2593 bp, Heterodera glycines
  coding sequence=SeqID_1596; coordinates=Jan-56
  peptide sequence=SeqID_1794
gaaatatgaaaatgaaggcggtcttcctgggcttgatgatcagacggctaatcgaagcggagaagggcgtttgcgaggcggacgatcgcgatttttacggaaacaaacgcattgagttggctggatctttgctttctctgttattcgaggaccttttcaaaaggttcaactccgaattgaaacgaattgccgacagtcacctcaaccgaaatatggccgctccgctggacatcgtacgacacatgcgccaagatttgataacaaatggtcttgtcaatgctcttgccactgggaattggacaattaggcgttttaaaatggaacggcatggcgtcacgcaagttttgtcacggttgtcttacatcagtgtgttgggaatgatgacgaggatcaattcgacgttcgaaaagacacgcaaagtgtcagggccacgttccctgcagtcttcgcaatggggaatgatttgtcccgccgatacgcccgagggcgaatcttgcggtttggtcaagaatttatcgttgctcagtcacataaccacggacagcgacgaagcgcccattttgcaacttctctacaatttcggtgtccaagacgttcgtccgttgaaatttagcgtcgttcatgaaagacgttatcacatcgttttcctcaatggttccattgtcggaattactgatgacgttgaaaaaatcattggcacggtgcgactgatgcgccgaagagggaatttgggtgcctttgtctcggtcagtttcaacacgtccacaaatgcgctgtatttggccagcgacgggggccgactctgtcgtccgtatgtcatcgttgaaaatggtcgtccatgtctcacgcagtcccaaattcaggaagtccgagacggtcagaaaacctttgaccatcttttggcggagggatgcatcgagtttttggacgtgaacgagttgaacagtacgcgcatcgctgtctatgagcaccaaattttgccgcagaccacccacttggagatcgaacccttttcgttgctcggcgtcgtctcgggactgatcccttacccacaccacaatcagagtccccgcaacacttaccaatgcgcaatgggcaaacaggcgatgggcaccatcggatacaatcagcagaagcgaattgattcgctgatgtatctgctcgtttaccctcaaaagcctttggtgaaaaccaaaacaattgaattgtcaaacttcgaaaagctccccgctggtcaaaatgcgattgtggcggtgatgtctttcagcggctacgacatcgaagacgcattggtactgaacaaagcgtcgttggaccggggttttggacgctgtttggtctaccgatttgccaagggcaccgcgcgaaagtacgccaatcaaacgtacgacaaaatcatgggaccgtcgctggacgcgacgacgcgcaagccgattgcgaaacatgccgttttggaccaggacggcattgtttttgttggggcgaagattatgccgagacatgtgctcatcaacaaatccatgcccataatgcaatccgaaatgcttcccgctggcaatgtcgccgggttcaaccacaattttgagacaaaggacgtgtcaattccctaccgcggctcaatgaatgccgtggcggagcgcgtgctattgacctgcaacgacgaggagcaatacttggccaaagtgttgatagcgcaatgccgaagacccgagttgggtgacaaattcagcagtcgacacggccagaaaggcgtttgcggactgatctcgccccaggaggacatgccatttgatcacaacggcactgtgcccgatttgatcatgaacccacacggttatccgagcagaatgacagtgggaaaactgatggaattgttgagtggcaaaaatgcgctgatgggcccgtgccaaaagtggcggttgcattacggcacagccttcggaggggaccaagtggaaactgtcagcaaacaattagccgcccacgggtacaacttccttggcaaggacatgctcacgtcgggcagcacgggacagcaaatggccgcctatgtctattttggcccaatttactaccagaaactgaagcacatggtcatggacaaaatgcacgcgcgagcgaaggggccccgcgctgttctgactcgacagcccaccgaagggagggccagggacggcggacttcgacttggtgaaatggaaagggactgtctgatagcgtatggcgcgtcgatgctgctgatggaacggctaatgatctcctccgatcaattcagtatggatgtttgtgccgagtgcggtttgatcggctacttgggatggtgccaaaattgcaagtcatccgccgccatggcaaagattaaaatcccttacgcgtgcaaattgctgtttcaagagttgcaagggatgaacattgtgccacggctaaagacagcaaaatacaccgacggactgtgaagagattgatatttttattataatttacattttacacaaataattgttgttgattgttatcgtgcaaataatttatttgcatatttatttataataaatggaatcaattaaaaaaaaaaaaaaaaaaaaaaaaaaaa

SEQ ID NO: 1379 - DNA, 2190 bp, Heterodera glycines
  coding sequence=SeqID_1597; coordinates=Jan-69
  peptide sequence=SeqID_1795
ggaaatggacaaatgtgacacttggccaagaagtgcaggttcagcccttttcgttcacacccggccaacggattatcacttcaatttcactgactgtcgattttcaaaagaaaccatcgaatccatccgaaccattggactcagatgcaatggcccgtgaatttctcatgcaattcgccaacatggtgttcaccgttacccaggaacttgtcttggagtatgtgcagcagaagcggagtaccggcggaggcgagaaagcgacggcgatgaacgcgacgacgtacacactgaaattggtggtgaaacggatggaaggcgccaatctgaactcgtcgccggaggagatttcgatcggtccgctcagtccgaatgccgtcgttatttttgatcggcccgaaaattcacagatcaatttgatcggtcgtagtaaaggaaagtccactcatcgttcgctgataaaccccgactgggacttccaacagatgggcattggcgggttggacaaggaattctcttccatttttcgacgcgccttcgcttctcgcgtttttccgcccgaattcatcgaacaattggcgatgaagcatgtccgtggcattcttctctacggacccccggggacgggcaaaacgctaatcgcgcgacagatcggcaaaatgctcaacgcacgcgaaccgaaaattgtcaatggccctgaaattctgaacaaatatgtcggcgaatcggaggcgaacatgcgcaaattgttctccgacgctgaggaggaatggcgccggtgcgggcccaactcgggactgcacataatcatttttgacgaaattgacgccatctgcaaacagagagggtccatggctggatcatcgactggagtccatgatacggtggtcaaccaactgctgaccaaaatggacggggtggagcagctgaacaacatcctcgtcattggaatgaccaatcggaaagacatgatcgacgaagcgttgctgagaccgggacggatggaagtgcaattggaaatatcattgccagatgagtacgggcgcgtccaaattctgaagatacacacggcacggatgagagaatataacaaattggacaccggcgtgaacgttgaggacatcgcaaagaggaccaagaacttctcgggtgccgagttggaagggttagtccgtgccgcccaatcgtccgcaatgaaccgattggttaaacccgggggcaaagtgcaggttgacgatgacgctattgacaaactgaaagtgacggcggaggactttgactatgcattggaaaacgacgtgaagccgtcctttggactcagtgacgaggaactgagtcggctgctgtacggcggactttgcctctggggtgacccggtcgcccgcgtgttggaggagggacgccttctgatcaaagagaccgcttctcccgacacgcgcggattcgtccgtgcattgttaacaggtcccccaaatactggcaagtcttatttggctgcacaaattgccaaggactcggaatttccattcatcaaagtttgtactcccgaagaaatggttgggtacagcgagacggcaaaatgtgccaaaattcggaaggttttcgaagacgcgtacaaatcgccccttagctgtgtgatcatcgacaacatcgagcgaatgatggattattccccgattgggccacgttattcgaactttgtgttgcaaacactccttgtactgctcggaaaacgaccacctcggaaccatcgtctgctcgtattggcaacaacgtcgaatgagcagtttttatccgaggccgacatgctcagcgtgttcagcaaagtgatccgagttgaacagttgcacagcgccaaacaagttctgacggtgctcgaggacgccaacgttttcagcgaggaggaaagtagacaaatagagggcgaactgcgaagctgcgaatacagcttttcaattgggatcaaacggatactcgaactgctggactttgtgaaacagagtgagcctgagtatcgagtgcagctgcttctggacggaatccgggacacgggcggggcgaaagacttttgatgcaaaacgtacacattccatacattttgtgcggttattttctcagcattttctgttttgtattcacagtgagttataattaaccatctgttgttttgtgaaaaaaaaaaaaaaaaaaaaa

SEQ ID NO: 1380 - DNA, 2171 bp, Heterodera glycines
  coding sequence=SeqID_1598; coordinates=1-1308
  peptide sequence=SeqID_1796
gaggcgtggcaaaataccttttttgggtctgacgatgaatcacttaatgcttcgcaatcgttcaaaaagtaccctcctctgctggccatccctctctattctctcctaccagtgaatttgcagaagaaaattttcaacgaaccgccagatgacgggtctagggtgtgtgtagtttctacaaatgttgcagaaacttcgttgacgattccaaatgtccgttacgtcatcgattctgggcgggaaaagaagagggaatatgacccgattacgggagtttctcggtttgtggtcggatggtgttcaaaggcgtctgcagaccaaagatccggtcgtgccggacgagttcagtccggatacgcattcagattgtattcttcggctgtttacgaagatatgcgcgatcattctactcctgagatccttaataaaccgatcgaccaattgattcttatgttgaaagcaatgaatttcacgaaaatcgacaattttcctttcccgactcctccaagattggaccaaatcaaatcttctgagctgagactttctcacataggggcgcttagagttcaagaagggctttataccatcacacaacttggacaatcacttgcgcagctgcctctcactccttcttttgcgaaggtcgtcatcagttcaattcgtggcggacttcttccttttgccgtcactttggtgtcggctctctccgttcgtgaaccattattgttcatttcaagcacaaaagaggacggaacggaagagagacgaaaaagaatgtccgaagtgattaagcaaagatttctttggtgtgctgttggcgaggctcgactctttggtgatttgacagtaattctgaacactgttggtgctgctgactatgaggaagagaacgctcacgcaatcgaagccctaggacttcgccctaaggccctaaaggaaatcaacaaacagagacatcagctgacgcttcttctgaacaaatccgattctgtggagaagttgcccgagaagttcagaatggatgcaccctcccaagaacaactgaggagattaaggcatataatggtgaaatgccatccggataaattggcaaagaaagttcagtcattggatgcaccaaagggcgcatataaaacacttattttggagggttacgtgttcattgaccaaagttcagtgcttcataaagaacagcccgattatgtcctgtaccaagaaatcgtacaaatggcacataaaaaatgtgtaagaaatgtcgcttctgttgaacccgagtggatttctgattttgttactttttcatcataattttatttctgtgtgtaattttacaacaaacatttgttctctgtgcaaatattcttttatttttgctttactttttattttttattaattgttttaagagttcaaaatgaataatgtgacctctaagttgccgtttctttaccgctttctgggtcatcatttaagaaattcaaaacgacaaatagcggtctctccagtagatcatgtacgacaaaaaaatgttttcatgaggcgtgaaatggattttttgcaaccgaccagcaaaatttcttccccatcggctgtttgtatactgaaaaattactttgttacttttgggtttgtcgaacaatctgatgtcggaaaggcggttcaaatagctgaggcaagtcttcaaaaggatatcgtgaattaggtaatcacaattcagtatcatttggatggttctataaatgctcgtctcatcttgacggtgccggagttacgtgaattatatgagtcggtgaagtcacagcaaagtgttctgattgagggacagaaaaccatccagccacttgaaaagtctatcgatcaaactacgatgcgaatttgggaggacatggagtgtggtcggaatcaatttttaggcttgcttgacaaattagttaaggtcttcgtgtgctcagagtaggccattcgactccattttacaacaatctcagagaattagttatacccattttcaatttggaagaatttttggaccgtatggactatgtattaatgagcgagaaataaaatagttaaagataagatatctcaactttcgttgtctgttttataaaatcgaatttggaaacgttaaaattacattttctacatttaaaaaaaaaaaaaaaaaaaaa

SEQ ID NO: 1381 - DNA, 898 bp, Heterodera glycines
  coding sequence=SeqID_1599; coordinates=32-724
  peptide sequence=SeqID_1797
ttgaattcaataccccttcaatttggctatcatgcaaatcttcgtcaaaactctcaccgggaagaccatcactcttgaagtcgaggcgagtgacaccatcgagaacgtgaaagcgaagatccaggacaaggagggcatcccgccggaccagcagcgcctcatcttcgctgggaaacaactcgaggacggacgcaccttggccgactacaacatccagaaggagtccactcttcacctcgtcctgcgccttcgtggagggatgcatatcttcgtcaagacgctcaccgggaagaccatcacccttgaagtcgaggcgagtgacaccatcgagaacgtgaaagcgaagatccaggacaaggagggcatcccgccggaccagcagcgcctcatcttcgctgggaaacaactcgaggacggacgcaccttggccgactacaacatccagaaggagtccactcttcacctcgtcctgcgccttcgtggagggatgcagatcttcgtcaagacgctcaccgggaagaccatcacccttgaagtcgaggcgagtgacaccatcgagaacgtgaaagcgaagatccaggacaaggagggcatcccgccggaccagcagcgcctcatcttcgctgggaaacaactcgaggacggacgcactctggccgactacaacatccagaaggaatcaactcttcatctcgtcttgcgccttcgtggtggaaagaactagaacgacgaacggaagaaatgagtgatctgtatcgatccatatccgtatcttgagactgtcctgtattattgtgttccgttttattcatcatcatgaaatgtatttcaatgaccacggaacgataaatccatcaaaactcaaaaaaaaaaaaaaaaaaaaaaaaaaaaaaaaaaa

SEQ ID NO: 1382 - DNA, 835 bp, Heterodera glycines
  coding sequence=SeqID_1600; coordinates=1-738
  peptide sequence=SeqID_1896
gaagcgttgaagggcaccgacgccgagacgtacaaagcggcagagaaacattttgaggtcgcacttcgaaaggccccacaaaacggcgccgtcggcttcaaacaggaagtgaacaaatgggtcgtgctggtcaaattgctcatcggcgaaatccccgagcgcagtctcttccacacggccgaacttcgccacgtgttggcgccgtatttgctgctgacccaaactgtacgccttggcgacgtggccggcttcgaccagacgaagcgcgagcacgggcccatctttgtgaaggaccgcaccgctgcgcttgtcgagcgcatccatcagagcgtcattcggaccgcaattcgcaaaatttcgacgacatattcgcgcatttacgtgtccgacgtggccaccaaattgaattcgaccgagcaggaggcgcatcgcgagttggtcaaggcgatcaaagagggcattgttcgtgctcagttggtcgccggcgacccgttggcgggcgggcggcactacgtcaaatttgggaccaccgatgaccaatatcgcggggttgagccccgcagggaattcgacgcgcgggtcaacgaactgttggagctgtaccaccaggcggtgaaggcactgcggtacccggacatgcgcaacccggaggtggagaccattgacgagcagcgcaggcgtgaacagttggctctcgaaatggcagcagcggaagaggaggatgatgacgatttttgaccaagacgatgtttttgtttcacaaaaattttttatatgctgcgaaatggggttgaggataaaacgaagttttgaaaaaaaaaaaaaaaaaaaaaaa

SEQ ID NO: 1383 - DNA, 1838 bp, Heterodera glycines
  coding sequence=SeqID_1601; coordinates=38-1669
  peptide sequence=SeqID_1798
ttccccactttgtttttacattttgtgatcagctcacatgcattttgctgacctgtccctaagtgaacgggaaaaagcgctgagtgttcgctatttgcaggagcgtgatgcgatgtttgagcgtttttcggagtggacggagcaggaccagacggacttctgcaaacaccttctgcagcgcatgtgtcaccaccaacacggccaaattgaccaatttttgggcccaatgcttcagcgggacttcattgcgttgttaccaaccggtttggcggagaatgtgcttcatttgttggacgccaagtcgttgtgcgcctcggagtttgtcagccgccggtggagtcgtgtcattgtcaacggattgctgtggcgcaagcacatcgagcgccaagtgcgcaacgacgcgctgtgggccggcctcgccatccgacggggatggaagaagtacttcttttgctccaaggaccaggcgacacgcgcaatttctcagtcgtggagacagccgaagaacggggaggacgcgttggagttccagcacaaattctaccgcgaactttacccaaaaatcactgctgacattcggcaaattgagcagaattggcgcgagggacgacatcgattggagcgcatcaattgccaatcggagaatagcaaaggtgtctactgtctccaatacgacgacgaaaagatcatctcgggactgcgcgacaacacaatcaaaatttggtcccggcccagcctcggctgtgtgcaaacactgagcgggcacaccggctccgtgctgtgcctgcagtacgacaaccagatgatcgccagtggcagcagtgacgcgacagtcagaatatgggacgtgaacacgggtgagcaactgaagacgctggtccaccattgtgaagctgttctccacctgagatttcaggacggcatgctggtcacatgctccaaggaccggtccatcgcggtttgggacatggcatcgcctcgtgacattgaagtgcgtcgggtgctcgttggccaccgggcggcggtcaacgtggtggactttgatcacaaatacattgtgtcggccagcggtgatcggacaataaaggtatggaatgccagcacgtgcgagttcgtgcgcacactgaacggccacaagcgtggcattgcctgtctgcagtaccgggaccgactcatcgtgtcaggctccagcgactattcaatcagactttgggacatcgaatgcggcaactgcttgcgcgtgttggaaggccacgaggagttggtgcggtgcattcgcttcgattccaaacgcattgtgtccggcgcttacgacggcaaaattatgatctgggacctggcggcggcacttgacccgatgacaccgcccaactccatctgtataaagacactttcgcaacacaccggacgcgtttttcggcttcaatttgacgagttccaaatcatcagcagctcccatgacgacaccattctcatctgggacttcctcaacacgggcccgtccgccgccgttgccgcgggcgctgcggcagcagccgcgcacaaccaggccgttcaacatcaccaagcagcacccgcagcccaaccggctgctgcagcgatgcccgggggcgctggtgccgcgccggccgccgctatcattccgttggcaccgccgccgtccccataaaaagcaaacctaaaaatgctgaaatgatttgatgaatatacaacactttttaattccaaatgtttcgtttcgcttttttgtgggatttccttttatgttttcttcacaattttgtgtattatggtgaacaacaaacaaacaaatgaaaaaaaaaaaaaaaaaaaaaaaa

SEQ ID NO: 1384 - DNA, 1198 bp, Heterodera glycines
  coding sequence=SeqID_1602; coordinates=1-1074
  peptide sequence=SeqID_1799
gctgactgcgctgtgctggtggttgcttgtggaacgggagagtttgaagctggaatttcgaaaaacggccaaacgcgtgagcacgctttgcttgcgcagactttgggggtcaagcagctcatcgtcgcttgcaacaagatggacaccactgaaccgccattcgccgaggcccgttacacggaagtgatgactgaagtgtccaacttcatcaagaagatcggttacaacccagccactgttccattcgtcccaatctctggcttcaatggcgacaacatgttggagccgtctgacaggatgccgtggtttaaggggtgggcgatcgagcgcaaagatggcaatgcatctggcaaaactctgctcgaggctcttgactccattcttccgccgcaaagaccaactgacaagccattgcgtttgcctctccaggatgtgtataagattggaggtattgggacagtgccggttggccgtgtcgagactggtgttctcaagcctggaatggtggtcacttttgctccgcaaggcatttccactgaagtcaaatcagtggaaatgcaccacgagtccttgccagaagcgcttccaggagacaatgtgggcttcaacgtgaaaaacatctctgtgaaggacattcgccgtggttcggtcgcgtccgactcgaagaacgacccggcaaaggagaccaagagcttcacagctcaagtcatcatcatgaaccacccgggtcagatcgctgctggttatactcccgtgttggactgtcacaccgcgcacatcgcgtgcaaattcgccgaactcaaggagaaggttgaccgtcggtctggaaagaaagtggaggacaacccgaaggcgctgaaaaccggcgatgctgggatcgtcgatttgattccaaccaagccgatgtgtgtggaggcattcacggactacgctccgcttggtcgtttcgccgttcgtgacatgaggcaaaccgtcgctgtcggtgtgatcaaggcggtggagaagactgaaggcggtggaaaggttaccaagtcggcgcagaaggctgctgcccctggtgggaagaagaaatgagaaacgctgataattggaatggattcgatttttggatttgttgttttttttggccgtgaaataggcccgttaactttgggttttgttggataaaatttgttttaaaaaaaaaaaaaaaaaaaaa

SEQ ID NO: 1385 - DNA, 2564 bp, Heterodera glycines
  coding sequence=SeqID_1603; coordinates=162-2453
  peptide sequence=SeqID_1800
tggcgcaagagccgcccttacaaattgtgattcccagattggatgatgataaaccgttggtgcgtcgaccgacgcctcaggcacaaccggcggctccagcggtgccggctgaactgcgcgtgtccaatcgggaggaggacgcgcagaacatcgaaccgtcaatgagtggcaaacaaatagtcgggttgatcattccaccgcccgacattcgaacaattgtggacaaaacggcgcttttcgtggctcgcaacggattggaatttgagatgaaaatcaaagagcgcgaggcttccaacatgcgtttcaactttctcaaccctaccgacccatattttgcctactatcgcaacaaggtcaatgaatttgagacgggcgttgcatcggcggacactcagtccaaagtgaagttgccggaggctgtccgtgagcatgtgcagcgggccgaatttattccgcggctgccgcccaaaccgttcgaattctgtgccgatcctttgacgctaaacgcattcgatttggatctcatccatttgaccgctttgtttgtggcgcggaacggccgtcaatttctcactcagctgatgaaccgtgaggtgcgaaacttccagtttgatttcttaaagcctcaacactccaacttccaatacttcaccaagctggtcgagcagtatacgaaggtgctgatcccgccaaaaacgattgtggatgatttacgtgcttcggtcactcaacacaaaatcttggaggacgtgcgttaccgcgtcggttgggaccgccaccaaaaagcgctgaaggaccgcgaggaccaagcggtggagaaggagcgcattgcgtacaatcaaatcgactggcacgaatttgtcgttgtccaaacggtggactttcagcccagcgaaacactaaatttgccgcccctgtgcacgccaaaggatgtcggggcacgaattctgttgcaacaacgtacggaagcggccaaagcggcggctgagagtgtggcgatggatgtcgagtcggacgaggagggcggcgccgagtcgggtgacgaggaaacggccaaagaacgagccgcaatcgaagcggcggaggatgcggctggcgaactgcaccaacgcttgaacatcggggcggagaagcaacacaccggctcaacgctgacgcaaccggcacccgcggcgccgaccgccggcagcgtaatcatccgcgactacgaccctaaaaaatcgcgtggtggtccggtgtccaaaactgcggctgcctccacggagaagtacataatttcgccgctgacaaacgaacgcattcctgcagacaaactgcacgagcatgtgcgttacaacaccgttgacccacagttcaaagagcaacgagaccgtgaacaaatggatcgccaggacgaagacttagtgatggcgcccggggcagaaattagtcgaaatattgccaaattggccgaacgtcgaacagacattttcggtattggtgaaaagggagccgaacaaacaatcatcggcaaaaagttgggggaggaggaacggcaaatgccgcgttcggacccgaagaccatttgggacggacaattgtcgacgattgatgctaccactcgcgcagcgcaacagagtgtttcgttagagcagcaaatcagcgaaatccagcgacagcatgggtatttgccgaacccagccgcagaacgaatggtgccgtcgatgccgcccccgacttcgacaccttcacaacaattcggcggtggacaaccgctgacttcacattcaatggctccacctcagcgccctccgcctcatcagtccaccggtggcattgcgtccaatgtgcagaaaattgtgccggttccccaacagccgccgcaaatgtctattccaccacagcaccagcaacaacaacaaatgcgtcctccgcagcaaatgccaccgcaatttatgcagccgccgggcggtcgcccgcatatgccacctccgcctcatatgggcatgccaccgcacggcgttatgggcgcaatgccaccgcacatgcaaccgggaatgcctcctcctggcatgatgcgtccaccgcatggctctttcatgcttcctcctccgccccccggcgcctctgttggcgatgagccgccaaacaaacgcccgcgcgaagaaacgctggaaccggaagaacgttggcttcaaaaggtccacggtcaaatcgctgtgcaaatcgctacgccgcaaaatgatgaatggaacctgaaggggaacacagtacaaattcagttggacatcagttcatcggtcactgcgttaaaatcgttaatccaagagcagatcggagttcctgcaaccaaacaaaaattagtctacgagggcattttcatgaaggacagtcagagtttggcctactacaattttatgccgaatgcttcagtgcaacttcagttgaaagaacgcggaggacgaaaaaaatgaaatgtttttttgggaagtgatcacagaatgatgaatgaattggattactttattggcacatttatttgtttgaactttaaatttattggtaaaaaaaaaaaaaaaaaaaaa

SEQ ID NO: 1386 - DNA, 1104 bp, Heterodera glycines
  coding sequence=SeqID_1604; coordinates=52-927
  peptide sequence=SeqID_1801
accatcggaacatcgccaatttgcattttcaataaaaatctgtcgtcgacaatgagtgcttatcaaacaattgaaaagggttctcttcatacccttaactatcgcgtattttttaaaaattcggatggaaaattgatttctccttggcatgacattcctctctatgcgtccgagtcaaacaaattgttcaacatggttgtcgagattccgcggtggactaacgctaaaatggagattgccactaaggaagtgatgtctccaattcgtcaagacgagaaaaagggtcttccccgcttcgtcaacaatattttcccgcaccgcggatacatttggaattacggagcgcttcctcaaacgtgggaagacccaggacataaggacgagaacactggcgaaaacggagacaatgatccaattgatgtgattgagattggaagcaaagtgcagaagaggggcgccgtcattcgggtcaaagttttgggagttttggcacttttggacgaaggcgaaacggattggaagttggtagcaatcgacgaaaatgatgagttggctccgaagttgaacggaattgaggatattgaaaagcatttgcctggactgctaagtgccactcacgaatggttccgcatttacaaaattccaacgggaaaacccgctaacaaattcgccttcaatggccaattcaaagaccggaacttcgcccacaaaataatcgaacaaacgcatcaattttggaaaaagcttgtcacttccgctagtccgcatccattgaacactgagtgtcacaaggaaggggctgttttcaaagcgaatctttcggattgggaaagctttatatcgaaacagccagagtttggtcatgcccagcaggtgccggaacatgtcgacaaatggcactttattagtagcgaacagaatcaatgacggagcaattgaaaagtgattgacattcgtattgttgggtaggtttttaatgttattgttaatttttcgtttgaactgctttcaatgtaagtcggtttatttatcattccgttataatgcacaataaatgcttgaattgacaaaaaaaaaaaaaaaaaaaaaaaaaaaaaaaacccg

SEQ ID NO: 1387 - DNA, 1945 bp, Heterodera glycines
  coding sequence=SeqID_1605; coordinates=1-786
  peptide sequence=SeqID_1802
gacgaccgactcgacctcgacagaccgaccaattggagggtcttcaacattttggccgtcttccacaatctttcgtttgaggaggcgaacacggcccttatgggcgaaagtcacgcgcttgtcaggtttttgctgctttgctccaaatgtcggtggcatttgctgcgtaaaattgcctatgatacactgagtaacatcgcaagaaatataaaattggtcgacaaattgtccaccgttttgctgaacaccgtccaaaagggtctccactcggacgacaaatgcaaagtgatgcgatccatggaaattgtggccggtttatgcgcaacgccaaccaacgagtcaattgtttgtgaattcttcgaagaatcgcaaatcataccgcggattttcgctcttttgtcactcaaggatattttgatgtgtatgtgtgccatggagtccgtgttggccatttccgagttgggacgggtcgcgtgcgaagccgtcgcccgctgtgaccgcgccgttgaaatgcttgtcggctttttgaccaccgatgccttttcttttggcaccgtcggtttggcggggatgcacgtggttgaggtgcacggacaccaaaccagaccttatgttgcgccaaacaaaaagaatcctcccccgccgcttaaacttcaacccgtacaaccgcccgttcaatatgcgcaacagcggcaccaaacgtcggcgagcagtacaacaacaacggcaccaccatttggtgaagcgatggaattttgcaataaatgctcgtacagatactcttgaaacatgcccagatgcctttcatcgtcgtgcaaccgatggcaatgactctgctcaatttgcctctcatcagcgtcatccaccgactcgcaaaaaagtttatctgaaatcttcgcgcctgccttttctcaaccaccgacaacaattggccaccgatgctccgcctttacaaaatggcctttcgtcaattgctgccgcggttctatcgtccattgaatctgtggcgaatgaacgcgactttatgtgcgaatggctgatgcagtcggagggggacgacgattggtcggacgaggagggcacagcagcggggccaattgagccgtgcgcgaggtgtgccgggggaatttgaccacgcacagcgacggcgaaccgccgaggattcgctgtcgttggcccatttgcgaaaacactccgcgcactctgtggtccatcacaactcatttgcaagacatccattgcactgaaaatgcgttggagtcggcgatgctccaacgggtggagatgggctaccacgagtacgtctatcacattcggcaacagttcgagcgcagtagggaacggccatccgcgcagaatgcttactcagactttgccgcacaggaagcgatacgacggcacgcatttgccaatttgcgcaaagagattacggaagattcggagggtccggtgacgcgaagcattcgcctcacttcagcgctcattctgcgcaacatttgtcaccattccgtcgccggacgtcgcaaactccgcacgcatgagagtttcattagttggctgtcactctcacacatggaatcagctcgtacattggcacagtgtttgagtgaaatggcgcgacacgcgaacaatgaaacggaaccacaacgaaatgtcattaaaaggaaaaccagctgttcgtctggtgatctacaacagaatcagccaagctttgcgtcagaacaaatggatgacaatgacacggcctaacacaactttcatggatcatttcgtctattgttaattgcaagcgttccttctccgtcgcgaatttgagcaattcgaatttctaatctaatttgaacaaaaaatcattaatcggaaattcaaatttcttcacttttacactagcgccaaagattttctgatgaatgaccgtattcccaaaaaaaaaaaaaaaaaaaaa

SEQ ID NO: 1388 - DNA, 1516 bp, Heterodera glycines
  coding sequence=SeqID_1606; coordinates=9-1430
  peptide sequence=SeqID_1803
gagaaataatgggtgacttcgtgccaaaatttgagcgtaatttggacaacaaacctttgggcccgcgaccattgcccacggcaggcgcaattccagtaaaagatgagaaaggcagaattgtgatgaaaaaggtcaaagtgcagcgctacatggccggcaaaatcccagaatttgctcaagacttcgattctgatgaggacgcacaacaagcggaagaagaagtggagacggacctcagacagcacagagaagagaaaagagaacgcgaacgacgtgagaaggacgaacacagacacaacagaaaggatgggaaaaggcatcgcgaaagacgtgaccagcagctggacgagttcaaaaaggagctgaaggaggaagaggcattggcacttggggaggtggaggaggaagacgaacaaacgcgggaggagcggcaccaacgggcgatgttaaggcacagacggacggagcgggaggaagcgccgttggaacaggaggacttggaggaggaggctgacgaggatgaacggcagcggaggagggaattgctgaagcgaattcgccaaagacaagaggaagaggaactgctcgccaaacagcccgacgctggcgaagtcagcgaagagagcgaagaagagagttcggatgaggaagaggaggacagcgaggaggaaatgatgccacggctaaagccggtctttgtgccaagaaatgaccgtgtcactctcattgagctggagaaagagcaggcaaaattggaacagctgaaaatggaggaggaaaagcgcaaggaggagaagaagcgactgtcagcacggcttgtggaagagcaactgaagagagaagcggaccaggaaaaggcacggcgcgaggagggcgcccaattggatttgacggcggttaacacggacgacgagagcgacgaggtggcctatgaaatgtggaaagtgcgcgagatgaagcgcctcaagcgcaacagggaggagagagaagctttggcgcgtgaaaaggaggagatggagcgcattcacaatatgacggaggaggaaaggcgcaattacttacgaatgaacccaaaaatcatcaccaaccaacagaacaagggcaaatacaaattcctgcagaagtattaccatcgtggtgcctattttctggacaaagaggacgatgtgctgaggcgtaactttgccgaggcaacgggcgaagacgtttttgacaagtcggtgttgccgaaagtgatgcaggtgaaaaatttcggcaaagcgagtcgctccaaatggacccatttgacggcggaggacacaacggaccaccagggagtgtgggcaacgccgaccccactgagtgctaaatttgtggcaaaacacgcggcggggatgaaaaatgtattcgaaaagccatcagcaaaaaaacgaaagattggtggggattgaatgactctgtgcttaattaaatgataaatttggcatttaaacggatggataaaatttgaaaaaaaaaaaaaaaaaaaaaaaaaaaa

SEQ ID NO: 1389 - DNA, 2224 bp, Heterodera glycines
  coding sequence=SeqID_1607; coordinates=21-Jan
  peptide sequence=SeqID_1804
gcaacatggaaactaggcattttcatcaccgatatgaacatatcgcgagagttattcgttcgcggtgacatgaccatcggtagtctgatgatgcagttggtggggcaaattggcgagactcaggactggagtgaccattacatgtggtggcctgaccgccgtaagtggctgaaacacacgcgaagcacgttggaccaaattggaatcactgcagcgacttacttggaatttacaccgatgcataagcatgccaaggtccaactccccgatttgcagattatcgatgcccgactcgatttttccgtgcccattttgaaggtcacccaaaaaatctgccaagaacttgccatccgtcacccggaagaactgtcgctgaagcgtgatattccgccagatattttgcgaaaaggcgcatctgtcgaatcggaggctcagattcagccatacatgaagccgggcgaggagtccattggacccggcactctccgaacggccaaacccatccgcgcttcaactgtcaacctcactagcgggcgaggctcacctgcactttcgcaggcatctgcaatgggccccggtcacttgtttaacgcttctgaaattggcacactgccgaagatgggaacgattccgcgcggaatgagccccggtccagccgcatatcgcgaagtgcttggacgaacaccggagcccggttactctgaaggaggcggtctcgaatgtgaccagttcgacgaaaatttgataaactcaccgaaaataactccgggtcgtgaaacattcagaccccaaaattatttggagaaagccgcgttgaaccggggatggttggactcatcgaggtcgctgatggaacaaggcatttgcgaaggcgatgttgtgcttcttcgttttaaattcatgcagtttttcgacatgaatctgagatatgaccccgtccgtatcaatcaattgtatgaacaggccaaatggtccgtccttttggaggaggtcgaacacacggaggaggagtcatcattatttgcagcgctgcagttgcaagccgcgcttcagcgaaactctccggaccgcgaatctccggaacgtgacgaggtcgatgtactgcttgatgagttggaacagactttggacaccactgcctcactaagtcgccgtgatttaacatacgtgcctgagttgacagaatatctcaaatatttgaaacctaaaaaattgggttttaacaacttcaagagagcttactttacatttcgagacctttacttgagttattacaacacagctcaagatgcaaatgggcctccacttggtcactattatctcaaaggttgcgaggtcagccaggatttgagcgtctcgcaaggaaagttcaacataaaattgcaagtgccgagcagtgaagggatgtcggaactgatattgaagtgtgacacggagcaacagtttgccaaatggatggccgcttgtcgtttggcatctcgtggaaagacaatggccgattcttcgtacaattcggaggttgaatccattaagaaagtgctgcagatgcaagcaggaagggcagcggcagcgcaaaacggtgcacaaaacaagaagaaatcgcaaccggtgcagctgcccacggatttcaattcggaagagttcgtttgtcagcgatattggaagagatcggggaacaaaagcatgcaacagcgcatttcggatgcccattcaaacgtgaaaacattgagttgcaccgaagcgaagcttcagtacattcgcaattgggaggctctgcccgagcacggccttcactatttcatcgtcaaattcagaaatgggaagaaagctgaactcattgcggtggctcacaataggatgatgaaagtgaacagcgacaacggagaatcatcaaagacatggagattctctgggatgaaaaaatggcacgtgaactgggagataaggcacttaaagatacaattcgacaacgaggatgtcgaattcaaacctctgtcagcggactgcaaggttgttcatgagttcataggcggctacatttttctctcaatgcggagtaaagaccaaaaccaaacactggacgaggaagggttccatcgcctgactggaggatggggatagaaaattttatttgtaaaccacaactgccatttcaatttgtcatagtttctcacatttaaacaaaataaaagcgacaatatgcaaaaaaaaaaaaaaaaaaaaa

SEQ ID NO: 1390 - DNA, 1255 bp, Heterodera glycines
  coding sequence=SeqID_1608; coordinates=40-861
  peptide sequence=SeqID_1805
ctaatattcaattttttgaattaacataattcttttggaatggctcctgcaccagaaaaggaaaaaactgaagataagaaactgaaagacgggcaaaaaccaaatgtgaccacggatcacgcacactgtttgagcaatgtccaaccaaatcttcccgtcaataaagtggtggtgcatccgctcgttctgcttagtgtggtcgaccacttcaaccgcgtgaacaaaacgcacaaagtcaatcgagtggtcggtgttttgcttggttgtatgaagcacgacaaaacccttgacatcgcaaattgttttgctgtgccttatgacgaggactccgagaattcgaacattttctttcttgatgctgattttctggaggacatgtttgggatgttttacaaagtcgcggcacgtgaaagaattgtcggatggtatcactctgggccgcgtctttgcaagaatgacattctgatcaacgaagtcatcaaacgctttaccccgaaccccgtgctggtcataatccaagcttctcaaggccgacaggatttggcactgccgacggatgcttatgtggaagtccaggaagtgcacaatgatggttctcccccggtgaaaacctttgaacacgttcccagtgaaatcggagcagaagaagcggaagaggtcggagtggagcacttgctcagagacatcaaaaatcaaacagccggcaccctctcgcaacgaattgctaatcagttgacgggaattcgtggtctcgagaaccatttggctggttttacgagctatttgcatcgtgttgcgagtcgagaattgcccatcaaccacgctatcatatttctaatacaagtcgctgggaaattttgaaattgttcttttaaagccctacgttgtttttatattcctctgcttctcaaacacccatttcgttcttatgaatccctttcgcaggaaatgctcaatttgctgccggaggtcctctcaccggactttgtcgacgcgcacaatgtgcagacgaacgaccatttgatgtgcgtttacatcggttcgatggtgcggacgataatcgcattgcacaatctgatcgacaataagttaacgctgcaaaaagtggcagaaaaaagtgcgaaggaaaagacggtcaaagagacggaaaagaatgaagcaaatgacaaagagattgccaaaaacgccaaataattgtatgaccattttgctggaaaatattttaaatcattaaaaaaaaaaaaaaaaaaaaaaa

SEQ ID NO: 1391 - DNA, 921 bp, Heterodera glycines
  coding sequence=SeqID_1609; coordinates=12-800
  peptide sequence=SeqID_1806
gcacgaggataatgagcaatcttcgtctgcaaaagcgcttggctgcttcggtgttgaaatgtggtaaaggaaagatttggctcgacccaaatgaagtcaacgagatttcgaatgctaattctcgtcaaaatgttcgacgtcttgtcaaagacggtctcattatccgcaagccggggaaagtccattcacgttatcgcgctcgtgaacgtttggaagcacgcagaaagggccgtcacatggggttcggcaagcgtcatggtactcgcaatgcgcgtatgccagagaaagtgatttggatgcgtcgaatgcgtgtgcttcgtcatttattgaagcgttatcgtgatgctaaaaaaatcgacaaacacctttaccatgagctctacctcaaagcaaaaggaaatgcgttcaagaacaagcgcaacctcatggaatacatctttaagaaaaaaaccgaaaaccaacgttctaaacagcttgcagaacaggccgaggcacgtcgcaacaagaacaaggaaacccgcaaacgtcgcgaggagcgtttggttcagaagcgaaaggaacttttgcacaaaatttcggagagcgagaaagagaagacgcctcagcccctagtgacaaagccagccgagaaagagcaaccgaagccacaacctgtcgctgcacggaccgctgataaggaacagcccaagacacaacctgccgcggtaaaaactgcagagaaggagcagccgaagtcaaaaacggaaactgtgggcaaaagggaaactgttggtcccaagaaaaagaaaggaggcaagtaaatgacaacaagcggacgatcggatttgagacaatcgatcgcattcattgttttgccacatcatatttgttgaagaatttgttattattcaaaaaaaaaaaaaaaaaaaaaaaaaaaaaaaa

SEQ ID NO: 1392 - DNA, 1350 bp, Heterodera glycines
  coding sequence=SeqID_1610; coordinates=1-1273
  peptide sequence=SeqID_1807
gtttgaggcaaatttcgaaccaatttttatttccgatggaatggtcggacaatgtgcggcacggaaggcagccggattgattgttcgcatgattaaagatggacaaattgcgggcagagctttgctaattgttggcgagccggggacgggcaaaacggcggtggccatgggaatttcgaagtcaattggcggcgatacgcccttcatttccatttcggccagtgaagtgttttccatggatctgagtaaacccgaagcattgactcagtcattccgaaaggcaattggagttcgaatcaaagaggagactgaggtcctttgcggtgaggtcgtacaactcgaaattgaccgtccccagtcgggtgccgggccacgagttgggaaattgactctgaaaacaacggacatggaagcaatttacgacattggaaacaaaatgactgaatccgtcatcaaagagcgaatcacggccggcgacgtcatccaaattgacaaggcaaccggtaagatttcgaaaattgggcggtcgcttgcccggtcaaaggatttcgacgcacttgggccccaggacaaattggtcgcctgtccgtcgggggaaattcagtcccgcgtggaaacggttaacacaatttcattgcacgacattgatgtgatcaattcgcgttcctccgggtatttggcggttttttcgggcgatacgggcgaaattaaaagcgaagtgagggagcaaattgacaaaaaggtgatggaatggcgggaggaaaacaaagcgcaaataatcccgggtgttctgttcgtcgacgaagtgcacatgttcgacctcgagtgcttctccttcatcaaccgttacatcgaatcggacctttcgcccattttggtgatggccaccaaccgcggcattgtgaacattcgtggcacttccgttgagtctccccacggtgtgcctttggacttattggaccgcagccttatcatcaggacgtcgagttacaaagaaaatgaaattggagagatactgaaaatccgtgcttctgatgaactcgttgaaatggaggatgccagcatcgcagtgctcgtccaaatagcattggaaacatcgatgcgttactgcatgcaactcatttcaactgccgacattttacgacaaagaagaaaaggcgaaaaggtcactgaagaagatgtgagaaaggcgagaagtcttttcatcgatgtgaagcggtgcagaaaagagatggaaaagcacggggacagtttcatcaacgatctcaactgatcattccaaactgctttatttcattgttttttgttatttggaatgaatcgtcactcaaaaaaaaaaaaaaaaaaaaa

SEQ ID NO: 1393 - DNA, 652 bp, Heterodera glycines
  coding sequence=SeqID_1611; coordinates=1-490
  peptide sequence=SeqID_1808
gccttttcttcggatgacttatgcggaggcaattgaatggcttcaaaagaatgaagtgatgaacgaagaggggaaacccttccaattcggcgaggatatttccgaaggccctgagcgatttatgaccgacacaattggacaaccaattcttctcaatcgctttccgcatggaattaaggctttttatatgtcacgttgtgcagatcaaccggaattgaccgaatctgtggatttgctaatgccgggcgttggcgagatagtcggaggatcgatgaggatttggaaggaggacgaactgcttggggccttccaaaaagccgacatcgatcccaagccatactactggtacgtggaccagcggaaatacggaggttgcccccacggaggttttggacttggtctggagcggttcgtatgctggttggccaatcagcatcatatccgtgatgtgtgtctcttccctcggtacatcgggcggtgtgcgccgtagcttttttccgtctttgaaaaggaccaaaaacgaacccatacgaatatgggtattgttcatttttggcgttaaaacaaatgtatcttctaaattgtgcattttttttgttgttattgcataaagggataaaacacaaaaaaaaaaaaaaaaaaaaaaaaaaaa

SEQ ID NO: 1394 - DNA, 1965 bp, Heterodera glycines
  coding sequence=SeqID_1612; coordinates=125-1792
  peptide sequence=SeqID_1809
ttatactcatcagaaactctgaatgactcataaaagccgattttggtgtgtgtattttagcgtttgtgcagaatttttataattttgtttcacctttggtttgccctaattttctgctcaagcgatgagaatcaagaaaaagtttgcgagtggcactgcccgggtattcgtctcgcggaagaaggcgctgaagaagttgcagttgaatttgagggatttccgtcggctgtgcattttgaagggcatttacccgcgcgagccgagcagtgcgaagagggcgaacaaagggggcagcagcgagcacaaaatcttctaccacctcaaggacatcaactttttggcccaggaaccgttactcgaaaagttcagggagtacaaagcctttctgaagaaagtcacccgggcacgagccaagcgtgagcatttgaagttggagggactgctccgtgccaagcccaccttcagctatgaccatttggtgcgcgaaaggtatccgacttttgcgtccgctttgcgcgacttggacgacgcgctgtgcctttgttttgccttctccgcactgacacagtcaaaaattgcgcggccgcgaacaattggccaatgccggcgggcggtcaccgaattcatgcattttgtgattgaggcgaaggctttgcgaaaggtgttcatctccatcaagggagtgtattaccaagcggagattttgggcgaacgcgtcacttgggtggttggccacgaaagggccgtcggacgcgccaacgaattggacttttcggtgatggccaactttgtcgacttttacctctgcatgctttgcttcgtcaatttccgactttacaaaacgctcggccttttccatccgccgcaattgcgccgccagcaaatgccatcggaaaacgacttttcgtttgaccattcaaatgagcttgacgagcgcgtctattcgctggcgtttccgctcaaacgcaccgacaaaatggacgccgacagttgcggcgaaccgtccatcattgacacatttgcggaggacgacgccgaaggcggtgaatcgctggcggagaaaatgcgtcaagcggaagtgcagaaaacactgtttgccaaatgcaaattcttcctgaaccgggaagtgcccaaggaggcgcttgcctttgtcatccgctccggtgggggcttcgtctgttgggacggatgcgccccgaattcggttgacgaacacagcgaacagatcactcaccaaattgtggacagaaaagtggagaagaccaacattaacagagtgtacgtgcagccccagtgggtgttcgactgtttcaatgcgcggcgcattttaccgccggccaaatacgcgccgatggccacgctgccgccccatctttcgccctttgtcgatgcacaacatttggaagtcggcgccggtgcttatattcccttggagcgcattgaacacgcaaaacaacagaatggaacggatttggcagcatttttggatggcacaactccggcgaaaagtgccaaaaaggacagcgccaaagagaaaaatgaggcggcggacggcgaaggggcgaaaatgggcgtacgaaagtcgaaagtgttggcacgggaaagtcgacagaagcaaataaacgaagagggtcacaatttgaaactgcgcgagatgatggtggccaggaagcaccggcgcgtgtacggaaagatcaaatacgggctgaagaggaaggcgcgcgaggcgaacaaattggcggagaagcgggcgaagctaacgacagatgatggcaaagggacgaaagagtgaataaaagtgaacgaatggatggaattggagcgatgggaaggcaaagttgtggtgttctaccgtcatccaattgtcacaactttttgttattttgttcaaaacattttgtttggttctgaaaggtgttgttcgcaattaaacagcaaattaaaaaaaaaaaaaaaaaaaaaaaa

SEQ ID NO: 1395 - DNA, 2075 bp, Heterodera glycines
  coding sequence=SeqID_1613; coordinates=21-1814
  peptide sequence=SeqID_1810
cttttctgattttggctaaaatgactacgacagcgcctattgcgacagaagagggtgaggatagtttgtaccctatcgctgtgcttattgatgagcttcgtaacgaagatgttcagcttcgtctcaactcaatccgtaaattgtcgacgattgctttggcattgggcgttgaacgaacgcgcaaagaattgattcaattccttacagacaccatttatgacgaggatgaagttctattggcattggccgaacaattggggaatttcactccgttggttggcggacctgagtatgtacactgtttgctgccgccacttgaaaatttggcgaacattgaggagactgtcgtgcgtgacaaagcggtggaatcgttgcaaaaaatagcagaaaaacacagtgcagctcaactcgaggaatatttcattccgatggttctgcgattgtcagctggtgattggtttacttcgcgcacctccgcttgcggattgttcagcgtggcatacgctcgtgccaatcctgctcaaaaaactgaattacgtgccgcattccggtgcctctgtcgcgacgatacaccgatggttcgccgtgctgccgcatccaaattgggcgactttgccaaagtgcaggaggaggactatttgaaaaatgaaatcacccaaatgtttgaggacttggccaaggacgaacaagactctgttcgactgctttcagttgaggctggcattgtgatcgttggtctgttgtccgaagactcggcaaaattggcccaagtgaaaccgatcgctgtttcgttggtgcaagacaaatcctggcgtgttcgttatatggcagctgataaaattgttcaaattcagcaagcattcggtaccaaaattggcattgaagaaattgtcggatggtacaccggacttttgaaggactgcgagggcgaagtacgcgatgcagcggcagagaaactacaatcattctgtgctgctctgtcggaggaaggccgaaaaaagggaatcattgaagaaattttgccagtgattcgaccactaacaactgacgcgaatcagcatgtcaaaattgcgttggctcaggttgtgatgggattggcgcctctgctcggcaaccaatgcaccattgagcatttgttgcctatttttttgtcaatgcttcgtgatgatacacccgaagttcgcttgaacatcatttcttcattggaaaaggtcagcgatgttattggtgcagatgagctccaatactcacttttgcccgccatcatcgacttagcacaagatggaaagtggcgagttcgcttggccatcgtggaatacatgccgttgcttgccaaacaacttggccagaaattttttgacgagaaattgcttaaactgtgcatgaattggttgacggatcacgtttatgccattcgcgaggctgccacaaacattttgaaggaattagcgcagaaattcggtgccgaatgggccgtcactatggttttgccccgtgtgattgaacttgcttctgacagcaactatctgcgtcggatgacttgtctcttctgtttcaacactttgtgtgaagcattgaacaacgacgcaattatgaaggaacttttcccaacgataaaagcgctttgccatgatcaggtgtcaaacgtgcgtttcaattgtgctaagacattggccagagtgggcaaagtggtggacacacaggtcatgaacacggagattaaaccactgattgtgaaaatgtgcgaagaccctgagtttgacgttcgctatttcgctgaagaaacaaaaatagaacttggaatggcagcttgatggtttagctgtttgaacctaagaaagttttgatggatggaatgcttctcattaaccgatcttaaatattttttagaatttaacaacaatcgtgtgtgtgtgtgaatcgaaatttcatttcggtctgtctgttttatgtattaaattctgtcgtttgagtattcgataatttccaattctgtccatttctatcgatgttaagaaattcgagattccaccgacaaaaaattctttttctgttaaaaaaaaaaaaaaaaaaaa

SEQ ID NO: 1396 - DNA, 1046 bp, Heterodera glycines
  coding sequence=SeqID_1614; coordinates=1-818
  peptide sequence=SeqID_1811
gtttgttttttgtcattgaatttatccctggcggcgatttgatgtttcacatgcaacgtcagcaaaaattgcctgaagagcatgcgaggttttactctgcggaaatcattttggcgcttcattttctccattctcggggcatcatttaccgtgatttgaagttggataatgttctccttgacgccgaaggtcacatcaaactcactgatttcggcatgtgcaaagaaaacattggccctggcgatggcacttcaactttttgtggcactccgaattatatcgctccagaaattttgatgggcgaagagtacggttttagcgtcgatttttgggcccttggtgtgcttatgttcgaaatgatggccggaaggtcgccattccatctcccaacaacggaagaggacgaacaaactgctgaggaccttctctttaaaatgataatggaacatcaaattcgcattccacgccatttaagcgtgagggcagcgaatgtattgaagggatttctaaataaaagtccttctgagcgtttgggctgcaaaaccgacttggaggagggactggcagacattaaaatgaacagtttcttcaagtcgaacatcgactgggaattgcttgaacagcgacagatagcgcctccctataatccaaatgtgtccggagacagagacttacaacgatttgacacgagtttcaccaacggaaatccttccctaacaccggacagtccatctgtgatcgcgcggattgatcaatcggagttcgaagggttcgaatatgtgaacccattgatattcaacaaggaggatgccgtttaaatatcaggacagaattattcacttttcgagattatctgccaaaaataattaaattaacgccaaaaggattcataagtattcaaatgcccactgtcaactgaatcacttggtttctttattccaaaatacaaaaatattaattaattaaattttaatttctaaatatttcacttaattgtgtttaattttgtgcataaattattgttataaaaaaaaaaaaaaaaaaaa

SEQ ID NO: 1397 - DNA, 2076 bp, Heterodera glycines
  coding sequence=SeqID_1615; coordinates=Jan-84
  peptide sequence=SeqID_1812
gttcaatattcctatcatttcctcggatcgtttgccaaaactgcgcaatgttctcgccggtgtcttctccattcaaaacacttacaaatataacgacaattatccgttggacggtgaaggaaatacaaaaggcttttgctttttggagtaccaaacaaaggaggcggccaacgcagttttggccatttgcgatggacatcgccttgacaaaaaccacacattttcagcgtatccattcaccgctattcgaagcatgaaggagccggaaaaggactggaagaaaccggagagacaaccttatgtcgatttgggtgacccatggtcttggctgcaaaaccccaagtgtttggatcagttcggtctcctctatgaatcgggccagggtggcactctccgtttggatgtgttttggaacgtcagaaatggcgagccaacgcccgtggacaatgcttctcgagaaaattggtccaatgaccttttcaaatggtctccccatgggacttatttggccacgatgaacaatgacaagcggaatcagcgactcggagccgtaatttggggcggcgaaaagttcgacagatttcaacgcttttcccacgagggcgtcaattaccttgacttttcgccaaatgagaaatttcttgttacttatgcttgcgatcagaacagcactcgtgacaatgagaattgtttgcgcattttcgaggtgttcactggcgaactgaagaaggccttttcgccctctctgcgctctgctggccgtctccacgattggccctttctgaaatggtcacacgacgagaaattctttgcattttgccgtctccgcggcaattgcgtgaacatctttagcacggacgacttcatgctctgtgagaacaaagcgattgaattggatggccttgtctcttgcgaatttaacccaacaaagaatttcttggcttattactgcgaagaaaggccgagtgcaaatgctcccgcagagattggtttgcttgacgttgaaacgcgggtgaaaatccgcgcgtcgcgcattttctccgtctcacagtccaacctttactggcaaaagtcgggctcttatttggcagcgcacactgaacgctaccagaaaatggtgaagaacaaagagggggaggtgaaatatacgggtaataattcgtacttggaaatattcgactgtacagacaaggaatatgcggtacagtccatccaattgcccgaacctttcgtcaatttggcatgtgagccaaaaggcaacaaattttgcgttttgatggctgtagggcaaaaggttacgccgctaatctatcgactcgaccacggaaaaccagcgccacaactcattggcaagatcgaaccggccaacggactgaacacggcgatgtgggccccgcagggcggttgggtggtggtgatgggggtgaacacgtccagcggaattgtgagcttcatcgacgcgacgggggcagaggcgaacaaagctaaaacgattgagcatacttcactcagtcagggttcttgggacccgaccgggcgatactttgccacgtgcactttcgcgggaaagagtcgctatgagacgggctatcgcattcactcgttccaaggacgtgagctgcgacgtaaggcggtagacgccctgctgcgattcaaatggcgtccgcggccacccgtttcattgtccgagcaaaaagtgcgggagactcgcaaatcgttgaagcaattgtcagcgaagtttgaggaggaggacaaaagggaaatgctcaaagtttcgaaggaaataattgaacagcgcaaaaaggcattggaactcttctcgaacattcgcgtcgctgctgctaaaacatacgaagaagaacgggaaaaacggactgagctcagaggtggcattgaccaggaaattggcgagaaggacctcgttgaagaaacaataacagtggcactaaacacggagaaggagaaaatcagagacgagagctaatagaggagagaggtgtttttcatgcactttaaattatgttttctgttaattcattgttaaatatgatatgtaaaaaaaaaaaaaaaaaaaaa

SEQ ID NO: 1398 - DNA, 1419 bp, Heterodera glycines
  coding sequence=SeqID_1616; coordinates=23-1312
  peptide sequence=SeqID_1813
tttgttaaaaacagtttttataatgaagccagacttaaaagaccgggactttatgtacaaattaattgttggccaactcttttacgatggtcatcaacaattggcactgaacttggcacaaacgcttggtctttcgctacgaccgcctcctccatctgacaaactttttcgtcttgtggcaatagctaaacaatttgtggaagatcccgagtctaaagaacgggagacaatcttgcaggtcggtgggtttgagtctgctgggcttgacttggaattcgatgctgatgttgtcccgacaagccctgaaccaagtttgtacgaaactgtgtacctcaccacacacaaggccccgtgtcgggcggctgctttctctccagatggagctcttgtcgccacggcctccaatgattgttcaattaaaattttggatgtcgataaaatcatttccaggattgacgtgactctgagtgagtccggccccgacgcccatcacccggtcattcggaccctttatgaccacctcgatgaagtcacttgcgttgctttccatccccgcgagtccgtcctcctttcgggcagcaacgattttacgctgaaaatgttcgattattcaaaaactgcggttaaaagggcaatgaaaacgatcacggaggtcgagccgatcactgcggtcagttttcatccgagcggagagttttttctatgcgcaactcggcatccgaccttgcgtctttatagtgccgaaacacagcaatgctttgtttctccaataccgaaggaccaacattctgattccattacggatgtgtgctattcggaaaatgcgcgaatgtttgtcacgggaagtcgtgatgggaatgtaaaagtttgggacggagtttccaatcgatgcattgagacttttacccgcgcgcatgacggagccccgatttgcagtgctcagttcactcgtaatggaaagtacgttctcacagtaggaatggacagtgtgcccaaattatgggaattgtccaccaatcgctgtttgatcgcttacaccggcgcgggcaccacaggcgcacgtgaacatccgatgcaggcgcactttaaccacaccgaagactatgtaatgcttcccgatgaaaagtcgggttcgctatgttcgtgggatgcacggaactcggaccgcgagcggttgcttgcgctaggccacacagctccgactcgagcttttgtgcattcgccaagcatgccaatgttcgtcaccggatcagatgaccaccgcatccgattttggtacaggcggagacaatggggcgaaggcaaagcctagcaaaaacggacaaaacacacaattggcaccatttattgattgttcgcttttttcagcaatttttaattaaaatgtttttgaactcaaaaaaaaaaaaaaaaaaaaaa

SEQ ID NO: 1399 - DNA, 837 bp, Heterodera glycines
  coding sequence=SeqID_1617; coordinates=73-717
  peptide sequence=SeqID_1814
gtttgagatttgctgcaatttcaattccattttttaaattttgtcgacaaattaaacagtgccgaaaactaaatgacttccagggatgacgaatatgactatttgtttaaggttgtattaatcggcgactcgggggtcggcaagtccaacctgttgtcccgcttcacgcgcaacgagttcaacctggaaagcaagtcgaccatcggagtggagtttgccacgcgaagcatccaggtcgactccaaaacggtgaaagcgcaaatttgggacacggcgggccaggagcgctaccgggccatcacttccgcgtactaccggggcgccgtcggtgcactgctcgtctacgacattgccaagcatgtgacctacgagaatgtggagcggtggctgaaagagttgcgcgaccattccgaccaaaacattgtgatcatgctggtgggcaacaagagcgacctgcgccatctgcgggcagtgccgaccgacgaggccaaggcgtacgcggaacgcaaccagctgtcattcattgagaccagcgcgttggacgccaccaatgtggaggacgcgttcaccaacattctgaccgaaatttatcgctctgtcagcacacgacaagtgccaccggaccggatggtgccaatcaacagccagcacaacatcacactgtcctcctccaccagtgccaacaaggagaagaaggcgtgctgttccgcctcctaatttattgattgattgattgatcggaataatgacaaaagtggtgtgatcagagaaaggggaagagagcaatcatttaattcaagaaataataatataaataaaaaaaaaaaaaaaaaaaaa

SEQ ID NO: 1400 - DNA, 1814 bp, Heterodera glycines
  coding sequence=SeqID_1618; coordinates=32-1576
  peptide sequence=SeqID_1815
gtccaattaagatatcctttctatttgacaaatgtcccgttttgtgtgtgctatttctggaaatgagcctgaggtggctgtggcatcgcccgtctccggagaagtctttgagaaacggctgctcatcaagtacattgaagagaacggcaccgatccgatcaccggccacaaacttgacacttccaacttggtcgagctgaagcaggacccgggcattcgttctatgcaaaagtcattggccaccgcctcgttgccttcgttgcttaagcaattgcaagacgaatgggacgccaccatgctgaacaacttcacgctcagacaggagttgaaggcagcccgcgaggagttgacccacgcgctttaccagaatgacgcggcatgccgtgtgatcaaccgtctgagcagtgagctgcagtccgcgcgtcaaatcatcgcgacactgccgcacggacgacgcgctgccgcggagagtgagacggaggcgaccgatgttgagatgcgtccggaggaagtggaggagggcgctggtgcggacggtctgccgggcatcagcgaagagttggtcaattttttcaccgacaaatgccaagacttttccaccgcgcgtaagcagcgtggccgaaatttgcccgaggggttggcatcagtggaacaaattcaaaagtatgaggaggttgcgtgccacgatgcgctgcacagtgccagcgtgcccggcatcaccgcgttggatttgcagaaaaatctcatcgcaaccggcggaatggacaagaccatcgtgctgttcgactcggagacggagaccatcaagaacacgttcaaggggcaccagaagcgcatcagtgccgtccgtctccatcccaaccttcaaacaattgtctcgggctcttttgactcacagatacgaatttggaacgcggatgatcaaagtgccagaaatgttattggcatccacgaccgacccgtcactgacgtgtctctgcacccaaccggcgattatgtgctctgttcctctgaggattcgcattggtcgctcatcgacctcaatgctggacgtccgttgataaaagtgaaatccgacgacgacgatgtgccgggaatttgctgtggccagtttcaccccgacggactcatctttggcactggcggcaaaaacagcgtcgtcaaaatctgggatatcaaggagcagatcaacgtggcccaattcccgggccaccaggaggcggttgttgccatttcgttttccgaaaatggctactacttggccaccgggtcaacggacggcgaagtaaaaatttgggacctgcgcaaactgaagaatctaaagaatttgacactgtacgatgtgaagcaggcgatcaactgcctcacttttgaccagtctggcgcctatttggccgtcgggggcagcaacgtgcagattttccaggccaaaagttggaacaacattgcccagttcaacgcgcactctcagccagtcaccggcgtctgttttgccgacgatgccaagtccgtggtgtccgccagcatggacaagtccgtccgtgtccacgccgtgccgcccgtggcgaacgaatgaattaattaataatcagaagaatgtgcgtcaaaagtgcggttgttgttatttgagggaggagaaggagaacaatcgaaatgagacagatcaatgaactcatcacaaattaaatgaatgaaatggcttatcattttttgtcacttttaaatattttcagtgttgatttgtgtttgttatctctctgcttttgacagtgtaaaaaatgggcctcgttaaaaaaaaaaaaaaaaaaaaaaaa

SEQ ID NO: 1401 - DNA, 469 bp, Heterodera glycines
  coding sequence=SeqID_1619; coordinates=1-268
  peptide sequence=SeqID_1816
tctcagtccgccctggggcgggcccgcctacctgcacagggaccgtccgtttgacctgctcgccgacatggagccgaacggagttgacattttccgcgtggcgaaaaaaatttcgccgaacattgtctactttttgccgaaaaacacccgcactgatcagttaattgcattggcaggccccggaggccgtgtggagttggagcaaacggtgcttaacgagaagatcaaggcgttgcatgcttattttggcctgttggcggccaattgagtccctcgtcttttttcgcgcttttctttggttgttacactcacggattatctcaaattattatctctttgaattcgttgcttttccattttctcttgatcattttgaaaattttgatattgtttcaccttctcttgctacaaattttccaataaattttcccatttcaaaaaaaaaaaaaaaaaaaaaaaaaaaaaaaaa

SEQ ID NO: 1402 - DNA, 692 bp, Heterodera glycines
  coding sequence=SeqID_1620; coordinates=17-577
  peptide sequence=SeqID_1817
tttgaatttcgaaaaaatgggcaaaattcactactgcaagcgtccggacaacagcacaaagtcgtgcaaagctcgtggttcagatcttcgtgtccatttcaagaacacacatgagacggcgcgtgccatcaaacatatgccgttgaagcgtgccatccgctttctggagaatgtacgggagaagaaggagattgtgccgttccgccacttcaacggcggcgtgggacgcaaagcgcaggcgcaagcgtggggcacaacacagggacgttggccgaaaaagtccgccgagttccttctccaacttctcagaaatgcggagagtaatgccgaggtgaagggcctggacgtcgaccatttggtcattgaccacatcgtcgtgcaagcggccgccaaaatgcgtcggcgcacttaccgcgcgcacgggcgcatcaatccgtacatgagttcgccgtgtcacatcgaagtgattctgaccgagaaaaaggacgtcgttgcgaagccggccggcgcattggtcaaagtgaagaaagagtcgaagaagaagcagcgacggcaattggcacgtggcgaattctgagtgacccgaggacatccccgaaccacactctctttgtgcggcttgttttgttatttggtggcgataaaatttgttgaaccttaaaaaaaaaaaaaaaaaaaaaaaaaaaaaaaaa

SEQ ID NO: 1403 - DNA, 867 bp, Heterodera glycines
  coding sequence=SeqID_1621; coordinates=86-631
  peptide sequence=SeqID_1818
ctcgatttctctgctttttgtccattagactttatttaattccttccattctaaacagcgaattgcttttacgccaccataaaatatgggtttggccatttccggtctgttcagtcgacttttcggcaaaaaggaagtgcgcattttgatggttgggctggacgcggcgggaaagaccaccattctgtacaagctgaagttgggcgaaattgtcaccaccattccaacaattggcttcaacgtggaaactgtcgaatacaaaaacatttcattcaccgtctgggacgttggtggacaagacaaaattcgaccgttatggcgatactatttccaaaatacgcaaggactgatttttgtcgtggacagcaacgaccgcgagcgtgtgggcgaggcgcgtgaggaactgatgcgaatgctggcggaagacgaactgcgcgacgcggtgctgttgatttttgcgaacaaacaggatttgccaaatgctatgaacgccgcagaagtgacggacaaactcggactgcacaatcttcggaaccgcaactggtacatccaggccacctgtgccacgtcgggcgacggactttacgaaggcttggactggctgagcaatcagctgaagaacagaggatgaacagcagcgagcggagcggcggatcatgcaaattgaaagaaaatgacggatgggggaatttgtttagctctatgttctggggatggccgtttcatttcatttcgataactatttaaatgtgtgttttttttttgtgatgacaatccaatcaaagtgacttctgacacaattgatttgtgagcatcggttccgtgttataaattatttataaaacaaaaaaaaaaaaaaaaaaaaaa

SEQ ID NO: 1404 - DNA, 2121 bp, Heterodera glycines
  coding sequence=SeqID_1622; coordinates=337-1848
  peptide sequence=SeqID_1819
gcctcgtgccgaattcggcacgagggtttgagtaattgtaacatctcggcacctttttgatttattccgcctactatagaaggtgaacagcttgaaaatgatgaaaacgtttctccgagtcgcgtttcccccaccaatgcctttggtgttcaaaagagtggccatttgctgcacaattttgctgagcctggaccactgacgacaaagatttattattacgtcgatgaccaacaaattccgttctccaccgaaattgccatccctccgtccaaaattacgctggcggacttcaaaaagtgtatcacgcgcaggaactaccgatattattgcaaagtgatggacccggcacttaacgccgaggtgaagacggacattcgcgacgaaaacgccgtgctaaagccaaattcgaagaatggacgctttgaactgtttttgctgtccgagacacaacagacgcactcgtccgcctccactctccccatccaaaagctacagcatgtcgatgccatccgtgcctctctcatggaaaaacggacaacggccaataattacattcttgacgggaggccaaaattcattgatgacagcagtagcagccccgaggaagacagcaccaatttgcgtttgtttggcgagtcaaattttgagggcattacggggagcatcgacgacagcgactctcagtacaccaccgactttacgagtgtttctcagcagaatccacacgtgccgaagcgcaaatttgccatggcggagcgatggtgcggggaaagttgtgacgatggcaaacatgggcatggccaacaacaacaaaggcaccgccatcgtctcgcctttgtgagtacgaacaaacgctacgacagcaacaacaaaccgtgttggacgcgcgagaagcggacgcgccgcaggtcattcacggcactttccagcacattcgaggacaccacggaagcatcaatgtccttggaaatgatcacggtgactttcaacttggacagtcgacgaccctttgggatgtccattgtgacgaagaacaaccgttccggatttgcagggatttatgtgcatgaagttaaccctggcggtcttgtggcgttggacggtcgaatcagacccggctttatcattctggaagtcaacgacatttctttggatgaccttagctcaaaggaggcgctcaatctgatcatctcttcggttcgaaatgctaccgaaaccagggggcaactcaaattggtctgtgctcccagcagtgagtctgttgaactcgcgcgaaacgttttccaccccattttggccgagcccgtacgaccgattgatcccaccgcgtggattcagcacgcaaacgccgccagggggttggaccaccaattgcagcactttccccctcccccgccaaccgctcattcgcaagggcaacagccgccgatttgttgtattatgccgccacaatgtcagccgaacgtggcgaaaccgatggccagcaaatcgtcaaccattccaaaaacaaaccctcagcaacagggaaaggtccatgaaaaacaacaccaatttgcgggtgctgcaaattgtgccgttgacggagacattcgaatgatccaaaacccatcgactgatattaccacgacagagtcgggcatttcctccgtggaatgctctattggccaattagagccctccacgaaagcgaaaggcgcatcaactggaaacagaaagaggagcaaaacgacggagacgaagaagcgaaggggaagcggaggcatcgggacggcactccgccgattggtgtgcattcggacgacgaaaagaggggggagagggaacagtggggaaaagaaaaatgggtaagcggaggacagacaaacggacgcagcggggggaagggaagaacggaaggagggaacgtacagcacaacccaagaaataatggaaagagggcaaagcacggcggatgagtcagcagcgacttgcaacatttttttgattttggaatatattcgccataatttttgctaattctaacctcataacttaaaaacgctaatgtaaattattcgagcttcaaagttgacttcgtaatttagtaaaatatttttttctaaaaaaaaaaaaaaaaaaaaa

SEQ ID NO: 1405 - DNA, 1396 bp, Heterodera glycines
  coding sequence=SeqID_1623; coordinates=20-1171
  peptide sequence=SeqID_1820
ctaactaccgctttaaaccatggcaaatccttcgattaacgctaaggcggccgttttggtggacaatccgcgggttgaatttgtgcaactcgactcattggtggtcatgaaaattgtgaagcacggggacatcgaattctatgccggaatgtccaaaattgctggcgaaacgtgccaaggcattctcaccggactgatctccgtcgaggacaagcggcttgaagtcacgaattgtttctcgatcactcgtccggatgctctgcacgaaagtgaagagagtgccgctggtcccgagacgtccctttcagacgagaacaaacagggcgagattctcgacatgctgaagcgatttcgaatgatgaacatcgattacgagtcggtcggcttttaccaggcgcacccattcggcgcctgtttcagccacgaactgctcggttcattggtggactaccaatcggacatttcagacgccgttgtcattgtttacgacccggtcaaaacccgtcagggatgtctgacccttcgcgcttatcgcctctccaaaaaggcgttggatttggccatcacttgcgacgacagttggtctcctgaacagaccaaattggctggggtcaactttgccaatttcttcgaagaattgccaattgttgtgaagaacagccatctgatgaacgttctgttggccgagttggcactttccaccaaatgccaacgcgccgcttccatccgactcgaattgggcaccaaacagtcgctggagaggtccatgaaggcgttgattggcaccgtcgacgaactgaacaaagcggtgaatgcctacggcaaatacacggtggaaaagcaaaagtacgacacaatgtacaacaatctgatgcagaagagacaaacggagaacgaagcgcggcaatcgcgcggagaaccgccgctgacaatggaggacataaagcggcagctgaagcagccgcaaatgcagacaaagtacggaatgttggacttgctgctgaacgcgctggacaccgacgcattcacgacgtaccaaattcagacgaccaacgaaaacgtggccaaattgcacctttcccaagcggtctctgctcagcccgtcgtcgccgcctcttccgctgccattggcacttccgccgcaaatgcgcccaatttggaaaggaaataaaaacatggaaattggggcggagagagaagggaaatgcgaacggagcaacaaaaagattggattattattttgttttccctgttgctcttaattgtatggacacacacaaattgttgctgtttttattttgtttcgttgttggacggaccgacgtcggtcctccagcctaattataattaatggtgttgaaattacataattaaaaaaaaaaaaaaaaaaaaaaaa

SEQ ID NO: 1406 - DNA, 764 bp, Heterodera glycines
  coding sequence=SeqID_1624; coordinates=28-672
  peptide sequence=SeqID_1821
gtttgagaaaatcatattaaactaaaaatgggacgtcgtcccgctcgttgctatcgctacattaagaacaagccttatcccaagtctcgcttttgtcgcggtgtccctgacccgaagattcgcatttttgacttgggtaggaaacgcgcaactgttgacgagtttccatgctgtgtgcacatgatatcgaatgaaagggaacatttgtcgtctgaggctctcgaagctgctcgaatttgtgcgaacaaatacatggtgaagaattgcgggaaggacggctttcacatgcgcgtccgaatccacccgttccatgtgattcgcatcaacaaaatgttgtcctgcgctggtgctgaccgtcttcagacgggaatgcgcggcgcctttgggaaaccccaagggttggtggcgcgtgtcggcatcggtgatatgctgatgtcggttcgtgtccgtgaccagcatcaagcccacgctcttgaagcattccgtcgagcaaagttcaaattccccggccgtcaatacatcgtcatttcgcgcaaatggggcttcaccccttttgaccgcgaagtttacgagaagcaccgcaaggaagggcgagtcattccggacggagtcaactgccgattcctcaagcaacacggaccattgacggaatggctcaaaaatccaatctgatcaattgtacgacggatatattcccttttatatgctttgttgattaaattgttggatctaaaaaaaaaaaaaaaaaaaaaaaaaaaaaaaaa

SEQ ID NO: 1407 - DNA, 528 bp, Heterodera glycines
  coding sequence=SeqID_1625; coordinates=1-402
  peptide sequence=SeqID_1822
atgaacatgaatcaacttttggttggccgttcgctgttcccaaaaatcatccgccctttctcgcacaccaaaccccttgccaagtctgaggctgacccggatgattacggctacttcccggacccaattgaacactcatggggtttggagaggaaaatgctcatcgctcgtctgaagggtgacgaccgctatgagccgaaggtgtatttccgcgctgaacataccacccgggactatccgaatttggtgccggtccatttgcaggacaaagtcgtcgggtgcctttgcgagccggacgcggagtacgtgaactattggcatattaggaaaggccagatgaagcgatgcgagtgcggacattggtttaagggcgtgcaagccgaccctgacagtttcgcctgaatgcgatggatacgaattggctttgaagtgataggagatcatataaaatgatcagttattttaattgtatttctaagttggttggataaatgtaaagcataaaaaaaaaaaaaaaaaaaaaaaaaa

SEQ ID NO: 1408 - DNA, 664 bp, Heterodera glycines
  coding sequence=SeqID_1626; coordinates=61-555
  peptide sequence=SeqID_1823
gtaatttcaagcacattatttttggaaagcttatttgatttatccatcaacagctgcaaaatgacgattagcaagaacaacaagatgatggcgcacctcaactacaaaatgaaggtgatcgtccaggattcacgcgtttttatcggatacttcaaagcattcgataaacacatgaacataattctggccgactgtgaagagatgcgccgcattaagcccaaacaaggagctaagaagtcaaacgtcgaggaggaaaagcgcattcttggcctggtgttgctgcgaggggacaaaatcatctccatttcggtggaaggaccgcctcaaaaggaggattctggtgtgcagttgccaaaggctggcggactcggtgggcctggacaaggacgaggtgccggtcgaggaatgccgatgggtgtggtgccgccaatgggagctgttcctccgggtttgcagggcgccgttcgtggaattggtggtcctgggatgggtgggcccatgcagcccggatacatgcaagggatgccgcagggaatgccgccacgtccattttgatgctcgattttgttttctttgttcgaccattatttgttttcttacttttacacaatgatctgtttgtttgataaataagttatcgaaaaaaaaaaaaaaaaaaaaaaaa

SEQ ID NO: 1409 - DNA, 753 bp, Heterodera glycines
  coding sequence=SeqID_1627; coordinates=41-586
  peptide sequence=SeqID_1824
tttaattccactttgttctcccggttcgatattcaatattatgtttaacctgcaagaccgttgtaagggcgttgaccaggaccgcgattaccacgcgactcgcatttcaattcgggacaaattgctcagccaagagaccaaagagttggaacagaaccttcgcgatttgcccacttgcaaattgattttcccctcaacgtcggcgctgcacgaaatggagctgacggttaagccgaacgtgggcctttacaaaggcggcgctttcaaattcagcatcaccgtcccaccggagtacaacaacgtgcctccaattgtgaagtgtctgacccgcgtttggcatccgaacattaacgaagacggaagcatttgcctgagtttgttaaggcaaaactcattggacggatatggttggatgcccacgcgccgcatccgtgacgtcatcctcggccttgaccaattgttcaccgatctcatagactttgacgacccgctcaatgcccaagcggcgcagcagtggcaaaccaacaaagatggatttgcccaaaaagtcaaggaatacatgaccaaatactgcccaagaaactgacaaaaagacggagaaagggaaaagacgggcgataaattggcaaggattctttaatgatggacggatttgactaaagtttgttttgatcggacattatttcaactcgtttacatttgatcgttgttataaattttctattctttaaaaaaaaaaaaaaaaaaaaaaaa

SEQ ID NO: 1410 - DNA, 910 bp, Heterodera glycines
  coding sequence=SeqID_1628; coordinates=35-775
  peptide sequence=SeqID_1825
tcgatttccaaatttggaaaaagtaaatttaaaaatggtcgcactccgtgcccaatttgaggcgagcaatgatgtcggagttttctgtaaactcaccaatgcttattgtctggtgggcattgcttcttccgaaaatttttacagtattgtggaggctgagttggccgacgtcatcccggtcatccattgcacagttgcgggctgtcggattgttggccgtgtgacggccggtaatcggcacggactgttggtgccgaacgcgaccacggaccaggaattgcagcacatccgcaacagtttgcctgactcggtccaaattcgaagggttgacgaacggttgtcagcgctgggcaatgtaattgcatgcaatgaccacatcgctgttgtccacgcggacataagcaaggaaacggaggcggcgctggccgaagtgctcaaagtggaagtgttccggctcagtctcggcgaaaatgcattggtgggctcttacgcagcgatgacctcaaacggtgcgttggtggcggcaaagacaccgccggaggtgcagcgcgagttcgcctcgctcgcccaagtgccggtggtcgccgggacggtcaaccgcggctcggaactgatcggtgccggctgttgcgtcaacgattggatcgcattcacaggcctcgacacgacctccgccgaactgtccgtgttggagtccatcttcaaattgggagacgcggcgccgagcgcaatttccaccgatttgcgcgatactttgatagaatcgatgctttgaatgaccaaatttgatgacgaacaccaaaacactgacacttttccgtaatttattcatctgttggttaggccatccattgactcgcatttgaaaatttacggaaatcagtcctttaaaaaaaaaaaaaaaaaaaaa

SEQ ID NO: 1411 - DNA, 704 bp, Heterodera glycines
  coding sequence=SeqID_1629; coordinates=6-500
  peptide sequence=SeqID_1826
gaaatatggttttcgacccgaaatcgaaagacaaggcgcgggaacttggttcctaccgcgatatgcggttcgaggggtcgttgcccgaacaagaacgtcggcttgcacagtccaccactctctacattggtaatttgtcttactttacttctgaagaacaggtatgggagctgttccgccgcgctggagacgttcgtcgggtgattatgggcctggaccgttttaacaaaacgccatgcggtttctgttttgtcgagtattatacacgtgaagatgcagaaaatgcactgagatacataagcgggactcgccttgacgacagagttgtcagatgcgattgggacgcgggttttaaggaaggtcgccagttcggtcgtggtaaacatggcggacaagtcagggacgagtatcggcagaattttgattcgggaagaggcggatggaacaaaacaattcaaaaacgaaatgaccaattcacccagcgaaatatcaaagcctgacattcgacttcgttggacaaaattcaatttaaaatctcattgcttattattattgaccgttgttttgttatccatttaaaatttgctcttatactttcatttcattacatttttggtgtatcagtgaacgcattcattcattgtttgatttattgaaaatgcataaacatttaaaaaaaaaaaaaaaaaaaaaaaaaaaaaaaa

SEQ ID NO: 1412 - DNA, 749 bp, Heterodera glycines
  coding sequence=SeqID_1630; coordinates=1-662
  peptide sequence=SeqID_1827
cgggaattgaacttcacaaagagtcgcgttggtacgcgggatggaagacattcacagagtccaactcctattacaacaaaattattgactggaaaacacgcattgacgaaagcgagaatattttcgtccgaactgttcgtggtaccttcgaacgtgtccaactcgcatttgaatccaaagacaatgtgtcggaagtgctaacgcaaatatccaaaatcgaccccgaattcgacaagtcggaatggctccgtttttgcgaaaaagaaatgatcccgaacattcttgaatcaacttaccaaatgaacttcgaagtccttcgtgattggtgttacgagaaagcgttcaatttaatcgcaaattctatcaaagaatacgaaaagattggcttcaacacgagggattctcgcattatcgatgttagcaaagtggagttggtcacggggaatatgaccgaccaagggccgactttggtcatccaattccaagtattcatgacaaatgtggtgaagaacagcgaggggaaaattgtccaaggtgaccctgaaaaagcggttcgagtgagacacatttgggtaatatgccgagacatggaggagttcaacccggcaacagcttggaaactgcttgagctgcacatgataaaggaggatttatttgtttagcgccgaacgtcaaaaacattttaatttaaatttatttgatttgttccgacaataaaaaacgtcattaaaaaaaaaaaaaaaaaaaaa

SEQ ID NO: 1413 - DNA, 1336 bp, Heterodera glycines
  coding sequence=SeqID_1631; coordinates=1-1191
  peptide sequence=SeqID_1912
gtgatgcgttctccatcaccgaccgataatgacaaagcgcgttccttaaatgtgtacagacgtaaattggccgaatataaagaaattgagaatcggcttaaggaattgcggactaaggaacgcgaaagtcacaaattgttcgacaagtcggaaaatgagattaaatcgcttcaatcggtcggtcagattgttggcgaagtgcttaaacaattgacagaagagaaattcatagtcaaagcgaccaatgggccacgatatgtggtcggatgtcgtcggaccattgacaaggagaaactgaagcagggcacacgtgtggctttggacatgaccacgctgaccataatgcgccaacttccgcgcgaggtggacccgttggtgtacaaaatgagccacgaagaccctggcaacgtgagctatgccgaaattggaggtctctccgagcaaatcagagaactgagagaggttgttgaactgccgctgatcaatccggagttgttcaaacgcgtcggcataacaccgcccaagggctgtcttttgtacggaccgccgggcaccggaaaaacacttttggccagggcggtcgcttcgcagctcaactgtaactttctgaaggtcgtctcgtcggcgattgtggacaaatacattggagagtcggcacgaatgatccgcgaaatgttcaattacgcccgtgacaaccagccgtgcatcgtttttatggacgaaattgacgccatcggcggacgtcgtttttcggaggggacttcggccgaccgcgaaatccaacgcactttgatggagttgctgaatcagatggacgggttcgactcgcttggcaaagtcaaaatcatcatggccaccaatcgacccgacacgcttgacccggcactgctccgtccgggccgattagacagaaaaatcgaaattggactgcccaatggacagagtcgtcttgaggtgctgaagatccatgccaccaaagtgctgaaaaaagaagaaatcgattacgaagcggtggtcaaattgtccgagggattctcaggggcagacctgcgcaatgtgtgcacggaagctggactgaatgcgatccgaaaggagagggacggcgtggtacaggaggacttcatgaaggcagtccgtaaagttgcggacgccaaaaagttggagaccagtcttgactacaaacccgtgtgaaagggctgtaagcacttcccgatgggcaactcaatgatttgtttaattgtttcgcgtaaaatattcaaactattttttgaattattattgtgctgatgagtccaaatgtaaaaccgattaaaaaaaaaaaaaaaaaaaaaaaaaa

SEQ ID NO: 1414 - DNA, 1284 bp, Heterodera glycines
  coding sequence=SeqID_1632; coordinates=11-1033
  peptide sequence=SeqID_1828
tttgagcccaatgttcgacttccatcaattcatgggtttgggcggtggtgctgtcgccacttattcagtgcaattgcgtgccttttctgcgccatttttccagcgacacgatgaacgaagaatcaacgaactcaattacggcggaaagattctgttgccaaattcgtgtctcgacaatttgatgcgtcgcaacattcagtacccgatgctcttcaaattgactaatgtcggcccggcccttcagaggggcacccatgccggtgtgctggagtttctggcggaagaaggccgctgctatttaccttcctggatgatggcccaactcgctctgagggagggcgacctcatcaccgtggagtacaaagcgctcccgaatgccacttacgccaagttcaagccgatgtccaccgacttttacaacatttcaaatccccgtgccatgctcgaggtcgaactgcgcaagttttcctgtctgaccaaaggcgatgtcatcgcagtgcagtacaacgaacaagtgtacgaattccaagtgaaggcactgaagccggaaaatgcggtgaccatcgtcgagtgtgacataaacattgaatttgacgctgcggaaggctacgtggagccgaacagaacgcatcaacaacggaatgagatggtcgcagcggaggaagagcagcagtcgcatccacccaacgtgttcaaaccgttctccgggtcagggtttcgtgtcgatgggaagaagccgcgatctgtctcaacaagttcacagcaggaggcgacgagcagctcatcctcttcggcatcttccgggcgacagccttcctctgggattgcttcgactgcgtccactgcgcgtgacgctttggaggcaattgctgtggacgaaaattacatccctggggagttgcgttttgtgcgtcgtccgtacaaaagcaaggcacaaagggacaaagaggcgcgcgaaaaggacaacggagggacgatgaagccattcggaggcgaagggaacacaatccgaccgacgcgaggcggacaatgaacgggggatggacaaaagaatgacttgtggagaaaaagactattgacgaacggatgagtaatgataaaagtccttttgacggttgcattggcatctaaaacaataaatgattttggatctatccgatctatgcaattgtcccgtaaaaataatattggtgaatgttatatttaaaaatgttgccgaaatgcatgctaaattcatcaaataaatttgggacaaattgaaaaaaaaaaaaaaaaaaaaaaaaa

SEQ ID NO: 1415 - DNA, 850 bp, Heterodera glycines
  coding sequence=SeqID_1633; coordinates=1-706
  peptide sequence=SeqID_1913
gaaaattttctctttgcttctctctcctctgtttttcatttccttaaaagcggcaatgaccagtcgaattttgagctgcaatttgcgaaggtacttctccaagatgaaccaacacatcgagttcggcacaacgaagagcgcttcgtccgacaaacaatcgccgccttcccctacaaacaatcaaacgcaacacgagggaatgagtcaggaatgtcgggagcaaatcgagcagatggaaaagctgaagagcgacaacgaaatgctgaccgacaaatacaaaagaacacttgcggacatggaaaacttgcggaagagaacgcagcggcaaattgaggaggcaaaactttttgcaattcagccattttgcaaggatttgctggaggtggctgatgtgcttgacttggcgttgaattcgttggaaaaaatgaaaacggaggacggtgccgcctccttggacagtggagtgaacaaagggatcaaaatgacgaaggaagtgttgctgaagacgttcaaaaagcatgggcttgtaccggttcaacccgaaggacagaagttcgacccgaatttgcacgaagcggtgtatgaaataccgaaggaccagtcagataggcctgccggtcacattgcgcatgtgttgaacattgggtacagtttgcacgaccgtccgattcgaccagccaaagtgggcgttgtgaagatggaatgatggccaatgtcagcgtcattttgtgtctacgtgcctttgtacaccattttattttgttatgtgcgatccgtcgctattctttcaacttacatatattgttttagcaataaattttgaatatcaaaaaaaaaaaaaaaaaaaaaa

SEQ ID NO: 1416 - DNA, 1111 bp, Heterodera glycines
  coding sequence=SeqID_1634; coordinates=31-1071
  peptide sequence=SeqID_1829
aatacatttacataacaaattttttgcttaatgggaaagacttcaaaggataaacgtgacatttattatcgacttgcgaaggaggaaggctggcgagctcgttccgcttataaattgcttcaaattgatgagatttgcaaaatcttcgacggtgtctttagggtggtcgatttatgtgctgcgcccggcagttggagtcaggttttgtccaaaaaattatatgtgagcgagaaggacgaagaaaaacggaagagagtgaaaattgttgcggtggatttgcagccaatggcgccattgccgggagttattcagctacaaggggacatcaccgaggttggcacagctcaacaaatcatttcttattttgatggttccctggcccaacttgtagtttgtgatggagctccggatgtcaccggtcttcacgcctttgatgaatacatgcaaagtcaactcgtttattcggccttcagcattacttctcatattctccaaaatggcggcacttttgtttcaaagatttttcgggctaaaaatgtgaatttgctctacgcccaaatgaaatgctttttcaaggaggtgtcgtgttgcaagcccaagagcagtcgactgagcagttgtgaggcgttcatcgtctgcaaaaactattcgcctcctgagggttacaaaccgaccctcgtcaacccaatcttggcatcagactacaatgaatgcttggctcagttggagggtccaatgaatgctgctctcgtccctttcatggcttgcggtgacctctccggattcgactcagaccgaacttacccacttaacttggaggagctgtccaacgaattcaagcaattcgactacaaatacagtcacaaagatgtgttgcaaccacccacagagccagcatataaaaaggcatgcgaaatgaagaggaactcggagttggagacaaacttggaccagcaacggcaaagaacgcaatcaaaaaaaccagcgaagaatagagaagcaaaggaagagttgcaaaatgatgtgattgccgaattagaagagggatgttttgaaagactgttgttgtgatgataaactttatgcgttatcaaaaaaaaaaaaaaaaaaa

SEQ ID NO: 1417 - DNA, 823 bp, Heterodera glycines
  coding sequence=SeqID_1635; coordinates=1-341
  peptide sequence=SeqID_1830
caattattgaagtgccactgaatccgacaaatcccagccaaccgaacatggaatttgtttacgaggctattgccactttattcaccactcatttcaaaaatttgacagagccgcaaattcgagtcacagtcaaagggttcttcagctttaaccgcacagttacaaagatgcgtgaacacatccgagacttcctcgtccagatcagggaagaagccggcgacgacactgcggaccttttcttggaagagaaagaggctgagatccagcgcattcaatcgttaaaacaagcgattcccggggttagaaatccgaacgaattgttggaggaggacatggtctgacaatgcgtccgtcgggtgggctcgtccctgccttccccgtttttgttttttccatttgtccatcctgacattaaacgatcgttcgtattttttctctgcgcccatttgaattcctttcgtctgtttttgctctccttttcatgttttgtgtccgttctgctgagctttcccctgcttcttctaatggagtttgtttctttgcttctgattgtctctactcgtctgttttggtgagagatttgattgtttctgagtgtgttcctccatccgttttgctttatgaattcgaccattgtcgaccctccattattcacagtctgtcatctcttttttaaatattttttgtctgaattatggtactgtccaatttcaaagtgacatttgtggtctattttatttatcgtttgttaaatgactgttttttaccgtataaatttgagtgcttgttaaaaaaaaaaaaaaaaaaaaaaaaaaaaaaaaaa

SEQ ID NO: 1418 - DNA, 2097 bp, Heterodera glycines
  coding sequence=SeqID_1636; coordinates=3-Jun
  peptide sequence=SeqID_1831
ttaagatgaaattattgagattgcgctcttatcttcatttttcatgtaatttgcatgttcgcaatttgacgaatttatccaaatttggtacctacaatgagaaagccattcagcttatccagcagcactatgatgaagcgacgtcatcttcacatcaatttgtcgattctccatcccaagaagtcttccgaatggttttgccacctccgaatgtgacaggcaacttgcacattggccatgccatcactgtcgccctcgaagacgcaatatgtcgctaccagcgattactcgggaaaaaagttcgttggaccccaggctttgaccacgccggcatggccactgaacaagtggtgcaaaggcaactcgcgcaacgctttggaaaacaaacggacgaaatgtcgcaatcggagtttgtcgcacactgtgaagaatggaaagaggcaagaattcgggacatttctggtcaactccgctccatggcctgttctctggattggcccgatttgttctacacaatggaccaaaatttttcccgcgctgtccgtgtcgccttttgccgtttgcattcgcttggactgatcgttcgcgagacgcgtcccgtgttcactgctctctccgcggacgaggagaagaaagcgcccgaagcggtgatgatggaacaatggtttctgcacatggacggaatgaacggacagctgagaagcgatttggaggcgggaaagttcaatttcaaacctccgatgaacaaagggatcaccgaggagttcacaaaattcaaagaaccatggaatttgagccgtcagatcgtttggggacaccgaattccggcatatttcgtagagaagtccaaaagatggattgtggccgaatccgaggccgatgcgcgcgctcaattggcctctgatgaagcggactctccgcttctacaggacccggacgtgctcgacacgtggttcagttcctcgctgattcccattgtgattgccgggtggcccgaccgaccgatttgtggccaatcgttggaactgatggagactggctacgacattgttggccattgggtagccaaaatgatgatgatttgccattgcctcacgggtgagtatccgtttacgcgtgttctgttgcacggaatggtcagggacaaccgggaaagaaagatgagcaaatcgttgggcaatgtggtcgacccactcgacattatcagagggaccggcattgaagagatggtcgagcggatcaactcctccaatttaccatctgaagagaaagcggttgctgaggcggacttgcgcaaacgctttccgcgcggaatgcgtcacaatggggtggacgcgttccgtttctcactgcttcagcacgacctgaccaaggcggtgatacgcgtggatttcacattgccgctcactgaggcgcgcaatttctgtaaccgcgtgtggaacttgtgcaaattcacgcaacgcgtcttcaaagctgcgcatggatgttcccatccatgggcggaaaacgctgaacaaacgatggcgcacgatttagcggagatgacctttgagtcagaagacattgagctgaagcgacagttggcactcgccactcgcgcctaccattgccacatgcaatcgctgaacacaaaccaagcactgcacacgctgcgcacgttcattggcgaccgcgtaaacaacgaatatttggaacagatcaaatccgttctcaatgcgcagccggcggatgagcgtcggctgagggccattgcggaaacgttgcgcgaggtggtcgccacttcgctcggtctgctgctgcccttcctcccgcagctgtgcacttttctccaagacgcgctcgcgttggacgcgcaggcggcggccacgcgcgcactgcgcgacgccagggaatatgagaagcagcagaaaacggatgatgagggaaaagaaggggagaaattgggaggagaggaggaggaggaactgaggacgacggagaaggaacggagagaatttgcttaattaattgttgctgatgttatttctgctgactgtttatgctgttatttcttttcaattgaaatttaattgcttaaaaaaaaaaaaaaaaaaaaaa

SEQ ID NO: 1419 - DNA, 476 bp, Heterodera glycines
  coding sequence=SeqID_1637; coordinates=1-388
  peptide sequence=SeqID_1832
gaaactcgcgtccattcgtcgcactttgctattaaactacgacacagaggacggactgatggagttcagacaatactccataaagtcagtgcccgcgggcgtttctcgttcggccaaaaaactgatgcagagcaaagtgccagacctgtccaagtacaaagacatcagtgacttcatgctcaaaccggagcagttgagtgacagcgaatttgaaggcgaacagacggaattggagctcacgcaggatattggcggacggggcaaaaaacgaggacagcaaaccaaattgaggttgatggaaattggaccacggatgacattacgtttgatgaaaattgaggaaggcgtcaacgcgggcactgctctttggacacactcttcaacataacatcagattcatattccaaacacgtttattttgtttttatgcatgtgcgagaaccgtttgatcaaacaaaaaaaaaaaaaaaaaaaaa

SEQ ID NO: 1420 - DNA, 842 bp, Heterodera glycines
  coding sequence=SeqID_1638; coordinates=9-779
  peptide sequence=SeqID_1833
cctttgcgatgaaagtcatcaacgagtttggctatcgtcaagatgcccgaacacccagccaaatccgcaacattgtctatcaaatgggagtttactcacatgcggacggctccgcttacattgagcagggcgagacgaaggtcctttgtgcggtttacggtccgcacgaatgtcgcttccgatcacgagccaaagaagacgaggccattgtcatttgccagtacagtcaggcaactttttcggttcctgacagaagaaacaggccgcgtggcgatcgtcgaggcaattccttttcccaccttttggagagggctttcgaatcagtcattttcacaaatttatatcctcgaagtcaaattgatatattcttcgaactccttgaggctgacggtgccaatttggccgcctgtgttaatgtcgccagtttggcactggctgatgccggcattcccctgcggggactgctgtccgccgtcgaatgtggtagtgctgatgggttgccttgtgcggatttgagttctcgtgaacatagtgaattggtaccacgcctcacaatggccaccgttggaggtaaagacgaaattgttcttatggacatgaaaaacctactccacaaaaatcatttgccgtctttgttacaaatgggcgtcaatgcgtgtgcccaagtacacatttgtctggagacagctgtttttagacatgtcgaagcatcgcatcggaaaaacacagaaagtggaaaacaaaattcgcttttgaacagaattgttgaaggtcgctaatcacagatttaatttgttggattaataaattcatatttttaaaaaaaaaaaaaaaaaaaaaaa

SEQ ID NO: 1421 - DNA, 752 bp, Heterodera glycines
  coding sequence=SeqID_1639; coordinates=1-626
  peptide sequence=SeqID_1834
caccgcaagacaaaggcggcgttattgtggcggtcgattcgcgtgcaacgggcggaacttacatcagctccaaaacggtagaaaaaatcattccgatcaacgaccaattggtcgcgacgatggcaggcggtgcagcggactgtcagtattggacgcgggtggtgagcaaatattgcaatcttttcgaacttcgcgagggtacgcaaatttcggtggctgcggccagtaaatattttgccaatgttatgtacgactatcgtggccaagagctgggcgttcactcgatggtttgcggggttgacaagttcggcccttccatttacatggtcgaagctgaagggactcgcgtgaagattgacaccatttgttcactcggttcgggcatgttacacgccatgtccattttggacaccaaatacaaggaggcgatgactgacgcggaagcgttggagttgggcagagaagccattgtgtacgcgacattccgcgacgcggcttccggtggccattgcaatttgtgtcatatcacttccgaaggaaagaccatatacccgccattcgatgtcagtgataagtattatgaattcatggcaaagagaggaactccgcttgtgcccgaattgtgagttgaacgaacagaaataccgaagagtgactggttgcggaaatgctgttttcgaatgtcataaattcactcgttatttttattaaaatgaatttaaacaaatttgaaaaaaaaaaaaaaaaaaaaa

SEQ ID NO: 1422 - DNA, 940 bp, Heterodera glycines
  coding sequence=SeqID_1640; coordinates=34-822
  peptide sequence=SeqID_1835
gcacgagggtttgagagacaaaaattatcgtaaatggctgtcggaaagaacaagaagatggggaaaaagggagcaaagaagaaggccgtcgacccatttacgcgcaaggaatggtacgacatcaaagcgcccgcaatgttcacacaccgaaacgttggcaaaactttagtgaaccgcacccagggaacacgcatttcaagtgactttctgaaaggtcgggtctacgaagtttcgttgggcgatctcaacagcacggacgccgactttaggaagttccgattgatctgcgaagaagtgcaaggcaaaatttgtttgaccaatttccacgggatgacattcaccagggacaaactgtgctccattgtcaaaaagtggcatacactcattgaggccaatgtggcagtgaagaccaccgacggtttcttactccgactcttttgcattggctttaccaaacgaaatgccaatcaaatcaagaagacgagctatgcaaagacatctcaagtacggatgattcgtgccaaaatggtggaaataatgcaaaaagaggtctcttccggcgacttgaaagaggtggtcaataagctgatcccggactccatcggcaaggacattgagaaggcgtgctccttctactacccgttgcaggacgtttacatccgtaaagtgaaggtgttgaagaagccgaagttcgagctgggcaaattgctggagatgcacggcgagggtgccggaacggtcgccactattacgacggccaccggagagaaaatcgaaagtcggccggacgcatacgaaccgcccgttcaacaaagcgtttaaatggtcagattgacaaaatggagatttatttgactgtttgcatccgaattgttttgctgttgttgttaaactgactttgtgaaaaaaaaaaaaaaaaaaaaaaaaaaaaaaaaaaaaa

SEQ ID NO: 1423 - DNA, 769 bp, Heterodera glycines
  coding sequence=SeqID_1641; coordinates=57-596
  peptide sequence=SeqID_1836
gtccaattaaggtatatatcaacatacctaattatctgacctgcagttttagcagaatgggcattttaactgcttcgaaagtatgcactttgccacggctttcttccgctcgctctatgacttggtggtggggcccggagaaaaacaatgggcgcgaagttgttggccccactttccacggggatgaattttaccaagatcgtcttgaccgttggtacccgtccattcgatttcgcaaaaatgacgaagtgatcacgcccattcgccacaaggaattgggagattggaagaagttgagcattgaggagaagaagcttatctaccgctactccttccgtcaaactttggccgagtttgaggcactgacgccttatggctatctcacagtcactttgttcttttctatgcttgggcttactattctgtacgcttcgtttgttaggacttacgtgacaaaattcaatgaccgattgcctgacactttcgatgatgaatataaagaaagtcaggccgagcgccgtgtggtactggaaaggggcaatccttatggaccggcctactactacgattacgagaaaaatcgttggaaggactgaagtggacggaaaagtcctactcgaaattcgttggagtgttttttaattttaggggatttttaatggacatttcaaatttgcacattttttcgtaaatttcttattcagtttttacgattgataaagttgggtttcagttaaaaaaaaaaaaaaaaaaaaaaaaaaaaaaaaaa

SEQ ID NO: 1424 - DNA, 2872 bp, Heterodera glycines
  coding sequence=SeqID_1642; coordinates=Jan-93
  peptide sequence=SeqID_1837
gtcccctttgacgttgaatatcaacagctaaaaaagaccaacaccccggcaaagctttacgagttcaaactcgacatgttccaaagccaggcactcaaatgcctggacaatcaacagtctgtgctggtctcggctcacacatcggccgggaaaactgttgttgccctctacgcaattgccatggcattgcgggacaaacagcgagtgatttacacgtccccaatcaaagcattgagcaaccaaaagtaccgtgaacttgttgaagagttcgaagacgttggccttgtcaccggggatgtgacactgaacccaaatgcatcatgtgttgtgatgaccaccgaaatactgcgttcaatgctttaccgaggctgtgaaattgtgagagaagtcggctgggtgatctttgatgagattcattacatgcgcgacaaagaacgtggcgtcgtctgggaagaaactctcattttattgcccaaaaccaccaatttggtgtttctttctgcaactattccaaatgccaagcaattcacagaatggatttgctatctgaagcacaaacagtgcaacatcatttacacggactatcggcctgttcccctccaacatttggtttattctgccgggtcggacggtctttgggaagttgtgaacataaagggcgagtttaaacaggacaactttgccaaggcgatgagctgtttggaggagcgccaaccgatgggcggcgaagtgcggcctcagcacggacggcggagtggcgcgaacgacgcgacgcagaagagcaacgttgtgaaaatcattagaaccattcgagagcgagacatgttgccatgcattatcttttcattcagccgaaaggagtgcgaggcgtacgcctccgaaatcaaagacattgattttaatacagaagaagagaagcgcgccatcaaattgatcttcaacaatgccattgacctgctttccgacgaagacaaaaagctgtcccaaattcggcacgtgcttccctatttaatgcgtggcattggcattcatcattcgggtcaattacccattatgaaggaagtggtcgagatccttttcggagagggtttgattaagacccttttcgccactgaaacatttgccatgggcataaatatgccggccaaaactgtccttttcacttcggcacgcaaatttgatggtgtcagtaacagatggataacaagtggcgaatacatccaaatgagcggaagggcggggagacggggcaaagacgagaagggactggtcattctgatggtggaccagcagatgagcgcggagacggccatgcaaataataaaaggcacgagcgatccactgaactcccaattccgactcacttacaatatggtgcttaatctgttgcgagtgccggacatcaatccgcagtttatgctcggcaattccttctatcagtggcagaattattcccgccttccggaccttctgcagaaacttaacaccaaaagacaacttttcctaagtgcgcatgtcgaccatttgtcggaattggaaggacttttcagattggagaagcaaattgagcagcagagaaatgccatcaaagctttggtactgaagccggcaaaagttatccgcttctttcagccaggccgaatgctcaaactcaaatgcttcgacaaggacttcggctggggcgtgctgttgaggtacaccaaaaagccgaacccactgaatccgttgtctcctgaaatgctctatttcctcgacgtggctgtgttcgtctcgcgcgaaagtgagaactgcgcgcaaaatctatgtgcggtgaaacctccgccgcccggggagaatggcgtggtggtggtgctgcccttcgctttcgactgtatccaagcagtgagcacaattcggctaaaaattcctcaagagctgaagagcaaggaggcattccaagcagtggccaagaccattctggaaacgaaaaaacgcttcgaccaactcattcccgaattggatcccatcgagcacatgaacatttccgacccgcagctgaaaaagtctttggaagagctaaaaaggtgcgaagagcggttcacggaacatccgctgagaaaccgacgcgacttcgatgaaatttgggaagcatttatgaagcggcaaaaactggaggacgaatacaaacaagccaagaaggaatttgacaacgggaaaaaactgtcgggtttggtcgaattaggctatcggaagagagtgctgcagcggttgggttacgcgacggaggaggacaccatcacggaaaagggccgtgttgcctgtgaattgagttcggccgacgaattgctgctcacagaaatgattttcactggcgctttcactgatctttcgccggccgatgccgcggctttgctttcgtgtttcgtttttcaagagagagcaccgattggcaaactaagcgattcgctaagtgaacatttgcgcactatgcagggcatggcaaagaaaatagcaaaaatctcgattgagtgcaaattggaactggacgaggaaaagtacgtggagtcgttctgtcccgcgatgatgaccgttgtctccaagtggtgttcaggcgccacattcgccgaaattctagaaacgtccgatatattcgagggcagtataatcagatgcatgcgacgtcttgaagaattactgcaagaaatggtgaacgcagcccggtccatgggtgaccggccactggaacaaaagtttgagcaggcccgatctctgcttaagagggacatcgttttctcagcgtccctttatctctaatttgcgatcctttttttgttaatacatttaacatgttgcgcaaaaataaatattcattaaaaaaaaaaaaaaaaaaaaa

SEQ ID NO: 1425 - DNA, 1073 bp, Heterodera glycines
  coding sequence=SeqID_1643; coordinates=39-995
  peptide sequence=SeqID_1838
gcctcgtgccgaattcggcacgaggctttttttaaaaaatggctaacaaaatgaagaaaaagaagaaaaatgctgttgctactacaactgctggaccccaaaaggatggaggcaaatttaagcagaaagggatcaaattcaacacggaaaagggccaacacattctgaagaatcccggcgtggtccatgccatcgttgagaagtccgctgtcaagggcactgacactgtgctcgaggttggcccaggcaccggcaatttgtccatgaaattgttggaccgtgccggccgtctgattgcctacgaattggaccctaaaatggtggcagagctgcagaaacgtgtggtcggaacacccgtccaatacaaattgcgtatcattgctggcgatgtgatcaaagcagccgagtggcctccgtttgatgtgtgcgtctccaatttgccctaccaaatttcatcaccgtttatttttcgactattgctccaacggccattgcccaggtacgccgtgctgatgctgcagaaggaattcgccgatcgactgttggccaagccgggcagtaaggtgtattgtcggctgtccgtttctgtccaattattggccaccgttgagcatctgatgcgtgtgaagcgttccgaatttgtgccacctccaaaggtggactcggccgtcattcgcattcagccgcgcaatccgccgccggccatcaattacaaggaatgggatggaatgttgcgcattgcgtttatgcgcaaaaacaaaacactgtcggcgctgttcaagcagaagcaggtggtcgatgtgttgcgcaaaaattacgcagtcgtttgcggcacgaagggaaaggaagtgccaactgatttttgcatgacctcacacattgaacgggtgttggaagaagcacaatttgccaagcggcgtgcccggacaatgtcaattgaagactttttggcactaatgttaacatttaacaaggcggacattcatttttgttgattgtggtggttatttgtttccttgtttcgttttcacaaaaaaaaaaaactaagtaaaaaaaaaaaaaaaaaaaaaaaa

SEQ ID NO: 1426 - DNA, 1789 bp, Heterodera glycines
  coding sequence=SeqID_1644; coordinates=1-1705
  peptide sequence=SeqID_1839
cgtagtcatcatgttgtctgatcttaccatgggagagatgaaaattttgcccaaagatgtacaactttgtgctgaggttgcgactggtgttgaacggatgggccaatatcagtaccaagacctggtgatgctggataaagaaacagttggagtaatcgttcgtttggaacgcgaaaatgtggaagttttgagtatgcatggcaaaatacttcgtgttaaccctcaaacgattgaatgcaaaaagaattcgcggttcgtcaaggcacttgattctcaaaagaatacaatccaagcgggagatacggtcaaagttgttgagggcttcctggcgcgaaagaaggaaactgaagaagaacgtcagggcgagatcaagcatcttttcagaaattgggccttcgttttttcacgtaaatatccacaaaacgggggaatgtttgtttgcaaagcgcggaatttggcattgattggtggaagcaaagcgtcggagtcacaaatcaacactactattttggataacagtcaacttatgagtcctcgtcctaatccgctcgaaagtcctcgcaccattcacggcggaatgactccccattccgggtcaagtgttgttggtgcacaatctgtccgtggcgatcatggttttaaagcaccaagtgtggtcgggagcatcgcaacatcagcaaccggagttggtcggcaacatgtacgtcggaacatggaaataatgggcaaaactgtgcgcgttctggctggtccaatgaagggttacattggaattgtgaaagatgcaacggaatcgactgtcaaggtggaactgcacaccatgccaaaaacggtcaattttgacatcaacaaagtgatggaggttggtggtgccgtcccgagggaattgatggacactgctggcgcaatgactccgggaacggccaccattggcgggcgaactccgatgtacggaggagcgcagacgccaatgtacggtggagcagcaacgcctatgcacgactcattcggtgctcgtactcctcattacggctctatgaccccggcttacgacggcagtcgaacgccttcgcaccaaccatcttcgtcttgggaccctgctttggccaatacgccggctcattcaactgctcattttgacaatgaatttgacacaatgggatttggcggaggagcatcaacgccggcaggttctgtgagaagccgacttgggggagcgaatactccaatgggccaaatgacaccgcgagatatgttcggcgattattcttcaagcccttaccccaacccaagcacaaatgcttcgctgcatccgtcgaaaacgcccattggtcagtcaccggcacttcaggaaataatgcccgattccgaaattcccactggttcatggtgtatggtcgacctgtgcgtcaatgttcttccgacatgtggaaaggaccaacttctcggtttagaaggctcaatacggtcaattagagagggcgaatgttgtttgtatttcgaggagcttgacgatgacttcactattgagcacgaacatgtggtgcccattcgaccggcaagtggagaccaggctaaggtcatttatgggcacgatcgtggggtgtctggctctttaatcaccacggaaggggaggatggtgtgctgcaggggccgaacggggcaaagctttattcgatgtccgttctttgtaaacttgtttgatttgaatttgataatccgattttattgttcaaatatatttggaaattaaattattgtgccagcgaaaaaaaaaaaaaaaaaaaa

SEQ ID NO: 1427 - DNA, 1046 bp, Heterodera glycines
  coding sequence=SeqID_1645; coordinates=1-972
  peptide sequence=SeqID_1914
gaaatgtctaaaagagagaatcaccccgaaaaggaaagggaagaaaaccgcgccaaatttctccgctcgctcatcgatgatgcccatttaattttggcacatggaaacccaaaaatcatcgaccatcgcatttcacattctgaccgttgcgagtccttttggataagggccggttttctccctctgtacgagagtttgcccgtttgggaaatggaaaaagtgccgtccattcgaaaagtgaagttcaccggcgatgacagacgccgtcttggcgaactttcctttacaatgcgcgacaaacatacgatgcaagtgcggacgaaaagcccaatgaaaaggctcttcgattgggatgaacctgacaaactcgaggcaccagtgtttccgccgtcttttgacgttgcggatgaattgataatgtcacccatggtttataatcttctcgccgacacagagccattgtggcaatgcccaggctacgaatatgactcgggtgaaacgcataagtacggtcggttggctatcaaggacattactccgctgatcactcgtctggacactcattggcgttgcgacacggaacatgagcgaaaggaagtgctcagagaatgtttggccgcaacggcggtcgtatctctcttcaattggttgaatggacaagcgcattgtcttggacacactcaatacacagaaattgtcgccccgttgagttcccaattgatactttctgacggcttgcaattgttttatttcgctctcggtcaactcaacactctcgcaattaacattgatgttgaaggcttcaataatcagcggtccaatttttgttgtgttaatggacccttcaaactgtacgatgaattcgatccggcaacgaaaaccgtccgacacgtcgacccttcggatggcctttcgaaggacggactgaatcccctcgtgttgcaccgaatcctccaaatgtgtgttgtttaattgtgagtgatacaatatttctcctttttgtttgaataaaattacattttttcaaaaaaaaaaaaaaaaaaaaa

SEQ ID NO: 1428 - DNA, 1494 bp, Heterodera glycines
  coding sequence=SeqID_1646; coordinates=49-1416
  peptide sequence=SeqID_1840
ggtagtctataagtgataatttatcactgttaattattatcattaacaatggtagccgcgccagatgaagcgcaatttcatatttcgttttacactgacgaagaagagtgtaagaatttgttgcctgccgagtccatcaatgtgcccgcgtcttcgcactcggaccaactcaatgtgttgatcaaccaaatcgggtcgatgaacgatgacagttggaagcccgtccaattcgactttctgctccattccgtgctgttgcgctgctctctgctcgagttggtcgagcagcaacagttgtccctggagaatgtgctgcgcatcgaatgcattcgccagtcgcccgctccgcggccgaccgccgaactgaacgaagcgcaatgggtggccgatcttagaacattgagccacaattgtgttttgtccgtgaattttgccggtctgctgaatgtgtgggaattggccggtgaatggaccagagccgtcgtcaaacaattggacgacgaaccgttgaaatgcgtggacacattcactcgggacgacggaacaactttcgctttgagtggaggtcaaaaccaaactttgactttggtgcgactgcgggcgcagaatagggcggacgacgaagacgaaaatgaggcccaaagcagccgaggcaaagggaaatggcgcgcggagccgacggcaattttcaggggccaccagcgttctgttgaatgtgttgcgataaatgctcgaggaaatcgtgccatttccggttcattcgacaaatgcctgaaggtttgggacattgaaaacacaggtgatcagaatggaatgccaatggcgggcaaaaacacaacgagaatgaactcgacaaagcgtatgcgaatggacgtgccaaagattactccgatggtcactttggaatcgcatcgcgagcctgtggtcggctgcgcgtggcatccgtccaacttgagccaggcgatcactgcttcatgggaccatcagctgatgctgtgggacctccaattggcaggccccatctccacgctgacttcgaataaagccttttccgcactttccgtctgtccggccaatggccttgtgctgacctcctctgtcgattcgttggttcggctttgggattttcgttccagggatggctcaatggtcaaggcatcgttccatggtcatgttggcgttgtgtccgatgtctgttggcactcaaccgaccagcatttgtttgtttcggccagctttgacaacacagttaaaatgtgggacgtccgcagccccagggcggctctatatgatttgatgggccattcggaccgcgtgctgtgcgttgattggacagtgccgagccgtatttgcagcggttcggtggactcgacggtgaaagtgttctcacatgggaccgaagaaaatatctactagtaattgtttatcgtgatatcattgttgttttgttatagttaaaatttctgtacaaaaaaaaaaaaaaaaaaaaaaaaa

SEQ ID NO: 1429 - DNA, 1962 bp, Heterodera glycines
  coding sequence=SeqID_1647; coordinates=1-1797
  peptide sequence=SeqID_1841
ccgaagccgacactgcgttttgcggccgtccgaacgttgaaccgaatttccattgactaccctcaggcggtgatttcgtgcaacgtcgacttggagcagttgatcacggatagcaatcgttccattgccacattggccatcaccacgctgttgaagacgggtgccgaggcgagcgtggaacggctgatgaagcagattggcacttttgtcagcgagatcagcgacgaatttaagattgtcgtcatcgaggctatccgttcgctgtgccatcgctacccgcgcaaacacgccacactcatgaactttttggcctcaatgctgcgcgacgagggcggtttcgactacaaaaaggccattgtggacaccatcatcaccatcgtggaggacaaccccggcgccaaggacttgggcctgtcccatctttgcgagtttattgaggactgtgaacacgccgcattggccacccgtgtgctgcatttgctcggccgtgaaggaccgaccactgcgaacccgtcccgttacattcggttcatctacaatcgcgtcattttggagagcactcaggtccgtgccgccgctgtcactgcgctggccaaattcggcgcggagtgtgcacagctgcgcccgtccattctgattctgctccagcgctgtctgctggacacggacgacgaagtgcgcgaccgggccaccttttatttggtggtgctgcgcacggagaagccgcaactcatcctcaactacatcctggacacgctgaaggtgtccgttgtcggtttggaacgcgcgttggagcagtacacaagtgctgctcattttgatgctccatttgacctgaagcaagtgcctttatccaccgagccgttgaccgcttcaaccgatgaggtgaaaaagaaagcggcgatggtggacgatgcatcggcggccatgaaaaagcagaaggaggagaagaaaagcggcacttcccgacaggagcaatttgcacttcaattggcgtccatgccggactttgccgcctgcggtgccctgttcaagtcgtgtgccgcggttgagctcaccgaaaccatcactgaatacaatgtgtcatgtgtgaagcacattttcaacgacgactttgttcttctgcagtttgactgtcgcaacactttgaatgaccaactgttggaggaagtttttgtcgaaattgagccgcaggatgagggcgaagattgcccttggcatgtgcaaagtgttcacccgttggcccagttgcccttcggccagcccggcaccacttatgtgctgctcaaaatgccggaggacggacgcattgccggcacatttggcgccaaactgaagttcaaaatttgcgacgtcgacccggcaaccggcgagccggaaagcaacgatttgtacgacgaagtgtacgcgttggagcccatcgaagttggccttgccgactttctgttggccaccgcgccgaagggcgcttcatttaccaccgcgtgggacgcgctcaaggaggaggggcacgagacggaggagtcgtacgcgctgtccaatgtgcacacattggaagatgccgtctccaaactgctcaaatgcaccgcccttttcccttgtgagcattcgaatcgggtgccggagggcaagtcgtcccaccagctgttgctgtgcggcattttccgtggcggcatcgatgtgctgtgccgtgtccgcctggtcatggacccatccgaccagacggtgtccatgaacatggttgtcagatcaatggacgaaacagtcagtcaaatgatcgcaaacattgtcagctgaggaacggcaaaaaacattcatctgttgttacatcaatgataatatttctaaatttacactatttgattgaaggctggattttatttatttactcgttttttgttttattgtgtccacaaaaataataaaaagtctttcggtcaaaaaaaaaaaaaaaaaaaaaaa

SEQ ID NO: 1430 - DNA, 729 bp, Heterodera glycines
  coding sequence=SeqID_1648; coordinates=1-625
  peptide sequence=SeqID_1915
ggcaatgtcatctgattttggaaaccctctgaagaagttcaaactcgtgtttcttggtgaacaaagcgttggaaagacttctcttatcaccagatttatgtatgacagctttgacaatacgtaccaggccacaattgggatagattttctgagcaaaactatgtatcttgaggacagaacggtcagacttcaactttgggatactgctggtcaagaacgctttcgttcgctcattccgtcgtacattagggactccacagttgctgttgttgtttacgacattacaaatgcgaattcctttcatcaaacgtccaaatggattgacgacgtgcgcaccgaacggggcagtgacgtcatcatcatgctcgtgggcaataaaactgatctcgcggacaaaagacaagtttcaacggaagagggcgagcagaaggcgaaggagctgaatgtgatgttcatcgagacatcggcaaaggctggttacaacgtgaagcagcttttccgacgaattgccagcgcacttcccggcattgaggtggaaaaggctgcggacgcaaaacaagtcgttgacattggcccgattaagccccgtcagattgtcactgaagagggttcctgttggtgttaatatgtgactttgtgttctgttgggttcccgttaattattgtcgttatttattcacattgtattaaatttctcgaatttaaaaaaaaaaaaaaaaaaaaaaaaaa

SEQ ID NO: 1431 - DNA, 1499 bp, Heterodera glycines
  coding sequence=SeqID_1649; coordinates=14-1327
  peptide sequence=SeqID_1842
cgaattgcagcaaatgtctgtgcctggctctcaacctccgcaacagggcgaggacgccgaggagcggctgatcaacgaggagtacaaaatctggaagaaaaactgcccgttcctttacgacatggtgatgactcatgcgttggaatggcccagtttgaccgtccaatggctgcccgacgtgcaacgacaggagggcgccgactacacaatccatcgcctcattttgggcacgcacacgtcggacgagcagaatcatttggtcatcgccaaactgttactgcccaacgacgacgcacagtttgacgcgtctcgctacgacactgaccgaggcgaatttggtggctttggcacagtgaccggcaaaattgaggtggaaatcaaaatgaaccacgagggcgaggtgaaccgggcccgatacatgccacagaatccggttctgattggcaccaaatcaccctcctcggaggtgtacgtctttgactacacgaagcatccgtccacgccggctgacgtggagtgcaagccgcagttgcgactgcgtggccacaccaaggagggatacggcttatcctggaacaacaatttgcctggtcatttgttgagtgcctccgacgacatgaccgtgtgcctgtgggacattcaagcggcgactgcgaatgccaactttttggacgcaaaatccattttcacagcacacactgcggttgttgaggacgtggcatggcacgttttacatgacacagtctttggttcggtcggcgacgatcacaaactgatggtgtgggacacgcgcacgaacagctccacaaagccaacccatgttgtggaggcacactcggccgaggtgaattgtctctccttcaacccgtactcggaattcattttggccaccggatcggcagacaaaactgttgcgttgtgggaccttcgtaatttgaaattgaagctgcattcatttgaatcgcacagagatgaaatatttcaagtccaatggtcgccccacaatgagaccattttggccagctcgggcaccgatcgccgtctgcacatttgggacctgagcaaaattggcgacgaacagtcgccagaggacgcggaggacggaccaccggaactgttgttcatccatggcgggcacacagccaaaatcagtgacttttcgtggaaccccaacgagccgtgggtgatctgttcagtgtcggaggacaacataatgcagatttggcagatggcggacaacatttacaacgaggaggagttggacccggcgatggtggaaagtgttgcggccgcaagcggcgccggtccgatgggccaacaacattgaacagcaccagaacttattcaaaattttgatgctaatgatgatgattgatgataatggtctctgtttcctcaacaacactaaatatttattttctgtcatccattttttatgtttttgtttttgaataaagcgccgatattatggaacttaaaaaaaaaaaaaaaaaaaaaaa

SEQ ID NO: 1432 - DNA, 2051 bp, Heterodera glycines
  coding sequence=SeqID_1650; coordinates=54-1796
  peptide sequence=SeqID_1843
ttggtccctacttctgatcaatcccgttatcctctcccaattttgtctgcaaaatgtcggacgactatcgcagttcgattggcccacggcctgcgttcaaccgcaactcaacagcctattcaagtacgggcggacctgtctcgggcggcaaccgcgtgctgaaaattgtcacggagacaatgtcatcgagcaccagcggcggcggcggtggcatgtcaccgtttggcgccaacgcggcacaaatccgtgactcccgtgatcgcgagaagaaggagctgagtgatttgaacgatcgattagccaattacattgaaaaggtccgcttcctcgaggcccagaaccgcaagttgaaggcggacctggacatgctgcaaggacgccgcggcaaggacaccatcaccatcaagaccatgtacgagagcgagattcagacggccaaaaagctaatcgaagacacgggccgatcaaagcacgagttggagcaggacgtggccaaactgcaacgtgacttggacgagcagcgccgcaaatacgaggaagctgttcgctcacgggccggtgaccgtgaaaagttggacgatttgctggtccaattgagcaatttggaggccgaaatcagcctgttgaagcgtcgcattgccctgctggaggaggagctgagcaaactgcgcaaggagaactcacgactgcaggccgacctgcagcgcgtgcgtgccgagttggatcaggagacgctgaaccgcattgactaccaaaaccaagtgcagacactgctcgaggagatcgacttcatccgacgctcgcatgaccaggagatcaaggacttgcaggcgatggccgcccgcgacacgaccagcgaaaaccgcgagttcttccgcaacgaattggcatcggccatccgcgacattcgcaacgagtacgacgtgttgaacaacaaagaccgtaacgacattgagtcgtggtacaagctgaaggtgcaagagattgagacgcaaagtgcacgacagaacatggagcagggctaccagaaggatgagctgaagcggctgcgcgttcagctgacggatttgcgcggcaaattgtcggatttggaagcgcggaactcgctgttggagaagcagatccaggagctgaactaccagcttgaggatgaccagcgcgcttatgaggacgcgctgaatgcgaaggatgcccaaattcgaaagatgcgcgacgagtgccaagcgctgatggtcgagctgcaaatgctgcttgacaccaaacaaacgttggatgccgaaattgccatttaccgcaaaatgctggagggcgaaggggacgggcccggcctgaaacagttggtggagcaggtggtgcgcaccaccggcatcaacgaggtggcggacacagaaacgatgcgtgtcgtcaagggcgagacgtcctcccgccagtcgtaccaacggtcggccaagggcaatgtgtccattttggagacgtcgccggagggcaaatacgtggtgttggagaacacacaccgatcaaaggaggagaccattggagagtggaagctgaagcgtcgcattgatggcaagcgcgaaattgtgtacacattgcccgccaactttgtgctccgcccgatggcccgtctgaaggtgtgggcccgtaaccagggcggcctgcacgccccgccggatcagctgatcttcgatggcgaagaatcgttcggcgtcggctcaaacgtgcaaaccattctctataatgcgcaaggagaagaacgtgccacgcacatccaacgttcaagccagacagctgcctgaagaggaagagagagataatgctgataagagtgatcactgggggacggaattttaaattttttaattatttttcgaaaaatcgaaaaatgcacccccccccccctcctaagaattgattttcttttttaattttcaaaaaattccccttatataaaattgattttttcaatgaccaaccgacatttaaccattaaattttaacaaattggataaagtgacaaataataaaaaaaaaaaaaaaaaaaaaaaaaaaaa

SEQ ID NO: 1433 - DNA, 805 bp, Heterodera glycines
  coding sequence=SeqID_1651; coordinates=1-504
  peptide sequence=SeqID_1844
gagaatttgaagttcaaaagagagagacgagaaaagttcagtcagtcggcggcgattccttcgaatttgcccccttcgacaagcaatggacaaatgggttcgcttcttctgcacgatgaaatggcgtccgcttccagcggttcttcgacctttgcgttggacatggataaattggagcaacagcgggtgcaggaacagaccactctactgctcgacgataccgaacagttccaccaatcccggttcaacgccatggaaagcattgaaagcagcatctctgagctgggcacgattttccgccagttggccactctcgtctcggaacaaggcgaaatgatcacgagaattgactcaaatgtggaggagagcagcctcaacgtggaggcagcacaccacgagttgctcaagtatttcaacaacatttcccgcaaccgttggctgattatcaaagtgttcggcgttctgatggcattctttgtgttctttgtgattttcctcacctgatcggctgataaactcagttctgcggggattccttcacattgtcatcataatcactcacagaattttattctcttaaacagcagtcaaatcattgaccaaatattcctaacttattacccattctttattgtgttaattgttggtcatcattaggtctttctgaaaatcgctttgtgacggttccattcgcccgttccttcttctgtttaaactctcccactcctctttagtccatgtgatagctttgcgactcttccgcttctgaataaattattttatgtaaaaaaaaaaaaaaaaaaaa

SEQ ID NO: 1434 - DNA, 1178 bp, Heterodera glycines
  coding sequence=SeqID_1652; coordinates=63-1094
  peptide sequence=SeqID_1845
cacaatcttatctacctagttattttttcatttgatcaactacacgattaaaagcgtcaatcatgggcaagggattccaaaattttatgtccaagaaggacttccatccaagtgcatggtggaacttaaaaaggaaatgggaagctgagcaaaagaatgacttggagaaaagaagacaggatgaattgcgtgtccaatatgagaaggagcaagaaattctcaacaataaggcacttcttggtgacgaaaaagcgaggttgggcctttctttcatgtacgatgcgcccgctggcattaacaaaaagaaggaggaagggccggaaccgaaattcgaatggcaaaggaaatacaatgcaccgcgtgaagaatgggcgaaaggaaatgaactcatccaggaccaacctttcggaattcaggtgcgaaacgttcgctgtgtcaaatgtcgcgcgtggggtcatttgaacacggaccgcgaatgcccactgtatggtatgagtggaaatgctgaagaccatggctatgcaaataatccctccgatatcattcgtgatttaaatgtcgaaaagaaaacaaagactgtctctgatgtcacgaccaatgagcagattgatataaaaccgaaaattgaggtgcgcaaaagccacgaagagaagaaaaagaagcgacgccattactcatcggaagaagaggaagaggggacggaagaagaagaaaagaagccggaaccgatcgatcaggaacaattgctggtgaacatgcgtgaggagcacaatttgaagttcaagaccggcattctgattggtcttcgagcggacgaacacataaaaaaaatgtcagcgatggttggaggaggagaggaaaaaacttttgaggcttttctgaaaggactggatgagaaaaaacgaagaaaattaatgaaaaaaatcatgaagactgaagtgagcgatgactccgatatcgagaaggacaaaaaacagcgaaggaagcaaaagaaggaggaaaagcgcaaggcggacaaaaaacacaaacatcgcaggtcgtcgagtcgggagaccagcagaaagcggaaggaggggaagcaccaccgccactgaaaaagggaagcggactcattcttcggattgccaccatttgtataataaaatgtaatcgcttttaaaaaaaaaaaaaaaaaaaaa

SEQ ID NO: 1435 - DNA, 808 bp, Heterodera glycines
  coding sequence=SeqID_1653; coordinates=38-676
  peptide sequence=SeqID_1846
ctgaaatataaaccacaaataaaccgacaaaaacgaaatggctccacgaggaaacaacatgcttcccaatgcccacttccacaagcattggcagcgtcgtatcaaaacttggttcaaccaaccggcacgcaaggaacgtcgccgcgctgcacgttccgccaaggcggcccgattggcaccgcgtccggccggcggtctgctgcgccctgttgtgcgttgcccaagcgttcgctacaacaagaaatgccgggtgggccgcggcttcacactggaggagttgaagcggtccggcatgggcaaataccaggccagatcgttgggcattgcggtcgacacacgccgtgttaaccgatccgttgaatccaccgagcgaaacgttgcgcgtctcaaggaatatcggtctcgtttgatcattttcccgaagaagatgaacaagccgaagaagggcgacagcagtccggaggagttgaagctggccgcacaaatgcccggctctgtggtgatgccgccggtggtcaaacagcgccggttgaaggccgagccgatcaccgaggcgatgaacaaattctccgcctattgtcaccagcgtcgcgtgcgggcggacaaacggttgaagggcaagcgagaaaagaaggccaaggaagcggcggacgaagggctgggcaaagggcgttgatcaatccttggacgatcagtggcgatcacaatttattgattttgcttgttacaatccaatttccttgttgcgcactgtgcatgaaaaaaaaatgcaaaatgtgttaaaaaaaaaaaaaaaaaaaaaaaaaaa

SEQ ID NO: 1436 - DNA, 946 bp, Heterodera glycines
  coding sequence=SeqID_1654; coordinates=56-676
  peptide sequence=SeqID_1847
ttttataaaacttggcaaaactcttattaattgccgttaaagattgatttgaagaatggctgccatgaatcctgaatatgactatctcttcaaattgctgttgatcggcgattctggtgttggcaagtcgtgtctgttgcttaggtttgcggatgacacctacacagagtcgtacatttcgaccatcggcgttgatttcaaaattcgcaccattgagcttgaggggaagacgattaaacttcagatttgggacaccgccggacaggaacgcttccgcacgattacgtccagttattatcgcggagcacacggaatcattgttgtttacgacattacagaccaggactccttcaacaacgtcaagcaatggctccaggaaatcgaccgatacgcatcggagagtgtgaataaacttcttgtcgggaataaatgcgatttgaccaccaaacgtgcgatagagacgaatgttgccaaggagtatgccgaccaattgaacattccattccttgagacttctgccaaaaactccactaatgttgaacaggcgttcatcacaatggccactgaaatcaaaaatcgcatgggccctcttcaacaggccggtggcaatgcgtccgccgtgcgcattggtccgtctcagccggtgcaggacaaaaaaacgggcggatgttgctgagttagccaacggaggacagcgcagggtggacaaaacaaagttgtgagaatgtgcgtgaaagtgatttaatttccggcggacgaatgtttgtgcggcgttcgttccccccccccccatttcgtctcttttctttcgtccatttgtatgcctatgcatcaattatcaatggatgataatcagtgggaacttttgacacatgctttttgtattggtttataagtaaaagtttaatgattaaaaaaaaaaaaaaaaaaaaaaaaaaaaaaaaaa

SEQ ID NO: 1437 - DNA, 1542 bp, Heterodera glycines
  coding sequence=SeqID_1655; coordinates=1-1308
  peptide sequence=SeqID_1848
gtttgttcactttcgctgactgttacagctgcactgatggacaattacaaggtcaatccaaaggacattggctttctcgcggttggcaccgaaacattggtcgacaaaagcaaaagtgtgaagtcagtgttaatggatttgtttgccgattcgggcaacatggacttggagggcgccgacgagaaaaacgcgtgtttcggtgggactcaggcgttgttccatgccgtcgattggatgtacgctaattacgcaacagaaaaacgccttgccatcgttgtctgtgctgatgtggcagtttattcggctgggcccgcccgatgtacgggcggtgccggtgcagtggcctttctgattggaccaaatgcaccgattgcacttgaacgtggccttagggcatgccattctcaaaatgtttacgacttttacaagccaattggaggcgttagcacgcaattcccacgagtggacgggccaaacagtgtggagacctatttgaacgccgttgacatgtgttacgggcgattttgtgagaaatggaacaagaaattctgcacagggcccccttgctctctttcggattttgtcgctgtcattttccactcgccgtacgctcgtctcacccaaaaagccttttcttggctgtccttcgtcgactttaaacggggaatgatggacgatggtgtcacagctgatgatgatgatgtgtctgattgggatcaactcagcgcatacaaatcgaaatcactccatgagatttttgcggtggaacgcacaaaaactcgctcggacggcgatcgatttactgacaaaattttgcggatgagttcgcggacagcggatgccaaactgaatccatttttggagtttagtcgacgcattgggaacatgtacacgccgtcggtatatgctcagctgatcaacgtctttctgaacactgaactttccgataaatcgaacgggaaacggatcctcatattttcttatggcagcggttgtatcgccgcaatgtactcacttcgtttcaatttgtgcacggaaaaactgatggctgcctacggcgcaattaaacaaagcgcgaaaaaggcacacgcgcgattggaccagcggatccgacacagccccaaacagttcacagccgcattggagagaacggagcaaattgtcgctggaggggatacttacatcgaaactcccgatgatggcaaacgcagtgatggcattccaatgtttgccgggaccttttatttgcgagaaatcgactcaaaacagagacgcttttatggccaaattgatgatgccaatgagtgatgacagaaagggaagaaaaaacgcaatattcgacgaaatcccatgacattcccttcccttaaggatggcgtcggtccttaataattttattgtcccatcactttccaattgtccccgccttccgtccatttttaatttctatagatgacaaattattttttataattttatctcatgaagctcagttaaattttgtgattcttaaaaaaaaaaaaaaaaaaaaaaaaaaaaaaa

SEQ ID NO: 1438 - DNA, 1057 bp, Heterodera glycines
  coding sequence=SeqID_1656; coordinates=18-902
  peptide sequence=SeqID_1849
taaaccaaaatatcaccatggttttcgtcaaggccgtcaagaacaaggcttacttcaagcgctaccaggtcaagtaccgtcgtcgccgcgagggcaagaccgactactacgcccgcaagcgcctcgtgacccaggccaagaacaagtacaactcgcccaagtaccgccttgttgtgcgcatcaccaatgccgacgtcatctgccagatcgtctactccaagatccagggtgacttcgtcttgaccgctgcctacgctcacgagctcccccgctacggcgtcaaggttggtctcaccaactgggctgccgcctacgccaccggcttgctcgttgctcgtcgtgccctcaagaagttgtcgcttgacgacaagtacgagggtttcgtcaaccccgacggcaccatcgccgaggtcgagccccttgaggacggtccccgtcccttcaaggccttcctcgatgtcggtcttgctcgtaccaccactggtgccaaggtctttgcggccatgaagggtgcctcggacggcggtatcttcgtgccccactccgagcagcgtttccccggctacgaccgcgagtccaaggagctcgacactgatgtgctccgctcgtacatcttcggtggccacgttgccgagtacatgcgctacttgcaggaggaggatgaggagaagttcaagaagcagttctcgcgcttcattgccgagggtttggctgctgatgatctcgaggagatgtacgagaaggctcacgaggccatccgtgccaaccccgaggccgtcaagtcgactgtccagatcgacgtcgagaaggtcaagaagttcaagaagcagcgcctcaacctcaagcagcgtcgtgaccgcgtcaagcagaagaaggctgccttctttgcccagctcgagtaagtctcaagatgttgcttgtttcttgtttcttgtttccctctgcgtcaccatcctgccctgcagttgtcggatcgccttgtgtgtgcctcaatgcatgtggtttgaccttgaagttgagaaaaaaaaaaaaaaaaaaaaaaaaaaaaaaaaaaaaa

SEQ ID NO: 1439 - DNA, 813 bp, Heterodera glycines
  coding sequence=SeqID_1657; coordinates=124-633
  peptide sequence=SeqID_1850
tgagttgggacgacctcttttcatgaatgctgaattgcatgtccttccataaatagtcattaattaacgcaaaaattaacgacagcagcaaatctctgttataataagcgttttgagtgcaaaatggccggtatcgcagcaggaagactgacggaggagcggaaagcctggcgcaaagaccacccattcggtttcatcgcacgacagtgcaaaaaggaggacggcacattggacctgtacaattggatctgtgccattcccgggcccaagtcgaccatttgggagggtggcctgtacaaattgcgcatgatcttcaaggacgacttcccatccactccgccaaaatgccgctttgagccgcctctcttccatccaaatgtttatccgtccgggacggtctgcttgagtctgttagacgagaacaaagactggaaaccgtccatcaccgtgaagcagttgctgctcggtatccaggaactgctggtgtcgcccaacccggaggacccggcacaggcggaggcgtaccaaatttatgtgcaaaatcggcccgagtatgagcgtcgagtgcgcaaacaggcccaacagttctcagaggaccaggtgctgaagcagttgttgacggacgacagctgaacggacgacggacagaacggagcgaccatttttttttatctcattttacactcactcgtccaagagagagtgtttttgcttccccccatttttgttcaatgttttgctattatgacgaaacccaaagaaaaagtgtgtttttgtgtactttgtttcgtaaaaaaaaaaaaaaaaaaaaaa

SEQ ID NO: 1440 - DNA, 571 bp, Heterodera glycines
  coding sequence=SeqID_1658; coordinates=30-449
  peptide sequence=SeqID_1851
cagcagtccaaaaacaaatttcaccagcaatgatttaccaccgatttgttgagattggccgtgtcgtttacattgccaaggggaaggaccaaggcaaattggcagtcattgtgaatgtcatcgacggtaacaaggttttattggacggcccctcctcgggtgtgcctcgcggtgtttggaatttcaaagacttgcagttgacaaaattcaccctcccactgcgtatcggccaacgtacgaaaggagtgcgcgaggcttatgaaactgccaaaatcaacgagttatggcaaggcactgagtgggcaaagcgcattgatcggaaacagaagcgtgccgggctcaacgacttcgagcgcttcaaagtgttcaaagccaaacagcaccgaaaccgtttggtccgcgttgagatggctaaactgaaaaagatttcgaagccgacagcgaagtaaatgactgaatttggcctgatcatattttgaacacacaaatgccgtcttttttgttgatgaaattatttgttggagttaaattgttttttaattcaaaaaaaaaaaaaaaaaaaaaaaaaaaa

SEQ ID NO: 1441 - DNA, 1192 bp, Heterodera glycines
  coding sequence=SeqID_1659; coordinates=39-974
  peptide sequence=SeqID_1852
gtattcttttaacatcaattttggattccaacaataaaatgattggggaagagcttacggatgttgacaaggctcgcattgcgtcagacattctgcttcagtcgccgccgggcgagttcaacgaggtgttcaacgacgtgcgcactttgttgcagaacgacgcacttttggaaaagggcgtctgtctggaggcggtccggcgctacaacaaggcacagtttgtgccggtcaaccccgagccgggcgctgaacacccgactttgatcaccgaacacaacgaattgccggacggacgtttcgtggacccaaaaacgggccgtgttttcaaatacgaccatttgcgaaaggaggcggccgatgcgcagccgtcggggcccaaggaaattgacgaaaaattggagccatggcgaaaggcactgcaaaaagagttggacgagtacatttacgagcatttccatctgaccggcgtcgccactgttttcacgccgttgcagcaccaaaaagagccgaaactcattctatgcattgagtcccatcagttccagccaaaaaactattggaacggtcgttggcgttccgaatggcattttcccaactttgacggctcttcaaaaacggcggggactctccaaaaatgcacgggcaaattgcgtttgcaggtgcactattatgaagacggaaatgtgcagctgatttcggagaaagaggcgacggtggaagtgaaaatgacgaatgaccgggagacgagtgcccgtgaactgttgcgggcaatttgcgaagcggagtcagcttatcagacctccatccaggagtcccaagtgcaaatggagagcaccttcaaggcgcttcgccgtcagttgcccgtcactcgctccaagctgaactggctgaacttccactccttccgcatcactcaacaggacatgaaacagccgccgacgcccaccgtcgctgtccaacaacagtcccagtgaaaaacaacaaatgaacggactgacggacggatgaatgacaccgcaactaattggagagagacactttcgcgtcctcaccactcatttgtttagttgtactcattcgttcttcatttcattaggcttattgggtgcgggcatttattaaccgtttggaaatggtgctttgcgattccttccattaaatttgtccaaatttaaaaaaaaaaaaaaaaaaa

SEQ ID NO: 1442 - DNA, 649 bp, Heterodera glycines
  coding sequence=SeqID_1660; coordinates=34-513
  peptide sequence=SeqID_1853
gatagcactttttgattaccatcgctgtacgcaatgaagacagagacgtgcgtttattccggctacaaaatccacccgggccatggcaagcgagtggtgcgcgctgacggaaagatccaaatctacctgagcaagaaggcacagcgtggtgcagcactgaagcgcaacccgcgtgacgtgccgtggaccgtgctgtaccgacgaaagcacaagaagggagtacacgccgaggagggcacgcagcgaaagcgcgtgaagcgcaccgtccaaattgcttctcgacccatcgccgacctcaccgtggaggcactgttggcccagcgcaatcagaagcccgaattccgtaaacagcaacgcgaggcggccatcaaggctgccaaggagtccgcccgagtcaaaaaggacgagaccaagaagaagcagcagaagattgacaaaaaggcagcgccaacgaagacgaaggcggccaagcaggtgaaagcgccgaaacaatttgtgggcggaaagcgctgattttgtgatggttgacgaaaagatgggatgtgcttgtgtgaattcggggcgggaattttgttcgagttctttgtcctcctcatttttgttgttgaaaaattaaaaaacaaacaaaaaaaaaaaaaaaaaaaaaaaa

SEQ ID NO: 1443 - DNA, 2001 bp, Heterodera glycines
  coding sequence=SeqID_1661; coordinates=40-1650
  peptide sequence=SeqID_1854
ccattcgatttcaaaacaattcctttcaaaacaaaataaatgggcacaccctccaggcgtggcaggaaaagaaagtctgaagtagtgcccgataaaagaacatcgacatcttcagcaagatcaaaacctttgatgccgcgcaaatcatttgtgccgttgtccattgaacagtttcggccaaccgcagttggcacacgcgtgctgagctgtggcgagggcgaacaattgggccatccaaatcggaacacaacgaaaaagccgcgtgccgttggcacattcccaaccgacatgacatttgttcaggtcgccgcgggcggtgttcactcgctggtgttgaccactgatggacgtgtgttcagttgtggcatcaacgagaagggcactgtgccggtccaaggcctggaggcggaaggcaccaccgacacattcagcgaaattgtgttcaccacggacatccaacggcttggcaaaattgtgcagataactgccggcgcgtcattttccgcagcgctcaccgaaaagggcagtgtcatcgcgtggggaaatttgagggatacccaaggggaagtcaatgtgcacgagacgctcacggacatacagaagaagccgatggtggtgatgcggcacaaaaacaaacagaattgtcacattgtcaagattgctgctggcgaaaaccatttggctatgctgtccaacgagggccaaattctgacatttggtgaaggctccatgggccaactgggccgctcggtgcgtaccgagcacattcgcgcaaggtatatggtcgatgaatcgggcgcctcgctgacactgcgcgtgttggagcacaaacagtttgtgcgcttcgtcaacatttgggcgcgcggcttttggaccattggccgggcggaggacgggcgtctgtttgtgtgcggcctcaacaattttggacagcttggcgtgccgccccaatcgccggcgcaccgcaagtccgccgctgggaccagcgacgaagatgacggtggaatcggtccgcccaagccaaagtcgccggccaccatcgccgctggccaagaggagtccaacaaggtagcactgctcacttgcgccaccgcgtttccagccgacaaacggtggacccatgtggcgggcgtgcagcatgtgatctgtcggagtggggacgacagccaaatttatgggattggcaagaacacggacaacgcgttgggcctcgacacgtggcagggcaaccatgacgaggagcactggcgctatgacacactgcagcacatcccattgccggacggagtgaacgccgtggccggcgtggacgcaacgctgggcgccaccatattttggacggatgatggtcgagtgttcggtttcggctgcgacacggttggccaactcgggctgggcatcaaggaagaggatgagaaggtggtgtcgaagccgcgtcagatcacttcggcacatttggacggatatcgagtgttgggcgtgtccattgccgacaatcatgcgctttttctcgccgcgtcgattgaccaacaaccgccgctgccatcagcttcaccaccaccaccacaacagcagaaggcccagcagcaccaacaactgcagaccaacggcaacggaatattggaaacaccgattgatggcaaagcttgattgattgatggatggatggatgatttttattttttgttttgatttggatcatcacaaatccttttttgtgtctgctgcccttctctaatttgtttgtcgtctcattttgtttattgttgctctctctctctctctctcttcccccctctctctctcccctctccacactatgcgcactgcattgattggctttgtttgtctcgatttgtttggcttttcttctctctctctctctctcccgcttctcctcctgttgcttgcttttatcttcccttccttcatccctccctcactggtcaaaggcaaagcgtacaataaattaaatccaattaaaaaaaaaaaaaaaaaaaa

SEQ ID NO: 1444 - DNA, 1280 bp, Heterodera glycines
  coding sequence=SeqID_1662; coordinates=1-1104
  peptide sequence=SeqID_1855
gtcggtgcaattgcagccacatcaattggtgaaccctccactcagatgacgctgaaaacctttcactttgctggcgttgcgtccatgaacatcacccaaggcgtgcccaggataaaagaaatcatcaacgcggtccgctccatttcaacgcctatcatcaccgtggcattggccgatgagcgggacgaaaagttggcacgacgggtgaaggcacggactgagaagaccacattgggcgatatcattgattatgtggagcaggtgtttttgccggatggcctttacgtactcgtcaaattgaacacccggcggatcagagaaatggaactggaggtgaccatggacaccatcatcgactcaatttgcgcctccaaattgcccgtgtcgcgcattctgtgcgaccagatccgctcggtgggcaagtccatgctgctggtcaggccggtcgagtcgtccaaatcgcggacaaagttcaacaattcattggtgattgccgaagtgttgggcattgaggcggcacggggctcaatcatttccgaaattttggccataatgggaaaacacggcattgagttggacagacagcacgtgttggccgatttgatgatttatcgcgacgaggctgccttctttggccaacaggaccgcatcttttgctttttggtgacatcagccgctttatatgcagcacaattgccgctgccacttcgtttaattgccttcacaacttgtcttaattttgctggggctcttcaaccaggacaaagtgaatggttctccaacgaccctctgacgcggttcatcaagaaggcgtggcaaccgcgcacgggaaaggattgcgagacggaaacggatggagagcagacaagaacaaaaatgttgaccggattgttttgcgtaagcgtgctcgccgctctcaaagtgatctttctgcacacttggccccgcatccgacgccgttttctgacatggattcgagagaaggaacaaatcgcgactcccacaaacggcagcaatttggtcggcttgcagaacctgatcaataagccgaacgcacagcacaccgaaattgctaacagcgagcaggccgttcaacatcactaagcagcagcacccgcagcccaaaaatgttgaaatgctttgatgaatataagaatactttttattattccaagtgtttcgtttcgctttttttgtgggatttctttttatgttttcttcgcatttttgtgtgttttggtgaataacaaacaaagaattacaaaaaaaaaaaaaaaaaa

SEQ ID NO: 1445 - DNA, 1563 bp, Heterodera glycines
  coding sequence=SeqID_1663; coordinates=115-1212
  peptide sequence=SeqID_1856
tcacctctcttggccccagcccaccacctcgcccccgccgttgccggtgacaccacacccatcaagggcgtcacacctaccaccaagctgacgggcacgcttgagaatctcgagatggactctgtcaagaaggcggccgtctccggatcactcacggcttcgggttccgccgcagcccgtgacgacgggtcgtcggttggccgtcccgctcgtacactcctgtcggatttggagttgagtgagcccatcttgaccgagaacaagaaccggtttgtcttgttccccatcaaataccaagatatctggcaaatgtacaaaaaggccgaggcctccttctggacggccgaggaagtggacctgtccaaggacttccacgactgggagaaccgtcttaacgacgacgagcgccacttcatctcgcacgtgcttgccttctttgccgcctcggacggcattgtcaacgaaaatctcgttgagcgcttctcgcaagaggtccaagtccccgaggctcgctgcttttacgggttccaaatcatgattgagaacattcactcggaaatgtactcgctgctcatcgatacctacattcgcgacccggcgcagcgcgattacttgttcaatgccattgacaacatcccatgcatccaaaagaaggccgactgggcgtgccggtggatcgaggaccgcaacacgtcgtttgccgagcgcctagttgcctttgccgccgtcgagggcatcttcttctccgggtcatttgcatccatcttttggctcaagaagcgcggcatgatgcccgggctcaccttctcgaacgaactcatttcgcgcgacgagggcctgcactgcgatttcgcgtgcctgctcttcaagcacctcaaccacaagccgtccgtgtcgaccgtgacgcaaatcatcaaggaggcggtcgagattgagcaagagtttttgacggacgcattgcccgtggcgctcattggcatgaactcgacgctcatgtcgcggtacattgagtttgtggccgaccggttattggtggcgctcgggtgcgacaaggtgtacgaggtcgagaacccgtttgatttcatggagctcatttcattgcagggcaagacaaacttctttgagaagaaggtcggcgagtaccagaaggccggcgtcatgtctggaaacggtgccgcaacgcactcgtttaccatggacgaggatttctaaggagtgtcattgtgtgtttctctttttgtcttccttttcgttcgtccgtttcccctcgtttctctcctctcgcttgcattcgcctccttgccacttccttcccctcgccaaaacattgttgtgatgttctctttctgtctctccctcgcttgctcgtcacccccacgaccccccaacaacgtatcgcaactctcctggacatcctgcccccttgttttgcgttttctttggccaagcgccaagttgtcctgctcgcactaccgctactctctttggttgcagtcattaaatgtatctgaccctttgtccgtgaaaaaaaaaaaaaaaaaaaaaaaaaaaaaaaaaaaaaaa

SEQ ID NO: 1446 - DNA, 728 bp, Heterodera glycines
  coding sequence=SeqID_1664; coordinates=21-641
  peptide sequence=SeqID_1857
gttgtctttctattgtaaaaatgccgaacattatgggattgcatggtggctccatgattgccatgagaagcaaagatagtgtggtgattgcatgtgatctgcgcttgggagagcaagccatgaaaaacattgctactaatgcgacgaagatccatcccatttctgacaacgtttttatcggattgaccgggtttaacgcggacgccaccactgtgcttaacaagttgcgcacacatcaggccatttatgagatgcgcgagcagcgtccaatgtctcccaaggcgttgacttcctatctcgcttggatgctctataagcgcaggttcggcccgttcctgatcgaacccatcattgtggggctgaatcaacaaaatgagccgttcatttcccacatggacgtggtcggtagcgtaagtgagcccgaagactacacggtcggtggcactggtggcgacttggcgatgtctctgtgtgaagctctctggcgacccgatatgacctccgaagaaatgacggtggcggtcggtcaggcgatgcttgcggtggtcgaacgcgacgcatccactggatggggcgttgtcatccacacgatcactgcggaaggagtgaccacaaaaatgattaaatcgcgcatggattgatttgatcagctcctgtcgcttttgttgtattcgaaataagcgataaattcatatgcaaaaaaaaaaaaaaaaaaaaaaaaaaaaaaa

SEQ ID NO: 1447 - DNA, 1461 bp, Heterodera glycines
  coding sequence=SeqID_1492; coordinates=1-1461
  peptide sequence=SeqID_1705
gttgtgcactaaaagccaacatgatacaggcttggcgcacgcattttgttctcgaggaaggcatgttggaagtcgagtgcacttcacttacaccagaatacgtcttaaaagcttctggccatgttgaccggtttatcgactggatggtgaaagacaaacaaacgggtgcttgttttagagccgaccacttggttaaaaatcaagcggaaactttgattcgggacaaaaaaactgatgaaaaaacaaagtccgaacttatgaatgtgcttgttatgcttgatgggatgagctgtgatgacttgcacgaagtcattaagaaattcaatttcaaatctccgctaaccggcggtgacttgtccgagcccgtttctttcaatctgatgtttcccactgaaattggacctacctgtgatcagcgagcctttctgagacccgagacggctcaaggaatctttatcaacttcaaacgccttttagaatttaaccagggacgacttccttttgctgcagcccaagtcggttctggctttagaaacgaaatttcgcctcgacaaggacttatccgcgtccgagaatttacaatgtgtgaaattgaacactttgttgacccgaccgacaagagacatcccaaattcgagaaaattgcacatttggaacttactttgtttcctgcttgcaatcaaatggaatcaaaaaatccccaaaagatttcaattggaaacgcagtcaaattgggtatcgtaaacaatgaaactttgggttattacatggcgcgaactcatttgtttcttctttctgttggcatttcgcccgataaactacgctttcggcaacatctttccaatgaaatggcccattacgctcaagactgttgggacgcggagtgttttacctcttacggatggatcgaatgtgttggaaatgcggacagagcttgctatgacttgcaccagcaccaaaaggcatcgggagtgaagctcgtagcggagaagaaactcggcgcgccgaagcaaatcgaagtggtcgaagcagtgccaaacaaacagttgctgggcaaagaattcaaatccgattcaaaacagattcttgcagctttggacgatttaactgaagcacagatcgaggaattggaacgggaaatcaaaagcaatggtaaatatcgcttgtctttgtgcgagggaaaaacttttgagctgaactcgtcaatggtggaagttaagcgtttcgagaagactgtccatgttgaagaagtgactccttcggtgattgagccttcctttgggattggtcgtattttgtacgctgtgttggagcattcttttcggcaacgcgagggggacgaaaagcgatgctatcttgaacttccgcccctaattgcaccgatcaaatgctcaattttgcccatttcttctaatgagcgacttgacccaataatctttgctgttcgggaccaactgacct

SEQ ID NO: 1448 - DNA, 543 bp, Heterodera glycines
  coding sequence=SeqID_1665; coordinates=49-417
  peptide sequence=SeqID_1858
ctcaatttttatttttggaattccaagagccaacggtcagtaagcgcgatgaagcttgtccgctttttgatgaaattgtcccatgagtctgtgaccatcgagctgaagaacggcacacaagtgagcggtgctattcagggcgtcgacgtggccatgaacattcatttgcgctcggtaaaaatgacagtgcgtggacgagagcaaatcagtttggacacactctccatcagaggaaacaacattcgctatattgttcttccggattctttgccattggacactttgctcatcgatgacgagccgcgcaagaagcccactcaacgccgatttggtggccgtggaggacgcggtgggccgcgcggacgtggacgaggccgcggagggcctccacgcggcggcggcgggggacgacgctgatgatggaccacaatgggagaagggatcagtgtctattgttgttgttcatttcaaaccactggctgaacatctcatttatttttctgatataaaatggggttactcaaaaaaaaaaaaaaaaaaaaa

SEQ ID NO: 1449 - DNA, 787 bp, Heterodera glycines
  coding sequence=SeqID_1666; coordinates=25-603
  peptide sequence=SeqID_1859
gtccaattaagctaatcactgaaaatgccaaagaaaaagaatggcaccaccgacgaaaagggttgccttctgatcacaaattatttcccaattcgtaggagcaagcgcataacaacgaaggaacttgaggacatcaaattgaaggagctcaaggagttgatcgacacagggttcaacgaggaccatttggaggtgtttcggtgttcggtgaaggggcgaagtgtccgtgcgtcgaaatgctttcaaaggggcgaatttgttgtggagtacaaaggcgacttaatcagtgtgaagacggcccaactccgcgaacaacggtatgccaaagatgagaacgtgggctccttcatgtactactttcggcaccgggacaatgtgttttgtatcgacgcgaccgatgaaacgccgtacaaaggccgactgatcaaccacagctatttgaagcccaacctcaagacgagggtggccgacttcggctgtgacggcttccatttggtgctcgtcgccatgcgcgacattgacaacggcgaggagttgttgtacgactacggggagcggcggccctccgtgctggcggttaacccgtggattttgggctcataggtggcgagcagtgtgcctctatttattcttttcattcactactcttttttctttcctttccttttgtccttttttgaaacgttgatgatactcattcactcactcatgtcattaattcatcatcattttgttgtttaatgtataatatggttgagtgccaaaaaaaaaaaaaaaaaaaaaaaaa

SEQ ID NO: 1450 - DNA, 641 bp, Heterodera glycines
  coding sequence=SeqID_1667; coordinates=18-563
  peptide sequence=SeqID_1860
gagccaagttttaaacaatgccaatcaaagcatccggagaaactttaagaaagtacatcgttgttggacgtaaactcccaactgcaaatgacccaaatccgacactgcatgaaatggttatttttgccagcaaccacgtcgttgctaagtctcgcttctggtacttcactagcatgttgcgtcgtgttaaaaaaacacacggagaaattatttcatgtcaagaggtcttcgagaaaaagcctggctccgtgaagaactttggcatttggctccgctacgattctcgtactggacaccacaacatgtaccgcgagtatcgcgatgtttgtgaagcgggtgctgttacgcagtgctatcgcgacatgggcgctcgtcaccgcgctcaagcggatcgcattcagatcatcaaagtgcaaaccatcagtgtggcggactgcaagcgagccggggtgaagcaatttcagaactccaagatcaaatttccgcttcctcaccgtgtgaattccaagcgacgcaatatgactcctttcacgacacagcgtccgagaactcattttgtgtagagaaagaaatgagacgacttgtatttccgatttgttgattaaagttgttgtgttaaaaaaaaaaaaaaaaaaaaaaaa

SEQ ID NO: 1451 - DNA, 671 bp, Heterodera glycines
  coding sequence=SeqID_1668; coordinates=46-591
  peptide sequence=SeqID_1861
ggtatttgctttgggaaattcacatatttgatttgttggttaccaatgactgctccttgcattgatgttggcaatcttttactcattaatgttgagacggacgccgaagatttggccagtagcaactcagaacggattaacgaacttacaagcaaaaatgcccagcttttgttcaatgaaatatggaaattacccagaaaaattgtgcaagatgcgacttgttctcagcttcccgaatacacttatggccttcctcgtgaaaaacccattccaaaaccgaaagaaccaacgaaatgggagaagttcgcgagggctaaagggataacaaagaagaaagacaggaaagtctgggacaaaacgactcaggaatggaagccgaaatacggatacagacgagccgagaaccaatcgaaggaatggctcattgaaattcccgaccaaaaagacccatacaaagattattttgctgagaaggcggaggaaaagcgggaaaagaataacaagcaggagttgcaacggctgaagaacatttcccgcgcctctaacaaatccaaagttccaactgggaacagaaaggtgttcaaagattgatcaaatcaaatctgtcaattgttttatgtttttgttgttttcataaacaattttaatcgaaaaaaaaaaaaaaaaaaaaa

SEQ ID NO: 1452 - DNA, 1051 bp, Heterodera glycines
  coding sequence=SeqID_1669; coordinates=32-973
  peptide sequence=SeqID_1862
ttaagattaattccttgaagctattaattcgatgtctcaagcggatgccggacgtatcattcacattgggaagcggcgagagcgtgccaaagaggacattgagagccaacgacaaaggcttgaggaagagcggcgaaatttggcggcgagcatcaaagcgaaattcactacaaatattgacgaacaagaagagaaattcaaagaacgaacggttggattggtaacacttgacgaagtgaaggagagacagaacgaaatattttacagtgggccatctttaaaattttcaaacgaagaccgacccaaatttgagaaagccattcaaaaaagagtgctttcgtttggcgcttttgacgacgacgacgacgaggaggacgaggcactgattccaatcaccaaaaagagacacggaatggacccaacggtggacacttcttttctgcctgaccgcgaaagggacgaacaattgcaacgtgagcgcgaacggatcgctaaagaatggcaagaaatgcaggagagggaaaagaatgaggagataaccgtggcattttgctattgggacgggtccagccatcggaaggactcaaaaacaaagaaagggacgacaattgctcaatttctgcagaaggcattggacacatttcgcaaagaattcctcgaattgaaattggcaacagtggataatctgatgttcgtgaaggaggacttaatcatcccgcacttttacacttttcaagacttcatcaaaacgcgtcaaatgggcaaaacgggtccgctgtggcagttcgaagctgttggcgaaattcgcgtgcggcaagatgccgcgttggacattggcgaatcgcacccggtgaaggtcattttgcgcagttggtatgagaaaaacaagcacatttacccggcttcgcgttgggagccatttgtgccggggaaagtgtacaaacggacaattgacgacttatccacgatttgagaattttaattgaaaaatgttgtaaaatgagcaaatggcatacagtaaagttaaaaatgaaaaaaaaaaaaaaaaaaa

SEQ ID NO: 1453 - DNA, 907 bp, Heterodera glycines
  coding sequence=SeqID_1670; coordinates=1-674
  peptide sequence=SeqID_1897
tttccgacaacgatgtccaaaagcagcttcgccatatgatggcatttattgagcaggaagctaacgaaaaagcagaagaaatcgacgcaaaagcggaggaggagtttaacattgagaaggggaaattggtgcaacagcaaaggcagaaaatcatggaatattacgagaagaaagagaagcaagtggagctgcagcgcaagattcagaggtcgaatatgcaaaatcagagtcggttgaaatgtttgaaggcgcgggacgaccatttgaaaaatgtgttggaggaggcacgcgccaatctcagcaaaatttcggcggacagagagcgctatccggccattctcaaaggacttttgcttcagggccttttccaattgctcgaaagcaaagttgtgttgcgatgccgcaagaaagacgaggaaatggtggcgaggattttgcccgaatgtttggaggaatttcagcggacgtggggcaatcgaagcgaagtgaaaattgacaatgagtactttttgtccccggaaagtgcgggcggcgtcgaattgttggccaaagacggcaaaatccgcgtctcgtccactttggaagcgcgtctcgacctcattgccgacaaaatcactccccaagttcgcactgctctgttcggtcccaatcagaaccgccgcttcttcgactgatcggtcccttcgcttcgaccattccattttattctgttcacttagccaatagtcacaaaggtagcgacttgggactgatgctgcaaattcggcccttcttttggctcttgttttctttggatttcgccggacattcgcttttccacccattgatcataatttgtcacttgcaaataatgcattaccaagtaataaactgtcatttcccataaaaaaaaaaaaaaaaaaaaaaa

SEQ ID NO: 1454 - DNA, 876 bp, Heterodera glycines
  coding sequence=SeqID_1671; coordinates=20-778
  peptide sequence=SeqID_1863
gtttgaatagcgaccgaatatgctcaggaaaaccataaaaacacttcaaccgatatataacgccagaacagcattccgttttcagaccggaggttatgctgcgcctggtactgaagcacaagcacaggaagtaaaaaaacagacaagcacaaaatacgtgattgatgaacaaaagcgggagaagctgactctcttcggtcaatatgtagccgcatgtatgcccaaattcgtccagcaagttcagtttgctggtggggatgaattggaagttctgatccacccaactggtgtcctgcccgttatggccttcctcaaagggcatcactcggcccaattcacaaattttattttcgcttgtggcttggacgttcctacgcttcggacatacactgacgaagttgctccaatcgattccatcactccagtcttttccggtgctgaatggtatgaacgtgaaatctacgacatgtacggggtttggttcaacaaccacccagacttaagacgtattttgaccgattacgggtttgaaggtcatccccagcgaaaagacttcccattgtccggatacgtcgaactgcgttgggaccacgagctgaaccgagtgatttatgagccaaccgaaatgacacaagagttccggaagtttgacttgaacacaccgtgggaggttttccctgcatttcgtgacgaatcgataacctccggatacaatgtcattcaaaaggcaggcaaaattgaggccaaaaagcttgatgatgcttccaaaaaaccgtaatttgtatcaatataatagaaaccaagttattagaaactcattgtcagtttaaatacaatgattaaaaagtataaacgaaaaaaaaaaaaaaaaaaaaa

SEQ ID NO: 1455 - DNA, 684 bp, Heterodera glycines
  coding sequence=SeqID_1672; coordinates=22-588
  peptide sequence=SeqID_1864
gcacgaggaacataacgaaaaatgaagctgattgaatccagcgacatcgtcaaattcccagacaatgtcactttcgcgctcaacaaccgtgttgtgactgtgaagggaccgcgcggtacgctcaagcgcgactttcgccacttaaacattgaaattatgcgagaaaacccgaagctgctccgtgtgcggaaatggtttggcatccgcaaagagttggcagccattcgcacagtgtgctcacacattgaaaacatgatcaaaggtgtgactgttggatttcggtacaaaatgcgctcagtctacgcgcattttccgattaacatcacgcttcaggagaacaacaccgtcgtcgagattcgaaacttcttgggcgagaaatttgtgcgccgtgtcggactaccgcaaggcgttagcgctgtaatgtcgaccaaacagaaggacgagttgatcattgacggtaccgacatccaaaaagtgtcccaggccgctgctcgcatccaacagtcgacgaccgtcaaaaacaaggacattcggaaattcctggacggcatttatgtgtcggagaaggtggccattgccgatgaatgagcacacaaagataaaaacccattgttaccccttttttgttggtcaaatggataaagaaatgttgttaaaaaaaaaaaaaaaaaaaaaaaaaaaaaa

SEQ ID NO: 1456 - DNA, 607 bp, Heterodera glycines
  coding sequence=SeqID_1673; coordinates=34-480
  peptide sequence=SeqID_1865
gtgttattgaaaaattattattacaaaggaaaaatggctgacgcagctgctcaagaacaaaaaaagaaacgcacttttcgtaaatttgtctatcgcggagttgacttagaacagcttctggaaatgaatgagaagcaattcaaccaaatgattcccgcccgtcaacgtcggaagatgaaccgcggattgaaccgaaagcacaaatctttgctcgttcgtctgcgtaaggcaaaactcaattgtcccgagctgatgaaaccggagtgcgtgaagactcatttgcgtgatatgatcgtgctgccggagatggtcggctgtgtggttggcattcacagtgggaaggcatacaatcaggttgaaattcgagctgagatgattggatattacttgggcgaattttctattacgtacaagcctgtcaaacacggtcgtcccggaatcggcgcaacgcacagttcgcgtttcatcccactcaaatgattctttttgcgatcatcggaaattgttgtttaccgatcttttgttattgaattgtttggattttgttggaagttagcggactcaataaagtgaaaatttgttaaaaaaaaaaaaaaaaaaaaaaaaa

SEQ ID NO: 1457 - DNA, 639 bp, Heterodera glycines
  coding sequence=SeqID_1674; coordinates=1-526
  peptide sequence=SeqID_1916
gtttgagcattccttgatggttcgtcatgtgactgcctcctgctttcgtgcgccatggccttttgaaaaaaagggctcaactggatggcggaagaatgggccggttgttattgaatcgcacaaatggcccggtcaacaaaaggaattccccgagctctcgccaaaatttctaggagcaaactttaaacagctatggagatacaccggagtggcgcccacaggatttaatgaccccaaaactgacgattttgttcatgttcccgaaatggtgcccgaattggtcgtgccggacctagccaatttcgagctgaagccatacgtctcttacaaaacagatgcaaaaattgaagaaaggctacgcaattttgacaaaaaattgacaaaattcggtgggaatgagaaagcagcgattgccaattccaaagagacggaactatggccccctccgccaatcgacgcgaaaattctcttcgactttttctacgctgaaaaaattcgtcaggcatttgaaaaagggaagaagtaaaaaaagattagcagacgatggaccaaagcagacgattgacgccttatttttctctgttttattctccctttgataaacaatgattagctaaaaaaaaaaaaaaaaaaaaaaaa

SEQ ID NO: 1458 - DNA, 616 bp, Heterodera glycines
  coding sequence=SeqID_1675; coordinates=1-529
  peptide sequence=SeqID_1866
ccgaaccgaagtgttggcacgggacgcggaaattgacggatttgacaccgccaaattcgttttcaccgacatttcattcgacgccacagatatggatcgcactgtcgttgtccgggagcaggacggaacgctacgaacggcgttgccggaagaacacgatcggatgaatcggctgttttttgtgcaacccaatcggcctgtcaacgaaccgccgctgtttgcaatgaccgacgaatggttacagaagacgctggaccgtgatgagcatgagtttgtgctggactgggcctgtcatttttacgagccggacgctcccaaatttgttgagctttgtaagtacatttttgaccacacattggaaaatgacaagttggacgtgctgtactccaccagacatttcggcacattggccttctatttggtgatcaacggcaaaatggacaaactgttggaattctatgagcagaagaacagaaatgacggcgtagatcaaacgcgacaactttggcagatactttcttgttattgaagttttaattggatttctttctaaatgtgccgacaattttttgaataaattttgttcattttcaaaaaaaaaaaaaaaaaaaaaaaa

SEQ ID NO: 1459 - DNA, 772 bp, Heterodera glycines
  coding sequence=SeqID_1676; coordinates=1-571
  peptide sequence=SeqID_1867
agttcaaagtgtggcgatcagtcagaatggcgacttgtacatgacgaaacagccgacccacgggacggaagagtccgccatttggagatcacacatcgatcatccaatagcatgggaggaattttgctcgacattcgacgaatgtttccaatcactttgtgtttacgataatgaaacccttgcagtcgccgttgtttcatcgcctgttaatttatattcaaaacagtgcattaaatgggttgctacaaaagactgtcgaatcattgggtcattttccgctgccggcaaagacaatgggcaaatatttttcccgcgatgtttgcaaaagcatggtgactcattgctcattttggacaaaaccggaagaatacaaaaatttacacgggaagggcatttcgtagaaatatcagccaaaattgatgattatattgggaacggattcacaattcgagaggatgaggctgtgatcgcgtgcagtggtattgtgaaggatgaggaaggaaagaccatgtgcgacgattgggtggaaaacattcgcttggatgggtcgagatggacggaggaagcataaagagcggcttaaagaaaagaacacataaaccgaaagagaaaccaagaaatatctctcaaaaaatgtcaaatttgggcattttcggttgtgaatcattacttaaatacctaatcgcttcttttgatttaaattccttaccctttttaattaatttaataaatattacatcttcctcaaaaaaaaaaaaaaaaaaaaaaaaaa

SEQ ID NO: 1460 - DNA, 1327 bp, Heterodera glycines
  coding sequence=SeqID_1677; coordinates=1-1250
  peptide sequence=SeqID_1868
cgctgattgccaaagtgaggccgtccagctacgggcaacggcgcaactactccagcattgacatttcggcggagaaatggttgatgcactacgacgccgactcgttggccaaactcgagaacccaccgtcactggcggacggaatcaatcgcgaattggagagggacattcgctatttgggctgtgaactgatacaatccggtgccattctgttacggttgagtcaaacatcagcggccaccgcacaaattctcttccaacgttattactacctcaaatcatttgtgcgctacaatttcgagcacatggtccaagcttgtctgctgttggcaagtaaaattgaagaagaacctcgaaaaccgcgtgacgtgctcaatgtgtacaatcgccttaagcaaatccatcatcggagaaatgcggtcgcatcacaacaccccgaagatttgcaaaagctgagcaaaaagtttgagcacttggagttgtgcagcaaaaggtaccaagaattgaagaacattgtgatcaaagcggaacgtcgactgcttaatgtgctcggatttgttgtgcacgttcaccacccgcacaaactcatctacatctatctgcacatccttgaccagctgaaaaatgatcaaaaaaagtacagtgcaagcgaaattcggaagagtcggcaactgttgcagaaggcttggagctttatgaacgacggtctgcggacggacatgtttttgcgctacaccccggagacaatcgcttgcgcatgcattcaactcgcggtccgaacagtggaccaaccaattgtgttgcccaccgaaccctttgcatggtttgaactgttcgatgccagtgaccgcgatgtgcgcgccatttcacagaccatttgggagctgtacacgcgcaaaaaggcaccaaatttgaaatgggtttcggaccatttggagcagttgtaccaaaaagcggtggttgagccggagaaggcgcgcaaggagaagacaatggtcgaaatgcgagacatcaaggaacagattctgcagcgcaaaagtgcgatgcttttcggagcaggaaaaaccgtcgctgacgacagatcgccaccgaaacgtcgtcgccgagacatggccggacaaaatgtcgccgagacaaaacgtcgccgggacagaacgccaccgagacaaaacgtcgccgagacaaagcgtcgccgggacaaaacatcgccgagacaaaatgtcgccgagaaaaaatattccaaaaattaattcgaaaattgttcttaaaaaccatttttttcgctaaatacactcatttttcgttaaaaaaaaaaaaaaaaaaaaaa

SEQ ID NO: 1461 - DNA, 446 bp, Heterodera glycines
  coding sequence=SeqID_1678; coordinates=49-318
  peptide sequence=SeqID_1869
cgttaatttcttcattttcgttcgcttgcattttgttcttccgtaattatgggcgacagaaaggcggtgattaaaaacgcggatatgaccgaagagatgcagcaggaggccattgagtgcgctacgcaggctttggagaagtataacattgagaaggacatcgctgcgtacatcaaaaaggagtttgacaagaagttcaacccgacatggcattgcatcgtcggacggaacttcggctcttacgtcacacacgagaccaaacacttcatttacttctacttgggccaagtggccattcttttgtttaagagcggctgatccgactttttgagacgaacggaagccgacgatgcaaaaaaacttattatggccgtgctgtaagacagttttgtcatttcatcaccaataaatacttttcaaaaaaaaaaaaaaaaaaaaaaaaaaaa

SEQ ID NO: 1462 - DNA, 1503 bp, Heterodera glycines
  coding sequence=SeqID_1679; coordinates=1-1344
  peptide sequence=SeqID_1870
gctgattttgacggaaaagagatttggcttcgtggccgtctccacgactctcgcggaaaaggcaaaaattgttttgcgaaaattcggcagcggattcacagcgtacaggcggtgttattcgtgggagcagacattagcaaacaattcgttaaatttgtccaaaacattcccaaagaatcaattgtcgatgtttatgggcttgtggcgcgcacccctcagccggtcactgcttgcactcaaagcgatgttgagattaaagtgcacaaatttttcattgtctcgcaagcagagcctcggcttccgcttcaacttgaagacgcggttcggcccgacaacgaccaagaggaattggccgtagtcaaattggacactcgtttggacaacagagtgctcgacttgcgaacgccaacgagtcaggcaattttccgtttgcagggtggagtttgcgacgcctttcgcaagattttgtcctctcgcggtttcatggaaattcacactcccaaaatcatttctgctgccagtgaaggcggtgcaaacgtttttgaggtttcttacttcaaaggccatgcttttctggctcagtcgcctcaactttacaaacaaatggcaattgctggtgactttggccgcgtgtttaccattggctccgtttttcgggctgaagacagtaatacgcatcgtcatttgaccgagtttattggccttgatcttgagatggctttcaatttccattaccacgaagttcttcaaactattgctgagatgttcattgacctgttcaaatatttgcaaggcaattacattgctgaaattgaagcagtccgtcggcaatacccagccgagccgtttctctttacacaaagtccactcgttttgcaataccccgaagcggtggccatgttaaagaaagctggtgttgagcagggagatgaagaagacttgagcactccaaatgaaaagcttttgggtagattggtgcgtgagaaatatcaaacggatttctatgttctggacaaatacccattggctgtccgccctttctatacaatgcccgacccaaatgacaccaaatattccaatagttacgacatgttcatgagaggcgaagaaatcatttccggtgcccagcgtgttcacgactcggcaatgctcaccgaacgtgccaaactgcacgggatagacattgagaagattcagtcatacatcgacgccttcagatttggatgcccaccacatgcggggggaggaattggtttggaacgcgtgacgatgcttttccttgggttgcccaacgtgcgtttggccagtctttttccgcgcgacccgaaaagaataacgccatagaaggaagtgagagtttaagcgactttactgttgttttgcaaatattcattcatataagttgttttacaggaaattgtttttgaacaaaaaataaatattgttctggtcaaaaaaaaaaaaaaaaaaaaaaaaaaaaaactcgagggggcctcgcccccc

SEQ ID NO: 1463 - DNA, 400 bp, Heterodera glycines
  coding sequence=SeqID_1680; coordinates=1-193
  peptide sequence=SeqID_1898
ggttgggttcagcaatttggtctgcgggttggcagtaggaattgttggctctggggcggcacttgctgacgccgcgaacccagtgctttttgttaagattctgatcatcgaaatatttgctagcgctatcggactgttcggcatgatcataggcattgtgcagaccaacaaattcaacattggcaccacctgagggacgactttgccattgcttctcgtgtttctgtactttaccctctgcggacaatgaactgttttctgctggttgtgtgatcatagaatttaaattcgcatattttacatcagtcgttttttaacttttaaaaatggaatgaaaaaaaaaaaaaaaaaaaaaaaaaaaaaaaaaaaaaaaaaaaaaaaaaaaaaaaaaaaaaaaaaa

SEQ ID NO: 1464 - DNA, 900 bp, Heterodera glycines
  coding sequence=SeqID_1681; coordinates=81-815
  peptide sequence=SeqID_1871
gcacgaggccatgcccgtcctgaaaagggagttcgtccgatccgaaccctggaataaatttttggcttttccaaaagattatgactttgcgtttgggttctaaattaaaattttccattttactccaaaatgttggaatcagaaaaaatccttttcgcaattcttataactatccgattacttttgaacacgtggttttcccgccaaataatcagtttaagttgccaacaatgcctcctgagcccatttatgacgagtcattgggagaaacgaagcacaaattgactaagcagtttattgaagcgaggggatttgagccaatccacacggagttgatccacaagcagtacggcttggtggcgatgagcggtggttttatcaaagccgaagactttgcatggattcagcaggaagtgaatgagaaattagtcgataagcaattcgccatttggcgcgttgacgccccgtggcttccgcgggtgcggcgtccgccatcaacaaaaaagggcggtgggaaggggcccatccatcactacgagacaccggtcagaaccggacgggtcattttggagctcggcgggtacatcactgaacaggaggctcgttctattttgatgcatctctatttgcatatgccattcccagtggaatttgtcagccaagaattgatggacaaacgcaagggattggagatgaaagtgcgtgcaaataacagaaacaaattcgattgggacacacttatcaaatacaacatgcagaattgcaaggcttggctgagtccgtacgatgtctattggaagtgccgatacaaatgaactacggaattgtttttgttctttattcattcaaaataaaagtttgttttacaaaaaaaaaaaaaaaaaaaaaaaaaaaaaactc

SEQ ID NO: 1465 - DNA, 389 bp, Heterodera glycines
  coding sequence=SeqID_1682; coordinates=1-267
  peptide sequence=SeqID_1872
gaaggagaaatcgtcggaatgatttcggtgaaacacgtatacgaaattgccaaagtcaaatctcaagacaaatctctcattggagtgccgttaaaagaaatttgtcaattggtcattgagagagcggattcgattggcatcaaagtgcaaaatgaagatttagacccggaagaatataggaaattcctggaacatcgtcaggaagttgtgcaaagacaattggaggaaatagcgaagcaagaagaggccaagctggccagaacatgatcggattttgattcattgttttctttttctcttcagcttatgaatgaacgtcaagttgaaaaaaaaaaaaaaaaaaaaaaaaaaaaaaaaaaaaaagtactctgcgttgttaccactagtag

SEQ ID NO: 1466 - DNA, 454 bp, Heterodera glycines
  coding sequence=SeqID_1683; coordinates=34-282
  peptide sequence=SeqID_1873
cccttgggtttaattacccaagtttgagaacgaatgtctgcgttaattccatttataattgttacactgttttgggctgtcattggtgcaggaggcccatttttggtaccaagtggtatgaacagagggatcattcaaacgatgatcgtactgaccgcagtctgctgttatatgttttggctgatcgtctaccttcaccagttgaaccctttgataggaccacaactgcccgtgaaaacgatttggtggattcacaacacttgggggaatgtgaagaattgatgatcgatgattgcagtgattttccacttttgggtgtagtattagtgaattctctatttctgtgaaaaactggcatgacaaaaagacacatataatttttcaaccttttatttctataaaaattgctttaaaaaaaaaaaaaaaaaactcgagactagttctctctcaaggg

SEQ ID NO: 1467 - DNA, 853 bp, Heterodera glycines
  coding sequence=SeqID_1684; coordinates=58-735
  peptide sequence=SeqID_1874
cccttgggtttaattacccaagtttgaggaaaaccctccttcgaacagtgtgttccgatgttgccagcaataaaacctgcaaattccgatgggattgttttagacgcgcttccatatattgacgatcaacaatataccgatgaacatcgtcaattggcactgcaactgattcaggccgaatgcaaaaagtttcctatgacaaagaattacctgagaaatctgcctgaacctgactatgataagtttacaaccccgagaataatggaacaccaagcgaagatggccaacaaacaagaaattgagaaaatcgatttgttgcgatacgaagtgccatccccagcaaatacgagtcgatcgggcaataagaaagcgtggcttggtgccatcgataattgcagggcccaactgtcaaatcaatcgttacgcaaaatgaacttggaacttttggacgaatttggcccggaggcgtttttacggtcgaatcagcacctaaaaaagcaagttgagaaagaggaagccgaattgtttaagcttcgctcccaactctatgaattgaatgctcgccgaaaaagatcgcaattggatgctggagaaaggctggctgcgttgggacaaacatgggttgaactagtgacgaagaatgccgcgatggttgtcgccaatgacaaacttgagaccgaaattcgaacattggcgaaattatgtaaaatggactctggcatttgcaaaaaataaattgaagaagaacgttgttaaaagcatcatctttgtattttattacaaaattatttgacaaacatttttgctttgaaaaaaaaaaaaaaaagactcgagactagttctctctcaaggg

SEQ ID NO: 1468 - DNA, 828 bp, Heterodera glycines
  coding sequence=SeqID_1685; coordinates=16-642
  peptide sequence=SeqID_1875
gcacgaggttttattatgagtaccgcatccgaaagtggaagtgacaaaattgtgttccaaaagaatgttactgggcgaggtagccaggttttggatgacgccgagtttgttaaaatgtatgatcggtcgacttcgaaaaccttgaacacttcctcagccaatgacaacgcacagtcaaaccaacagaaagaacaggttcagaagtggaaagtcggtgatcaatgcatggcactctacgaagtggacggaaagtggtacccggccaaaatcgagcagatttcgcctgtaaaaaacacatgcactgtctcttacattggttacgaccaaaaggccattctgaagttggaggacattttgggtgaatccgatgttgaggctgccgatgaccatggcgatgagcgtgaagcggaagggacaagcggaacgactaagattgcggacaatgatgtgaaaaaagatgcatttccgatcccggatttatgtcctccaccaccgccatcgatgtttggaaagatagccgttgcgggcaatgagaaggaggcactgaccaacatgcttatgtcgtggtacatgtccggataccacaccggcttctaccagggtgttatgcatgaaaagacgacccgtcagaagccaaaatagataacgttgccatacggcttaaaaatcatctcactggttgctgtccatttttattgtctctcccctccctcagttattgtttaattttcttgttaagacataaattgccggtcaacatttccaaagcaataaacggatagcctttaaaaaaaaaaaaaaaaaaaaaaaaaaaaaaaactcgagggg

SEQ ID NO: 1469 - DNA, 764 bp, Heterodera glycines
  coding sequence=SeqID_1686; coordinates=59-613
  peptide sequence=SeqID_1876
cccttgggtttaattacccaagtttgagggcctaattctgactacctagttttgcgaaatggttgtgctctcaaaacttggctcgccgcttcgtccgttttccaatgactatctcctttgccgcttccaggccttccgtaattatgcaatcaaaaaagaaaggccgccaccagcgaagattcaagtgccgccacccgcaaacgaaactggccattggaaatatgagcgtgactactcctatgacctgcgttattcaaacccgatcaacaaatactccagttttaccaggttcattacgctcaccgcaacaggccacaaagaattgtgggcacttttcgcccttctgatgctttcgtcatctctggcgataggaattgtgttctatagccttggcaagatcgaagtttgggttgatcgaagcacctcaactccgccgtgggattgggcgcgagtacgtgacaaatattggaaatttccgacggttctctatgacccgaccggcattactcatgttcgactcagcccgatggagaaacttcaggacgaaatgctggaagctgctaaagaacgtggaacccgcgatgctaagggctattgggttggaaagcaataggaaaatggatgtaatttgatgtgttaactgttctttagcttgcgttctcatataatgtatacgtggagcaaataaaagcagattttaaaaaaaaaaaaaaaaaaaaaaaaaaaactcgagactagttctctctctctctctctctcaaggg

SEQ ID NO: 1470 - DNA, 2290 bp, Heterodera glycines
  coding sequence=SeqID_1687; coordinates=1-757
  peptide sequence=SeqID_1877
gcacgagggtttgaggggttattgttcccgtcggatcgaacggattcgaaaatcactgaagtttatgcattcgtataaatgtgcgcctaaaaggacagcaaaattcattgcgcgaaatgtttctgctgagttaatcggagatttaagatttctccaaattgccgtgttcgaagtcgaacgtaattgggcttacgcaatgcaaatgaaatttgagatgatcgatttgccactttctcgcaaaaaatttcacatgagacaaaaattgcgtcgggcagtgaaaagtgctcattttttacattcgcttattaatgacaatccgctggtccatgaggtcactcgtgttgaaactgtttcttacgtgtctttcatcttcggcagtttggaactcgaactgaaaaattggaaacgagccatcgaaacttttgacagagcaagaatcggttactccgaactgcttgaacaagtccgaaacagcgatctcagcgaaacttatgctacaaagtgtcgcgaggtcgaaaatctgctcattttgtgccgggctcagacaggagatgcgaatgttctgctttcaactgtcagttcagtaaatctcaatgcttctgaagatgaccggaagccttcgcccgagcaattgatagggaaggcaatcactgaaagcaccaaacagcagaagaaaaaagccaggatgatgaaagagccaaagccaatcaaacctttcttctacgatttggcagccaatttcaccgaagtatgttgaaagcacacgcattgatgaaaagggactcatttatgttgaataaatttttgggtttgttaaaaaaaaaaaaaaaaaaaaaaaaaaaaactcgaggtcgacggtatcgataagcttgatatcgaattcggcacgaggctctggtataattttgggctttcaattcaaaaaaatttcgccatccctgtgcgtaaatgactaaaaaaggcgacgacgaaagcggcggtgaagcagcggcggcaattcgtgtgctcgtgacgggtggcaccggactggtcgggtcggcaattcgacaggtggtgacggaggaagagcagcaacagaagccccagcggttgcaggagcagtggtttttcgtgggcagcagcgagtgcgacctgaccgacttggagcagacgcgggcgcttttccgccgcgttcggccgacgcacgtggtcaatttggcggcaatggtcggcggactgttccacaacttgcgccacaacctccaattctttgtcaagaatttggcgatctgtcaaaatgttctccaatgctgccatgagactgacgtggaacggtgcgtttcgtgcctttccacgtgcattttccccgacaaaacgccgtacccaattgacgagacaatggtgtacaatggaccgccgcatgacagcaattttggctattcgtacgccaaacgaatgatcgatgtgctcaaccgcggatatgctcaggagcacaatcgaaagtacacttcggcagtgccgtgcaatatatttggaccgcgtgacaattacaatttggagaacgcccacgtggtcccggcactgatccacaagtgctttttggccaagcgcgacggcggccctttggtggttgccggctcgggcaaaccgttgcggcaattcatttactcgttggacctcggccgtctctttgtgtgggcaatccgcgaatacgaggacgtgacaccaatcattttctgcgttgaccctgccgacgaagtgaccatcgccgatttggtcgacgccattgtcaaggcaatgcaatttaaaggcgaagtcattttcgacacgaccaaggcggacggacagtacaaaaagacctcgtcaaatgccaaactgcgcgcccggctgcccgacttcaaattcacatccttcgaacgtgccattgcggagtctgtgcaatggttcgaggccaattacgagaaggcgcgcaaatgaacgaatggacaaacggccgacggacaaacgaccgacagacaattagtgtaaatggtcgagatttcttttcgatggcagcccttccaacattaaaatatttctaattttttgctttattccattcttcccttttcacattttgttacagctaaacaaacatttaatataatatttattttggaattgtcctttcccctcccctcctgctgttcttctgtgttgtcaacctttcccagatttattcgcttttcatttaatttccattcacaaaacgaacgaacataaattttttgacaaacaaaaaaaaaaaaaaaaaaaaaaaaaaaaaaactcg

SEQ ID NO: 1471 - DNA, 1187 bp, Heterodera glycines
  coding sequence=SeqID_1688; coordinates=1-1025
  peptide sequence=SeqID_1878
gcacgaggcgcattcaatccgttccgctaatcatcggccaattcctcgaagccgtcgattacgaccacgccatcgttggttccactactggctcgaattactacgtgcgtgtgctgtccattttggaccgtgaactgctgaaggccggctgcagcgtgtccttgcacaagtacagcaacgcgctggtcgacgtccttccgcccgagtccgactcgtccattcaaatgctgcgagcggacgaaaagccggacgttgtctactcagacatcggcgggctcgacacgcagaagcaggaagtgcgcgaggcggtggaattgccattgaccaatggcgagctttacgagcagatcggcattgaaccgccccggggagtgcttctctatgggccgccgggttgtgggaaaacgatgttggcgaaggcagtcgcaaagcacacaaaggcatcattcatccgagtggtgggcagcgaattcgtgcagaaatatcttggcgaagggcctcgaatggttcgcgacgtgtttcggctagcaaaggagaacagtccatgtatcattttcatcgacgaaattgacgccattgcgacgaaacgatttgacgcgcaaacgggcgcggaccgggaagtccagcgcattttgttggagttgctgaaccaaatggacggatttgaccaaacaaccagtgtcaaagttataatggcaacaaatcgtcaagacaccctcgacccggcgctgctccgtcccggacgattggacaggaaaattgagtttccaatgccggaccgtcgccagaagcggttggtgttcgccacagtgtcatcgaagatgaacttgagcgacgaagttgacttggaggattacgtggcacggcccgacaaaatatcttgtgccgacatcagttccatttgtcaagaggccggaatgtttgctgtccgagaaaatcgctacatggttctgaacaaagactttaacaaagcatataagcaagtggtgaagaaagacagcgacgagttcgctttctacaagtgatttgtgatcgaatgacccccacccatcgtcaaccatttgctttttgttgtttttgcgcttatatatcatcatttccccgttgtgtactgtctttttcattgcgtgtcatcgaataaagggaagtgaaaaggaaaaaaaaaaaaaaaaaaaaaaaaaaaaaaa

SEQ ID NO: 1472 - DNA, 2161 bp, Heterodera glycines
  coding sequence=SeqID_1689; coordinates=Jan-85
  peptide sequence=SeqID_1917
gttttatttctgaaatgaaaacttcaaagaacattaaaagcagaaaaactgcttcaacaaatgaagtgaaaaaggaatgcccagaaggcacagagaaccgcgaaaatgttgggacgtcgagcaggttaattgtgaagaatttgccgtgtggcaaaaagacgcgatgggacgaggccaaagttcgagcgcacttctccaaatttggcactttgacggacgttcggctgaaactcagcgaaaagaccggagcttgcaaatttgcctttgtcggcttttcatctgccgaacattgccaaaatgccatcaaagcgttggacggcgcgtacattggcggctcaaaacttacggtcgaagagtgtaaagcattgacaactgaccgaacggcgatcaccaaacaactttcgttgaacaaacgcaaaaaactgaggcaaaaaggcaaatgcgaagttgatgaggaggaggacaaagaagaagctgccgaagaggcggacgtcgactcactaattgaaaagcaaattttggacaccggacgacttttccttcgaaatttgccctttgtgtgctcggaagagcaaatacggcaacttttcgagccgtttggaccactcgccgagttggaatgtgtcgtggacaatgcgggcaaatgcaaagggtacgccctgtgcaccttcatcttcccggaacatgcggttgccgcgtggaaagcgttggacggcaccgtttttatgggccgaatgctgcacataatcgccggcgaagagaagagagtgcggacgaacggtgcagacgacgacagcacaaacgacggatgccaaagtgcgttccaacgcgaacggaacgaaaaacgcaaggcgaacgacgcggaaggggcgacagaggcggcgacaaacaatcgttgcacttggaacgcgctgtttcttggcactgacgcggtggcggagacattagcggaaaattatgaagtggagaagcgcgatttgctgctggttgacggcaaacagcagaacagtgccgcggtgcgcgtggcaatggccgaggcgcgtttggtgcgcgagacgcgcaaattcctgcttgacaacggcgttcggttggacgcgttcgcccagcggtggcaccttttgagcaatggtggcgacaacgtcgacggcactgaggacggaaccgcaaaaatgagacgttcaaagacgacaattttggtcaaaaatttagacgccacgagggaagggaaaaaggaatggctgcactctctgtttggacgctttggggtcgttaagacggtgctggtgccaccagtgcacggaatcactgcgatcgttgagatggcaaatgcccgtgacgcgaagtgcgcctttgaggcgttggcctactcgaagaaacacactccgagcgggggacgaccgctgtttttggaatgggcgccgtccaacgtttttgacgaggcgcaccccctcagagcaattggacattacggctatcagcaaaagggtcaaactgccgtcctttctgatgacccatcatcagttgggcatcagtccccggcggagacgaaaatggaaaaaacagacagagagagagggggagaagaggaaggcaaattggaggagaaaccgaagaaagaggagaaggaggacgagaagcacaccaaaatactcgtcagaaacgtgcctttccaggcgaatctcaaggagcttacgcagctgttttccgcatttggtgaactcaacttcatccgattaccaaaaaagcctggctccgaaggccaccgcggcttttgtttcgccgaatttctctccgtgagcgacgcgcaccgcgccatggacgcgctggtgcattccacgcatttgtacggtcgacggttggtgttggagtgggccaaaccgagcgaagaaagcgcggaggagaagcgacagcgaacgcaggacagaatggcaatggccgcgggcgttgccggggcgaagaaaaggccgaagatgcgatcattttagagccagtttcaagaattggcactttttaaccgttaattacattaaaatggtccgtccaccttgcgaaaaaatgttgttactgttatcttttggtcatttgtttttataacaatttacacacaaaaagagatcatcaccaatttaaaaaaaaaaaaaaaaaaaaaaaaaaaaaaaaa

SEQ ID NO: 1473 - DNA, 921 bp, Heterodera glycines
  coding sequence=SeqID_1690; coordinates=1-637
  peptide sequence=SeqID_1879
gcacgagggcacacagcgctcccgacaacagctgagctcatccgaggggttggccgagtccaccgcacgggaattgttggagcaacgggaaaagttggaacgggccgaacagaatttggacaccattcaccacaccactcagcacacacagcgcagcctgaacagcttgaagtcgtggtttggtgggctggtcagaaacaaactttcacgagcgccaaaagggttgggcacggcaaatgccaatgccaacaatcagcagcaacaactggaacagaccgtgcagcaacaacatcagcagcgtccgctgcatgcccatttggtgcagtcgtctgctgacgaatttgccggggccatcggtggcggaggcggcggcgttcagcccccgcaacagcactcgctgaactcctcgtcacgcgcgtacattcagggcactcgttgggaggcgatggacgacgaaattgacaacaatttggatctgatgagtgcccatttgggccgactgagaacgtttggcgtcgcgctgggcgacgaggtgcaggaccaaaatctgatgttggaccgcattcaaaagaagacggagcgcaacgacggcgtcatccgctcgcaggaggaccaaatgcggaagttgctcggctaatggatgaccaattaacacgcctaattaatgaacgaatgagtaatgtgatggtgttgatctatggcactgtgccgactgaccaatttaagacgaaatttgacttttgacgaccccccaaattaattggtattattgataatgatgattgatgatggatgattaattgtttcgttgattgtcccaatttctctctcttttttctaccgctgccaccgctcactgacctttgtatttaatcggttaaataaataaacaaaaaaaaaaaaaaaaaaaaaaaaaaaaaa

SEQ ID NO: 1474 - DNA, 741 bp, Heterodera glycines
  coding sequence=SeqID_1691; coordinates=35-529
  peptide sequence=SeqID_1880
gcacgaggataaaatcgtgccaacaatttgagggatgtccggtgacaattcggcactcattgcagcggagcaagcggcgtatggcccattttttggctcacttggcgtcactgcggcgatgattttcaccgcggccgggtcggcctacggcacggcaaaatccgggactggcattgcttgtatggctgtagcaaggcctgacctcgtgatgaaggcgatcattcccgtggtcatggccggcattgtggccatctacgggctggtggtggcggtgataatttccggccggctggaggcggccgggcccggctacaccatcgaccgcgggttcagccagttcgctgcaggcctcgtgtgcggtctgtgtgggttgggcgccggctatgccatcggcgtggtgggcgacgcgggcgtgcgcggcctgtcgcagcagccgcgcctgtttgtcggcatgattctgatgctgatcttctcggaggtgctcggtctctacggaatgattgtctcactgctgctaagttcttcctgaacaatggaaggaagaaagaaggaaagaatggcacgtctgctgaacattgtgccgaccgtcgtgttgtgatgatcaaaatgaccagccaccgtatataatagataaataccgtattttccatccatttttttttactgtgccccccccccttttctcttttttactattacatttttacaacatttaaaaaaaaaaaaaaaaaaaaaaaaaaa

SEQ ID NO: 1475 - DNA, 1633 bp, Heterodera glycines
  coding sequence=SeqID_1692; coordinates=44-1458
  peptide sequence=SeqID_1899
gcacgagggcacgagggttacatttaattaatttttggttcggatggtttctatggtcgctgggagagtgcatcttttgccgcgcgccgcctcttttggcaaatcgtttctttcatcggatgcgactaaaaagcctgataagacttcctttggcaatttgaacgactctgatcggattttcactaatctttacggtcgacatgactatcgcctcaaaggcgctttggcgaggggcgattggttcaaaacaaaggaaattattctgaagggtcccaaatggattctcggcgaaattagcacttccgggctgcgcgggcgaggcggggccggctttcccagcggaatgaagtggggcttcatgggtaaaccgttcgacggtcggcccaaatatttggtggtaatgcagacgagggcgagcccggcacatgcaaagatagagagataatgagacacgaccctcacaaattgatcgaaggttgtcttatcgcgggcgttgcaatgggcgcgagagccgcttacatttacatccgaggcgaattttacaacgaggcgtgcattctgcaagaatcaattcacgaggcttacaaagcgggttacattggaaaggactgtcttggcaccggctacaacttcgacattttcgtccatcgcggagcgggcgcttatatctgtggggaggaaacggcactcattgagtcgttggaagggaagcagggaaagccccggctgaagccgccatttcccgcggacatcggattgttcggctgtcctacgaccgtaacaaatgttgaaactgtcgctgttgctcccgcaatttgtcgccgcggtggcgcatggtttgccagttttggcagggaaagaaaccgcgggacgaagttgtattgcatctccggccatgtcaatgatccgaccaccgttgaggaggaaatgtccatcccattgcgcgatttgatcgaaaggcacagtggtggagtgatcggtggttgggacaaccttttggccatcattcccggcggttcatctgtcccattgttaccgaagagcatttgtgacgatgttctaatggatttcgatgcgcttgtccaagtgaattcggggcttggcacagcggcggtcattgttatgaacaaacagtgtgacgttgtcaaatgcattgcgcgtcttgccgagttttacaaacacgaaagttgtggacagtgcacgccttgccgggaggggtgcaattggctgaacaaaataatgtggcgcttcgtccagggcaaaggagtgcccagcgaaattgacatgctgtgggaactgacaaagcaaatagaggggcacaccatttgcgctttgggagacgcagctgcttggccagtacagggactgatccgacattttcgtcctgaattggagaggcgcatggcgaaatatgcggagagtcatcccgaaataaaggaaactttagcgaccgcataaaaacctttgttcatttgcttggattaggtgaatttttgctatgtttgtacagagtaaaaaatgatggataggctcataaataattatttattcgcttaattagttgttccgttttaattaatgaattcattgcgcaaaaaaaaaaaaaaaaaaaaaaaaaaaaaaaaaaaaaaaa

SEQ ID NO: 1476 - DNA, 523 bp, Heterodera glycines
  coding sequence=SeqID_1693; coordinates=17-415
  peptide sequence=SeqID_1881
gcacgaggaaatcgccatgacgaaaaagagacgcaacaacggacgcaacaaaaagggacgcggccacgtgcagcccatccgttgcaccaactgcggccgctcatgtccaaaggacaaagccatcaaaaagtttgtcgtccgcaatattgtcgaggcggcagccgtccgcgacatcactgacgcgtcggtttacgatcaatacgcactgccgaaactctatcacaaattgcactattgtgtctcgtgtgccattcacagcaaagtcgtgcgcaatcgttcgcgtgaagcgcgtaaggaccgaaacccaccgccacgttttggccaacggtctgccgtcgatcgtccgcaacgtccggggggagcggcccctggaggccccggaggcgttgggatgatgcaagcgattcgaacttaaagtgggcgaccgaagatgcatccttcgctgttttgttgttaccgttttttgtctttgtcaaaggataaaagttgttgaaaaaaaaaaaaaaaaaaaaaaaaaaaaaaa

SEQ ID NO: 1477 - DNA, 1440 bp, Heterodera glycines
  coding sequence=SeqID_1694; coordinates=1-1266
  peptide sequence=SeqID_1882
ggcgttggcattttcgaatcggacaataagctgagcccccgcccgttcttcccatggacagagatcaaatgcatttcgttcaaaaacaaaatgttcaccatttgtactgcggacaaaagcaaaatcaagttcagggcacaggacatgtccatcaatcagtcacttctcgacctctgtgtgggcacgcataacctttacctgcgcagacgacagcccgacctgctcgaggtgcaacagatgaagcagcaggcagacgagcagcgaaggcgcagaatggaggagcaggtgcggttgcaccgcgagcgtgagcagcgcgcgcaggcggagcaggagagggaccgctaccgcgcagaactgaaccatctgtcggaacagttgagcgccatgcagaatgtgatcagaagtgccgaggagacgcaagtgttgatcgcggaacgggcgcgtctttccgagcaggaggccattgagcaggcacgtcgtgccagcgaagccgaggcggaagcgcaacgcgcaaaactatcccagctgagggcggaagagaccaaaatgttgttggagcgaaaaatacgcgagactgaaatggccgcacaacgaatggctgcgcttcagcaccaacaacagcaaaaacagcagcagcaacagaatggcatcacaacgcccgggacggcaacagttgcgcagcaacaacaacagcagcaacagatgcagcagccacctccgtaccaagaagtggtcgagaatcggcaacaaacgcagcagcagcaaatgccattggccaatggtgtcggcgccgcagcagtgccattgaacaggccgacgacggcacaatcgccgaagaacaacggcgggacaaccacacccaataacaacaacaacaacaacaacaacttgattgtcgtcacttcgcctcagcaaatggcgcctttgtatttcggcggctgtcaatatgaaatggccacgacaatgtccgactcgcgcacttccgtcgccgccgaattgcagcacattttcgctgagctggaaatgtccaggagtgagtacaacgagcggaatcagtcgctgcgcgaccgtttggccaatttccgtgccgagttggactcgctgaagcgcgagggcaccgacacggaaaatgatcggctgttcgcccaaaaagtgatggccggcgacgcattcgacaaattttccacgctgcgaaagagcatcatcgggtcgccaaagtcacgcgtaaaactattcgacgaattggctccaatgaatggacaatgaaaaggtgctaggtcgatcctaaaaaagtatcaatggggcgatcctaaaaaagtatcaatgataatgaatttgctttcttttcctgttataagcccgtcgaactgttatccatgatggataattgattgcaagcgaattcacttttaaaaaaaaaaaaaaaaaaaaaaaaaaaaa

SEQ ID NO: 1478 - DNA, 873 bp, Heterodera glycines
  coding sequence=SeqID_1695; coordinates=1-744
  peptide sequence=SeqID_1918
gtccaattaagtgaaaattttacagcaattataaatatggacacaaccatggaacaaccggctgaagatgttgaggacgtacagttggatttggggaagaaaaagaagaagaaaaaggcgaagaccacagaactcaaattgtcagaagatgagcatgaggaggaaaaggaagtcactgcactcgccgaaggcgttggccgtacaaatttgctcgacgcaaaaaaccccgacgcgtggacggactacaactacgacgagatgctggacatggtcttcaacatcatgcgggagaagaacccagaaatggtttccggcaagaaaaagacatttgtgatgaaaccgccggaggtgcaaagggcgggcagcaaaaagacggcgttcacaaatttcactgaaatttgtcggctgctgaagcgtgacccgaagcatgtgctgcaatttcttatggccgagctgggaacgacgggctcaattgacggcaatcagtgtttaattgtcaagggcaagttccaacagaaacactttgagaatgtgctgcgcggttacatcaatgaatacgtccgctgtcacacgtgccgctcctcggacaccgagttgaccaaggatgtgtcccgcctgttcttcatccaatgcaaacggtgcgggagtcgtttcgcggtgtcctccataaagtcaggctacacggcaatggtgggcaaacgggcggcactccgtcgggcggccgaagcgacggcgggcaaatgaatggcaaaaagcgaatgtggatgggaaaggaaagagacttcttccttttgttgtttcctttttttgtcatgtaatttaacgcatcaaaatccgtaatattacctaaaaaaaaaaaaaaaaaaaaaaaaa

SEQ ID NO: 1479 - DNA, 579 bp, Heterodera glycines
  coding sequence=SeqID_1696; coordinates=53-370
  peptide sequence=SeqID_1883
ttttcttttccctttcattttttattcgttcaatcccttctttctttttgcaatgcttctccgtttctccctcactgttcaacttttgctgcttttcttcgcttttgaagtttttggcgctgaaccgccagaaggtgcacaaaatgaagaaggccaacgagacagcaaaagattggaaatggccaggaaagggctgaacgttcacatgttttcctcccccaatttcgccccaatgtttggcattatcgccggcctttccgttgttcttatcattgccattgttttcattgtcgtcggattgctcagcatggaacccgcgaaggattcgattatctatcggatgacaacaactcgcctaaagaaggactgattgtgagcaaagtgtgggagagagtgccgtgccgaaaaggaaaagtccgtcccccattaaatgatttgtttcatttgatagtgaatggtcacccaccctttgtcggtgttgcaatccgcaacgaatcatcaaaacatttaattttatagaatgtctatttcttcccattcattgtaatcatgtagagaataaattttttattttcacaa

SEQ ID NO: 1480 - DNA, 623 bp, Heterodera glycines
  coding sequence=SeqID_1697; coordinates=47-623
  peptide sequence=SeqID_1884
caagtttgagatttttacaaaaatacacatttaattgaattggcaaatgtcccttcgcttcttcggtttccacgattcggtcagcgaagggaaatttctgtgggagattctcacgcaactgagagggctcggagttggacggtgtgtgaccaaaagcgaatggatgcgcagatggcctgaccaaccgtcctacatgagaatagtcaaggctcgtccgacgatggaccgttggctgcaggagggaagcctttgggccgattggaccttccgcggcaaacatttgggcgtgtacgaattcggcacggacctgaacaggtccgactgggtgctgatccataagcacgaggagaagaagttcacggagaacaggcagcagatgggcacgctgaacattcccagcactttccctgtgcctcctttgcagcaattgctgtccaaaaaatgggccgagaaatgcggcggctccgaggcggcggtgcaccacaaaaaaagggcgccactggacgtctgtctcgacccgaactttgaaatgtatcgcaaattcatcaaacgggtggagccaaagaaaatgtccgtctcaatttacgacgaaattgaccctggcgtcttcctcgacctgtacg

SEQ ID NO: 1481 - DNA, 1023 bp, Heterodera glycines
  coding sequence=SeqID_1698; coordinates=1-943
  peptide sequence=SeqID_1919
gtcacattttatggcgttaaataattgttttactgagaatagatatccaaatgaatgcattctttcctatggctcgatcgctgtttcggatccgctcgatgcgttcgtttgttgtcgtttttccatccatgaacaccaggagaacatctgcgcatttggcacagaatatggcagagtagtgatttgcgatgtgacagctccgattaagggcgaggattttatcaaacatcgatttgccactggaaaaaatgctgtgttcgacttatgtttcattcctgatcgccctaatttattactttctctttgtggtgcctcaaacctagagcttttggacatcgaacggtcgtcgtccatttttttgcttggtcatcgtgacacggtccgatgtgcttccgtgtggcctgaaaatcccttttgcgttttgactggttcaagggacggtgacattttgctttgggatttgcgtgaaaaaccattgaaaagagaaattggtcggaaaagtgtgtcaaattctgtttcttctcttcgacgatatcaaactgctcatgaggcaaccattgcaataacaggccttttgcacatgagcgagaattatttcatctcttcttcatcgtcatcttcaagtggtattagaatttgggatttgcgatatcaaatcgcttcttcgccaatccgctctcttttcgttccccagaagatgagcaaagaatcgggcgttgcctcaatgtgttgggaccgattccgttcttccttttttgcactttgcactgacaatgccatttacgaatatgtcccctctcttaacagttcatttccagtgcgaagtttgcggacaaattttgtcaattcattttttgtacaatgcgctgcttcacctttctctgaccatcttttatgtggctcctctttttcaaaggcttttatttgggatttacagttttaggaggatcgcaaatattttcacgacatttcgtctcattatggaaaaaatcatgcacataaaaggaataaaaaaatgttacc

SEQ ID NO: 1482 - DNA, 690 bp, Heterodera glycines
  coding sequence=SeqID_1699; coordinates=1-513
  peptide sequence=SeqID_1885
gcctcttcctctgcaatcaaaagggggagtgatttgacctccgacgaaatgttcaccggggaaggcttttcccagcaaggcttgcttaattacgctgtcggattcttcaaaaaaggtcgtctttttttgttaccggtggacaaaaccttcgaaatgcgaaagcccttgcgggggaccattgagcgcgagtcgacggcgcgtaccaccgcattaaagccgtcttcgtccgtcttctccacttcgacacgttccgttgccgctgattctgctccttccggcactgcgtccgcttcgtcgtcttccgtcgctgttgccgcgccgttgcgcattcgctttgcacgtgccgaaaatgacttgcaacgacgccgccgagagcagtcgtccttctacaagcagaagctggtggagcaggaccagtggattccgctcaaagtggagcatagagatttgttggaaatgtacgaaaaggacatcaacaaggtgctgctgtcttcagaatgtccgcccaagtagcaaaaaggcacaatgaatgcttatagacattatattgaaagtcaaaacaacttctcgaacgcttaaactgttctaataacttgcaattgttggttttcccatctggaaattaccaaattatttctgttgatacatataaaaaaatgcatgttaaaaaaaaaaaaaaaaaaaaaaaaa

SEQ ID NO: 1483 - DNA, 632 bp, Heterodera glycines
  coding sequence=SeqID_1700; coordinates=1-472
  peptide sequence=SeqID_1886
ggccgtggtaagccgaatgtggtatattggaaaggagacttgcaaattcttccacggtgctgtgaaagtcttttttgacccaaattggcaaatcccaaagaccaagcttgatccaagaatgcccgcctatccaacccaacttcatgaatggcttcgcatgttcccctggcgtcattactgggcttactacccaattctgcgcaatttttgctacgtcttcgcctcagcttttgtcgttacgagcattactcaaccgacaagcgttaaaatcaccaaagaacacgtgatcaaccacgaattgcatcacatcgaagcgaaaatgctccacgcgtacacccaacggaaggaggacctgaagtacttcaaggagaacgacgtcatggccaaactgcgcccgaaaaactttgccagggatttgtcaatgggcgacttcaattacttcccctgggggtattccttcggagcgcactgatttctgcggagtacagaaaacgaaggtggacaacgcatttgcgatgccaagcacagattaggacaatgtttgttgaaatgtaccattgctattatattttgtgggaagtaagagaaataaaaggctaaaaaaaaaaaaaaaaaaaaaaaaaaaaaaaaaa

SEQ ID NO: 1484 - DNA, 319 bp, Heterodera glycines
  misc_feature (165)..(165): n is a, c, g, or t
  coding sequence=SeqID_1701; coordinates=1-262
  peptide sequence=SeqID_1900
aacctgtacacttgcaagggacagctgcacttttctcctccctttatgctacgacgaatatctcctttatcgtcctcttttcgggctcgacgattcggccggcacgctgggtgcaatgactcccccaacgcccgcctcgctgcttttctccttttggcccgatanaccccatattccccctttcgaggctatcgttggaggtatctgccgcgtgctttacgacactctccgtccgctggtcgtccacaacccgcacctctaaacactgggacaactgtgcactcttttgaaggtcaaaatgatcgacgagcgctgtgcc

SEQ ID NO: 1485 - DNA, 676 bp, Heterodera glycines
  coding sequence=SeqID_1702; coordinates=40-528
  peptide sequence=SeqID_1887
ttgaggtaaattttttgtcgcacacaaacttgagtaaaaatggcatttcgcgcactttctttcgcccgtcgtccgtttacaacttcgtccatttgccgtaaagaaattgacctggtcgccggtgtttatctgaacaaagttcgggaagtggttggcaaacaaagtgagattctcaattcgcctcagttgaagaagcagttggacgaccaactgaaccgtttggcccaaaaattccatttgccggatgccgacgcggttgccaagttgggccttcagtttaagggagcaagtgttgtcagttcggtggaccaattggttgatgggggacagtcggtggatgcccagcttaatgcgcttaatgacagtcgtgccaaatatgaagcggagcagaaggggaagagacaggctgaacaggagcggatcggcgcaatttctggtgatgcggactatgcaaaagagtttttcccaattccgccgcctcatatcgaagcccagcaattggccgccgccgccaaagctgcgcaatgatattagaagtgatcagcggaatgagtgatcaaaatgacaaaaaacaaatagcgattttctttgcctctttttgtgtgaaattttttgtagaatccgtctccgtataaaaaaaattgctaccaaaaaaaaaaaaaaaaaaaaaaaaaaa

SEQ ID NO: 1486 - DNA, 844 bp, Heterodera glycines
  cDNA sequence=SeqID_1291; peptide sequence=SeqID_1888
gcacgaggacaaccaagagcccgtgaccaagcgaggcttctgccaatttgtgttggacccgatcttcaaagtgttcgacgctgtgatgaacatcaaaaaggacgaagtggcgaagttggtggagaagctgaacatcaaactgaccttggaggagaaggaacaggagggcaagcccttgctgaaaacgatgatgcgcaaatggttgccagccggtgacactatgcttcagatgattgtcatgcatttgccatcgccagtcactgcgcagagataccgcatggaaatgctgtacgaagggccgcatgacgacgaggcggcggttgcaatgaaaaactgcgaccccaacggaccactgatgatgtacatctcgaagatggtgccaacctctgacaaagggcgcttctacgctttcggtcgcgtgtttgctggcagagtcgccactgggatgaaagcgcgtatccaagggccgaattatgtggtcggcaagaaggaggacctctacgagaagaccatccaacgcacaattttgatgatgggccgttacattgaaccgattgaggacatcccggctggaaacattgcgggactggtcggcgttgatcagtacctggtcaagggtgggaccatcaccacctacaaagacgcacacaacatgcgcgtgatgaaattctccgtgtcgcccgttgtccgtgttgctgtcgagccaaagaatgcgggagatttgcccaagctggtcgaaggactgaaacgtttggccaagtcggacccgatggtccaatgcattttcgaggagtccggtgagcacatcattgccggcgcgggcgaaatgaaagcgcgcatctaa

SEQ ID NO: 1487 - DNA, 824 bp, Heterodera glycines
  cDNA sequence=SeqID_1304; peptide sequence=SeqID_1889
gcacgaggcgcgaatatcttcctaaagtgttgggctcgtccttcgccgccacaattggcccttaccgcggctatgacccgaacatcgatccgacggtggccaatgaattcacttcgcaggcgtatcgttttggacatggaatgattcaggagttttacccgcgcttggacagtgccgggcgcaccattccctcgggcggatttgccttcgtcgacggcactctccactcggaccacttcattttccagggcggtccggacccgatcattcgtggaatgatgtctcaacagttgaaaaggccacaacgattgacgcggacgatcaccgaacaaatgtttggcaccaccgacttgggcacaattaacatccaacgagggcgcgaccacggggtgccgtcgtacatgcgctttcggcaattgtgcgggctttccaccgcgacgacatttgaccaactgagtcgtgagataatgagtgtcgaggcacgacagaatttgcagaggatatacggcacgccagaccgaattgatctgttcgtcggcggaatgctcgaagacccggtggtgcgcggtttggtcggtccgacagttgcctgcattattggtcctcaatttgcacggactcgcgacggggacaggttttattttgaaaatccgggcattttcacccgcgcccaattggccgaaattcgccgttcgtcgctcgcccgagtgatttgcgacaacggcgacgactttcggacagtgccgcgcgaagccttccgcacggggccaattgtccagtgcacagagataccgcaaatggacctgagcaaatggaaggagtga

SEQ ID NO: 1488 - DNA, 1149 bp, Heterodera glycines
  cDNA sequence=SeqID_1309; peptide sequence=SeqID_1703
atgcgaacaagacaaggcacaactcgaggaagagaacaagcacttgaaatttatgaacagtatcaagaagttcgacgaggatttgccggacagatcggagaacgaagaaaacaatcggagcaactgcgatccaacgaagtgaacacgtcgacgactttgcaagagcttggttttggaccggacgaggacgacgatttgcacaatgccagtcacttttcacaaccgactccggcgaatgcgatggctgccagtaccagcgcgggttacgatattccgcagcgtttgaaaacgctccacaatttggtcattcaatacgctgcccaggggcgttacgaagttgccgttccgttgtgcaagcaggccctggaggacctggagaagaacaacggccacgaccaccccgacgttgccaccatgctgaacattctcgcattggtttatcgtgaccagcgcaagtacaaagaggctgccgccctcctcaacgaggccttggccattcgcgagcgatgcctcggcgaggaccacccggcggttgccgcaactctgaacaatttggccgtcctttatgggaagaggggcaagtacaaagaggcggagccactttgcaagagagcgttggaaatccgagagaaagttttgggcaacgaccatcccgacgtggccaaacagctgaacaacctggccttgatttgtcaaaaccagggaatgtacgatgaagttgaaaaatattatcgtcgagcgctggaaatttacgagtcgaaattgggaccggacgattcgaatgtggcgaagacaaagaacaatctttcgtcggcatttctgaagcaaggcaaatacaaggaggcggaaatgttgtacaaacaaattctgacacgggcgcacgaacgacagtacggccgagtgaccgatgagaacaaaccgatttggatgatagcggaagaccgggaggacagtaaacaagcggacagcggaatttaccacgagaatttgcaagtgtcgatgaaagttgacaagtattcaaagtcattatggcggatgtttggcctaagacggttccaaaagagcagcaccctttttacgtcctccaccccgagcctattcgaatctctccgctgctccgatttgctcgttggtcggccctcggcctag

SEQ ID NO: 1489 - DNA, 1176 bp, Heterodera glycines; identical to SEQ ID NO: 1316
  cDNA sequence=SeqID_1316; peptide sequence=SeqID_1890

SEQ ID NO: 1490 - DNA, 180 bp, Heterodera glycines
  cDNA sequence=SeqID_1317; peptide sequence=SeqID_1704
atggtcaacaggcttctcgaccatggcattttggtgactcgcgcccgataccttctcgacaaagaaaaattctgtcccaaactgacaataaaagtttcgtgccgtgccgatttgaatggcgacgaattggaaaatttgggacagaaactgcgtctgacttttgccactttggaattttga

SEQ ID NO: 1491 - DNA, 1586 bp, Heterodera glycines
  cDNA sequence=SeqID_1324; peptide sequence=SeqID_1901
gcacgagggacgactcgcacattcgcgaccaggcaatttccatgagggcgcaacttgcagaagcggacactttggtgctgggacttcgcgacagactccagcaaatcgacacgaatgctgcggtgattgaacagcaattgggacagtttagcacggacaaggaaaccacccataaagagctgtctgttggagtgaattatgtgcaaacacaaggagaacagcacttggcaaaagcgcaggaggcgttcgaccgttacggggaaaagagtcagcaattgtcggagatcgctggcgaatccaagcagttgtctgatacgcaggagcagcgtcgccgggagatcctttcgttggctgagcaaattcggaaggagtcgcggcaatcgctcagcgacgccaacgaagcaatttttggagcttcaagcaccagtctgcaaatttctgctttgttgaccgaggtccacgagttggaacagcgactgaaagccatccaacaaatggcgacggaacagtccctcgagacaaaccaaacacacgacggggccgccttcattctgagcggagtggacagtatccgtctgccgaacgttttttctgatgagttgatggagaaagtcaaaagggcacaggaagagggtttggaagcgctgtctaaaacacggtcggaggcggaaaagcaagcggaattggtagaaaaagtggataaattagtggaggaagcgcgcgaacagttgcgaaatgcgcaacagaagcaaatgagtgtggacaattcctttgacgaagccgagtcttttaatgcgcgcacccaaacggctttcgaattggccacgaagacgtggaacgatgcgaaggattcgcacgacgcgctttccgactttcatagtaaaatcgaacaaagccgcgcggaagcgaccgaggaaatgaccaatttggcggatatcgaaaaggaaatcgaagaggcgcaggcgatgacaaaggaagccgaagatgcggtcggagacgcgagtcaaaatgcaaaagaagcggcggaagtggcggaggaggccaaaatgaaagcgcagaatttggccatggaagcggccaatttaacagacgccactgaacaaacgatggctggggccacagaaacgaaaagtgcgctggacactctcagcagcgaattggactccgttttgaccacaacaaaggattttgagaaccaagcaatttccgacgcggaacgttccaacgaagtcgcgaaaaaagcgactctctccgaagcgactgcaaattcactgcaggaaaagctgagtgactcggacacaaaacttacggaagcattggcccaactcagttccttagacaatgtggacgatgcgcaattggacaccgtggagaaactgctgaaagaagcggaaaatcgtttcgattcgagcggcaacgaagtgaaaatgcgagaacggatcatacaagcggagaccaaagcggtgaagcagaagagggaaatcgatacattggcaaaagaattggagaatttgcgtcaaatcagagattcattgccgactcgctgctacaattatgtaaatttggaacaggagggacaacgatga

SEQ ID NO: 1492 - DNA, 1461 bp, Heterodera glycines; identical to SEQ ID NO: 1447
  cDNA sequence=SeqID_1447; peptide sequence=SeqID_1705

SEQ ID NO: 1493 - DNA, 348 bp, Heterodera glycines; identical to SEQ ID NO: 1017
  cDNA sequence=SeqID_1269; peptide sequence=SeqID_1706

SEQ ID NO: 1494 - DNA, 444 bp, Heterodera glycines
  cDNA sequence=SeqID_1270; peptide sequence=SeqID_1707
atggcactgaaacgtatacaaaaggagctgcaggacctcggccgtgacccacccgcccagtgcagtgctggccctgtcggcgatgaccttttccattggcaagccaccattatggggccaccagaatcgccttaccagggcggcgtcttctttctgaccatccacttcccggcagactatccgtttaagccaccgaaggtggcgttcaccactcgtatttatcatccgaacatcaacagcaacgggagcatttgccttgatattctgagatctcaatggtctcctgcactgactatctccaaagtcttgctttcgatttgctctcttctctgtgatccgaatcccgatgatccattggttccggagatagcacgcatctacaagacggatcgtgaaagatacaatacgttggcgcgggaatggactcagaaatatgcgatgtga

SEQ ID NO: 1495 - DNA, 276 bp, Heterodera glycines
  cDNA sequence=SeqID_1271; peptide sequence=SeqID_1708
atggcaacttccgaagcacccaattatgcattgtatgaacatgcagtgggttacacactattcaagatcaaggaatatgaagacattggtcaaatacaaccagaggtgcaaagtgcgatgacagatgctcagcgttttcaaacgattgtccaagttcatgcatttgacccattcagaaacactgaggcggcgcttgaaaatgcgaatagcattgcggaagggattatccacgttgatttgctgaactttttggaggctaatctaccgaaaaaaaaa

SEQ ID NO: 1496 - DNA, 909 bp, Heterodera glycines
  cDNA sequence=SeqID_1272; peptide sequence=SeqID_1709
atggcatcgaatttgacggttaaagttcaccccatcgtttacatgtccatcgtcgacgcctatgagcgtaagtcatcttcgaacatcaacagtcgcgtgggcaccgttcgttccgtggaaacaacggaaaaccgagcgttgggcacgttgttgggattttacgagaagaatgtcgtccaggtgacaagctgttacgccgtgccgttccgcgagacctccgacgacattcccgaaataaatgatgcattgaacagacaaatgtggcacatgtccaaaaggacttcgccgtccgaacaaatcgtcggatggttcttcactgtgcccgacctttctgaaatgtgtccgcattatcacggctattacacggggttagtcaatgaaacgccgcgaaaagagccgccgcccattattctgatcaccatggatttcaccttttcgggagagagcgccgaccgacttccgatcaaagcatacgcggcacgcgaggcgggggtcccggggaaaggagcgactcaagcgacgattttctacccgttaaaagttgaaatggacgtgttccctggcgaatccgttgcactttcatttataatgaggggtttggactcggaacggcgcgagattaaatttgccaacagtcaggagcaattattggagaatggggaacagatggtcgactggttggagaagatgctcggctacgtgaaaagggtgttggacggaggagagaccgccgacccactcatgggacggaagttaatggagattgtttcactggcgaacacgcaattgcccgccgagaagatgaagtgtttggtggagcattcgctccgagattatcttatggtctctctgctggccaatttggccaagactcagttggccctgcaggaaaaagtcacttcctcgtaa

SEQ ID NO: 1497 - DNA, 1527 bp, Heterodera glycines
  cDNA sequence=SeqID_1273; peptide sequence=SeqID_1710
atggcttcttaccatgttgccattgctgctgatgaacgccaaaaatatcgctctttttgggaccaattttcgggaagagcagacaattcggcaatgatgctaaatgctaatgcagatcaaattgagtcattggacagagaaaatattctcgccctgttaccatcggtcaaaggcaaatttgtggtggacattggtgccggcattggccgtttcaccacagtgtttgcccagtcggaagcatcaaaagtggtggccactgattttgtggcctcatttgtggacaaaaatcggcagcgaaacggcgcatatgcaaatgttgttgagtggcgggtgggcgatgccaccggacttcagtttgacgagggcagtgttgatttggttttcactaattggttgttgatgtacttggctgatcaggaagcggtacaatttgttgccaatgctcttcaatggcttcggcctgacggttatctccatttgcgcgagtcgtgctcagaaccttcgacaaaaaaatctgctgatcactcaaccaccacaaccactaccagcacttcatcatcctcatcctcgtcgttgcacaacaattcgaagccaaatccgacccgttaccgcttctcatccgcctacatccaactgttgcgctccctccggcacacagacgtgcaaagcggaacccagtggcgcttcgatgtgcagtgggcgtgctcagtcggcgtgtacattgagcgacaatcaaactggcgtcaagtgcattggctggccaaaaaagtgcgtgtaacatcagcagaaaacagcatcccaaaatctattggatcgttggccacccaatttgctgaccaatggcccacggaacagcgacaatttgacggacgaatggacgaacaaaagccaggatggatgcaaaatgtgttggacaaatgcgttgctggcatcaaattgagcggcgatggaatcgttttcggtttcaatggcaggcaaacaattaaagaatttggtgttgatccacaaggattggcaaagcactttgatcgccgagtttgggttgtcgaaatggatccatttgcatatcgaaatgcgttgtcgcgcgcaaatcaatacgctgatcgacgagtccgtcacgcatggcactcaaattttgtcagtgcattagatttttggcgaaatgttggacaacggatgccaatgtttgccgcagttattggcactgaattgttggcacaactgcaggatgagcaagtgtttggcaaatttgcacaaatgctcgaaaatggagcacagtttgccaccgtggaagtgctgggcactaaccaaactcaaagcatcgacgacaaaaagctcaaagccactttggatttgcttcgttctcatttcgatgttgttgaacttgaacagatgcagcaacttgaaaatggcattaatcttttggtgataaaagcgacaaaacatcagtcattggcgtcaaaaatttatgaggacggaatgatggcgcattgccaaaagcgccacctgttaatgggcggattttga

SEQ ID NO: 1498 - DNA, 1053 bp, Heterodera glycines
  cDNA sequence=SeqID_1274; peptide sequence=SeqID_1711
atgcatatttacaaagatccttatgctcctccgttggctccaaaagtgcctgttgatccaccgccatggtttccttcgtggaaagaatacaaagggcgaaccgaatggtgggcttctcttggatacaaagaccttgacctgaagcgtggcttgacaactggtttttatcctttttttgaggaaagggacattcgttatgttgattcgaaagtgcctgatggaacttcgatggtcgggccgcaagggaaggacagtcgctaccaccaaagtaaaatggtcaaatggggaattcccggaaagtttgaagacttccagaagcagatcagggagaactgttcgcaatacaaacaaatcgctgaaaaatgggacctcagtgacgagcacccgggcattgcggtcaacccttcgctcgactcgatcattcgccaaaaataccgtccaattggcacggtgttccctctatttcctaaaatattggcttggccgcgtttttgggataaaccaatgaatgagggctgtttcgaaaagggacttgcactggccaaatattcgctgccgatcacttggattgcttatgcaggagcacttcgtggatatgatccgccagccaccaatgtcggtcgctttgaagcagtggagtttatcatccaatcgttccggggatggctatttagtagtaggatgattctgcccgcgttttattcctttacctttggccttacttcatgcacttcggctacatttcgcgatgaggacgattcgtggaattggatcgcagcaagtgccatttgcggactcgcccatgccactataagaaataacataccgcaaggatttgctttggctgctatcggctctttgttgggcgtctcctttcaagctgttcgaatcagtcacaacggctttggaatggtccacaaccgaatgactcaaggctttcttccgtttactggcccattggactggaagcatattccaacggatgccgttgatgtgttcttcgaatttggcgcagaatcattcacttttaggcattttttgcccaaagcttaa

SEQ ID NO: 1499 - DNA, 1388 bp, Heterodera glycines
  cDNA sequence=SeqID_1275; peptide sequence=SeqID_1902
tatttctaaacattatgaagaagtttgactatctcgtcattggcggcggttccggtggcatcgcatcggcacgccgtgccgcggaattcaaagtgaaagtcggactcatcgagtcggagcgccttggtggcacatgcgtcaaccttggatgtgttcccaagaaagtgatgtacaacaccgccatacatgccgagtttctgcgggaccatgctgactacggcttcgactcaatgaacgtaaaattcaattggagcaaaatcaaaaattcccgtgacgaatacatccgccgtctgaattccatgtatcagaccaacttggaaaattccaaggtggaaatagtccgtggacgggccaaattcaacaaagacggctctgtcgaagtctccagaagtgatggctcaaaagagacatgtcagggtacgcacacactgatcgcagtcggcggtgcgccgcggattccgaaggacgtgccgggcgccaagtacggcacgagcagtgatggattttttggctttgagcaaatgcccaataaaacagtcgtggttggtgccggatacattgcagtcgaattggcatcaattttggctgaccttggctctgaaacccatctgctgatccgttatgatcgtgttctgcgcaattttgacgacacaatgtcccaggcattgaccgatgcgctcatcgctggaccagttaatctcaaacagaaaacgctggtgtccaaagttgagcgttcagaaacgaccggcaaactgactgtccatatgacggacgaaagcaaattggaggatgtagacaaactgatttgggcaattggacgtgacccgttgacagctgagctgaacttggccgatgttggggtcaagctaatagctggcgactacatcaaagtggacgattaccaaaacacgaccaaggagggcatttacgcggttggcgacgtctgcacaccgaaattcgaactgacgccagttgcaattgccgctggtcgccgtttggcccatcgtttgttcaacaaggaagcggagaaccgtctcacctacgaaaacattcccactgttgtgtttagtcatccgccgcttgccacaacgggcctcagtgaaaaggaggcagtggagcgcttcgggcgtgaccaggtgaagacgtacaatgccggcttcacgaacatgtactttgccatgactcaacacaaagagaaaacccacatgaaaatcgtgtgccacggaaaggatgagaaggtgattggattgcacattttgggcatgggtgcggacgaaatgttgcaaggcttcgctgtctgtgtgaaggcgggtcttaccaagaaagactttgacaattgtgtcgccattcacccaaccgcctcggaggaacttgtgacaatgcgctga

SEQ ID NO: 1500 - DNA, 899 bp, Heterodera glycines
  cDNA sequence=SeqID_1276; peptide sequence=SeqID_1891
tgcggccaccggttgacgaggattatcgcccgatccgcgtacttggccaaggcgcgtacggcgaagtttggttggtgaccagcaaagaaaatgagagagagcagttcgccatgaaaaaaattcccgttaaagcgacggaggagggaattccgcagagtgtcgtcagagaggtcgcttctctcgtcgcactcaaacagatgaaacacccaaatattctcaggctccacgacgcattcattcgccgaaagggcggcaccatcagtttgaacatcgtctgcgaaaagtgcgactgggacttgtgcgactttttgcgaaaaattccgaaaaatatgtgcgacgcgcagtgcaaatattttgcacgtcaaataatgacgggcattgatttccttcatgccaacagtattattcaccgtgaccttaagcctcaaaacattttggtgaacaaagaccacactttgcggatcgccgatttcggactgtctcggaactacggtctgcatgccaccttcaccaccgaggtggtcaccctgtggtaccgtagccctgagctgctgctccagtgcaagtacggtactgcggtcgatctttggtccgccggttgcattttggcggagctgtacacgcgcgacgcgctcttcagaggggatacggaggcggagcaattgcgcatcatttttgaaaaactcggcactccgtccgtctctgtttggcccgccgatgcaattgtccctcattctttttacgccgaaaactctccgcacataacacctccgtttgccaatcagatgccccaatatttgcccgcctccggtgttgagttgctcacggcaattttgcaatttaatccgcacgaacggccgactgcggttgaatgtctgcagcacaaatactttgtctga

SEQ ID NO: 1501 - DNA, 1836 bp, Heterodera glycines
  cDNA sequence=SeqID_1277; peptide sequence=SeqID_1712
atggaacgattggagtcagtgctttcacaaactttccagcaaatgatgaccaatggcaaaaaactcgtcttggaacagataatcaccacgatcgcttcggtagctgatgccgcccaggatcacttcgccaaattttacggcaatttgatgccccctctcaaatacatttttgaaaacgccaaagatgacaatttgaagttgttgcgtggcaaaaccatcgaatgcatttcgctcattggaatggcagtcggcgcggaactgttcgagacggacgccgacagcgtaatgcaagtgttgctcagctcgggagtcaaattcgagaacaatgacgacccccaaatctcctacttcatcagcgcgtgggcgcgcatttgcaaaatcctcggcaagggtttcgccaagtatttggacatgattatgccggccgtgctgtccgccgccgacttcaagccgtctgttgcgcttgtggatggcaaggacacggatgacaacgaggactgggattacatgccaatcgacgagaaccgctcgctgggcgttcacacggccggactcgaggacaaagtgactgcgtgcgaaatgttgtgctgtttcgcgcgtgagctgaaggacagttttgccgcttacgtggagcgcgttatgcaactgatgctgccactgctctcctttctgttccacgacggagtccgttctgcggctgccgagtgccttccgtgtttgttggtctgtgtcaaagggtacggggatgagtacgtgcgccaaatgtggtcggtcatcctctccaattacataattgcgattggcaaagagactgatcttgaagttctctgcgaaatgctcaatggaattgcgcaatgtgtggaggactttggagggaatgacgccattgtgacggaccaagatgtggcgaacattttctgcgtaatttaccaacaaatcgaaaactttgacaagcgacgggcggagagggaaaagaagtctaaagaagaggagcatgacgaggaggaccaagagagattagacgaaatcatcgaactcgaaacttcggttttggcccgtgtgtcggacatcatccattaccttttcttgaccaaacgcgaggctgtcatcccccactttgacaaaatggcacaaatattcgctgcccttctcaacccgcgacgccctttccacgacagacagtggggcctttgcatatttgacgatgtcatcgaatttggaggcgaattgagtatgcgctatcagaatattttcttccaaccgatggtcactgctttggccgacaaatatcccgaggttaggcaggcggccgcttacggctgcggaattatgggactgaaggggggacagaattacgcgaaacattgcgcccaaatgcttcagccattaatcaatgccattgagaagaacgggtcgagaagcaccgaagaggacacgcgggcgacggaaaatgcgataagtgcggtggcaaaaatactcaaatacaacgcgacagaagtgaatttcaacgaggttgtgccgcgtttcgtcggttggttgcccatttggaatgacgaggaggaggtgccgtacgtgttcgacttcttctgcgatttggtcgagtctcagcacgacgcagtgcgagaggacccgtctcgtgttttccacattattctaaacgctttttcgcacggtgcttttgaggacgactcggcggaagagatgcgattggtcaaaagtcggatgaagggaataatggcacacattcgtgccaatgaacagttgttcacgcaaattgtacaatcgctacaattgaacactcaccagcgaactgtgctggagcaaattttggcctga

SEQ ID NO: 1502 - DNA, 1425 bp, Heterodera glycines
  cDNA sequence=SeqID_1278; peptide sequence=SeqID_1713
atggtatcgacaacaaatgagcaagatgaagaacaacaaaattggttgatgaaacaagacttgcaaaagctcaatccggaaaaattgacaccgctgacagaagaagtgatcagtcggcaggcaaccataaacattgggacaattggacatgtggcacatggaaagtcaacactcgtcaaagcaatttcgggagtgcatacggtcaaattcaaaaacgaattggaacgaaacatcactatcaaattgggctatgcaaatgcaaagatctttcgttgctccaatatcaaatgtccccggccgcattgctacaggtctgctgggtccagcactcccgaccgtttcccatgtgaacggcccgattgcggtggtgactttgtgtgtgttcgccatgtttctttcgtcgactgtcctggccacgacattctgatggccacgatgcttaatggtgctgctgtcatggatgctgcgcttcttctggtggccggcaatgagccgtgccctcagccgcaaacttcggagcatttggctgctgtggagataatgaagcttaaacaccttctgatcctgcaaaacaagattgaccttatcaacgagtctcaagcaaaggaccagcatgatcagatcaagagttttgtggaaggcactgtcgccgactcggcccccataattccgatttctgcccaacttaaatacaacatcgacgtcatttgtgagtatttgtgtaagaaagtgcccattcctccgcgtgacttctcttctgacgctcgtttgattgttgtccggtcgttcgacgtgaataagcccggctccgaagttgagcatttgaagggaggcgtagcgggcggttcaattttaaaaggcattttgcgagttggccaggaaatcgaagtccgacccggaattgtcactaaaagtgccgatggttctgtgcaatgccgtcccatctactcgcgaatagtttcattgtttgccgaacagaaccagctccagtacgccgtccctggtggccttatcggagtgggcactcaaatcgacccgacaatatgccgcggggaccgtttggttggccatgtccttggcgctgtagggactctgcccgacatttttactgacatcgaagtttcctaccatttgcttcgacgtcttcttggagtgcgcactgaggcagggaaaaaagcggcgaaagtgagcaaacttgccaagggcgaagtgctcatggtgaatattggctctctctccaccggaggtcgtgtaattgcagtcaaaggcgatgcggcaaaaatagcactgactgatccaatttgcactgaaagtaaccaaaatattgcattgagtcgacgcattgaaaagcattggcgtttaattggatggggcaccatcagaagggggacgaccatcgcagtgccccaaccatcgatcggataa

SEQ ID NO: 1503 - DNA, 1722 bp, Heterodera glycines
  cDNA sequence=SeqID_1279; peptide sequence=SeqID_1714
catgatgatcgtgtgccagcatttacggaacttacgcttatcagacattcacccgactctgagaatattcaaatgcaattcgccgcgttttttatttacagcggccttggaagattgatgagaccagttaggaaccttttatttgatcaaatcgagcaaataggaatttttgaacaagtttacctttccattataattgaccccgaagaggcagaaccgggcgtaacaatgcaccaagaacttcatccctcgtctctgttctcattcgctggcaatttgattccttttcccgatcacaaccaatcgcctcgaaatgtgtatcaatgtcaaatgggaaaacagacaatgggggtcccagtccacgcttggcagacgcgtacggacaacaaaatgtacaaattgcaaactgcgcaaaaacctttactcaaattggaggcccatgacaaatacgaaatggacgaataccctctaggcacaaatgcgtgtgtggccgttatttcgtacactggatacgacatggaagatgcaatggtgatcaacaaggcttcgtatcagcgtggctttgcacatggaactgtcgttaaagtgcagaggatcagtttggttgatcgctccaccggtggttttggtcagaacaaaaatgcggaaatggtctttttggggaagccgaacgaacgcaattacggcatcggtgcggacggcctgcccattgaaggccgtctctaccagcagggcgactgctattacggcactttcaatttggtcagcggacaattcaacgagcacaaattcacgaacagtgagcccgcttattgcgggttggtccgaattgtgcaggaggcggaccacaaaaacaaaaacgtgcacgtgttaatccaatggcgaatccaacggaatccgatcatcggcgacaaatttgcttcacgtcatggccaaaagggcatcaattcattcctttggccccccgagtcgatgcccttttccgagtcgggaatggtccccgacattatttttaaccctcacggttttccctcccgtatgaccattggaatgatgatcgaaagtatggccggaaaggccgcagcaatgcacggcacttcttacgatgcatcgccctttgttttcaatgagcaaaatacggccattgaacacttcgggaaactcctggccaaatccggatacaattattacggcaatgaaacgatgtattcggggatcgatggacgagaaatgaaggtccaaattttcttcggcattgtctattaccagcgattacggcatatgatagcggacaaattccaagtacgctcgacggggcccgtcgatccaattactctccagccaataaaaggcaggaaaaagggcggaggcattcgattcggcgaaatggagcgtgacgcactgatagcacacggcacagctttttgtttgcaggaccgtttgttcaattgttccgaccgggacgaggccgaaatttgcgcccgctgcggttccattgtttcagttacgcgtcttcgtccgcacattgcgatgtccaaatataaaacgcggccccatcagactcaaaagttcacccggtcgcactgttccatttgcttgagggaagaccaagtgtttcaggttcaagtgccgcgggtgtttcggtatttatgtgccgaattgggtgctgtaaatgtgaaggtccaattgtctttgtcgcatctccgagaaaatcggcattaa

SEQ ID NO: 1504 - DNA, 3249 bp, Heterodera glycines
  cDNA sequence=SeqID_1280; peptide sequence=SeqID_1715
cgcaaaaaagtggccgaacttctgaaactcgaggagacaattcaaaagaaatggcaaaaggcaaaagtctttgaaaaagaggcccctgaagaagacaaatcatcaactccgaaatacgtggtcacttttccgtttccttatatgaacggccgcctccatctcggacacacattttcgttgacaaaatgtgaattttctgttggttaccatcgcctgcgcggccgtcgctgtctgtttccattcgctttccattgcaccggaatgccaatcaaagcatgtgctgacaaactgttgagggaaattgaacaatttggcaatccgccagtgtttggctaccaaagcagcgaagaaatgtcaaaaaacgggacagaattagcgaaacaggaggaggaagtggaccaaatcatcaaggacaagagcaagggcaaaaagagcaaggctttggcgaaaactgtggctgccaaattccaatggcaaattatgcaatcgttgggcctcaatgacgcagaaattgccgagttttccaaatccgagcattggctgacctatttcccgcccaagtgtatggcggacctgcgcaaaatgggccttgcggtggactggcgacgtgccttcatcaccacagaggcaaatgcctatttcgactcattcgtgcagtggcaattccgaaagttgcgctcagaaaatctcatccaattcggcaaaaggtacaccatttactctcccaaggatggccagccgtgtatggaccacgaccgttccaccggcgaaggggtcggcccgcaagagtacactttgatcaaaatgcagattctggagcccaaacccaaagttctgtccaatgtctctgcttccaatggtaagccaatgtttttggtggccgccactctccgccccgaaacgatgtacggccaaacgaattgcttcatccatcccgacatcacttactccgtgttttttgtgggtacaaatgacgaagagattttcatcgcaacggaaaggtttattagggccgctcggaacatggcttaccagggcatgacggcggagaacggaaaaattcgctttgtgcccggcgtggaaagagtgaagggcgcggaattgcttggctgtgcgttgaaggcgccgttgacgagttttgagcgtatttacgcactaccaatgctaacgatcaaagacgacaaaggtactggcattgtgaccagcgttccgtccgacgcacccgacgattttgccgcactgatggacctgaagaaaaagaagcctttgcgcgagaagtacggcatcctggacgagatggtgatgccatttgagcccatcccaatcctcgagattcccgaatatggtcgtcttgccgctgtgcacatgtgcgaaaagttgggcatcaacagccaaaacgatcgactgaaattggaagaggcgaagaaggaactgtatctaaagggcttttaccagggggtgatgttggtcggcaattaccgggaccagaagacggaggtggtcaagaagctgatccaaaccgacatgatccgggatgggcaggcgtgcaaatatgtcgaacctgagaagaaagtgatctctcggtcgggcgacgaatgtgtggtggcattgtgcgaccaatggtaccttaactacggggacccggcatggaaagaagcgactcgcaaatgtttggcttcgcttaacactttttcggacgaagtgcggcgcaactttgagcacaccatcgaatggctgcatgaatacgcttgttctcgctcgtttggacttggaactaaacttccatgggacccgcaatatttgatcgagtcgctttccgacagtaccatttacaacgcttattacactgtttcgcatttgctgcaaaatgatatttacggtgctgaaacgggtgaactcggcattttaccacctcaactgactgacgctgtttgggattacatattcatgggtattccatatgattcgactaaaatgccaattgaagaagcaaaactgaagagaatgaggcacgagtttgagtattggtaccccgtcgatatgagggtttccggcaaagatttgatccaaaatcatctcacttattacattttcaaccacgtggccatttggcgtaaacagccgcagttttggccgcagggaattcgtgcaaatggacatttgttgttgaacaatgaaaagatgtcaaaaaatactggtaattttcttacgctttttgatgcaattgaacttttttctgctgatggaatgcgattcactttggctgacgccggagacggaatcgaagatgccaatttcatgtacgaaatggctgatgcgggcattctccgcttgtacgcctttctctcgtgggcttcagaaatggtcgaagcatgtgccaagggcgaattgcgcaaggacggcatcgagacttttgcggacaaaatattcaacaatgaaatgaaccgtctcattttggttaccggcgaccattttgagcgtactcttttcaaggaagcactgaagaccggctttttcgagtatcagttggcccgtgacaattatcggcagctctgcgggagtgaccaggcaatgagtgccgcgttggtgttacgcttcatcgaaacacaagcgattattctttcgccgatttgtcctcatgtttctgaacgtgcctgggaattgttgggaaagcccggccttctcgtgaccgatgctcgctggcccgtcactgctcctgccattccgttgctcgtcgaccagagcaacttcatccacaacaccgtgcacgagtttcggctaaggcgcgacgcgaagctgtgcccgaagaaaaaggacccgaaaaagcaattgcaacccccgaagtcggcaacaatttacatcgcaaaacgctatccgtcatggaggggaaaactcatcttggaattgggacaaatgtacacggacaacggcactcttccggacaaccgaacactgctcgaaaagctgagcaaaccagaatccgcggaagagaagaaggagcgcatgtcgttcgtacagatgttccgcgatcgcattgctcaacgtggcatttttgcggtgacgtcggaagaggaattcgaccagaaggcagcgctcagccaaatcagcgactttttgctctcgactttacaattggaggaggtgaaattcgctgattcggccaacgctccctccgatgtcatccgaaattcgtgctgtcccggcgcaccgttaataatgtacgactttgttgagacaacaaacaattag

SEQ ID NO: 1505 - DNA, 3150 bp, Heterodera glycines
  cDNA sequence=SeqID_1281; peptide sequence=SeqID_1716
atgggacgcatcaaattggacggtcgaattcgtgcacaaattgagcgcggcgtggccaaccgatggcgctcactgttcatcatcatcggggacaaggccaaggatcaggcggtcactttgcatcacattttggccaaggccaccaccggggggcgtccgtcggtgttatggtgctacaagaaggagacggagttcagctcgcacagaaagaaacgcatcaaagagttgaagaagcgcaaagagtcgggcctgttccagtcaaaggaggacaacctgttcgagcagttcatcctgtccactcaaattagctactgttactatgccgactcgcatcgcattctgggcaacacctttggcatggctgtgctgcaagactttgaggcacttacgcccaaccttttggcccgaactgtcgaaacggtggagggcggtggcctcgtcgtgctgctcatccaatcggtcacctcactgaaacagttgttcaccatgagcatggacgtgcacaaacgctaccggacggaggcgcacgcggacgttgtcgggcggttcaacgaacgcttcatcctttcgttggccagctgtgccaactgtgtggtgatggacgactgtctgaacgtgttgcccatttcctcctccgtcctcaacatggccaatttgccgcccgtcgtcgcccagcaaaaaagtgccgcgggcggcgatgtgtcgtcggagttggcacggctccaacagtcgctggccgacacaaaacccatcggcccgttgctgcaccggtgccgcacactgtgccaggccaaggcgctgctccgcctactcgacctggtcaccgacaaaatgtccaactcaatgtgcgcaatcaccgcggcgcgtgggcgcggcaaatcagcggccatgggcctggcggttgcgggcgcggtcggctgcaatttgacgaatatttttgtgacgagtccaacaccggagaatgtgcgcacactgttcgaatttgtgttgcgcggctttgacgccatcggataccaagaacatgccgactttgacgttgtccgctcgttggacccgcaaaccgacaaatgcgtgacgcgcgtcaacattttccggcgccatcgccagaccattcaatacatccatccgtccgagtttgtcaagttgggccaggccgaactgttggtgatcgacgaggcggccgccattccgatgccactggtcaaacagctcattcacggaaattttttggtgtttctcgcctcaaccaccaacggctacgagggcaccgggcgttcactgtcgctgaaactgcttgaacagttgcgacggggcggcggcggtggcgagcgcgggacgacgacggcggcgacgggtgccatcggtgatgctgctgagacggcgacaacggcacggcggcgaccgttgttcgaactgacgctggaggagagcattcgttacgcgatgaacgacccggtggaagattggctcaatcagacgctgtgtctcaactcgcagcagagtttgcccacgtctttgacggggacaccggcgcctgacaaatgcgaattgtattacgtcaacagagactcgctcttctcatttcacaaggcggcagaggtgttcttggccaatctgatgtccatttacgcggccgcccattacaaaaacagtccagacgacctgcaaatgttggccgacgcgccggcacatcacctttttgtgctgatggcacccgtgccggctgaccaaagctccgtgccacagattttggcggttgtccaactgtgcctggagggctccatctctaaacaaagtgtgacaaatgtacgggacaaaggcaaaaagcgggcggccggtgacctcatcccgtggacactttgccaacactttttggacgacgaattcccaactctgtgcggtgcgcgcattgtccgcgtcgctgtccacccgaacttccaaggcatgggctacgggtcgcaagcagttcgcctcctgctcaacttttacggacggaggccgcggcatgtttcaacgacaacggcggcggcacaatgccaaaatggggaggacaaaaatggtggaaatgatagggaggaggatgaagagatgtcgagggtccaacttgtggatgacggcgatctccaccaattgctgctccatgacgagcaaatttcgccccgtgccaatttgcccccgttgctcgtccgtctcgcggactaccgacgccatgctgaccaattggactatgtgggcgtttcgtttggccttacgttggcgctgctcaaattttggaaacggcttggctttgtgcccgtttatttgcgccaaaatacaaacgatttgacgggcgagcacagctgtgtgatggtgcgcaaaattgcaattgcagcagcagggggaggaggaggtgaacatggcgaagatgacggaaacggcaggatggacggggaatggaggcatcattatggcgtgctggcgagtgccggtgttgctgcttctgatgccacgctgaactcggacggcacttggctgtccgccttctttgtggagttccggcgacgcttcgtttctttgcttggcacttcgttcagcgcgttcagtccccacttggcgttcagtctgatgttcatggacagtgccagcatcatcggctgctccgtgcagcagcggcaggacgaacagcaggccgaaaatggcctgcttgaccgtgccgaactccgtctgcgcctgtccgacttagacctccgccgggttgcccagtactgtcgcaatttggccgacttggccttgatcagcgacctgttgcccaccattgccggcctgtacttcaccgcccgggtggacaccaaccgggccccgttggacctgtcccaggccgctgtactgctcggtgtcggcctgcagcgcaaaatggtcgaaacggtggccaacgaattggcactgtccaccagccaaacgcacgcgctgttgaacaaagcgatcagacgtttgtccgaatatttcgactcaatttgccgtgaggcgcttgaacagcaacaacaacaacacaacacaaatgatcgccaacagcacatagcaacagaagcagaaggaaaatttggggcaaaaacgaaaagcgacgaatgcccggcgattaaaaaattgaaaatttcacattttgtcaaatga

SEQ ID NO: 1506 - DNA, 795 bp, Heterodera glycines
  cDNA sequence=SeqID_1282; peptide sequence=SeqID_1717
atgggtaaaaacaaaaaaccgttcattgaccgaaaaagtgccgtaaattacacactgaacaacagagagttggaggagacgcagcggatcagtgattacaagagcttttcgtttcgttcactcgacaaacgttttgagggtatttacgaggactatgcgaatgaagaggaggagggagcggaggaaatggacgacgaagaaggacaaacgggggctgattctgcgattttccgttctctgctggcggatgggcaatcccagcggagttgcgaagaacgttttcaccgggagctgcccgattccgagctgaagggcgcggtgttgcgttatgcaaaagcgatggaaattggcaaaggaagggccgagccgacggaggacattttggtggacagtgcgaagagaagccgctgggattgcgagtccattctctccatgcattccaccctttacaatcatccgaccgaaattagggagccgatgaaagtcattgggaggcgaagggggaggacgaccaaagagaaggaaatggccaatttggaggaaacggaagttgacggagaccaaagagacgggccaccggcgccgtccgtccgcacgcgcacttcgatggttagcgtaattcgaccgaagggggagacgacggaagagcggcggatgcgtaaaattgcagtgaaagaagaacggagagagcggcgtaaggaaaagaaggcgaacaaagaaacctttcgggcggagagactgaaattggaggcacagcgaaaaacgaatcagccgaagacgcgacaaattcattga

SEQ ID NO: 1507 - DNA, 1150 bp, Heterodera glycines
  cDNA sequence=SeqID_1283; peptide sequence=SeqID_1718
ttttgccggggagagtgccatttgctgccatcacaagtcgctcaaccaaacttcgtccctccgcctcacttattccgctttccatggcgtcggctccaaattcgtccgccgaatgttcgctgagtttggctttccctcggagaacatttcgtacgttaaggaacaagacaagcccgaccccgactttggcactgttccattccccaaccccgaggaagggcaccgggtcctcaaactgtgcattgagactgcaaatgccaatgactcgactttgctcctcgtcaatgacccggacgccgaccgactccaattggcggagaaagaggcaaacggagagtggcgcgtgttcagcggaaatgagatgggcattctgctgacgtggtgggcgtggaccaattggcgtgccgccaacccaacggcggactcttcgcgggtgttcgtcctccattcggccgtctcttcccaaatggtcgccacaatggccaaaaaggagggcttcaaagcggcgcattcgttgacgggcttcaaatacataggcaatttggcacacaaattgcggtcggaaggcaacaccgttattgccgcctgggaggagtccattgggtttactcccggcacaacgctggacaaagacggcgtttcttccgccgcggtctttgctgaaatggccaattggctgcgcacccaaaagggcgtttcgctgcgtgaacagctcttccgcctcttctccatctacggctttcacctccaacgcaattcgtattggggggtcaaatcgacggaagtgacgaagaaattatttgcggaccttcgctccgattatcccgaaacgattgggcagaatttcgatgtgaaatttgtgcgcgacttgacgacaggttatgacaacgctcaaccggatgacagggccattctgccgctgagcacctcctccgaaatggtgactttcactttggtcgacggaagtgcggtgacactgcgggcgagcggaacggagccgaaagtgaaatattacatcgaactgcgcaccgaaccgggcaaagaagaaaaggatctgagttcggtgcttgagcagctcgaccaattggaatccgacgtggtggacactctcctccagccgaccaaatacggactgatcagtcgaatttga

SEQ ID NO: 1508 - DNA, 1311 bp, Heterodera glycines; identical to SEQ ID NO: 868
  cDNA sequence=SeqID_1284; peptide sequence=SeqID_1719

SEQ ID NO: 1509 - DNA, 1160 bp, Heterodera glycines
  cDNA sequence=SeqID_1285; peptide sequence=SeqID_1903
gaaaaatgaatcctgatcttgaaatcgctcaaaaatttttcttgtgtaaagaaaacaaaaaagatgtcgcaacaatttttctcgaattgcttaagagcattactgacaacgaaatggcgcccttttacgaatacgccgcccctcaactcggcgtgcccattgacaaggctaaactgcaaacactgaaggcacttaatgagcaaaaattggacgaatttgaccgaaaaataaaggacgccgaggaaaatttgggcgagagcgaagtgcgtcagtctcacttggccaaggccgagtatttgtgcaaaattggggacaaagaacgcgcattggccgccttccaactgacatttgacaaaaccgtgggcatcggttatcgcatcgatttggtgttcaatgtgatccggcttggcttcttcttcatggaccatcagatcatcacggaaaacattgaaaaggccaaatcgctgatggaaaagggtggcgattgggaccggaagaatcggctccgctcctacgaggctctctacaaaatggcaattcgcgaaatgcgcggggcggcgcttctctttttggaggccgtgcccacctttgacgcctatgagctgatgagctacgaagacctgaccttttacactgtgatttgctgcgtttatgctttggaccgacccgatttgaaggagaaggtggtcaactgcagcgaaatacagcaacaattgaacgccgaaccgacagacaaaaatcgtcatttgcccttggccaaacaattgctgaccaccttttaccggtcggagtatgctcagttcttcacggcacttgccgagctggagcagtacatgaagcaggaccgttatctgaggccccactatcaattctactctcgtgccatgcgtgtccgggcatatcagcaatttttgtcaccgtacaaaacggtcggtcttgatgtcatggccaaatgctttggggtcagcaaagagttcatcgacaaggaactgttcatgttcatctccttgggtgcgttgaagtgtcgcattgacacggtgaaagatgtggtggaaatggggcaggccgacaacaaattctaccagtacaaaaagttgcttcatgacggggacattctgttgaatcgtgtgcagaaattatcgcgggttatcaatgtgtga

SEQ ID NO: 1510 - DNA, 1164 bp, Heterodera glycines
  cDNA sequence=SeqID_1286; peptide sequence=SeqID_1904
aacccggtcaaattcggcctttacatcggcccaagcaaaaccgaggccatttgcatttcctcaaaaagttcggacagcggaaatggaccttctcttggcaccagccccacaatgtcattctcgccggtgcttacaattagcgaagagaatttggcctccgaattcgcaaaaggcaacgtaacaattgcggacagacgcccttcgaatgcaatggacttcgaactgtttgaggagaaggcaaaagagaagcggtcgttgcgtctctcccgtgaccaattggacctgttgaacttgaactacgggtcgaacgacgcgcggttcagcatcacaacaaaatatcagggaactgcttggtgttcttgtcacatttatttgctcaaatggtatgacaaattggtcatctcggatatcgacggcacaatcacaaagagcgacgtgcttggccatgtcattccagcaattggtggcacttgggcccattccggggttgcagagctgtatactggcatcaaaaagaacggatatcaaatggtttatttgtcttcgcgtgccattggacagtcccactacacgaaaacgtacctgcagaacttcgcccaggggtccaggactttgcccgacggacccgtccttctctcgccttcttccattctgatggcattcagaaaggaggtcattgaacggaaacccgaggagttcaaaatcgcatgtctcaccgacctgaaatcgctgttccccgtaggacagccattctttgccggatttggcaatcgcgaaacggacgttaaatcgtatcttgcggtccaaattcccccggaaaggatcatgattattgacccgcaagggtcgctcagaagggcggacaacaaagcgggtggttacgtgtccgattacccaaccttggccatggacagtgtcgactacgtgttcccgcctcgggtggacatggacggcatcgacattaggacgaaagaggacggcattttgagtgaattcgtcgcatggcgaactgacgctgaacaattcgatgcgctggtggacgcggaattggaacagtacgaagaaaggagcaaacgagcgaaagcaattgtcgcggggacgacggatggacgaggggcggacggaaagaagaaaatgtataggaacggaagacgggcaaagtga

SEQ ID NO: 1511 - DNA, 576 bp, Heterodera glycines
  cDNA sequence=SeqID_1287; peptide sequence=SeqID_1720
atgattccgctcaatttgcaaattgcagagtctgctctgaaggtcctccaaacaaaaacgcccgggggagaaattgagcaaagtgcgacggcgggagctcactgtacaaacaatacgtgcaaaaaagtgttcaccggtcccgagagcgatgccgaagagtgcgttttccacccgggcaatgccgtttttcacgaaggactcaaatactggtcgtgttgtgggcgcaaaaccaccgattttaccacatttttggaccaattgggttgcactcggggcaaacactgctggaaaaagaaagaaattgtcacaaatgcgcgcgaggattggtttcaacgaggtggccaagtgcacatcacaatttactgcaagggagcacttccgagcgaaacatccgccaaatcggacggtctgacattggaagtgaccatcaacgggtccaccaaacggtacgaactgttcggggaaattgcgccgtccgaaagtgtggtcattatcagcgaacgcaaagtggaaattgtgttgaagcaagtggccaaaattgggtggccaaaactttgttatgatccgccaaactga

SEQ ID NO: 1512 - DNA, 1953 bp, Heterodera glycines
  cDNA sequence=SeqID_1288; peptide sequence=SeqID_1721
atgccagctaaagctaatgcaattggtattgacctcggcacgacgtattcgtgtgttggagtcttccagcacggaaaggtggagatcatcgcgaacgaccaaggcaaccgcaccacgccgtcctatgtcgcgttcaccgacaccgaacgtttgatcggcgatgcggccaagaaccaggtggcgatgaacccatccaacaccgtgttcgacgccaaacgtctcatcggacgcaagtccgacgacccggcggtgcagtcggacatgaagcactggccgttcaaagtggtgcagggagagggtgctcgtccgaaagtgatggtggaagtcaaaggcgaggacaaagcgttcttccctgaggaggtttcgtccatggtgcttatcaagatgaaggagacggccgaggccttccttggccagactgtcacggatgcggtggtcacagtgcccgcttacttcaacgactcgcagcgtcaggccaccaaggacgcggggaccatcgccgggctgaacgtgttgcgcatcatcaacgagccgacagccgccgcgattgcctacggcttggacaagaaggggcagggtgagcgccatgtgctcattttcgacttgggcggtggcactttcgacgtgtccatccttaccatcgaggacggcatcttcgaggtgaaatcgaccgccggtgacactcatctcggtggcgaggacttcgacaatcgaatggtcaaccactttgtcgcggagttcaagcgcaagcacaagaaggacctcagttcgaaccctcgtgcgttgcgtcgtttgcgtacggcctgcgagcgcgccaagcgcactctgtccggttccacccaggccagcatcgaaattgactctctcttcgacggcatcgacttctacaccaacatcacgcgcgcccgcttcgaggagctttgcgccgaccttttccgcaacaccatggaccctgtggagaaggctttgcgcgacgcgaagatggacaagtcccagatccacgacattgtgttggtcggcggctcgactcgaattccgaaggtgcagaagcttctctccgactttttctccggcaaggagctgaacaaaagcatcaacccggacgaggcggtggcctacggagcggctgtccaggcggccattctttccggcgacaagtcggaaactgttcaggacttgctgctgcttgacgttgcccctctctccctgggcattgaaacggccggcggcgtgatgacttcactcatcaagcgcaacacgaccattccgacaaagacgtcgcagacattcaccacctattcggacaatcagcctggtgtgctgattcaggtctacgaaggcgagcgcgcgatgaccaaggacaacaacctgctgggcaagttcgagctcagcggcattccgccggcgccacgaggagtgcctcaaatcgaagtcactttcgacatcgacgccaacggcattctgaacgtgtcggcccaggacaagtctaccgggaagcagaacaagatcaccatcaccaacgacaaaggccgcctttccaaggaggaaattgagcgcatggtgcaggaggcggagaagttttccaaggaggatgaggtgcagcgtgaccgtgtgtctgccaagaacgccttggagtcctactgcttcaacatcaagcagacaatggaggactcaaatctgaaggacaagatcagcgaggacgacaagaagaaggtgctggagaagtgcggtgaggtgctggcatggctcgacgccaaccaggcggcagagaaggaggaatttgagcaccagcagaaggaactcgaagggatctgtaatcccatcatcaccaagctctaccaagccggcggcgcaatgcccggcggtccaatgcctggcggagggatgcccggaggtggcggcgctgctggtgcgggaggagccggtggaccgaccatcgaggaagtggactaa

SEQ ID NO: 1513 - DNA, 1341 bp, Heterodera glycines
  cDNA sequence=SeqID_1289; peptide sequence=SeqID_1722
atgtcagctgcggtttcttcttcgcgtccgatggaagattggaaatctgagttagctatgccagacaaggaccttcgatacaaaacatctgatgtgactgcgactaagggcgttgaatttgaggaatttgggctcactcgcgaccttcttaaaggcatttttgagaagggttgggagcatccaagtccggttcaggaagcgtcgattggaattgcacttacaggccaagacattctcgctcgcgccaaaaatggaactggcaaaactggcgcatattgcattccctgcattgagaaaattgacccatcaaaagaatacatccaagcaatgataatcgttccaactcgggagcttgccttacaaacatctcagatttgcgtagaactcagcaaacacttgaagattaagattatggtgacgactggcggaacagatcttcgtgacgatattttgcgtctcaatggtattgtacatcttgttgtggcaactcctggccgaattttggatcttatggagaagggagttgcgaatgttgcgtattgcaagacgatcgttctcgatgaagcggacaaactcctttcccaggacttccaaggtgtgcttgaccgtcttgttcagtttctacccaaagaccgtcaaattatgctgtactccgcaacatttccgcgcactgtcgcgacttttatggaaaagcacatgagcaagccgtatgaaatcaatctgatggaggaactgacgctgcttggcattacacagttttatgcttatgtccaagaaaaacagaaagtgcactgtctgaacacgcttttccgcaagctccaaataaaccaatccatcatcttttgtaattcgacacaacgggtggagttacttgccaagaaaatcacagaattgggctactcctgttactacattcattccaaaatggctcaacaccacaggaacagagtgttccatgaatttcgtcagggtcattgtaggaacttggtctgttccgatctgcttactcgtggtattgacatccaagccgtcaacgtggtcattaactttgacttcccgcgcaattccgagacatatttgcacagaattggacgttctggccgttttggccaccttggtattgctatcaatctgatcacctttgaagaccgttacaacctgcgacgcatcgaaaaggagctcaagacacacattgacccaattccaaaggaagtcgatccgaaactctatgttgctgaatttcaaatggatcacaccaaattcgactgtgggaatgtcgtcgatggtgcggtgctgaacaacggagtcgaccaacaacagcagcctcgggcttcgtcgtag

SEQ ID NO: 1514 - DNA, 744 bp, Heterodera glycines
  cDNA sequence=SeqID_1290; peptide sequence=SeqID_1723
atgttccgcaaccaatacgatagcgacgttactgtgttcagcccgcagggccgtcttcaccaaattgattatgcagtcgaagcgatgagacagggcagtgcagcagtagcaattcgtagcaaagattatgctgttgtggtcgcacttatgcgtgcacaaaacgagctttcttcatatcagcagaaagttttcaaattggacgatcatctcggcttgtctatgtctgggcttatttcagatggacgcattttggcacgctttatgcaaagtgaatgcgccgagtttcgctggaactatcataatccaatttcggttgaactgctcaaccgtaaattaggcttgaaacttcagtccaatacccaatattacggacgccgcccatttggtgtgggactgctcatcattggatatgatgacaaagggcctcacgttgtgaaagccgaaccctcgggggacgtgtccgaaatgtttgctgcttcgattggcgctcggtcacaaagtgcgcgaacttatctcgaaaagaacctaccagaatttgagacggctgacagagacgcattgattcgccatgcgattcgctccctcaaagagacgctgcaggcggacgctggcagtttggatgagaataacacgtttattgcgatcatcggattgggacaaccttttacctttttggggaaagacgccacgcgggcgcatattcgttcagttgaagaagaagcacacagggaaatggacgaatag

SEQ ID NO: 1515 - DNA, 765 bp, Heterodera glycines
  cDNA sequence=SeqID_1292; peptide sequence=SeqID_1724
atggagcattatgatcgtgcaattacgattttttctccggatggcagactttttcaagttgactatgcgcaagaagcagtgaagaagggctcaacagcggttgccgtgaaaggaaaaaattgtgttgtaattggagtcgaaaaaaaatctatcccgactctgcaagacgaacgtaccattcgtaaaatacatgcattggattcgcatgtgatggtcgcattcgccggactcagcgccgatgcacgcgtccttatcgaccgtgctcgagttgaatgcgaaaattacaaattgacgcttgaggaccgcgtatctgtcatgcatatctctcgcatcatagctgatataaaacagagatacactcaaaccactggccgtcggccttttggaatttcaatgcttgtcggaggcttcgattctgatgggacccctcatcttttcaagacggaaccgtccggagtttactacgaattgttggccggttcaatagggcgaaatgaaaagattgtgaaggagtatctggagaaagaatacggcaacgacaacacagctgatgaggagtctacgcttaaactgatgctcaagtctttagccccagtggtccaatcgggggcgcagaatatcgaaattgcggtgctcaaatgggtggatggcaccaatggggagcctgggtattgtgagcagcaaattttaaatgtcgaagcgattggagcgctgttgagtcaaattgggcctatcgaacaacagaaaccgatggaaacttcttga

SEQ ID NO: 1516 - DNA, 756 bp, Heterodera glycines
  cDNA sequence=SeqID_1293; peptide sequence=SeqID_1725
atgtttctgacccgcagcgaatacgacaggggagtgaacactttttccccggagggccgtctgttccaagtggaatatgccatcgaaactgtcaagcttggttccacaagcatcggaattcacaccaaagaaggcgttcttttggctgcggaaaggcgttcaatgagcaaattggtggtggacgactcaatgagcaaaatttcggaagttgagaagcacattgccgtcgcctcggccggtctcatcgcagattcacgcacttgggtcgaacacgcgcgggtggaggctcaacacttttggtttacttacggtggcaaaattcgggtggaagacattactcaaaaggtctcaagattggcactgcattttggagacgacgactcaactatcagtctcggccgtccgtttggagtttctatgctttttgccggcattgatcacacgggtgcgcatctcttccatttggacccgtccgggacgtacattaaatgtttggccaaggccatcggtgccggctccgatgcagcggaacaaacgctgcaagagcactgtaaaaactgcgacaaaaaaatggaaatggccgaggcaaaacaagtcgcactgaacacactcaaacagctgatggaagagaaaatcaattccaaaaatgtggaaattgttatgattaagccgcagacggacaaggaaggcaaaacgttgggcaaaattgtgtggttagaggaatcggagttgcaagaaatcatttcgcgattgtag

SEQ ID NO: 1517 - DNA, 1308 bp, Heterodera glycines
  cDNA sequence=SeqID_1294; peptide sequence=SeqID_1726
atgatcggaggtctttttgtttataaccacaagggtgaggtgcttatttcaagaatttatcgcgacgacgtgaatcggaatgccgttgacgcctttagagtttcagttatacatgcaaggcaacagattcgttcaccagtgacaaatattgcaaggacttccttttttcacatcaaaaggggaaacgtttggatgtgcgctgttagcagacgaaacattaatgcatcgatggtcttcgaatttctcaatcgttttgcagacacaatgcaatcttattttggaaaactgaacgaggaaaatgtgaaaaacaatttcgtcctcatttacgaaattcttgatgagatccttgattttggttacccccagaataccgacccaggagtattgaaaacatttataacacaacaaggcgtccgaacagcgagtaaagaagaacaggcacaaatcacttctcaagtaacaggacaaattggttggcgccgagaaggcataaaatacagacgcaatgaactctttttggatgtcattgaatatgttaacctcctcatgtcgcagcagggtcaggtgctttcatctcatgttgcgggaaaggtggccatgaagtcttatctcagcggaatgccagaatgtaaatttgggattaatgacaaattgacgatcgaaggcaaaggcaggactggcactgacgacccctctaaaacatcccgcgcttcagttgcaattgatgattgtcaattccaccaatgcgtgaagttgaccaaatttgacaccgaacatgctataagctttatcccaccggatggcgagtacgaattgatgagataccgcaccacgaaagacatccaattgccattcagagtcattcctttagtgcgcgaggtgtcaaggaacaaaatggaagttaaggttgtgatcaaatcgaacttcaagccgtcgttattagcacaaaagattgaggtcatcattccaacgcctccaaatacaagcggagttcagctcatttgtatgaaaggaaaagccaaatacaaggctggcgagaattgcatttgctggaagattaagcgtatgggagggatgaaagagtcgcagatttctgcagaagtcgatttgctgaacaccggaaatgctgagaaaaagaaatggaaccgtccacccgtctcaatgaactttgaggtaccatttgcaccttctggactaaaagtgcggtatctcaaagtattcgaaccgaagctgaactactcggaccatgacgttgtaaaatgggtgcgttatatcggacgctccggcttatacgaaacgagatgttaa

SEQ ID NO: 1518 - DNA, 1153 bp, Heterodera glycines
  cDNA sequence=SeqID_1295; peptide sequence=SeqID_1727
gcacgagggtttgtttggttcgtccatcggcacttcttcgccttttggcagcaagccgagtggtggtctctttggcgctgcgaacaccgcagttgtgcagcccagcacttcgaccacaacgcagcaggacatcgaggttccacaagctcccgatgacactgtgcaggcaatgaaattcaatccgctggtggccgggtctcccatttttttggctgctggttcctgggacaacacctgtcgcatttggcaggtcaatgaaaatggaatggttgaaccgaaggcaatgcaaaatgttggagcgcccattctttcgctggattggtcggaggacggctcaaaaatattcatcgctggtgcagacaaacaagcgttcgcctgggatttaggctcaaaccaaatggctgttgttggcacgcacaatgagccagtgcgaagttgccattggatagcgacaccccaatattcgtgtctaatgacgggaagttgggaccggacgctgcgtttttgggacatgcgccaattgcccacccaaaactccctggcaaccatccaactgcctgaacgcgtgtactgctccgacatggttttcccgctgatggtcgttgctttggccgacagacacatcaaaatgtataagttggacggaacaccctctgaaattcaagacgtggaatctcagttgaagtttcagagtcgttgcattgcgattttcaaagacaaaatgacgggacagcccaatggattcgctcttggctccaccgaaggacgagtggcgattcaatgtttgcagccaaaggacccgaaggacaatttcactttcaaatgccatcggtcagccgaactcatcaacaattaccaggagatttacccggtcaatgacgtcgcttttcatccgacccaccaaacattggccacggcgggcgcagacggaaaatattccttttgggacaaagacgcgcggacgaaattgaagggttccgatgccttgccaatgccaatcacaaaatgcgccattcattcgggtggaaacataatggcctatgcgatcggttatgattggagcaagggcttcgaatacagcacggcgaataatgtgacgaaaatctttctgcacgggtgtgacgaggagatgaaaccaaagccgaagaagtga

SEQ ID NO: 1519 - DNA, 1453 bp, Heterodera glycines
  cDNA sequence=SeqID_1296; peptide sequence=SeqID_1892
atggccgctgataattttgacgctcaacgtattttgaacattttggccgagagagacaatttccaaagtaatgaactcgccgatcagttgtccattgaccaccagcgactgatcggtgccatcaaaagtctgcaggtcaaagaagggttggtttgcacttcggaagtcaaaatcaaacgcatcgaattgaccgcggaaggcgaggaaattattcaaaagggttcccacgagtttaatgtgttcaaaatcgtcggagaaaagggcatttccaaatcagaaattgaaaaaacttcctttggtcccatcggattgggcaaggccatgcaatgcgggtgggtgggcatggacacgcgcgacggagtgcctttggtggtgcggaaggtggcaaatgccgaggacggggccaaggagcaattgaaattggtgaagaacggaaagggcgaccaattgacggcccaatgcgtggcacaactgaaaaagcgcaaatggataatggaaagcgcaattaaagccctttccgttgccaaagggccgaacttcacgacgactgtgcagaagcaggaattggatttgacttcggagatgattgcctcgggttcgtggcgtggcaagcagttcaaacagtacaatttctccgcgatgggcgtgccgcccccctccggccatctccaccctttgctcaaagtgcgtgccgaatttcgcgacattttcttccaaatgggtttctctgaaatgccaacaaatcgtttcgtggagagttccttctggaactttgacgctttgttccaaccccaacaacacccggcacgcgactcacatgacaccttttttctttcaagaccggcactttcaacagaattcccggaagattaccttgaaagtctatcgctacgattggaagttggaagaagcgcagaagaatttgctgaggacgcacaccaccgccgtttctgcccgtcagctttaccttctcgcacaaaaacctttccaaccgtccaaaatgttcagcatcgaccgcgtgttccgcaacgaaacattggatgccactcacttggccgaattccaccaagttgaaggcgttgtggcagaacgaaacctctcactggcgcatgtcatcggacttttcactgaattcttcaggaaatgcggaattgaaaatctccgcttcaaacccacttacaacccgtacaccgaaccatccatggaaatttacgcttttcacaccggactgaacaaatgggtggagattggcaattcgggcatgtttaggcctgagatgttgcttccgatgggacttccggaagacgttgccgtggctgggttcggtctctccctcgagcggccaaccatgatcagatacggcatttccaacataagagagctttttggccataagattgatctcgaaatgatctacagaaaccctttgtgcaggttggagcagaaaaactag

SEQ ID NO: 1520 - DNA, 636 bp, Heterodera glycines
  cDNA sequence=SeqID_1297; peptide sequence=SeqID_1728
atggttacggaacagaatggcgctacttttgctgttgacgttgaggaaattgcggctgggcatcacgttacgcctgtggacatgacaacagctaccagcaaacttcagcttgaggctgccgaagtgcgaaatccggcgaataaaccgaattggtcatcgtatttgcgctctcaattggtgcctcaaaatgagtacaatttcattattgaattggaaaaggccaaaaacaagcaggagagggacgaagcgttagccaaggacaagacgaattcggcacggagtattatcaatttgatcaccgaagttgcgaaggatcagctgatccgttacgttctcacccttttcgacgaccttttgcaggaggacaaatcccgggtagagattttccatgattatgcaagacggcaaaaacgaactatttggtcgtggttccaagggattttaacgcgaaatgacagtttcattgtcaaccaaatgtctgcaatattctcaaaattggcttgctatggctctgtgcttatggatggacaagaactgcaagcttatttcaatttccttcaacaggaaataaaaaactcgagactagttctctctcaagggcgaattctgcagatatccatcacactggcggccgct

SEQ ID NO: 1521 - DNA, 767 bp, Heterodera glycines
  cDNA sequence=SeqID_1298; peptide sequence=SeqID_1729
ccgacacggtcggttgttgctcgttgcgttgtgagcacatcaaattgcacgatgatatggacgacctgaagtatgttgtggaattcgacttcctcggcaaagactccatccgctattacaaccgtgtgccggtggaaaagcaagtgttcaaaaatctgaagctttttatggaggagaaagacccgggggacgatttgttcgaccgattggatacgagttcgttgaaccaatacctgaaggaactgatggacggactgaccgcgaaagtgtttcgtacgtataacgcgtcgatcactctccaagaacagctggacaaactgacaaatccttccgattccgtccacgagaaaatgctttcctacaatcgtgcaaatcgtcaggtggccatcctttgtaaccatcaaagggcagtgccaaaaacgcacgaaaagtcgatggaaaatttggagaataaaataaaagagaagaagcaggagtacaaggagttgaaggatcagctgaagaagagcaaatcggtggacgagaaaatggcaaaaaaatacgaaagattgaaggaacagatcgccaaactgaacacacagcgcacggacaaggatgaaaacaaacaaattgcactgggaacctcaaaactgaactacttggatccgaggatttcggttgcatggtgcaaaaagaatgacgtgcccgttgagaaaatattcagcaaaacgcaacgcgacaaattccgctgggctctcgacatggcgaaggaggacttcattttctga

SEQ ID NO: 1522 - DNA, 726 bp, Heterodera glycines
  cDNA sequence=SeqID_1299; peptide sequence=SeqID_1730
gaattcggcacgaggattgctcacacccagatgaaactgatgaagcaccgcaacaagaaggcacacataatggagatccaaatcaatgggggtaccgttgccgaaaaagtggactgggctcgtgagcactttgagaagcaggttcccgtggagcaagtgtttgagcaggacgagatgatcgactgcatcggtgtcaccagaggaaagggtttcaagggagtgaccagccgatggcactgtaagaagttgccgcgcaagactcacaagggtctccgcaaggtggcttgtatcggtgcatggcatccgtcgcgtgtctcattcacagttgcgcgtgccggtcagaagggctaccaccatcggacggagatcaacaagaagatctaccgcattggcaagtcgtgtttgacggccgacggcaagaaaaacggaatgaccgacttcgacatcactgagaagaacattaacccgatgggcgggttcccccactatggtctggtcaatcaggactttctgatgatccgtggctgttgcattggttgcaagaagcgtccgatcacattgcgcaagactttgatcaagcagaccaaacgttttgctttcgagaagataaacctgaagttcatcgacaccagctccaagtttggccatggacgcttccagacgagtgcggagaagaaaacattcatgggcaaattgaagaaagactttctggcggaatcggcgtaa

SEQ ID NO: 1523 - DNA, 633 bp, Heterodera glycines
  cDNA sequence=SeqID_1300; peptide sequence=SeqID_1731
atgggtatttcccaagacagatggcacaagcggcgaaagactggggggaagcgaaaccccattcacaaaaaacgaaagttcgaaatgggacggccggcagcaaatactaagattggtcctaaacgaattcatttggtgcgttgtcgtggcgggaacattaaacatcgcggacttcgtcttgataccggaaactttgcttgggcttctgaagggtgcactcgcaaaacgcgtatcatcgacactatgtacaacgcttccaacaacgaattggtgcgcaccaaaacattggtcaagggaatgatcgtctcaatcgatgccattccgttccgccaatggtatgaagcgcattacgcactgccattggcgcgcaaaaagggacaaaagttgaccgaagatgaggaggcgcggattggaggagcacagaaacgctcaaagtcgactctgaagaaatacacggaacgccaaaaaaccgccggggtggagccgcatcttctggaacagttccaggccggacgacttctcgcttgcataagctcacgaccaggccaaagcggacgctgcgatgggtacattttggagggcaaagaactcgagttctacaacaagaaactgaaggctaaaaaggcgaagtga

SEQ ID NO: 1524 - DNA, 980 bp, Heterodera glycines
  cDNA sequence=SeqID_1301; peptide sequence=SeqID_1905
gcacgagggattgcgttatgtggttcatcgacgaaaacaccggcaaattcagtgaccgtttttccgatgatcagttctcattgttcgatgcgatccatcaacctcgtccgctggtcaaaaacaacgtacgagaaatcattgacatggcaaacaatcgacggcttactgttgtggaggcggaggatgcgaacattttgcgtatgcgggtgggaagattcatcgaattgaacggacgcaccgaaatgtctctgcatgatgcgtaccaactcaaattggttcaaaagccgcagactttggccgaggtcattgatagtggctcgctggacaacaatggtcgtttcatcgatggtgttaaacctcgcactctgctcgaggcgatttgttcgggaatgctcgacccggatgtggcgcacatcaaagcgggaccaggcgatgagctgatttccatcggagaggcgctgaagcgaggccgattgacgccgaaaggagaaattgtgttgactctgggtgaagttggcatacacagaggagagaaaattaatttgttcatggcgcacgaacggggccttttgaccagccgtgttcgacacaccatcttcgatgtaaaaggagtgagaaatgctgcggatggttcaattatgagcttcaaggaagctcgtgatgcgggaatccttcagcttcaattcgatgggctggaaaccagactgagcgaagcatcggcccggggagagatcaattcgggactcgccgaaattctcgtcgctccatgcagcttgtccaacaatggtctgccattgtcattggtccgcgcgtttctcaaaggtcgcgtggacgatgtcaatggagaagtcattgatccggccaccgggcttggaaagtccattctcgaggcgtacaatatcggctccgttttctccacgttgcgtgccgccatgcgtcttgctgcactgctcgacgttcatccgtcgctttgtcagtga

SEQ ID NO: 1525 - DNA, 3276 bp, Heterodera glycines
  cDNA sequence=SeqID_1302; peptide sequence=SeqID_1732
atgggagttccagcctttttccgttggctttcacgaaagtatgtgtcgatcattgttgacgcggtggaacagcgcagaagagaaattgacggagtaaaaatcccaatagatgcaactcaaccaaatgagaattaccaagagtttgacaatctttacttggacatgaacggcattatccatccgtgcacacatccggaagaccgacccgcaccgaagaccgaggaagaaatgttcattttgatcttcgagtatattgaccgcctcttttccatcgttcggccaagaaaacttctctacatggcagttgatggggtcgcccccagagcaaagatgaaccaacagcgaagtcgtcgatttcgagcagcacaagaagcggcggagaagcgcgagctcatcgaaaatgtgcgtaagcggttggagtcggaaggaattccgttgccgccaccgcgaaaggaagaggaacactttgactccaattgcataacacccggcacgccgtttatggcccgtctttctgttgcccttcgctattacgtgcacaaacggatcacctacgacccggcatggcaaaagatccaggttattctttccgatgcgaatgtgccgggtgagggcgaacataaaatcatggactacgtccgacgtcagcgcgcttcgccggcgcatgacccgaacaccgttcactgtctttgtggcgccgatgccgaccttatcatgcttggattggccacccacgagtccaatttcaacataattcgagaagagtttttgccgaatcaaccgaggccgtgcgaactttgcggtcaatacgggcacgaggtcgaacattgtgaagggttggcacgtgccgagaccgggccggaccaagcggacccgctgaagaaggagaagaacttcatcttcatacgtctgccagtgcttcgggaatatttggagcgtgaactttccatgccaaatttgccatttccgttcgatttggagagggccatcgatgattgggtcatgatgtgtttttttgtgggcaacgattttctcccccatttgccatcgttagaaatccgtgaaaatgccatcgaccgtctcgtgaagttgtacaaggacatggtttatcaggctggcggctggctcactgaaaacggcatagtgaatatcgaaagagtgaagaagatcatgggcggacttgggaaggttgaggacgaaatattcaaacaaagacagctcaaagaattgcgcttcaaagaatcaaagaaacagcgaaagcagcaacaacggcaggcaatggcaaaaattatgccgtacaatgccaatttgatagcaccaatgccacttggacagcaaaagcgaatgtcgggcgaggaaatgcgcagattggcggcgggagaccgacaggagttcgtcagacttgcggatgtcgccagttcgcacaaattgcagtcgctgttgacgcctgtcgaccgacgaaaggccacggatggcggtgatcggaagcgcaagttggccccaagttcagtcgacagtccgaacggagcaccaccagctaaatcgtttaaggagggagtggctgctgcttccgtttcctccgaaacggccttgaaaccggagataaaactcgtaactccctctgggaagacggcgcctttggccaagggggcggttggggcactggcatacgactctgacgaggaggaggaagtgctcgacgaaatccgtctatgggaaagtggatggaaggaccgctactacagagccaagttccaagtgtccgagactgaccttgaatttcgcaagaaagtggcatgtgcttatgttgagggactctgctgggtgttgcgttattattatcagggatgtgccagctggaaatggtactacccttaccactacgcgccgtttgcctccgattttgaactgatcgccgatttccaacccgacttcaacatgcccacgaaaccgttcaagccattggagcagttaatgggtgtgtttcctgctgctagcagagctcatattcctgacgggtggcgttggctgatgaccgactcaagttcgccgataattgatttttacccggaaacttttgaaattgatctgaacgggaagaaatatgcttggcaaggcgtcgctctgcttccatttgtcgaggaaaaacgtcttttggatgcacttgactcggtgtacgccactctcacaaccgatgaaattgcgcggaatgccaccggaccagaccgtctttttgtcggcaataaacacaacttgttttcgctcgtttatgaggtgcactcccaaaagacgacaattccgataaaagatgaactaacaaatgatgacacaaaagaaacaagcgaagggacgcgagaaactgaaggagaagccgaggaaactcaacaggcggaaaatggtgaaagcgaacaaatagcgaaagccgaagaaacgacggcacaagaggaacaagcgaacgaagaagctatctcaaaacctgaacaggcaccgaaacaggaattcgagactgaaattgaatttgtcgatgacgaagaaaagaaatgggtgcacatcgacgcagtcaaagcgtatgggatgtctggcgaagtgtcttatgacgtcgaagcactcgcttttggtgaggcgcatcggtcgctgttcagaaattcgttggagtttggcgacatcaaagagaatacctgcattatggttgagttccgagatccccaattcccaatgcacttcatcttcaaagccaacaggctggacggcatcaaggaattgcctcgtgtgctcaaaccgaacgattgggaccaacgacggcacggctccttccaaccccaaatcggattcagtcgtgacatcccacgtgcaaatctctccatggcgggccatcgtacgctcaaccaccacataaacgacaaccgtcgcagttgtccggcctctcttttctcagtgcaaacatcgccaccagcgcacacacttccatggcacatgagcacaaactcaccacaacaacaacatcaaatgcagtaccaacatcagcaacaatggcagcagggtcaattttacaacgggcaacagcagcagcagcccgtgccgttgttcagttttgggcagatggcaatgcccccgcctccgccgctcccaccgcaaaattggattactagtcacccgccaccacaaatccagtctcacgtgccgtacgggcagcccccacctctaatatcacagccacggaatactcagcatcaccatcgcagaaacgacaacaacagaacttacaataggaaataa

SEQ ID NO: 1526 - DNA, 1506 bp, Heterodera glycines
  cDNA sequence=SeqID_1303; peptide sequence=SeqID_1733
atggcgaaatctgcaattgatgttaatcgcggcatcacagaagaccaaacagctaccataagaaattatttcacacaaccgcacttaatttacaaaactgtcactggagtgcgcgggcctttggtcatattgggcgatgttaaattcccacaatacgctgaaattgtgaaacttacactgcctaatggagaaaaacgcatgggacaagtactcgaagtaacgaaggacaaagctgtcgttcaggtgtttgaaggtacgtcaggtatcgatgcaaaaaacacaatttgcgagttcactggcgatattatgagaacacccgtttccgaggatatgcttggaagaatattcaatggatccggcacacccatcgacaaagggcccaatgttttggcggaggattacttggacatcgatggacagcctatcaacccatggtccagaatttatcccgaagaaatgattcagaccggcatttccgcaattgatgttatgaatagtatcgccaggggacagaaaattccaattttttctgctgcaggtcttccgcataatgagatcgctgctcaaattgtacgccaagggggcctcgtcaaacagccgaacagaaagaaggaaaatgaggtggagggtgacgacgactttgccattgtgtttgctgcaatgggtgtcaacatggagacggcgcgctttttcaaacaagactttgaagaaaacggttccatggaaaatgtgtgccttttccttaacttggctaatgacccaaccatcgaacggatcatcacaccacgactcgcgctgacttgtgcagaatttctggcttaccaatgccaaaaacacgtcttggttgtgctcactgacatgtcttattacgctgaagcacttcgcgaagtgtccgccgcccgagaggaagtgcccggtcgtcgtggttttcccggttacatgtacactgacttggccagaatatacgaacgtgccgggcgtgttgaaggccgaaaggggtcaatcacacaaattccaattttgtctatgcctaatgacgacatcacccacccaattcccgatttgaccggttacataacggaaggccaaatttatgtggatcgccaacttcacaatcgtcagatttaccctccaataaatgtacttccatcgctgtcgcgtctgatgaaatcggccattggcgagggaatgacccgtgccgatcattcggatgtgtccaaccaactttacgcatgttatgccattggtaaagacgtgcaagcaatgaaagcggtggttggagaggaggcactgtcgtcggatgatttgctctacttggagtttctcacgaaatttgaaaagaatttcatttcacaagggaattatgaaaaccggacggtgttcgactcactcgacattggttggcagctgttgcgcatttttccaagagaaatgttgaagcgaattccagcgaaaacattggataaatattacccaaggggaggcactggggcgaggaacgaatga

SEQ ID NO: 1527 - DNA, 1713 bp, Heterodera glycines
  cDNA sequence=SeqID_1305; peptide sequence=SeqID_1734
atggatttgttaaaatcttacgacggctcttcatcatcggacaatgaacaagaattggcagatataccttcttcgtccaatcacaacaaattgctcgctttgaaaatcccatccatcaacttaacacccaacgtgattgaacaacgcgccattcaacaggttgcggttgtggatccaaaaaccaaagagttgtatcacaatccgcgcttcgacgaattgtttaaaccagagagcggcccacaaaatccgtttaaaagtgaacatcaacgagcagaaaagaacacactgaccggctatgtggagccagcgcatttcaacgccttccattttgagcgttcacttcgctcctacgatacgcttggctatgcggataatccaacggcagacacaaccagcgcaaagttcgttggtgacgttggacaagcgcaagaaaaggccggcgagtcgctttttgaatcagtaaaaactggcggacagaagcgaaagagagtgataaattacgacgcatcaaacgttgacggatatacgggaccgtgggcaaggtttgaggacgagaagacaattgctcgaccggacccagaattgcagaaggaaatggacgaaattgtgcggaaacggaaactgaaaagtcgtgctggccgaagagcggccatcgcggaattgcatttggcagaagagagcaccaaattgcacataaaagatgacactgactatttgggccgttcctttatggaaccgccgaaatacacgggcaccaatctgcgcgaggactttgtgcccgaccgctgtttcccgcccacaaaacaagcacacacctacagcagtcacaccaaaccggtgaccgccatccgatggtttcctcgtagtgcgcacatgtttatctcttgttccatggacggaaaagtcaaattgtgggaagtgtacggcaaccgtaagttgatccgcacatacactggacacaaagtgcccgtgaaggacatttattttaacaacaccggcactgaatttctaagtgccgcttatgacaattacatcaaattgtgggacactgaaaccggtcaggtgaaaaaccgctacacaattggaggccatcgggcgtatgtggtcaaattcaacccggacgatgataaacaaaacattttcatggccggaatgtccaacaaaaagatcatccaatgggacacgcgaactggcgaaatcgaacaagaatacgaccgtcatttgggtccagtgaactcgatcacctttttcgacaaaaaccgtcgtttcgtttctacttcggacgataaatctcttcgcatttgggaatttggcattcccgtggatacaaaactgattcaacatgctggactacactccattccttcaatgactagggcaccaaatgaaaaatggatcgttgggcagtccatggacaatcgaattgtccttttccaaatcgtcgatgacaagttgcgattcgctcgtaaaaaggccttccgtggtcacaatacagcagggtacgcctgctcaactgatttttcgccagagatgagttttctcgcttccggtgatgcggacggtaaaatcacaatgtgggactggcgcacacacaaaattgtctccacgtggaaggcacatgataatgtgtgcatttcaacactgtggcatccgcacgagaaatcgcggatgatttcttgcggatgggacaatgtaatcaaaatgtgggtctga

SEQ ID NO: 1528 - DNA, 954 bp, Heterodera glycines
  cDNA sequence=SeqID_1306; peptide sequence=SeqID_1735
atgtcttttcttgtcacattagccggctatttgacaattgccatttttctccagaaactctttcgctctctgtacaatgtggttttcccctatttgttcgctgttcctcagaatatcaaggtgctcgcgggtgccgagtgggcagtggtcaccggcagcactgacggcattggcaaggcgtacgcgctcgagttggccaagaaaaacttcaacgtggtgctcatctcacgctccatggacaaactgaacgcagtggcggaggaaatcaaacagaaatatcccaatgtggaagtgaagtgcatctcatttgacttcaccaacgcaaatctgaaggactacgagcagacaattttctcccaactttccaccatcgaagttggaatgctcgtgaacaatgtcgggatgagctacgagtaccccgagcgattggaccgtattgagggcggactgcaacgcgtttccgacattaccgtgatcaacaccctgccgactacggtactctccgcttttgtgctcaaacagatgagggaacggggacgcggcgtcgtcgtcaatttggcctcctcggcagcgtatttcaattggttttacctggccgcttattctgcgtcgaagaaatacgtgtgttggttgtcctccattctgcgcatggaatacgccgacaccgacattgtcatccaaacggtgtgcccgatgatggtggccaccaaaatggccaagattcgcaaggcttccttcttcacgcccagccccgaggaatttgccgcccaagcgctccgcagcattggcttggtcgacgagaccaccggctgtttgtcccaccaaattcaggccgagctgatgttcggctacgtccccgccccgttgctgaacaaattcgtgcgcgacaactcactgcagacgcgcaagcgcgccctgaagaagaaagaagcgacggtggcgaagagtgaatga

SEQ ID NO: 1529 - DNA, 651 bp, Heterodera glycines
  cDNA sequence=SeqID_1307; peptide sequence=SeqID_1736
atgaaccaagaacaagacaatatcccaactttcaagcttgtgttggttggtgacggtggtaccggaaagaccacttttgtgaaacgccatttgactggagaattcgagaagaaatatatcgctacgcttggtgttgaggtccatcccctcacttttcacacttcgcgaggtcaaatccgattcaacgtttgggacacagccggccaggagaagtttggtggacttcgtgatgggtattacatccaaggccaatgtgctattgtcatgttcgacgtgaccgccagagtcacatacaaaaatgtgccgaattggcaccgcgatttggtccgagtttgtgagaacatcccaattgtgctggtggggaacaaagtggatgtcaaagataggaaagtcaaggcgaaaagcatcacttttcaccgcaagaaaaatctccagtattacgacatttccgcaaagagcaactacaatttcgagaagcccttcctttatctggcacgaaagctgatcggcgaccccaacctcgaattcgtggcgatgccggcactcgctccacccgaagtacaaatggatcccgctttggctgccaaatacgagcaagaagtggccgaggcagcaagcgctgaactcccggacgatgatgaggacatttga

SEQ ID NO: 1530 - DNA, 1024 bp, Heterodera glycines
  cDNA sequence=SeqID_1308; peptide sequence=SeqID_1893
gcacgaggcccgtcatcagggcgtcatggtcggcatgggacagaaggactcgtacgtgggagacgaggcgcagtccaagcgtggtattctgacgctgaagtacccgattgagcacggcatcgtcaccaactgggacgacatggagaagatctggcaccacaccttctacaacgagctgcgtgtcgcccccgaggagcacccggtgctgctcacagaggccccgctgaacccgaaggccaacagagaaaagatgacccaaatcatgttcgagacgttcaacacgccggccatgtacgtggccatccaggccgtgctgtccctgtacgcctccggccgtaccaccggtctcgtgttggactccggcgatggtgtcacccacaccgtgcccatctacgagggttacgccctgccccacgccatcctccgtttggacttggccggccgtgacctcactgactacctgatgaagatcctcactgagcgtggttactccttcgtgaccacggccgagcgtgagatcgtccgtgacatcaaggagaagttgtgctacgtggcactcgacttcgagcaggaaatggccactgccgcctcctcctcctcgctggagaagagctacgaactgcccgacggccaagtgatcaccgtcggcaacgagcgcttccgttgcccagaggcgctgttccagccgtccttcatcggcatggagtcggccggcatccacgagtccacctacaactcgatcatgaagtgcgacatcgacatccgtaaggacctgtacgccaacaatgtgctgtccggcggcaccaccatgtacccgggcattgctgaccgcatgcagaaggagatgaccgcgctggccccgtccaccatgaagatcaaaatcatcgctcccccggagcgcaagtactccgtctggatcggcggctccatcctcgcctccctgtccaccttccaacagatgtggatcagcaagcaggagtacgacgagtcgggcccgtccattgtccaccgcaagtgcttctga

SEQ ID NO: 1531 - DNA, 935 bp, Heterodera glycines
  cDNA sequence=SeqID_1310; peptide sequence=SeqID_1737
gcacgaggcacgaaaatgtggcgcccactgacattgaggagggaatgcgagtgggtgtggaccgcaacaaataccagattcatttgcctttgccggcaaagattgacgcgtccgttacgatgatgcaagtggaggacaagccggacgttacctacgcggacattggcgggtgcgaagaacagatcaaaaagttgcgtgaagtggtcgagtttccgttgcttcagcctgagcgtttcacgagtttgggcattgagcctccgaagggcgttttgttttttggtccgccgggcaccggcaaaactttgtgtgcccgcgcggtcgccaatcggacggacgcgtgtttcatccgcgtcatcggttccgaattagtcaaaaaatacgttggcgaaggcgcgcgcatggtgcgcgagctgttttcgctggctaaaacgaaaaaggcgtgcattctcttcttcgacgaagtcgacgccatcggcggagcgcgatttgacgacggaaaagggggcgacaacgaagtgcaacggacgatgctcgagttggtcaaccaactggacggattcgactcacgcggggccatcaaggttttgatggccaccaacagaccggacacactcgacccggcgctcattcgtcccggtcgcattgaccgacgcattgaattttccttgcctgacctcaaggcacgaggaaacattctccaaattcacaccaaacggatgagcgtcgaccggaacattcggtacgaattgattgctcgactctgtccaaacacgacgggtgccgacttgcgcagcgtttgcactgaggcgggaatgttcgctttgcgtgcacgtcgaaaggtcataacggagcaagactttctcaaggctgttcagaaagtggtgaaaagctacgccaagttcagttcaacgccggcgtatatgacgcacaactga

SEQ ID NO: 1532 - DNA, 573 bp, Heterodera glycines
  cDNA sequence=SeqID_1311; peptide sequence=SeqID_1738
atgcaaatcttcgtcaagaccctcacgggcaagaccatcacccttgaggtcgagtcctcggacacgatcgatgccgtcaaggccaagatccaagacaaggagggcatcccccccgatcagcagcgcctcatcttcgcgggcaagcagctcgaggacggccgcacccttgccgactacaacatccaaaaggagtcgaccttgcacttggtgctccgtctccgtggtggtggcaagaagaagaagaagaagacctacaccacccccaagaagatcaagcacgtccacaagaaggtcaagcttgccatcctcaagttctacaaggtcgacgacaacggcaagattacccgtctgcgtcgtgagtgccccgccaagacctgcggcgccggtgtcttcatggcctggcacgtcgaccgccagtactgtggcaagtgcggcttgacctacaagctcgaccccgccaccatcaagaagaacatggccgctgccgccaaggcctccaagcccgccgctgctgccaagcccgctgccgaggctgccgctgccgctggcaagggcaagggcaagaagaagtaa

SEQ ID NO: 1533 - DNA, 1074 bp, Heterodera glycines
  cDNA sequence=SeqID_1312; peptide sequence=SeqID_1906
gcacgagggtttgaggtgcctttggctgtggtaaaactgtcatttcgcagtcgttgtccaaatattccaactccgatgccattatttacgtgggctgtggcgagcgtggcaacgaaatgtcggaagtgttgcgcgactttcccgaactgacgatggaagtggatggagtgaccacgtccatcatggagaggacggcgctggtggccaacacttcgaatatgcccgtggcggcgcgtgaagcgtccatttacacgggaattactctggccgaatacttccgcgacatgggtctgaacgtggccatgatggccgactcgacctcccgatgggccgaggcgctccgtgagatttcgggccgtctcggggaaatgccggctgactcgggttaccccgcctatttggccgcacggctcgcttccttctacgaaagggcgggaaaagtgaaatgttttgggtcgcctgaacgcgaagggtccgtcactattgtcggcgcagtgtcgccgcccggcggagacttcgccgaccccgtcacatcggcaaccctcggcattgtccaagtgttttggggactcgacaaaaaattggcccaacgaaagcacttcccttcaatcaattggctcatttcttacagcaaatatatgcgtgcgttggacgattattacgagaagaattttgccgaatttgttccactgagaacgaaatgcaaagaaattttgcaggaagaggaagatttgtcagaaattgtccaattggtcggcaaagcatcgcttgccgaggccgacaaaatcactttggagctatgatcgcttctgtcccttctacaaaactgttgggatgctcaaaaatatgattggcttttacgactttgcccggcactcggtggaaacgactgcacaatcggacaacaaaatcacgtggaatcagatcagagatcacctcggggacatcattcacgaactttcttcgatgaaatttgaggacccatccgaaaaaacggaagatcagatcaaaaaggattacgaagaactgtatgaacggatgcagaacaaattccgagcgttagaggatgaatga

SEQ ID NO: 1534 - DNA, 601 bp, Heterodera glycines
  cDNA sequence=SeqID_1313; peptide sequence=SeqID_1739
gcacgagggcaagatcagaggtctcgcttacgtatgcaaagtgacgccatcaatcgcatctcgaatgattgacggagctaaaaagatgcttcacggaaacatttctgacatttacattacgattgaccagaggaagggcccccagggcggactatctcccggctttggaatcttcttgacggctgaaaccaccgaaggcgtatttttccatggagaagcgatgtcgcgccctaagggccaaaacgaagaccaaacagtgccggaagaaattggggaacaggcggcaagacgtttgctggatgaaattcatatgggaggctgtgcagattcgtcctgtcaatctttggccgccactttcatgactctctgcgacagagatgtttcgaaatttctccttggtccactcacaattaacagcgtacacacccttcggaatttgcaaatgtttttcgagcaaatgtttaaattggaggaatggtggaaggttatgaaagaaatcgtcggaaaaggcggaaatgcgatgaaaaacggaagtgaggacaaatgtttgatgacctgtgttggggttggtttcttcaacatcaacaaagaccaactttaa

SEQ ID NO: 1535 - DNA, 749 bp, Heterodera glycines
  cDNA sequence=SeqID_1314; peptide sequence=SeqID_1740
ttcgaacacctcaaatcggggacaaatttgcttcacgtcatggtcaaaagggaacaatgggaatgatgtacagacaagaggatatgcctttcacatgcgagggcataacgccggacattatcattaatccacacgctgtgccgagtcgtatgacaattggacatttgattgaatgcctccaaggaaagctttctgcaaacaaaggcgaaattggcgacgccacccctttcaacgacacagtcaatgtgcagaaaataagtgctttgcttgagggctacggctaccaattgcgtggcaatgaaataatgtacaacggatttaccgggcaaaagttgagcacacaggtgtttctgggcccaacttactaccaacggcttaagcacatggtcgaggacaaaattcactcacgcgcccgagggcctgttcaggggatgaaccgacagccaatggaaggcagggcacgtgacggtggactgcgatttggtgaaatggaaagagattgtcaaatttcacacggcgctgctcaatttttacgggagagactttttgaggtgtccgatccatacacagtttatgtgtgcaatcaatgcggattggtggtgattttcaatcaacggactaacactttcgagtgcaaagcatgtcaaaataaaacgcaagtgtcagctgttcgaattccttacgcgtgtaagctgttgttccaggaactcatgtccatgtctatcgcaccgcgaatgatgaccaaatag

SEQ ID NO: 1536 - DNA, 1970 bp, Heterodera glycines
  cDNA sequence=SeqID_1315; peptide sequence=SeqID_1907
gcacgaggcagaattttccctcattccctgtttttgttatggcttcaactcataatcattgttacattgaaagcctcaggacgaggcagacagcttcgctcaagcaacttctgaacctcaaccagcccctgaacgtttctctggcggttgaacccgtgtggaaattgctgatttttgaccgctactgtcaggacatcatttctccgctgctcagtgtcaaacagttgcgcgaactcggcgtcacactgcacttatcggtcgactcgccgcgtgagattctccccgatgttcccgcagtttattttgtgtcgccaaccgaacaaaatgtgcagacaatttgtgcggatttgaagcgtgccatgtatgacagcttctacttgaacatggtcaggcccatcccacgccctttgcttgaacaattggcggaaagcgcagtggccggtggcgcaacacaacaagtgcagaagttgactgatcagttcctctccttcatttcgcttgaagatgacctcttcatgctcagccgttacacaaaaagcagcccattctctttttacgcaattaatgacccgtcgataaccaccgatcaaattgacgcgttggtcgccgacattgccaatggactgttcgccgtctgtgtgacgcttggtgttgtgccggtgatcaaatgtccgaaaaacaacgcggcggagagagtggccgaaaaacttgatcaaaaaattcgtgacaatctccgcgacgcccgcaacaacttgttcgtccaggaaaacattcgggcaggccatctgagcattcatcgtcccgtgttggtcatcgccgatcgtaccaccgatctgtccacgatgttgcaccacacgtggacttaccaggcgatgatcgcggacattttggaaatggaattgaacagagtgcggatgaaagacaaaaatgggcgccaaaaggactacgaatttggcacggaagacaaactgtgggccaactacaaaggcagcccattcccattggtggcggaagccatccaagaggatttggaggcgtacagacgcaacgaagacgaaatcaaacggctaaaggaatcgatgggactgtccgacggcgactcggccgaaatggccgtcgacatttttggcactgccgccacggcgaaactttccacggcggtcggcagtctgcccgaactgttggagaagaagcggctgatcgacttgcacacgaacgtggccaccgcactgctggacaacatcaaaacgcgaaaattggacgtattgtacgaaacggaggagaaacttttgacaggccaagaaattccggtcattgaaacattgcgcgactgtccggacaaagacgacattttgcggctgattttgatcgctttgtgttctcggaatatgccaactgctgaacagcgcgaacttcaggctttcattgacgaacgtgcaattagctcggatgcgctgcattttgtgcggcaactcagggctttttcccatttgggtgccgaggcggaacagcaccaaggggccggcaccaagacggtcagcatgttctccaaactgctcagccactcatcgcgctttgtcatggagggcgtcaaaaatttggtgcccaaaaagcacaacttaccactgacgaaggtggttgaccagctgaccaccgatgtgaaaatgggcgttggagtggccggcattacgggcagttcgtccgactttgacccggaccaattccgactgttcgaccctaaactattgcagggctcggccgtaaacagagatgttcgtcccacccaagcagcagccgacgtgatcgttttcgtgatcggcggtggtaattacgtggagtatcaaaatgtgcaggaatgggccaaggcacggggcctccaacggtgcacctacggatgcacggagatggtcaacccgaagcaattcgtcgaacaactgaccgatttgggtgccaaatcacgggcaatgtga

SEQ ID NO: 1537 - DNA, 1629 bp, Heterodera glycines
  cDNA sequence=SeqID_1318; peptide sequence=SeqID_1741
gcacgagggtccccttctctttccgtcgccaactcaaatgtctctcgacagcttggccaaccaaaagtagcgggcttcaaagataaggataaaccggaaagtgttcgtaccagcaacatcgtggcagcaaaggctgttgcggatgcggtgcggacgagtcttgggcctcggggaatggacaaaatgatccaatcgggcaacggagaagtgacaattaccaatgacggggcgactattctcaaccaaatgtcggttgtgcatcccaccgcaaaaatgttggtcgagctgtccaaagcgcaggacattgaggcgggcgatgggaccacaactgttgtggtgttggccgggtccttgttggacgctgcagaaaaacttcttgccaaaggaattcatccgaccaccatttccgactcattccaacgggcggccacattttctgaaaaagttctcgaggaaatggccacacccattgacattaacgatgacgacgagttggtgaagctcgccatgacgagtttgaactcgaaggtcgtttcgcaacattcccatcttttggccccaatggcggtgcaggcagtgaagaaactgatgagttcaccggaggactcaagtgtcaatctgaagctgatcaaagtcgtgaaaaagttgggcgaaacggtggaggagtcgcagctcattgagggagcgctgatcgatcagaagtcgatgggccacggaggcccggcgcgggtggagaaggcgaagattggcctcatccaattccaaatctcaccaccaaagcccaacatggaaaatcaagtggtcatctctgactatgctcaaatggaccgtgcgctgaaggaagaacgaaattacattttggagctgtgcaagcaaatcaaaaaggccgggtgcaatgtgttgctcatccaaaagtccattttacgcgatgccatcaacgaaatggcgctgcactttttcgcaaaaatgaaaattatggtgatcaaagacatcgagcgggatgacatcgaattctatgccaaaatcctcgggtgtcgcccggtggcatccgttgaccattttgtgccggaatcgctcggaacggccgatttggtggaggaaattgagacggctgatgggaaagtcctcaaagtgaccggccttaaacagagtgggtgcgctgtgtccattttggttcgcggctccagcaaattggtgttggacgaagccgagcgctctctgcacgacgcattgtgcgtcattcgctgtttggtgaagaaacgcgcccttctttccggcggcggtgcccccgaaatggaagtgtccgtccgcgtccgcgcagctgctcagacaaaacacggagccgaacagtattgctggaaggcatttgcggacgcactcgaagtggtgccatacactttggcagaaaacgctggactgtcgcccattgaaacagtgacggagatgcgcagtcagcacgcaatgggaaacaaagagcacggagtgaatgtgcgaatgggtgccattacggacattcgtgaggaaaatgtggtgcagcctcttttggtcagttcgttcgccgtcaaacaggcggctgaatgtgtgcgcagcattctcaaaatcgacgacattgttctgtccgtgcgttaa

SEQ ID NO: 1538 - DNA, 691 bp, Heterodera glycines
  cDNA sequence=SeqID_1319; peptide sequence=SeqID_1894
gcacgaggtaaacattggcattcagccgcctaagggcgttcttatgtatggaccaccaggtacgggtaaaacgatgttggcacgtgccgttgccgctcaaaccaagtccacttttctgaagctggctggtccgcaacttgtccaaatgttcatcggagacggcgccaaattggttcgagatgcttttgcactggccaaagagaaagcaccgtccattattttcattgacgaattggacgcaattggaacaaaacgattcagttcggagaaggccggcgatagggaagtgcagcgtacgatgttggaattgcttaaccaactcgacggcttccagccaaatgacgacataaaagttattgctgcgacaaaccgtgtcgatgtgctcgacccggctctgctccgttccggcagattggaccgcaaaattgaactgccagcgccaaacgagaaggcccgggcgcacatcgtccgcattcactcccggaatatgaacgttgataaggatgttaatttcgatgagttggcacgttgtaccgacgattttaatggtgctcaatgcaaagctgtttgtgtggaggcgggtatgatcgcgcttcgtcgtgaatctcacatcattctgcacgaagattttatggacgctatccttgaggtgcaagccaagaagaaaacgagtctgaattattatgcctga

SEQ ID NO: 1539 - DNA, 957 bp, Heterodera glycines
  cDNA sequence=SeqID_1320; peptide sequence=SeqID_1742
atggacatcgttgacgaccctttgtccgagccttgccatgtttgtggtgacaaatccaccggcacacattacggcacggtttcctgcaacggatgcaagggcttttttcgccgtactattttacgaagtcagaagttcacttgtcgtttcaacaagcaatgcgtcatcgacaaaaactatcgctgtgcgtgtcgcttttgccgcttccaaaagtgtctgagtgccggcatgaaaaaagaagcaattcaatttgagcgcgatgcgattggttcgccgcttccgttgaaaaggcggcgcgtcgccgacgacggccgggccgaccattccccgtcaccgaccggtggacggacagcgaccgatggcattgggacggcggtgggccgacccgtaatggcacaaggggacggaaagggtcagatggaaagtcctcccgagatttacgttgacatcatcggcacattggtggagatggagcaacgcgtcaattacgaaatgagtcttcgctatcgttctctgtgcggcgccgtctttccctcctccgtcggcactgacaacgcatcgtttgccggcgacgcttcgtccgttttcaatctttcgagtggacgtggggcggcactttccgtggaggaattgaatgaactttcgcgtacgacgctccttttgatggtcgaatgggccaaaggcattgagccgttccctgggctgagcatggaggacaaagtcattctgttgaagaattacgctcctcagcatctcattctgatgcccgccttccgctcgcccgactccacccgcctttgtctcttcaacaattcgctgttgggcaatggcgcggagggccaagcggcagacggcggagaagcgccgttgggctgctccttcgccggtttaaaaacggctaatataatgcaagagtcctcgacgaaatcgtgtggccaatgcggcagctccaaatga

SEQ ID NO: 1540 - DNA, 552 bp, Heterodera glycines
  cDNA sequence=SeqID_1321; peptide sequence=SeqID_1743
atgacagaatataagttggtcgtcgtcggtgacggcggtgttggcaaatcggcgctgaccatccaattaatccagggccaattcattgaggagtacgacccgaccattgaagactcgtatcgaaaacaggtacttattgacggtgagacttgtttgctggacattttggacaccgcaggacaggaagagtattcagcgatgcgggatcagtacatgcgcacgggtgagggctttctgctggtcttcgcgctgaacgagtacaaatccttcgagaacatccatgcctaccgtgaacagatcagacgggtcaaggacagtgacgaagtgccgatggtgttggtgggcaacaaatgtgacttggcacagcgcgccatggaccagcgctccatccaggagttggcccgctcatttggcattccgttcattgaaacgagcgcaaaaacgcgacggcacgttgacgaggcattccatgcattggtgcgcgaaattcgtaaacacaaggacaaacaccgggagaagccgaaacggagaaagcgctgtgccgtcctctga

SEQ ID NO: 1541 - DNA, 1319 bp, Heterodera glycines
  cDNA sequence=SeqID_1322; peptide sequence=SeqID_1744
gcacgagggatttctttacttcattttaccaaatgcttaaagaggatgaaaaaacggcggacctccacaaagttgaggacgccttcgtacctctgatcaaactgcgctacgatggcattgaactcgacattttattcgctcgtttggcgttgaaagaaataaaggaagaccaggaactctcagacgacaatttgcttaagaacttggacgagaagagcattcgttctctgaatggttgtcgtgtggccgatgaaattttgcgattggtcccaaatcgactgaatttcattttggttcttagagccgttaagctttgggctaaaaaccatggcatttattccaatgtgttgggctttcttggcggcatttcttgggcaattctcgtcgcccggacctgtcaattgtatccaaatgcaacaccttctgttttattgcagaaatttttcctcgttttttctgcatgggattggccacatcccgtcattctgaaggatgtcgacgctaccccgcggattgacataccctatttcattgacatgatttgggatccgagaacacgcgcatcggaccgctaccatttgatgccaatcattacgccagccttcccagaacagaattccacatttaatgtgacaaggtcaacgagacaagtgatgaccaatgaattcaaagaaggcctagacaatatgctagaaatattcaatggacatgccacttggaaaaagctattcgaggaagtcaattttttcactcgctacaaacatttcattgcgctgctttgtctcaccgaaaatgaggaggaccacctgaacttttgcgggttggttgagtccaaaatccgccatttggtggcgtccttcgagcggaattcctgcgtgaatctttgccatgtcaatccccggcagtataaacccgcatacaaattggagctcgacatcgattacgagaaccccgtgtgcactttgtggttcattggattggacctgaacaagcaacttacgaaaaaaattgatctcacagaagagttgcagggatttacggacaccgtttacaaaagtgcgtccgtgctgaaggacttcaaagaaacgatgagaattcacccctcttacacgcgccaaaggaatctcatcaaatggctttccaaggaggacttggaccggggtagacgagcggaacgacgctgctccgccgcggcggcttctccacgcgtgtccatgctaaacaattccctggactcaaccggaaaatcattggacaccagcggaagcaattcacccgcttctgccgaagagccgtccctgaagaaactaagagtctaa

SEQ ID NO: 1542 - DNA, 1384 bp, Heterodera glycines
  cDNA sequence=SeqID_1323; peptide sequence=SeqID_1745
ttcggcacgaggcaccactgtggtggaatgtctgaaggatgccgacatttccatcaaaaagagggctcttgaactttgctttgcccttatgaaccaaacgaacatcgcgagcatgtccaaggagattataattttcctcgaaactgccgactccgatttcaaagctgagtgttcttctaaaatgtacgttgcgacggagcgcttctccccgagtcttgtttggcatttggacacaatgataaacgtgctgcaattggcagctaaccatgtacctgatgaagttgtcagtgcgatgattcagctcatctcttcccagcaggaactgcagcattacgcaaccgtccaattgtttcatgcctccaaacgggaacacatagtaaatgctcagcccttaatgcaaatcgcattttggagcattggcgaattcggtgatttgcttgtcgctccgggaaatacggaggaggcaaatataaaagtgagcgaggatgaagtggtggaattgttcgaacttttgatgcctcatccacagctcactgtgccaacccgtgagtatggactaactgcacttgccaaacttagcacgcgattcgactcgcacgccgaacaaattcatgcgttaatacgacaatattcggcacacatgaatttggagctgcaacaacgttccgttgaattctcacgattactgtcaaaggatgaactgaggaatgggctgctggagcgaatgcccgccattgaacacaatgcccttcacaccgcagcgacgccaattgaaatggacgataatcaccaggaattaatagtggcgcaaaaagaacaccaaagccaaaaaccgaaggccgatgaaattgacttgctcgggttgggcaatacggattctcctgctttggttgacattctcttcggcggggttccaaatgtgcagcccctttcaagaaatattggcaaagaccccatcgacgacctttttagttttgagtccagtaataaaaacggtgcccttgtggaagatgatcagttgaaaacgggtcaaatcgtgctcaaccagcgtggtatcgagatgcaattattcgtggattccaacggattcgactccaatggattggcacaattgcggtttcaaacagttaacaatacccccgctggagtagaagatttcaatttggcagtggccgttacaaaagcttatcaaattgaattgcttccggcgaattcgacgagtcttcaggccaatgctttgtccacgataagccaaaaggcgaatttgcggcggctggcaaattcgaaagcgcctcgtctacgactcagaatcagttatcggttggcgggtgccttgaatacaattgacgctgaagtgacgagcatcgcctgcctcgcctcctaa

SEQ ID NO: 1543 - DNA, 555 bp, Heterodera glycines
  cDNA sequence=SeqID_1325; peptide sequence=SeqID_1746
atggtgcgcacattgaaattccatgagaaaaagttgctgaagaaagtggacttcatcaattggccggccgagttggacaacagtcttcatgagaacaaaatcatgcgccgttaccatgtggagaagcgcgagcactacacactgtacaacaaactgtccagagagatccgagaaatggccaaacgcatccgcgagttggacgacaaaaacccgaacaagttggtgttggcacggatgctgctcggcaagctgttcgacatgggcgtgattccgaccgcggacacactcgagcgatgtgacaaagtgacggcatcgtccttttgccgccgtcgcctccctgtcgtttgccacaaaatgcaaatggcaccgacggttaggaagtccagccaactggtggagcagggccatgtccgtgttggtgtcgaaatggtcaccgatccggcctttttggtcacgcgaaaccaatcggatcacatcacatggacgcgggaatcgaaggtccgaagacatctcagcacttacaacaacgaattggatgactttgaggggtgttga

SEQ ID NO: 1544 - DNA, 1329 bp, Heterodera glycines
  cDNA sequence=SeqID_1326; peptide sequence=SeqID_1747
atggcctccaaatttgtattcagtcttcgcttttcctacccgaggcttttaaccagcagtgccctcaacaacaaaaaatcgggcccaaatttccttcagtctcgatcaattgtaaccaaatttgacctggaattgcctgacgattacccggagccttggccctacaaacaatggggcttcaaccaatttatgcaacattttgacaaaacgctgaagcgctggcacatcaactcgaaactgatcgttttcgaaagcaacattggcgtgggccggtcgtcgatcgcaaaggaattggccgatgcgttgggcttttattatatgccggcctttaaaatggacgacattttggttgaccgttacaacaatgacatgcgcgactattatcatttgtttccgaaacgctttcggttcccggacatcaacatgttctacaaggacccggccgacgaccaaacggctgtcatgcaagatctgatgtacgactgccgttgggagcagtacctgaacgcacaggcacaccttttcaacacgggccaaggcgtcgttttggagcggtgcgtccacgcggactttgttttcgcaaatgcaatgcgtgccaaggattggatcagcagagaatacttcaatttttacatgtacaagcgcaagcaatcgctgttattcaccagaatgtatccccatctgatcatctatttggactgtccgcctgaaaagtgtttggaaaacattcaaaaacggggcaatcccgctgaagtcaatgccgtggatttggaatatttggtcaacattcaaaattcctacaaggatttttttcgggaaatgagggacgaatgtgaaattctcgcgtacgattggacaacgccccaagtccttgacgttctgcttgaggacattttggagattgatttcgaaacactcgatttttattcctccggcaaacatcgcacttggtcactgatgggaacggacacaaaccactgcttttggcgccatatggtcaccaccaaagaccaactgaaggaaagggcgatgaacaaacttggcttgctgcaaacggaggtgtccgagctgtacatttaccccatggacggtattcatcatcggaatgtgattatgcatgaggtgctaaaagatcgttgcacccacggctacacaaagaaggacccgatccaggggctgacacgggccaattaccgcaatctcgaaatgccggaaagatggactgaatacttctggaaagaggaatggattggctcttcctgttcccttcacacactgttcgacccgaccgccaaggactacgacccggagtatttgtccaagcattag

SEQ ID NO: 1545 - DNA, 960 bp, Heterodera glycines
  cDNA sequence=SeqID_1327; peptide sequence=SeqID_1748
gcacgaggattaaaattgaaagttccaattctgctgtattgttttgttcaatgtttaagtgctgtcaaagtggacaatgccgagcaatccgaccaaccaactggcgattcttcctccggacaattcccaatttcgtatcctccaataaaatatgaaaacgatttggcctatgtggagaaaccgagtggcaacgagcgttgtctattctacgcggaaggactttctgtcgtcgtttttgccactaaaaaaagtcaatcggcgtgggcggactatcgctctgacaccaaagaaagtccgaagtataccgcgtcaattgaatgccaaggcaatatgaatgtgggcagcagctttgatgtctatttgaaaattgacggcaaagcggaaggagttgtgagagctgacattggaaaaaaggacgcaaaaagtgtcttcactgttgaaggagccgaatttatactcaacttcaacgtcacacaagtcggcttttggcaattggttggtgccaccgtggaaagaattgaagtgaaaggctcttcggatttcctgaacaaaaatttgaatgtcgacaaaaaatggactttggagccttcagttgttccatccacaaacattaacggcttcaaagactacagctttgcttgtggtcagaccaacccgatagtgtgggccctaaaggactcaaatgattacgcagtcggaattacgctgaacaatgtgcagttccaaccattcaatgcaacttacactgccggtggaaaagaagctgaccgtttaaaatttgggtggaaagtcaacgattgccaggggctgttcagcattggcacttggatgggcttggtagttgccactctgctcatcggcgtgctctttttcggctttctgatgcttaattctgtgcagacaatggacagattcgatgatccgaagcagaaacagttgataattagttcgaaagagtga

SEQ ID NO: 1546 - DNA, 621 bp, Heterodera glycines
  cDNA sequence=SeqID_1328; peptide sequence=SeqID_1749
atgctgataaaacgcgcattttcattctcttctcgtgcattgcaacagcacagtgtcgtcaggcctcccgtccaagtgacaggcattgagggaaaatacgcgtctgctctgtactcgtccgggataaaggagaaaaagctggaaaacatcgagaaagagttgcgtcaagtgaaggagttgtacgacaccaacaaagagtttaagtctttcattgacaacccaattctgaataagcaaaagaaaaaggaggccgttgaggatgtgctgaagaagcagggcgtctcacaacaagttcagaacttcttcggccttttggcggagaatgggcgaatcaacaaattgaccggtgtcgtgagctccttcgaaacaataatgcgagcgcatcgcggagaacttcacgtggaagtcgcaagtgccgagcccctcgacaaaaaacacgaacaatcgctgaacgacgccctgcaaaagtttgccacgcgtggacagaagctgaacttgactttcactgtgaagccggacttggttggtggactggtggtgaacatcggcgataaatatatcgatttgtcaatggcaacacgccttaagaaaatggacgcggtggtaaagggatcgatctga

SEQ ID NO: 1547 - DNA, 415 bp, Heterodera glycines
gcacgaggtggaggagtcgccgctcgaagctcaaaagcgtgaggaaatcctccgcatgtaccaatcgtgcaaggaggcgctgcgcatcatcagcgacgtgaacatggccacgatggccaccgatttgccccctccggtggtgtcaccggcgaacgatttccgcaacaattcctcgccagtgccacggcccgccccggcgcctcctggccaaattccgacaaatcggccagctcctcagcctccgatgggtgcccgtccgattggcatggtggccggggcacagccaataatgccaatccaaaaccgaccgctccccgggccgccgggacaagcgccaatgcctccgatacatgccaacgatttgaacaaaccgcgaattccggagagaccgcaaataccaagcagacccttttga

SEQ ID NO: 1548 - DNA, 1283 bp, Heterodera glycines
  cDNA sequence=SeqID_1330; peptide sequence=SeqID_1751
ttcctctctttgggataatgtccacggacagtgctgaccccctctattggctccgtgtgatcatggcttccaacagaggcacactgatggagttgggcatttcgcccattgtcacttccggtctcataatgcaacttctcgctggtgcgaagattatcgaagtgggcgacacgccaaaggaacgggcattgttcaacggggcgcaaaaactgttcggaatggtcatcactattggacaggcaattgtctacgtggcttccggaatgtacggaaacccacacgaaatcggcgccggaatttgcttgcttatcgtaattcaactcgtcgtggctggtctcattgtccttctgctggacgaattgcttcagaaagggtatggacttggctcgggaatttcgctgtttatcgccacaaacatttgcgagaccatcgtttggaaggccttttcaccggcgacgatgaacacgggccgtggcacggaatttgagggggcgatcatcgcacttttccatctgttggccactcggaatgacaaagtccgtgcacttcgtgaagctttctaccgacagaatttgccaaatttgatgaatctgctggccactgttctagtttttgccgtcgtcatttatttccaaggttttcgtgtcgatttgcccataaaaagtgctcgctaccgcggccagcacagttcctatccgatcaagctgttctacaccagcaacatccccatcatcctccaatctgcgctcgtctccaacctttacgtgatctcacaaatgctggcggccaaattcggcggcaacattttggttaatttgctcgggacgtggtccgactcttccggcacatatcggagcttcccaaccggtggtatctgctattatctgtccccgcccgagtcgctctcccacattttggaggaccccatccactgcatcatttacattgtgttcatgcttggctcgtgcgccttcttttctaagacttggatcgacgtcagcggctcaagtgccaaagatgtagccaaacaactgaaggagcagcagatgatcatgcgaggccatcgcgagaaatcgatgatccacgagctcaaccggtacattccgacagcggctgctttcggtgggctgtgcatcggcgcattgtcagtcacggcagattttttgggcgcaattggaagtggcacgggtattctgctggctgtcacaatcatttaccagtactttgaaattttcgtcaaagaacagcaagaaatgggcggagttgccggactctttttctga

SEQ ID NO: 1549 - DNA, 393 bp, Heterodera glycines
  cDNA sequence=SeqID_1331; peptide sequence=SeqID_1752
atgactgaaggaggtgaagaagtgaatccaaaggcctaccctttggcggatattcaactttctcagaagttgcttgatcttgttcagcaggcaacgaactatcatcaattgaaaaagggtgctaatgaggcaaccaaaacactgaaccgaggcattgctgaggtgatcattttggcagctgatgcagaaccattggaaatcattttgcatttgccattgttgtgcgaagacaaaaacgtcccatatgtattcgtgaaaagcaaggctgcacttgggcgtgcatgcggtgtgactcggccggtgatcgcaacttcgatcattcaaaatgaaggatctcagttgaagtctcagattcagaagattaaagaagatgtggaaaagttacttatttga

SEQ ID NO: 1550 - DNA, 394 bp, Heterodera glycines
  cDNA sequence=SeqID_1332; peptide sequence=SeqID_1753
gcacgaggaaatcacccgcgagttggtaaccaccattttgtcacggaagcccaaaatgtgcgcattcctcgagtataaggacacgaaagttgtgtacaaacgttacgcttcgctttacttttgctgcgccattgagcagacggacaatgagttgctttgtctggaggtcatccaccgttatgtggagctgttggaccgttattttggcagtgtttgcgagttggacatcatcttcaacttcgagaaggcctacttcattttggacgagtttttgttggccggcgaaattcaggagaccagcaaaaagcaagtgctgaaggcgatcagtgcgcaggatttgctgcaggatgaggagacaacgcaaggattgtttgaagacaacggacttggctga

SEQ ID NO: 1551 - DNA, 1711 bp, Heterodera glycines
  cDNA sequence=SeqID_1333; peptide sequence=SeqID_1908
gcacgagggtttgagacatctctttcgcgcctcattaaatgcatattcaaacggtcccgtaattgcagaaaacattataaattcgttgaaaagaaatcgagaaatggggaaggagcaacagaaacaacaaaacaaagaaaaaaaggttgccgcacaacagcagcaaaacaccggagatgaagcggggactaagaaacagacaaggcttgggttggatgtgacaaagacggagaactattccgaatggtattcccaggtgatcgtcaaggcagaactaattgagtattacgacgtgtccggctgctacgtcatccgtccctgggcgtattccgtgtgggaacacatccaagcattcttcgacgctgaaatcaaaaagctgggcgtcaagaactgttactttcccatgttcgtctccgctgctgcgctcgaacgcgaaaaaacgcacgtggccgactttgccccggaggttgcttgggtgaccaaggccggaaactccgacttggccgttccaattgccattcggccgaccagtgaaacggtgatgtacccaacctttgccaaatggtgcaaatcacacagggatttgcctatcaaaatcaaccaatggtgcaatgttgtgcgatgggaattcaaacatccgactccatttttgcggacccgggaatttttgtggcaggaaggacacacagcctacgcgacaaaagaggaggctgaggaggaagtgtacgacattctgaatttgtatgcccgcgtctacacggatttgttggccattccggtggtgaaagggcgcaaatctgaaaaggagaaatttgctggcgcagattttaccacgacggttgaggcgtatgtgccggtcaatggccgaggcattcagggcgggacttcgcaccatttgggccaaaacttctccaaaatgttcaacatcgaatttgactcactcgtcaaagggcaagtggagttcgtccaccaaaacagttggggtctttccacgcgaaccatcggcgccatggtgatgatccacggggacgacaccgggttggtgttgccaccacgcgttgcggacattcaggtcgttgttatccccgtcggaattaccgttaaattgtcggatgaaaagcgggtcgaactgattgaaaagtcagaagcacttgtcaaaatgctgaaggaggagcatggagttcgggcagttttggaccaacgtgacaatgtttcgcctggatggaaattcaatcattgggagctgaaaggtgtgcccatccgtctcgagttgggccccaaggatttggccaaggaacaagcgcttgcggtcattcgtcactcgggccaaaaggtgcctttgccattgtccaatttgggcgaaagcatcaaacaattgttggacaccattcacggcgaaatgtacaagaaggttgaacaaattcgagacgaacacatggtcatttgtctcgacttggaggaaatgacgcctctgctcgacaaaaagtgcgtcgttttggccccattctgtggtcgcattgaatgtgaaacgtcgatcaaagatttcaccgttcgcgaggagcctgcggatttgggcactgcccaaatgggtgccaaaacgctttgcattccgttggaacagccgaaggatgtccaactgcctgaacaatgcatcaatccccgctgttcgcaaaagacgcaatttttcgcgctgttcggtcgaagttattga

SEQ ID NO: 1552 - DNA, 2427 bp, Heterodera glycines
  cDNA sequence=SeqID_1334; peptide sequence=SeqID_1754
atggcttctgttccaactcaaaaagatgagaaaacgaaacgaaatgaggagttggcaactgcgattctcaagaaaatgccgaagccgaacagactcattgtggaccaatcgcccaaagacgataacagcagcgttctaatggcacagactaaaatggatgacctgggattgtttcgcggcgattcgatccttctcaaaggcaaaaaacgtcgtgagacaactagcattgtcatagccagtgacacttgtcctcccgagaaaatcttgatgaatcgagttgtgcgtcagaatctccgcgtcaaactgggcgatgtcgtcagtgtttcgtccgcttcaaatacgccaaatggactgcgcattcacgtgcttccgattgatgacaccgttgaggggctgaccggaaacttgttcgaggtgtttcttaagccctactttttggaggcctaccgtccggtttacaaaggcgacacgttcactgtcaacgcagcaatgcgaactgttgagtttaaggtgattgaaactgatccggcgcctgcttgcattgtggtcccaacaacgatcattcattgtgagggggaaccgatcaaacgtgaggacgaggagaacaatctgaacgacgtcggctatgatgacattggcgggatgcgcaagcagttggcgcagatcaaagagatggttgaactcccgctccgccacccgatgcttttcaaatccatcggcattaaacctccccgaggaatgcttttgttcggtccgccaggcactggaaaaacacttgtggcccgtgctgtcgcgaatgaaactggcgcattctttttcctgctcaatggacctgaaataatgagtaaattggctggtgagtcggagtcgaatttgcgcaaagcattttccgagtgcgagaagaattcgcctgccattcttttcatcgatgaaattgacgcaattgccccgaaaagagaaaagacacacggcgaagttgaacgtcgcattgtttcgcaattgctcactttgatggatggactgaagcagcgctcgaatgtcattgtcattggtgcaacaaatcgtcccaattccattgacccggctcttcgtcgctttgggcgtttcgatcgcgagattgacattggtattcctgacgcaattgggcgtttggaaattctgcgcattcacactaagaacatgaaattggcggacgacgtcgacttggaaaagattgctaatgagtgtcatggctatgttggtgccgatttggctgcactgtgctctgaggcggcaatgcagcaaattcgtcaaaagatggagctgatcgacttggaatcggaaaatattgatgcggaagtcttggcgcaattggctgttactatggacgactttcagtttgcactcggtaaaaacagtccgtccgcgttgcgtgaaaccgtcgttgagactccgaatgtcacttgggaagacattggaggccttgaaaatgtgaagagggaattacaggaattggtccagtacccggttgaacacccagagatgttcctcaaattcggaatgcaaccatcccgcggtgtcctcttctacggtccgcctggttgtggaaaaactttgcttgcgaaagcaattgcacgcgagtgccaagcaaacttcataagcatcaagggccccgaactgttgaccatgtggttcggcgagtccgaggccaacgtgagagatgtgttcgacaaggcacgtgcagctgctccatgcgtgctgttttttgatgagctggactcaattgctaaatctcgtggtggaaacgttggtgatgcgggaggggctgccgaccgtgtcattaaccaagtgttgaccgagatggatggaatgggatcgaagaagaatgtgtttatcatcggagcgacaaatcgtcctgacattattgactccgccattctgcgcccgggtcgtctggaccaactcatttacattccgttgccggacgagcccagtcgcctgcaaatctatcgtgcttctctacgcaagactcccattgcaaaggatgtggaattggaatacttggccaaagtcactgttggcttctccggagcagacatcactgagatctgtcaacgcgcttgcaaactcgccattcgcgagtccattgagaaggctgttgccatcgaaaaagatcgccaggccaaggaacagcgtggcgaggaagttatggacgtggccgaggatccggtgccgcagctgactcgcaaacattttgaggatgctatgaagtttgctcgtcgcagtgtttccgacaatgacatccgcaagtacgaaatgttcgctcaaactcttcaacagcagcgcgggtttggcaccagcttcaaatttcctggagagggcaaaaaatcgtcaagtggcagaggcgggaatgaggccggaaatgatgacgatgacctctacagctaa

SEQ ID NO: 1553 - DNA, 1545 bp, Heterodera glycines
  cDNA sequence=SeqID_1335; peptide sequence=SeqID_1755
atggcaatgctgaatgcgtccttcgataaattcaatatttctaattcggataaaatccgaacccagcggctcatatcaatgagtgaaagttgcgaagagtggaaaacatgcaccaagcgagaaacatatgcacttctcgaccaggagctgaacaaactgttgaccacgtcaccccccgagaaaatggagtattggaaaaaggaactcgatggatttatggatctttttgctcgtttcttgcgcgccaaaaccaccgtcgaatggtccaaaattgagccgttgcccgaaggggcaataacgccgtattcgaagcttgaacaaacaccgcgggaccgtgtccgtgaactactcaatgggttggttgtggtgaagctgaacggcggactcggcacttcaatgggctgcaaagggcccaagtcgatcatttccgttcgcaatgagctgaccttcttggacttgaccctgcagcagattcagagtttgaatcgtgaattcgaagtcaacgtgcccttggtactgatgaattcattcaacacggacgacgacactaagaagctgctcaagaagtacacaaatgttcgggttgaggtgcactcttttgcccagtcgagatacccccgcattgatcgcgaatcattcatgccgctggcaaaggatttgaaggacatggacttggaatgttggtacccccctggccacggaaatttctacgagtcgctcattaattccggtctgttagacaactttttgagtgaaggaaaaaagcatgtttttttgagcaacatcgataatttgggcgctaccgttgacccaaacattctcaattacatggtggccagaaaggcggaattcataatggaagtaaccgacaaaacgcgggccgacgtcaaaggagggacactgattgaatacgaggggaaactgatgctgttggagatcgcccaagttccgcctgactatgtggacgagtttaaaagtattagcaaattcagaatttttaacactaacaatttgtgggccgaattggaagcgatcaagcgggtggtactgaacaaagagctgaacatggaagtgatcgtgaaccccaagcatttggatcgcggtgccaatgtgattcagctggaaacggcggctggcgcggcttgcaaatgctttcgtggtgcctgtggcatcaatgtgccacggtcgcgtttccttccggtgaagaaaacttccgaccttctgctgctgatgagcaatctgtacgacattgagaatggttacgtgacactcagcactctccgctccttccctaccacgccattggtcaaactgggcagcagttttgacaaagtcaaagagtttgtgaagcgattccaaggcattcccgacctgctcgaactcgatcatttggccgtttccggcgatgtgtggtttggacgggacgtaacgcttaaggggacggtcattataatagccaaccatggagaccgtatcgacattccggcaggcaccattcttgaaaacaaaatcgtctctggaaacctgcgcattcttgaccattga

SEQ ID NO: 1554 - DNA, 399 bp, Heterodera glycines; identical to SEQ ID NO: 997
  cDNA sequence=SeqID_1336; peptide sequence=SeqID_1756

SEQ ID NO: 1555 - DNA, 393 bp, Heterodera glycines; identical to SEQ ID NO: 973
  cDNA sequence=SeqID_1337; peptide sequence=SeqID_1757

SEQ ID NO: 1556 - DNA, 771 bp, Heterodera glycines
  cDNA sequence=SeqID_1338; peptide sequence=SeqID_1758
atggcaaatcgcacagctcgagacgcacataccataaaaggcacaaatcctcaatatttaattgaaaagatcatccggactcgcatctacgattctctttactggaaggaacagtgttttggactctcagctgaaacagtcgtcgaccgtgccactgaattgcgttacattggtggaatatatgctgggaacataaagccggctcagtttctctgtcttacactcaaattgctccaattgcaacccgacaaagacataataattgaatttataagacaagacgacttcaagtatgtccgtgctttgggtgccatgtatatccgtttggtatttaattccgtcgaagtcttcaaatacttggaaccgctgtacaacgattaccgaaaactgcgttacatgaacagaatgggaaaattcgagttgctatacatggatgaatttgtcgacaatttgttaagagaagaccattattgtaatatacagctgcctcgtctacagaaacggcaagcactcgaagaaaaggaccaactcgagttgtacgcttccgccttggacgaagacttagagcgtctttccaccgactccgaagatgagcaggagacgcggaaagcacggccaaatatcgtttctcggcgccgaagtcgctcgcgcagccgtggccgaagtcggagcaaatcgagagaacggagacgccgatcactttccacggatgttggatttagaccgtcggggaggacgaagtgccgcgaaagacaccgaaagagaaattga

SEQ ID NO: 1557 - DNA, 528 bp, Heterodera glycines
  cDNA sequence=SeqID_1339; peptide sequence=SeqID_1759
atggctccaaaagagaaagaggttggaaagggatggagctttgctcattttttttggcatctaattaaaaaggaaacacgcaatgagaaggagagacacattttggcaaacggacgattggcactttcgtttttggcagttgcttttgccggatttgcccttctgtacgactacttttttccatttccaaagtcaaaaattattcttgcggtttgctccattagctatttcgtcatgattatggtcctccaggcgtaccaatggtacgttgagaagctgacattctttcaagcggaggagaaaaccactgacaatggcgaaccacgacattggaaatggtcatcggatatgaaacgctatgatgacaaatatgtgttgatcgctgagtactcccaaggcactcgtactggctcaatgaaagtggtcaaatcggtggctgcttatatcacggaggatggcgaggtgctcgtcccgttgatcaagagggaagtcgatctgctgataaagaatctgctcaaggccgactga

SEQ ID NO: 1558 - DNA, 1120 bp, Heterodera glycines
  cDNA sequence=SeqID_1340; peptide sequence=SeqID_1760
tttccaggaggtaatttctccgaatatttataacgcaaagctgtgggagcagtccgggcattggcaccattatgcggagaatatgttccggttcgaaattgagaaggagcagttcggactgaagccgatgaactgtcctggacactgtctgatgttcgactacaaaccgcacgcctacaacgaattacccatccgttatgccgacttcggtgtactccaccgcaacgaaatgagcggcgctttgtccggtctgacgcgcgtccgtcgctttcagcaggacgacgcccatattttttgccggaaggaccaaatattgtcggagatttcgggctgtttggattttctgaattttgtctacgtggaagtgttcggcttttccttccgtctccatctgagcacgcggcctgaagagggctatttgggcgacttggccacttgggaggcggcagagacacagctgaagcaggcattggacaacagcggactcaaatgggagctgaacccgggcgacggagcattctatgggccaaagattgacattcaaatcaaagatgcgttgggcagacattggcaatgtgccaccatccaattggacttccaactgccccaacgcttcgacctttcctattacgatgagaacaaagagcgtcttcgtccggtgatgatccatcgtgcaatttacggttcaatcgaacgaatggtggcaattttggcggaaaattgtggagggaaatggcctttttggctgtcgcctcgtcaggcaatgattatcgttgtgcaccattcggtgagtgactacgcgagcaaagtgttccgccgcattttcgacgcgggcttcgaggtggaatttgacgaggacagcccggacacgctgaacaaacgcattcgcaatgcccaactcgcccagttcaacttcattttggtgatcgggcaacaggagaagaacaacggaacagtgaatgtgcgcaccagggacaatcaggtacgcggtgagattgctgtcgatgcgctcatccaaaagttccaaattttccgcgacacttttgcccaagacacagaaagtgcaggatcttttgaaggcccgaaggaacaaaaagaaattttggatgacaaaaaatga

SEQ ID NO: 1559 - DNA, 1245 bp, Heterodera glycines
  cDNA sequence=SeqID_1341; peptide sequence=SeqID_1761
cggcacagcaattacgaattggcaactgctttgcttcgtcgtgccactacgcctccaccagtgcgtcgtgacagttactttgatgattcggccaaagtgcaaaaccgcgtgttccgatccctgaagttgtggtcgttgtacgccgacattgaagagtcgatgggctcactggaaagttgcaaggcaatttatgagcggatgttggagttgcgaattgcaacaccacaaatcgtgataaattatgcactgtttttggaggacaaccaatactttgaggatgctttcaaggcgttcgagaagggaattgggcttttccggtggccgctcgtatttgacatttggaacgtttatctgaccaaattcatccaacgatatggtggcaaaaagctggaaagagctcgcgatttgtttgagcaatgcttggacaaatgcccacccaaatatgccaaaaatatttatctgctttacgcaaaactggaggaagagcatggattggcacggcacgcaatggatatttacaatcgggcaaccggagcagtcgaaaaggaagaaatgcatctgatctacaatgtgtatgtcaaaaaagcgatgcaattttacggcatcaccaaaacgcggccgatttttgagtcggccattgaacgtttgcctgaggagcgttctcgggagataagtgtacgctatgctcaaatggagcggaatttgggtgaaatcgatcgcgcccgagccatttatgcgcattgtgccgaaatttgtgacccccgggtccaatctcagttttgggagagttggaaggagtttgaagtcaagcatggcaatgaggacacaattcgtgaaatgttgcgcgtcaaacggtccgtccaggccacgtacaacaccaacgtgaactacgtgagcgcccaaatgatggccacattaggcagccagactgaaatggccggtgaactcagtgctgccgactcaatggcacaattggaggcgcgcgcagcacaaattgcgcaggaagaggcattgattgcagcaaaaaaagtgttgccggcgacggacggacgaatttcgtttgtacgtggcgaaggtcgcacaacgacagaagcacgggctgaaaatccggaagaaattgacattgatcaaattgttgatgatgagcgaggggaggaagaggacgatgaaaacgccatggatcacggggatggcacagcggcgaaaagtgcagacgatggacagagggaaacggcggaggcgtaa

SEQ ID NO: 1560 - DNA, 862 bp, Heterodera glycines
  cDNA sequence=SeqID_1342; peptide sequence=SeqID_1762
cgcaatgaagtacacaatcatcgtttccgccactgcttcggatgctgcgccgctgcagtttttggccccctattctggcgccgccatgggcgagttttttcgcgataacggcaaacacgcgttgattatctacgacgatctctccaaacaagcggtcgcttaccgtcaaatgtctctgctgttgcgccgtccacccggtcgtgaagcttacccgggtgatgtcttctacctccactcgcgtctgctcgaacgtgcggccaaaatgaatgagactcatggcggcggctcaatgaccgctctgccgatcattgagacacaggcaggggatgtgtccgcctacattcctacaaacgttatctccatcaccgatggccaaatcttccttgaaaccgagttgttctacaagggagttcgtcctgcgattaacgttgggctttccgtgtcacgtgtgggttccgcagcacagacaaagtcgatgaagcaggtcgccggttcgatgaagctcgagcttgctcaataccgcgaagtggcagcctttgcccagttcggatccgacttggatgcctccacgcagcagttgttgaaccgaggagttcgtcttactgagctgctcaagcagggtcagtacgtgccgatggcgattgaggagcaagtggcggttatctacgccggcgtgaagggacatttggataaaatcgacccgtctcaaatcacgcgcttcgagcgtgaattccttgcgcacattcgagcgcatgagcaggaattgctgaaggtcatccgagaagaaggccaactcacaaccgcgactgacgaaaaactcaagaatttggtgacttccttcttgggaggtttcaaggcttag

SEQ ID NO: 1561 - DNA, 558 bp, Heterodera glycines
  cDNA sequence=SeqID_1343; peptide sequence=SeqID_1763
gtccaaacactcgtcaaagccgcttcgtctgcgcagcaggaattggtggcccaggggcgagtggccgacccgggcccagcaaatggcagcgaagagcagcaatggactgcaggtttggtctccgccgctaaactcgtcgccgctgcgactaaccaactttgtgaagctgccaacggattggttcaaggccattcgacggaggaaaagctaatcgcagcggcgaaacaggttgcttcttccaccgcccatctgttggtagcgtgcaaagtcaaatgcgacttgaacagccgagcaatgcaacgactccaaagtgccggtcatgcggttaaaacggcaacagaacatttggtgaacgcggctcggcaagcgattacgcaagaggactgtcgcgggttggtcatctcggaaaagattgtcacgggcattacacaaatgatggacgcgcacgaagaagtgctgagaaaggaacgcgaattgaaagaggcgagaaaccgactggcgcagctgaacaggtctcggtatgaaaagtcgccggagccctcgccagaaaagcaataa

SEQ ID NO: 1562 - DNA, 701 bp, Heterodera glycines
  cDNA sequence=SeqID_1344; peptide sequence=SeqID_1909
attccgattttttaaaaatgtcactcactggtgggactgtaattgcgttagcctacaaaggcggagttgcgatggccactgaccgtacagtttttgcatccggtgttcatcgttttcagaacaatacgcgccaatatcggttgaataattattgtctgatttctttctccggagactttgccgaattccaatggttgcaaaatttgctggaacgccgtcagatggaattacagatcgacgcggggatggaccatatgaagccgaagatggtgcacgcttttctcacctcactcttttaccaaagacggagcaaaatgaacccatttctgaacacaatggttgtctgcggcatgcaaccggtcgagtttcatgccggagaaattaagcctttcatcggcgtcatcgacatgcgtggcaatgcctatgaagttgaccatgtcgcgacagaaattggcaaatatttgcttcgccaaatgttggagacgcgacaaacgcaggcaaatggagcggaacaaatgagcaaagaagaagcacttcgaatggtcgcagcggcgttggaggtgtccgtcagtcgtaacagcagaacgggccaaatgttcgatgtttccactgtggacgccaacggagtgaaattccacgaccaattccaaataattggcaaatgggacgaaatcgaagtgtgtgacggcacttacaagtaa

SEQ ID NO: 1563 - DNA, 881 bp, Heterodera glycines
  cDNA sequence=SeqID_1345; peptide sequence=SeqID_1764
atgggttcattaactacgggtcaatcgtcaaaatggtggatagtgtcagtggtttggctcttccgatgatgcgaatatgcaaagttgaaaaatgcaatgggacggacgttgtggtgatcaacgacggagacagcggggagcaagtcagccaactgcacaagtgcggcttccaaatgctcagcggagcggagagtcggcctttgtttatgtgtttcaacggcgaaaacatagtgcaacaagacgtgggcaatgatcggagttttgtggcgaatgatggccaatttatgacggatcgaaggtatccgatcagagacggcgcccaatggacaattatctcgaccgatacaatccaataccgtttctttgaggcactaaggccagttcagaatgaggttgctcctgtgccaattgtcagttcgctggacatgcactcgactgacccgacttcgtcttccggcgcttacgttgagcttaatgggcacgacttctaccccaatttgcaggcttggctcggctccactcccatgcccacgacatttgtcaacaaagagatgctccgtttcactctcctccctctcagtcagctgaatttgcaggagggcgtcgattatgtgttgggtgcccgctgctctcttctgtccgtcccctgcccgctcagttcgccctcccattctccgacaacggcctcgtctcccccattccttcacttcctcaatggcacaacaacagtttcttatgacagtgatcaggaattggagtttccgttgtcattggttcgcgatgacggagtcatttacgccactcagctgagtgtgtcttacacgagaccacgggaacaacagttcaggacgggaattcaaggaacacaaccgaacagctag

SEQ ID NO: 1564 - DNA, 580 bp, Heterodera glycines
  cDNA sequence=SeqID_1346; peptide sequence=SeqID_1765
agctacttttgagaaactcgtaaagactgatggcaaagcgcccgatgaccttgaaaaacaagttgcaacggctttgtctgaattggcacacaattcagagatcaaggctcagctcagcgaactttattttgttggagcacaggaatacgaatttggaaacaaaaagtgtattctggtatggattcctgttccgcaacttcgagactaccaaaaaattcacccaaaattagttcgtgagctggagaagaaaatgagcgggtgtcatgtcatcttcattgccaagcgtaggattttgccaaaacctcaacgaggtaaaaaccgtaagccattgggacagaagcgtcctcgttcgcgaacactcactgctgtgcatgactcaattctcgcagacgttgtattcccagctgaagtggttggcaagcgaactcgagtcaagcttgacgggaaacaaatcatcaaagttcacttggacaaggcacaacaaacgaccgtcgaacacaaggtggacaccttttcgcatctgtacaagcgactgactgggaaggatgtggtgttcgaatttccggagccgttattctga

SEQ ID NO: 1565 - DNA, 1290 bp, Heterodera glycines
  cDNA sequence=SeqID_1347; peptide sequence=SeqID_1766
atgattatcagcagcaaagccgtccaacttttgacttgctacagaaataggatcaccagaaaactacaatattcgactacggagaatgtgccggtgaatgtgcctgagccggtcatttcctcctccaacatggcacagttccgcaagggagcgggcggtcgttccagcttctcgggcaatgtcattacagtttttggcaacaccggatttaccggccgaagggtggtcaatcggttggccagacacgcaaatcagctaattttgccgtaccgctgcgattcgtattttctcagagaattgaaagtgccttgtgaccttggccaagttctgttttttcctttccaattggacgacgatgaaagcattcggaaggcagtcaaatacagcaacgttgtgatcaatatgatcggcacatatgtcgacacaccgaattattccatttatgacgccaatgtggagggtgcgtggagaattgcgcgcatttgtcgggaaatgggcgtggaacggctgatccatgtgagcgcattgaacgcggacccatcgtacaaaacgcaattcatcaaaaatggcgcctttctgaaaagcaaaggcatggccgagcaggcggtccgtgccgaattcccaagtgccaccatcattcggccctctgtgatgtacggcgacattgaccgtctcatttataatctgatcacccgttggcgcgttgacccgttcggcaatgtgtacactttcaatgcgggcgaaggcatttacaaaatgccactttttgtcaatgactttgccgacggagtgaacagagtggcgatggactcctcaacagcgggcaaaacctacgaatttgtcgggccgcactgctacgaaatgtgcgagttgttcgacttcatcttcatcaaaggcggcctcgtcgctgacataactagcagataccgtcgtgttggtattccgatttggttccttttcacgtcttttctctgtcattcgtatacgaaaatatatcgtcgtcctggcgttattaattgggagtggttcgatttcatggaagcgacgagtgatgtgctgtcggctggggacacttatcttctgaaggatttgggcgtttcgttgaccgattttgaggatatgggcggctattacgccatgcaaatttcttttcagagaccataccagccaagaatggctgactatccgcagtgtccgctcccccttcgttcgccgcctctttacaaacggaagccgatcacttttaagaagcaaaatatagtcactgagcaaagggcgttcggactttga

SEQ ID NO: 1566 - DNA, 618 bp, Heterodera glycines; identical to SEQ ID NO: 1006
  cDNA sequence=SeqID_1348; peptide sequence=SeqID_1767

SEQ ID NO: 1567 - DNA, 640 bp, Heterodera glycines
  cDNA sequence=SeqID_1349; peptide sequence=SeqID_1768
ggcgcgaaggaagcgaatcggacactttggagtgcgagatagtcgacgacagtcgagaaagcgaaagaaattcgaatcaccgcaagccgtaccgcctgccgcgaacaccgacttcattcagacagcccggggcgcaattcggcgtcagtcattacgcgatcggagtgggatgacacttgcacggcttgattcacaacgtgaagggtccgacctgattaggagttggagcaaggaggatgtgtccaatgaggaaatgtctgcgcatcatttcggcaacgggggaccgtccacctctcaccagccgacagcaaatcagcaaagacgcgactcgccgcctaaaagaatgcagaaacaatcgcagcaaaagcagaagcaaatgtcgccagacgagtggttgaagaagttggaggccgaatcgggcggccttcgagacgaagaggaggagcaggcggagaaagacgtgctgaaagggagcgccggggagagcatgcggaagggagcgaaagcacagaaaggcaacggggtgattaggagagatcagcaacagcagcagcaacacgatatgaacggaatgaatctgaagggatcactcggtggacagaatcggaggcggaagaagagctgttgctgcattatttga

SEQ ID NO: 1568 - DNA, 735 bp, Heterodera glycines
  cDNA sequence=SeqID_1350; peptide sequence=SeqID_1769
atgactgaagccaaaaaattgccggaagtgccggagacgctgctgaagcgacgcaaaatcagagccgcacaacgggctgccagggcgaagaacagcttgaacaccatcaaaaaagcgaaggccaaaaagacggaaatcttcaaacgggcggaacattacttggttgagtaccgccagaagcagcgccaattggtcgcgttgaaacgggaagcgaagaaagtgggcaattactacgtgccggacgagcccaaacttgcatttgttgtccggatcaagggcatcaacaagatccatccacgccctcgtaaagtgttacagctgcttcgtctgcgtcagatcaacaacggcgtattcgtcaagttgaacaaagcgacaatccagatgttgcgcattgctgacccgtacattgcgtggggctacccgagtcagaagatcattcgccagttggtgtacaagcgtggttatgccaaggagagtgggcagcgcattccgatcacggacaatgccattgttgagcgaaacatgggcaaatcggacgtgatctgtgtggaggacatgattcaccagatttggacagtcgggccccacttcaagcaagtgaccaactttttgtggcccttcaaactcagcaaccccgtgggcgggttcaagaagaagtccaaccattttgtggagggaggcgactacggaaaccgcgaggaccaaatcaacaaattgcttgaaaaaatgatctaa

SEQ ID NO: 1569 - DNA, 1437 bp, Heterodera glycines
  cDNA sequence=SeqID_1351; peptide sequence=SeqID_1770
gaaaagggaggcgatcctgaacaaattcgcaaatctcaagtgggccgtttcgcagatgtttcattagtggacaaagtgatttcggcggactccgaatggcgaaaagagcgtttctttttggacggtttgaatcgtgcgataaaagtgtgcagtactgcgattggtgacaaaatgaagaagaaagagtcggctggtgactccgatgccattccggaaggacaaatcaaatcacttgcagaactgaaaatggatgacatcaaagaaatgaaaatttcgcaaattaaaacagtcaagggaatggtggacgaagaagtcagacggaccaaactcagaatggaaacgcttgagggggacagaaatgagcatttggccaaaattgggaatttgctgcataattcggtgcccatcagtgacaatgaagacgaaaatcgagtcgaacggacatttggcgactgcgcaagcagaaaaagttattctcatgttgacctcgtggtgatgtgcgacggatttgacggagagagaggcaccaatgtggcgggaggacgaggctattttctgaaaggaccgttggtgttccttgaacaagcgctcatcgcattggcattgcaaatgctcaacaaaaagggcttcacgccgctttacacgcccttttttatgcgcaaagacgtaatgcaggaggtggcacaactcagccaattcgacgaagagctttacaaggtgaccaccgcaaaaaagacggacgcagccaatgaagacggctctcccgacgagaaatatctaatcgcaacttctgagcagccaatcgccgcctttcatcgtgacgaatggcttaacccatcggatttgccaatcaaatatgccggaatgtccacctgttttcggcaggaggtcggaagccatgggagagacacccgcgggattttccgtgtgcaccaattcgagaagatcgaacaatttgtcatctgttccccatttgacaacgaatcgtggaagcacatggacgaaatgattgacaatgctgaagagttttgcaaagtgctcggccttccctaccgaattgtggccattgtttcggccgaactgaacaacgcggcggcaaagaaattggacctcgaggcgtggttcccgggcagcggtgcatttcgggagctggtttcatgctccaactgtacagattaccagtcgagacggttacgaatacggtacggacagacgaagaaaatggacggagaggtcaattatgtgcacatgctgaacgcaacaatgtgtgccaccacgcgagtgatctgtgccattctggagaacaatcagacggaggatggcattgtcgtgccggaacccctgcggccgtttatgccatcgcaatattcgcaacgaattccctttgtaaagccggcgccaattgagcaggaaaaagtgcagaaaaagaagaaatag

SEQ ID NO: 1570 - DNA, 916 bp, Heterodera glycines
  cDNA sequence=SeqID_1352; peptide sequence=SeqID_1771
ttggaagctgagaagaccgactgctgtctgtcaattgaggggacatgacgaacatgtgatcacgtgtctgaagctgcgaggcgacctcattgtcactgggtctgacgactgcactttgcgcgtttggtctgctgcgacgggaacgtgtgtccacgtccttaacggacacattggcggtgtttgggcacttcagctctcacaggatggcaaaattgctgtcagtggttccatcaaagtttgggacattgttgcgggtcaatgcattcgaactcttttcgggcacgtggctgcggttcgttgtgttaaatttgacggttcagtgattgtgtcgggtgcgtatgacaacaatatccacgtgtggaatgctgcggacggttcgttaatgcacgttttggaagggcacacgaacagagtctattcgatacattttgtgagtgagaggaaattgctcatttcgggaagtctcgacacaacaattcgggtgtggaacgtggacaccggcgaatgcttacaaacgcttgtcgggcaccaatcactcacttctggcatgaaattacgagacaacattttagtgtctgcgaacgccgattcgactatcaaagtgtggaacatcaccgacggcacttgtgtccatacttttgccggacccaacaaacacgcgtcggccgtgacggggattcgtttcctggacaatggaatggtggcaacgagtggcgatgatggcattgtgaaactttgggacgtgatggaagggactttcgtctgcgatttgcttcgactcgcttcccagggcgccgggggttgcgtttggagaatgaaggcgacgccgactctgctgatgtgtgccgttggttctcgtaatgggactgaggacacaaaacttattctgatggatttcgatgctccctacccttaa

SEQ ID NO: 1571 - DNA, 681 bp, Heterodera glycines
  cDNA sequence=SeqID_1353; peptide sequence=SeqID_1772
atgaaaccaacaatcgatttgaagcaggacatttccaagtacaaggaacgcttccaaaaacttcatcataaaagagaagagtcaagaaaaataaaccacgaacacgtcgtggaggaggatcgacgtctgaagttgcccaacaattttgaggcaaagcgaaaacgacaagaatgggagttggaggagcttgtggcaagaaaggaagcggaggagcgtggcgaagattatgacagaataaaggcactgggaacgcaagcggacatcgccgacaaaatggaagcggcaaaacgaagaaaagcaaaccccgacacgggatttgcgagttatgaagcgatgtcaattcggcaatacgaaagaatgaccaatgggataaagccggacatggaatcttaccaaaagatgaaaggagtcgtcggagaagatcaattctacgcaagtgcaaatacgttgatccaaggctcgcattatcccaccgacaaggcactcgataaactttcggaggatgttcataaccagatgaagaaacgtgaccagtaccaccgccgtcggatgttcgaccctgatgccccgattgacttcatcaacgaacgcaacagaaaattcaaccacaaattggagcgctattacggcaaatatacggcagatattaaagaagatttggagagagggacggccatttaa

SEQ ID NO: 1572 - DNA, 1017 bp, Heterodera glycines
  cDNA sequence=SeqID_1354; peptide sequence=SeqID_1773
atggctgatgacaaaagctgtgacggtgcttcttctgcgttgcctccgtgtttaattgtgcttggaatggccggttctggaaaaagctcatttgtccaaaggttggcgagtcatctccactccaagaaggtgttcccctacttggtcaatctcgacccggcggcagcaaccgttccattcccagcaaacattgacatcagagacactgtaaattacaaaaaggtcatgcaggaatacggcctcggtccaaacggtgctattctgaccagtctgaatttgttttgcactcgcttcaaccaagtgttggacttgttggacagacgaaaggggtccatgccatacgccattttcgacaccccgggccaaattgaggtgttcacgtggtccgccagcggcactgtcatcaccgattcattggccgcctcttttccgaccgttgtcgcttatgtgatggatagtgcccgttcgaccaacccgacgactttcatgtccaacatgctctacgcctgctccattctttaccggaccaaattgccatttttcgtcgttttgaacaagtccgacgtggtggaccctgcttttgccgtcgaatggatgagagattttgagcagtttcaaactgcgcttgaccaaagttcgtccagtttcatgaacgacttgacccgctctttgtcccttgtgctcgattcgttttacgaaaatttaaattgggtgtccgtatcggcaaagacgggtcagggctttgataaggttttggagttaattgaaaagtgtcggttggaatattgggaagtgtataagccaatgtgtgaacgagtggcacaagagagagctgctgagacagcgaacgacggcacaaccgacgcaatgccaacggaaaagttggcgaatttggaaataagagaaaatgatgtgccaagtgatgagaagggacaaacggaggaggcgcaaattacagaaacaaatggcgaagaacattcaacgaaaccaacggaagaaagtgaagcgcaaaagtga

SEQ ID NO: 1573 - DNA, 381 bp, Heterodera glycines
  cDNA sequence=SeqID_1355; peptide sequence=SeqID_1774
atggccaaaggtgtgaagttcgatcacgacaacgcgttcgtgcgattctgccgctactatctatggcattactgttggagtgggcgtcagtacggtcttcaattctacgaccaggcattcgaaccgcatcccgtagtccaagaggcactgcgccggctccgtcttaaggacccctaccagtacgaccttcgtctgcagcgtattcttttggccagtcaattgggctcaaagaatgagcgactgccgaagaacatgtggacaaaatgggacgacgagacattctatctgaacccgtattttaacgaaattgaggaggaaaagctggagcgtgaagccagcacgggcatgaagccgggataccaactcaaagagcagatttag

SEQ ID NO: 1574 - DNA, 1413 bp, Heterodera glycines
  cDNA sequence=SeqID_1356; peptide sequence=SeqID_1895
atgaaaattggacatcggaccccgccgaggcagaaaagagccactgaccctcccccacagttcgattcttccgatttgggctctccgcaaaaggtttggtcactgttatgcgagaaggacgagaaattgcgccgagatccgcacgtattttcgcgccagaagaaaataaacgccaaaatgcgtgccatgctgctcgactggctgatggacgtctgtgccgacaaacagctccaccgcgaaaccttccatctttgcatcgattacatcgaccgtttcatcgcattgagtgaccaccaaatgcagccccagcgattgcaactgttcggctccaccgccctggtaattgcgagcaaagtcgaggaaatttatcctccgaaaattgcggagattgccgaatacacggacggctgttgttctgaggctgacattcgaggcatcgaagagattatgctggagaagttggattggacgtgttatccggtgaccgctgtccattggctcgcacttttcatgcagctgatgagcacggacgaagtgatccccgcccagcgagtggtcatttcagccggcaaacggccgctagacactccgtcactcaacggcgactcttcgttcgtcatcggtaaaccgtcgctggaggtgagcattgagtcggcactgcccaacgacgagaacaatcagccggacgatgcccagcgggcggagtcgcgtccttccgtgccgtccgtttcgtccccgtgcccttcgccctcttcttgcgcagttggcgaagatgttcagctcgaggtttcgtccgtcgttttcgccggtgcgtcgcgcgtccgtcgcatttccttcagttgcgcctatccgcggatgcaactttgccacattggctcctccccacgcgtgctgctgcacaccacgcgagcggacattagttacgtcggccataattcgtacagcagcggccacatttacccggaccagcgctgcaccgtgccgaaacttatgcggggcgaattcgtccgaatggccgcgattttggacttggccatgctcgactcgggctgtcttcgcttccgttacagtgaattggccactgctgtggtcctttgctgctatgagcccgaacatttgatttgccaactcaccggtttttcgcctgaaaaggtgcgcgatgcccgcgcttacattgagccgttcgtccgcgtgttcgacctcagcgagcccaccggcacagccattccttgcctggcggacgtgccccacggcgaccgacacaacattcaaacgtacacatcgaagtgcctcgaacatttggagactgtgcagcaaattcgaaaagagactgaatcgcgtcgcaaggcggtggaattacgggtcgcggctcgggtgcgcaaacgcaaattcggctcggcaatgaatctctaa

SEQ ID NO: 1575 - DNA, 808 bp, Heterodera glycines
  cDNA sequence=SeqID_1357; peptide sequence=SeqID_1775
gcttggcatgcccggcttcccgggcacaaagggtgaaccaggagtgcctggacgagacggatttcctggcatggatggtgaaaagggcgatgccggatatccggggccagccggacccgctctcagagatggctttgttgtggtcacacattcgcagacgacgcaagtgccgaactgtccacaaggcactgaaaagctgtgggacggcttttcattgctgtacattgaaggcaacgaaagagcacacaaccaggacctcggcgatgccggctcatgtcttccccgcttctccacaatgccattcctgttctgtgattttaatgatgtttgcaattatgcttcacgcaatgacaaatcgtattggttatccaccggcgaagcacttccaatgatgccagtgaacgagcgcgaaattcagccatacatttcacggtgctcagtttgtgaaacgcctgcaaatgtgatcgctgtccattcccagtccatccaaattccaaattgtccaaacggttggagttctctgtggatcggctactcatttgccatgcacactggtgccggcgctgaaggcggtggacagtcattaagttcttcgggctcctgtcttgaggattttcgaacaacaccattcattgagtgcaatggcgcgaggggatcttgtcactttttcgccaacaaattcagcttctggctgactactgtggacgaaaaccaacaatttacgatacctcaaagtcaaacagtgaaggccggcgcacaacgatcaagaatttctcgttgccaagtgtgtatcagaaatgtgcgataa

SEQ ID NO: 1576 - DNA, 1190 bp, Heterodera glycines
  cDNA sequence=SeqID_1358; peptide sequence=SeqID_1776
gtcaaacttcgctgtcatgcccatcaaagtctcgtcctgaacatcttttctgtctcactccggagcatctttgcgatggcgtcacgcattgtgcaaacggagaagacgaagattctaagacctattgccgtgcgaaatgtgacgacaaaaaagaattctcgtgtcgcgtgtcggaaatttgtcttccgaaggaagtgttctgtgacggaataaaacattgtccttttggagacgacgaactgaactgcacggaatgtcgaggcgaagcaaagcgatgcggtgaccattgtctgccaaaacggaagttatgcgacggagaagtggactgtcaagtggacggagggagtgacgaaaaggactgcgattgtccttcttgttccggaatgaacagcgcgttgtgtgacggcgagcagaagttttgcgtggacaggcgacgattgtgtgacggacgagcggactgtccgggaggggaggacgaaaacgattgccatggcatttgtccatcattgcccaaaggagcgagcagaacggaggacaagaatacggatggaatggtcaaatgctccgatggagtcactcgcttatgggctgtcgcctgcggagggcttttccccgaatgcaacaaattctgtgatcggtgcaacccgcaaagcgcattccaatgtgtgggcagcacaaagacttccaatgacagcaacggcaatgaatgcattcatcgttcgctggtttgtgatgacaaaatggattgcctcgatggttctgacgagtcgaattgtgactgcgacgacgcgtttcagtgccaagaccacgggaaaggactgccgactggacgctgttattcagagtctcagaaatgtgacggatacacggattgcattggtggggaagacgagcgcgactgcgagacgtgcaaaaatgaagcatttctttgtcaaagtgagcgtcgttgcgtttcgagtatgggacgatgtgacggacacaaagattgtgaggacgcatcagatgagaaggaatgcacatgcgaagaatgcacgcgtttttcttcgcatccaatgtacatgtgtaaggaagcgcgacgttgttacccgctggacaaagtttgcaggcccagcagtttatgccctaaggtctccaaaatggacgaattatactgcgccgtgcggacccagcgtggcatcgaacttctctga

SEQ ID NO: 1577 - DNA, 1260 bp, Heterodera glycines
  cDNA sequence=SeqID_1359; peptide sequence=SeqID_1777
gagacattgaaggcgactctcgacttggacgaaatatttggcaacgaaaacgaaggtggaaaatcggccggcagcagcagttcgtcgacgagttcttcgcgttcctccagccccgacttgaccaagtcacgttctccttctcccgaagtcaaacaagagattaaaacaagggatgaaattatccgttgccaacttttccggcgaaagctcgcgaaatttgttcatgctccgttcttcgctaaaacagtggtcggttgtttcgttcgcatttcaatcggtcccaacaaatcggatgggaagcaagtgtacagagcggctcaggtagtcgaagttgtggagacagcaaaagtttacgaagtcgagccgaacagtgacatccgtacaaacaaaggctttcgcctcaaggtgagcgatggcgagccaatgcgagtctatcggttggagttcgtctccaacagtcttattatggaaagcgagtttctgttttggttcaacaaaatgcggtcttcgaacacgcccatgctaaccgtcgactttgttgaccggaaaaggaaggaaattgtgaacgcactcaactacaaatacaatgaggcggagatcaatttgctgatcaaagaaaagcagcgcttcaaaagacaaccgaccaatttcgcctttcaaaaatcggaattgctcagaatgaaggagcaagcagaacaaagcggcgatgtcgcgagggtgcgcgacttgcagcagcaagtcaacgaattggaagagaaggccaagaaaattgaacaccaaagaacgaagaacttaagtgccatcagtgccatcaaccagcggaatagggaccatatgaaacaaacattccttggtgccggaatagtgcgggaagagcaggagaaggacgacgacccattcacacggaagtcggcgcggatgaaagtggtctcgggatccgtgaagtccaaaaccgccggcgaaggaagtggcgccaatgccgagttatccgttatggacacgatggtttcttcgttgggttcgttgtcgtcttcgtcggagtcctctccaaacaaaaaagtgcaacttccctcaactcacgatttattcaacgcacatggaatcgacataaatattgacataaaaatgcccgccgtcgtcggcggttcgttgagagcgccgccaattaccgactcacaggcaccacgaacacaacagaagacgagcagctcgcggacactcacattggaagaatacaaaaagaagagaggacttgtgtga

SEQ ID NO: 1578 - DNA, 1497 bp, Heterodera glycines
  cDNA sequence=SeqID_1360; peptide sequence=SeqID_1778
gtgaaaacggcgtttgcggatgtggcggggtgtgaagaggcgaaaatcgaaatcatggaatttgtcaactttctgaagaaccccgcacaatacaaagcactgggcgcaaaaattcccaagggtgctcttctgactggccctccgggcactggtaaaactcttctcgccaaagcaactgctggcgaagcaaatgtgccatttatcactgtgtccggttccgagtttttggagatgttcgtcggtgttgggcctagccgagttcgggacatgtttgaaatggcgcggaaaaaggcaccatgcattctgttcattgacgaaattgacgctgttggacggaaacggggcggaaagggcgccatgggaggccactccgagcaggagaacacactgaatcaattgctggtcgaaatggacgggttttcaactgatgaatcgaacgttgtggtcatcgctgccacaaaccgcgtggacattctcgaccccgcgttgatgcgtccgggccgatttgatcgacaaatattcatccccgttcccgacatcaaaggccgtgcttccatcttccgcgttcatttgacaccaatcaaaacaaccttggacaaaatcgagctttcccgcaaacttgctgcgcacacgcccggattttccggcgcagacattgccaatgtttgcaatgaatcggcactaattgcggcccgagatgcacacgatgaggtgacttccaaggactttgagaatgccatcgagcgggtcatcgccgggatggagaagaaaagtcaggtcctgcagccggacgagaagaaaacggtggcgtaccacgaggcgggccatgccgtggccgggtggtttttggagtttgccgacccattgttaaaggtgtcaatcattccgcgtggaaagggcctcggctacgcgcaatatatgcccaaggatcaatacctttactcgaaggagcagctgctggacagaatgtgcatgactttgggtggcagagtgtcagaggaaattttcttcgggcgaattaccactggcgcccaagacgatttgcggaagatcacacagatcgcttactctcaggtggtcaaattcggaatgagcgagaaagtcggtccggtgtccttcgacactccggagcctggcgaaatggcattcgataagccctattcggaggctaccgctcagctgattgaccaggaggtgcgcgacatggtcagcgcggcactgcggcgaacgcgcgaacttttgatgtcgaaggtggaacagatcgaacgggttgctcttcgactgttggagaaggaaatcttggcaagggaggacatgatcgaattgttgggtccgaggccttttgccgagaagcacacttatgaggagttcgtggcaggcacaggatcaatggatgaggacacgacgctgccgaaaggacttgactcgtggaaccgcgaacgagagaaagaagagaaaaaggacggagagaaagagcaaaagaaagaagcagcctaa

SEQ ID NO: 1579 - DNA, 834 bp, Heterodera glycines
  cDNA sequence=SeqID_1361; peptide sequence=SeqID_1779
tccgtttatggcaaatcggatgaactgttgcagctgcgcattgagctgaacatgaccaccgaaaaagcgaccaaattcgtgtcagattcgcgtcaattggttgtccttccgcatccttttcaacactctgaaaagcgtaccattttggcatttgccggcaccaaagaagcgcaacaggaagtgatgctaaacggagcggacattgcaattgggccggaaatggtcaaaaagattctcaagggtcagttcaacatggacgactacgacttttgcattgcccacacggacatggccaagcacattctgccacttcgcggtgttatcaaaacgcgatttccgactaaaatcaacggaggaattggcgatgatctcaacgaaattttggaaagctttttgtccggaataaatttgaccgtaagaagggaccctaccaacaaggaatggggcctaagtgagcctttgatcggaagattgagcatgtccgatgagcaaattgaggagaacgtggcggtcattgttgacactctgtgcaaaatgcgcaaggccgtgcttggcccgttcatcaaccgcgcctctctgatcacagcctctgccggccctcaacagtcgtttttccctgtcgacgtgagcccttgggaagcgttgccgacggaagaggaaattgagaagcatgagaagacgaaaaagaaaaaggaccagaaaaagatgaagaagaagaaagagacggacgaattggaggaagaggaggacgaagaagaggaggcggaagaggacggacgaatattcccaaatttggacagaattgatcagaaaatactgatgaagcttatgtga

SEQ ID NO: 1580 - DNA, 1407 bp, Heterodera glycines
  cDNA sequence=SeqID_1362; peptide sequence=SeqID_1780
atgagttcagaatcggacgaacagagtgccgatgttaacggactctgttcgcaatcgcttcgatcagatgaaaaagtgtgtcccgacccggacacaattaaaatgtttattggccaaattccgaaggcgtgggacgagttacaactgaaggaatactttgaggagttcggtccgatttatcagctgagtgtgctgcgggacaaagagacggcctccagccgtggctgttgcttcgtcacttattatcaccggaaggatgcgatcagtgcccaaaatgagcttcacaatgtgcgcactttccccggactcagtcacccgattcaaatgaaaccggcggatgtcgaaaacaaaaacgagcgcaaacttttcattggaatgcttcccaagtcaatggacgaagagagcgtccgggcgctgttcaaagagtttgggcaggtggaggactgcagcattctgcgagaggacggcaaaagcaaaggctgtgcttttttgactttggtttctcgttcctgtgcccaacaagcgattcgaaaaatgcaccattcgcagattttcgagggctgttccaaaccgttggtcgtcaaattcgccgattcctgtcgagaaaaaaacgcaaaaaaagctccagatgtcaaaaatgaagagggtccgaagccgaacggtgggaaaccgaccagtaataatcagaattcgcaattgctcactgcctcaggcaccgaaacattggccaatttggtcactttacttcagcagccaaatgtcatttctctgcttgaggccgcacgtgtcatacaatcggcacagaatgtgacttcgtccgctgatttactactcaaaatggaccaaaatcgtcaacagaatcttttcaaaatgcccacgctgcttccaccgaatttgaatcagggcgcactgctcggcctgtcacagggattgctcctccaacagtccgcggtcggagcctcaccactcggtcactctgcgctgaatctctctgtgcccagtgcaattcattctgtgctgccaacgactccaccgaatttgccaattatttcgccttcttgctcaattgtttcaaggatgacgccggcaaatccttcatatcccatcgacaaatacaaccggggaccggacgggtgcaatttgttcatctaccatttgccacaagactttgccgacacagatttatattcactttttgctcattttggacaaattctctcggccaaagtgttcatcgacaaacaaaccaatttgagcaaatgctttggttttgttagtttttccgatgaatcttccgctcaaaatgcaatttctggaatgaatggtttccaaattggcgccaaacggctgaaagttcagctcaaaagatcggattcgaagccctacgaaaaaccaatagcgtattaa

SEQ ID NO: 1581 - DNA, 1240 bp, Heterodera glycines
  cDNA sequence=SeqID_1363; peptide sequence=SeqID_1781
ctccgaagttcaattagtgctccaacatctgccccaggagtatcagagattcgaggagaaactggaacgtgcccgtgccgaaatggcccaactccagcaaaatccacaacagccgccctatttgccacccgatgcgatgccccctccgcagcagataatgccaatgcccatccgacaggacttttacgtgagagccctcttcgacaacgacccctcccgcggggatgcggtgctgccgcaccgttccctcgcctttcggtacggcgacattttgcatgtgacgagtgtggcggacgacgactggtggactgcgcgaagggtcgccgaaaatggggacgaaggccccgagggaatcattccgtccaagaaaagggtggagaagcgcgagagacagcggcgcaaacaggtgaacttcaacgcgggcagtcaaagtttgggcagaaacgcgtcaatgagtgccggcggattcggcggcggcggcggattggacggccgacgcggttctcgcagccaactttccttttctcgcaaatttcccttcgttaaatcgactgagaaactgaacgaatatccctcggacggaggcgaaacaggcggcggcactatcgcagatgagccaattcattcatacgttacggtagaactgcgaacagttaattacgttcgcccggtcattgtgctcggggctttgaaggatcgcataaatgacgaattggtcagtcgacaccccgacagattcagcagctgtgtgccacatacttctcgcccaccgcgggaaggcgaagtgcacggacgcaattattatttcgttacgaaggccgaaatggagagggacgtgaagagcaaccttttcattgaagcgggccaattccaaaacaatttgtacgggacgagcgtagcggcggtgatggaagtggccgaatctggaaggcattgcattttggacgtttccggcaatgcgatacggcgactgcaaaacacagcccatatttatccagtttcggttttcgttaagccgcttaattaccaacaattacgagaatgggactctttgctcagtgaagaagatgccctgaagcaatttgaacggtgtcaacgccaagaacaaaacttcggggatttgttcaccggaatggtcaccggacattcgcccgacgatattttcgctcgcgtaattcacataataaacgaacagtcgcgacccgaagtttggattccgacgaatgaacagttgccttga

SEQ ID NO: 1582 - DNA, 1851 bp, Heterodera glycines
  cDNA sequence=SeqID_1364; peptide sequence=SeqID_1782
atgaaaaagagtgctaagcccgaaattcaaacagcacagacgcgaatcgcaattgtaaacccggacagatgcaagccgaaaaattgtgggcagccgtgcaaaaagaattgtcccgtcgtccgcactggcaaacaatgcattgtggttgagccaacatcgaaaattgctgaaatttccgagatattgtgcatcggatgcggcatttgtgttaagaaatgcccttacggggccatccaaatcatcaatttgcccagcaatttggagcgcgagaccacccaccggtacagtgccaattcattcaaattgcaccgcctgcccacgccgcggctcggctcggtgctcggcctggtgggcaccaacggaattggcaaatcgaccgcgctcaacattttgtccaaccgactgaagccgaacttgggcagcttcaagagtccgcccgattggccctcaattttgcaatattttcgcggctctgagctccaaaattacttcaccaaactgctggagaacaaattcaaggcgatcacgaagccgcaatacgtcgaccaaatcccgaaattcctcgaaaaacaaccgctgaaaaaggttggcgaattgttggagaaacgggcggagaaggacaacgttggccaaatcatcaaagacatggaactcacacatctgttggatcgcgaagtcggccaattgtcgggcggagaacttcagcggttcgcaattgccattgccgcggtgcaacaggctgacatttacatgttcgacgagccgtccagctatttggacgtcaagcagcgattgactgctgcacgagtgatccgagaattgctgaccgaccaaaactacgtgattgtcgtggagcatgacttggccgtgctggactatctgtccgacttcatttgcttactgtacggtgtgccgggtgcttacggtgtcgtcacattgcccagcggagtgcgcgagggcatcaaccaattcctggagggcttcatcccggccgagaacatgcgtttccgggacacggcgctgtccttcaaagtgtccgaggagaaggaggaggtcaagcgcagttcctactacgaataccccaaaatggagtacactgtcggaggggaaggagggaagcagcaatttcagctgaacgtttgccgtggtgacttcactgactccgaaattgttgtgctgttgggagagaacgggacgggcaaaacgacatttatacgccttttggctggccaactgaagccaacttcgtccgacacggaggtgcccgagctgtccatttcgtacaaaccgcagaaaattgcgccgaaatttgagggcaccgtccgccaattgctccaacagaaaatcccggcaatgttcattcacccgcaattcaaaacggacgtgctcaatccgttgaacattgacaaaatcatcgactttgaagtccaaaatctgtcgggtggtgaactgcaaagagtcgcgatcactctctgtcttggcaaagtggccgatgtttatctgatcgacgagcccagcgcgtacttggactccgagcagcgcttacatgccgccaaagtcatcaaacgcttcatcctgcacagcaaaaagagtggcttcattgttgagcacgattttatcatgtccacttatttggcggaccgcgtcatcgtttttgacggacaacccgccataaaagccactgcaaatgcccctcaaccgctggtgaacggaatgaaccgttttctgagccaactgaacatcactttccgaagggacaacgaaagtcatcggccgagaataaacaaattgaattcgcagctcgacgtggaccaaaagacgagtcaaaattacttttatttggacaattga

SEQ ID NO: 1583 - DNA, 598 bp, Heterodera glycines
  cDNA sequence=SeqID_1365; peptide sequence=SeqID_1783
gggatggtcacgttggtttggttggagttcgccgacgcctgagcaactcgtcaaccaaacggttcaagacgaacttcgagctttgctcgtcaataatccggagcataaacaatctttgctggacgacgatttgactgtgatccgacggaatttggagacacggaatttgccagggcccaacgaactttctgccgaaatgattcgtcagcaatggcggctcatttacagaaagcattttctcgaacgaatgctccaagctggtcacgattgccaaagtttttaccaaaattacaaattgggcgtacgctcggaagactcggacttggactgtcaagcggtggtgttcttctaccgaattaatcggatgctcgatctcagttgcaacgcgctcagacaacaaattgtgaacacggaacagcgacggttggaaaaggaagtgaaggaagtgctgaacgactggtcagcagacacggacaagaagaagcagtatttgaccgggagacaagtcgaattggccgaagaattggcccacgtgcgcttcatccaggagaagttggaggagttcattattcagcttcaccaggagaagccttggtag

SEQ ID NO: 1584 - DNA, 546 bp, Heterodera glycines
  cDNA sequence=SeqID_1366; peptide sequence=SeqID_1784
atgggcaatatgttcgctaatctgttcaaggggcttttcggcaaaaaggaaatgcgcattttgatggttgggctggacgctgccggaaagacgacaattctgtacaagcttaaactgggcgagattgtcaccactattccgacaattggtttcaacgtggagactgtcgagtacagaaacatttcatttaccgtctgggacgttggtggacaggacaaaattcgaccgttatggaggcactatttccaaaatacgcaaggactaattttcgtcgtggacagcaacgaccgcgagcgtgtgggcgaggcgcgtgaggaactgatgcgaatgctggcggaagacgaactgcgcgacgcggtgctgttggtatttgcgaacaaacaggatttaccaaatgctatgaacgccgcagaagtgacggacagactcggactgcacactcttcggaaccgcaactggtacatccaggccacctgtgccacgtcgggcgacggactctacgaaggattggactggctgagcaatcagctcaagaacagaggatga

SEQ ID NO: 1585 - DNA, 638 bp, Heterodera glycines
  cDNA sequence=SeqID_1367; peptide sequence=SeqID_1785
gcctcgtcctggccggaagtgctgattttaagaatgaactcgcccagtccgacatgtttgaccaacgattacaggcaaaaataatcaaaactgtcgacatatcatacggcggtgaaaacgggttcaaccaagcgatagatttggcagccgatgctttggcggatgttaaattcatcaaggagaagaaactgatcagcgcctttttcgacgagatttcccaagacactaacaaggcaatttacggggtaaaagaaacactgacagcattggaaatgggcgccatcgaaactctgatttgttgggagaatttggatctgataagatacgcattccgaacaaccaatggtgaaaaagtcgttaatctgaagcccgacgagaaggaccggtcgaactttgtggacccggagactggaactgactacgagattgagtccagcacgccattattggaatggctcgctaacaattacaaacgattcggtgcggcacttgaaattgtcaccgacaaatcgcaggaaggagcgcagtttgtacgcggttttggaggactcggaggtgtccttcgttattcggtggacattccgcagttggatgagctcgagaacggagtagacgagatcgacctcagcgagtactga

SEQ ID NO: 1586 - DNA, 924 bp, Heterodera glycines
  cDNA sequence=SeqID_1368; peptide sequence=SeqID_1786
atgtcggcagttaaaggacgacgtgagcaggacagaaaggaatgggcagcctattggaatattcgatggaaggaggtggagaattcattcgtcggcaaatactcttattacacaaaccgttttttggattggccggtcacttggttccgtgagaacattgtggaacggctgcacgacaagcacaagatgccgtattaccatcgcaaaatcagcagagtgcccgaaatcgacgaatgcggcgtcaacgaccgaatttgtctcttcgaagctgaagaacaattccgactggacaaattggtggaccattacattcgcgatattttgtaccaacgcttcactcagtgcgttcgcgccgaagggtacgaccatttgtacaaatgcgcaaagcacgttgacgactacgaaaatgccgagttgaacttctttatcaagtatggcgaattgggcagtgagcagactgtggtggcgtgttacatgaagcaaaagcatcggctgatttgggagcgtcgtcaccccgaaataatggaggagcgaaagcgagcgcatgaagaacacacagagaacatgaacaaggacaaattcaacatgcacttttggatcaaggacaacatttaccgaaagaagcaggattacccacccggcctcttcttcggccccaattgggacggtatcaaattgccgactgaaggagaccatcccatttcgagagattggcgttactaccaaaagttggaggaggagccggactttgacaaaccaaactacccgaagaaatggaacgaaatggccaaggcggccaaagaagccaaagatcagctgaaaatggcaaacaatggcaccaacgaaaacaacaaaaatggcggagcaaatggcaacggtgccgccaatggaaatgccaaaaatggaagtggggcgaccgaatga

SEQ ID NO: 1587 - DNA, 829 bp, Heterodera glycines
  cDNA sequence=SeqID_1369; peptide sequence=SeqID_1787
ggttcggaaactgcacgcggaattggattatgcaagacattttccgaaggcttatctggacaaagcgcaaaggcatgtccctatgaaagtgtacgacaatcgctttggcgctccgccggtcattcgttgggcaattcgacccgatgattgggcgatgagaacgaaacgtccgtgggagtacggagaagtgaaaaatgtgatcagacaggagaagatgtaccaaaggcaactgttttccacaaaattctaccgaaaaaattggaacaaaatgccgataattccggcagaaaattggacaattttccccggcgacactgtccaagtgatggtcggcaagcacaaaggccgcaaaagcaatgtatcccacgtgatcaaagaatcaaatgcggtttttgtggaaggattacacactaaactcgtggacaaattcaacaaggacagaatgaaagaaatgggaattggcgatgtgttcttcgaccagtgggaggagcagccactttttctgcacaaaggcgaagtgcaattggtggacccgagcgacggtgaaccgtgcatggccaaatgggtgctgaacgactcgaagacggaataccagcggatcagctcccgcaccggcttcctcatccctctgcccagtcgcgccttcaccacttacgattacgtagcgcctgaaacttatttggaagtgccgggaaaggacacatcagccgaagctgtgctaaaacggacctacatgccgaagttgagcacatttgagcaagaaattgaggaggaaatgaaattggagaagcgccccgagggcgacagaatgccgacctattggtactaa

SEQ ID NO: 1588 - DNA, 1062 bp, Heterodera glycines
  cDNA sequence=SeqID_1370; peptide sequence=SeqID_1788
atggaggcaatggaagttgacagcaaagcatctggaggtggcgaaccgatgaataacaataacaacgccaattcgtcgtcaaatccgcgcaccgttctcgatgagagtggtggaccgaaaaagatgagccatgaactaagccgagagttcatcaaagacattgacgaatggatagcgcagttgtacgagtgcaagcagctcagcgagacacaagtgcgactgctctgtgacaaggccagagagatactcaaaacagagtccaatgtgcaggaggttaagtgtccggtcacagtttgcggcgacgttcatggccagttccacgacctgatggagctgttcaaaatgggcggcaaatcaccggacaccaactatttgtttatgggcgactatgtggaccgaggctactactccgttgagacagtgtcgctgcttgtttgtttaaaggtacggtatcccgaacgtgtgaccatcttgcggggcaaccacgagtcgcgtcagatcacccaagtgtacggcttctatgacgagtgtttgcgcaaatatggcaattcgaaggtgtggaattatttcaccgatctgttcgactattttccgctgactgcgttggtggacggccaaattttctgtcttcacggcggtctgtcgccgtccatcgactcgttggaccacattcgatcattggaacgtctccaggaagtgccacatgaaggcccaatgtgcgatttgctgtggtccgacccggacgatcgtggcggttggggcatttcgccgcgtggtgccggttacacttttggccaagacatctccgagacgtttaaccatgccaacggcatttcgctgatctcgcgagcacatcagctcgtcatggaaggctacaattggtgccatgaccgcaacgtggtcaccgtgttctcggcgcccaattattgctaccggtgcggcaaccaggcggccatggtggagctggacgacgagctcaactactccttcctgcagtttgacccggccccgcgtcggggcgagccgcacgtgacacgccgtacgcccgactatttcctctag

SEQ ID NO: 1589 - DNA, 459 bp, Heterodera glycines
  cDNA sequence=SeqID_1371; peptide sequence=SeqID_1789
atggcctccggcgtgaaagtggacggcgagtgtaagcaggcatacgacgagctgcacaacaagcaccagttctcctttctgatcttccgtatttcggacgacgacacgacgatcattgtggagaagaaaggcgagaagaacgcgccgtactccgattttgttgaggagatgaagaaagtggtgggcgacggcaaacagtgccggtacgcggcggtggacgtgcacgtggaaattcagagacagggcaccgaagggtcgtccaacctgtccaaagtggtgttcgtccaatactgtcctgatgaagctccggtgcgtcgtcggatgctttacgcctcttccgtgcgggcactgaaggcgactttggggctggagagtctgctccaaatccaagcggccgaactgtcggacattgacgaaaaagtggtcaaacacgaagtgatgggtcgtcaacgaacctaa

SEQ ID NO: 1590 - DNA, 1797 bp, Heterodera glycines
  cDNA sequence=SeqID_1372; peptide sequence=SeqID_1790
atgcattttgtcaaaagaacgccattcgccaaaaaaagtgaagagcaaagagaagcagaggaaaagaaacgcgctgaaaagctgcaacaatttgttgattcaagaaatttggtctttcagaagagaaaatccggtgaatacgacgacgaagtgttgacggtttgcggagaacttctgaagaataacccggacatttacacactttggaatgtgcgacgggaggccattgaaaagcgagcgacgaaatgtgaggacgaaagtgacgaggaattggccaaacgaatctccgagctgatcaatggcgagttgaagttgacgcaaagttgtttgttgcgaaacccaaagtcatattcaacgtggcaccaccgctattggtcctgtcttcgccaccccacgccaccgttgcgacaagaattggcactttgcgaaaaggcgttgggccaagactgtcgcaattttcactgctgggaccacagacggtccattgcacggacggcccaactaagtgccgaggaggaactcagattttcggacactttggtgggccgtaacccgagcaattactcagcttggcattatcggggcactttgttgccactgatgaagccgaacaccgatcggcctgaggctgtgataagcgaccaatgtttggttgacgaaatgcagaaaattttgtcggtttgcggagtgaattccgaggaccaaactggatggacgtattgtcgctggttgacggatttggcttcggccaaaaattttgatcacaacaatgacaatctgattaccttcacacatttcgatgtggacatggctttgttggtgttttcggaggctgtcgacgcaacttcggttatgtccctaattggaacaacggcgcattcgttgcttgcgatctctccgttttccatggctcctcagtcgtccaaatggtgccgtgccaaagtttggcttgcctctggcggcatttccttttctccgtccgccggtgtttttcgtgccggcagtcctcgctttgtgaacgctgattttctgaccaagtacttttcgtcgtctccaagctgtactcggacattgccaagaaaagcactcacttcgttagtgtcaatgtgcgaggaattaattgcggaggagaacaatccgtgggaagtgtcggcactgacgagtgcccgtttagcacttgacggaattacgcaggaaaccttcaaattgacggaacaaaattgcgagaaattgaagcagttcgacccgcaacgttcggcaatgtatgacgaaatgtttgacaaagtccgaattatccacgaactgaccaaaaacacttccgacacacccgagcaaagccaattggatttgcttatggaggcgaaaagcgatcggcttaatctgaatggaattggactgatcagcctgctccatcttcggcctctgtccggcttagtccaggaactcaatctgcagaacaaccgggtcacttctgatcagatcactcaactctgctcatttgctgcgctcacttccctcactttggatggcaatcccatcgacagactccctctgatcaatccccgttggttccctcgcttggaattcctttctttggctcagaccaaaattggacaagcatcggtcttttgtccttcattgccctcgggcgctttccccgcgctgaagcgattggtcctttgtgagacaccgttggcggagagtgaaaaagaacggagggaaatgtacgcgttaacagagcagagagcgaaaggaacggaggacaaaatcagactgataatggactggacacgctga

SEQ ID NO: 1591 - DNA, 584 bp, Heterodera glycines
  cDNA sequence=SeqID_1373; peptide sequence=SeqID_1791
gtttgttgttgttggctgtcccattgttggtggtggacacaaagcaagaggtttccgaggcacaacagctgatccaaatttgtcgtgaatatttggtgggccttctgttggagacggcacggaaagaattgccacgcgactccgtggaggatgctaaacgcaacttggagatggccgcctatttcacccattgcgacattcagccggtgcacaagattttgacactgcgcaccgccgccaatctgagcttcaaaaacaaacaaatgcgccactgtgcttcgttctgtcgacgctgcattgaattggctcctaagccggaaattgccgcccaaatgcgcaaaatgttagcggtggcggaacgcgacaacaccaacgcgttcgagctcaactacgacgagcacaacccgttcgtgctgtgctcgcgctccttcgtgccgctgtaccggggcaagccgcagacaaagtgtcccttctgcggcgcttcgtatgcgcccacatttgccggctctgtttgcgacgtgtgcgaagtggcggaaattgggcgagagacgtcgtcgaatttgatgatttctaattttaaataa

SEQ ID NO: 1592 - DNA, 769 bp, Heterodera glycines
  cDNA sequence=SeqID_1374; peptide sequence=SeqID_1910
gctgtgcacgctgaacatggtgccgggcgagtcggtgtacggcgagaagcgcatctcctcccagcagaccgaaaatgcgccgattgctgcaataacgccgaagacggaagagacaacgaatggcagcaacggtgtctcagcacccaccgccgcggctgccggcccggcaccgccagtcgagtaccgggtgtggaacccgttccgctccaaactggccgccgccgtcatggccggcattgaggacacgcacatttacccgggtgcccgtgtgctttatcttggcgccgcttccggcacttccgtttcccatgtgtccgacatcgttggacccgaaggcatggtctatgcagttgagttttcacatcgcagtggacgtgacctgctcggcatggccaagaagcggtccaacgtggtgccaattgtggacgacgcacggcacccgcacaaatactccatgatgattggcattgtggacacaattttctcggacgtggcacagccggaccaggcacggattgtggcacacaatgcgcacaaatttctgaagaacaacggccatgtggtcatctccatcaaggcgaactgtgtggacagcacggcggagccggaggcggtgtttgccggcgaagtgaacaaattgcgcgaggagcagttcaaacccattgagcaggtaacactcgagccgtacgaacgtgaccacgcggtggtggtggccgagtaccgagccgccaaaaagaaggtcaagaaggaaaaaatggaggaggagtaa

SEQ ID NO: 1593 - DNA, 2177 bp, Heterodera glycines
  cDNA sequence=SeqID_1375; peptide sequence=SeqID_1911
gggagttggaagttggcatcgaacagcttgaacaaaagttacgcgcccttaactttgatccgcagttggaccaccagcttgagcaggagcgtgttcaattggccagagaaagagggcaatgtgcgcaagaattggaccggtttgaggccagaaatttcaaactgcgctttgactatacaatgccttacaacggattcgaccggaacaaagtgaagggcgtcgttgctaaactgtttaaaatgaacgaacaaagatatgccacggcattggaagtcgttgcgggtggtcggttgtttcacgttgtgatcgacaaagtgaagaccggcgaggatttgcttaaggcggggctgccccgtcgggtgacaatgcttccgctggacaaaatcagtgcaaatgttctcgaccagcggctaattgggcaggcaaaacgaatggtgggcgaggagaacgtgttcttccccggagagctgatcgaatacgaacgggaaattgagctggccattctcagcgtttttggcaattgcctgatttgcggggacatggaccaggccaagcagctgacattcgaccgggccataaactgtcgtacagtgacattgtccggtgaggatttcaagccgaccggtgtgctgactggcggattccggaagccggacgcgtcaattttgactgcgctcaacgaaatcagtggacaatatgaacggatccgagagcttgaccaccgaattggcgcaattgaaagggaactcgcaagactgaggcccctccgtcaacaatacgaccaattcaatggccaactcactgctcagcggaagcgactttacgcaatcaatgaacagttgcgcaacagtccgggggaagtgattcgggcagaaattgcgcaattggaaacggaagttggcgaagcgaatgcaacgattgaaacagcgaagccggaaattgaaaaactgacgaaaagagtcaaagagtttgaagaacggaagaccaatgaaagagcattccaagagagagaacggaagacggcccaacaagaattggcaaatgcgcagaaagagttggaacagttgaagggcacattttcgggcattaaagagtcattggcagggctaagagaagaaattaatgcattggaaaactcaattgggcaggacgaggaagaaatagtgcagatgaatgagaggattgaggaaatcagcactgaaatagccaaatctaacgcattcgtcatggaagccaaagaaaaggtcagaaaagcgcaacaaaagttagagacgtacaacaacgaagtgcgctcgcaggagaagcaaatccgtgtgaaaactgccgaaattgaggacttgaagaagcgcgttcgccatttggaagccaaaatcgagtcaaaaacacgggacagggaggaagcactgaaaaatgcgaaggatttcgagaaaagagcccaacagttggagaaggcgcacaattggatagccgaggaacggaaacacttcgccgtggagggcacggcgtacgattttcgcaattacagcttcgaaatgggcaagcgcgagtacgacgagcgcaagacgcgcagcaaagacttgctgagaacggtgaacccaaaggcgatggaatcattggcaacggcggagaaagagctaaacgaacttctcagcaaaagacagcagctcgaactggacaagaaaaagctgtttgatgccatcgagcagcttgacgacaagaaacgcactgaactgttggcagcgcataagcaaatctctgaagatttccgttccatttattccactctgttgcccggtgcgtctgccactcttgaacctccgtccggtgccgagaattgcctttccggtttggaagtgagggtggcgttcaacggcaagcacaaggactctttggccgaactgtccggcggacagcgttcactggtcgctctgtcgctgattctggccatgctcaagtacaaaccggccccgttctacattctggacgaaattgacgccgcgttggacatttcccacaccgaaaacattggcaagatgatcaagaagcatttctgtcagagtcagttcatcgttgtctctctgaaacagggcttcttcgacaacgcgaatgtggtgtaccgtgtcaactttcgcgatggtcgctctgtggtgacgcggacagaaaacaggcacaattaa

SEQ ID NO: 1594 - DNA, 1602 bp, Heterodera glycines
  cDNA sequence=SeqID_1376; peptide sequence=SeqID_1792
atggcttccatcgcatgtttgaacccaaaagcggagttggcccggcacgcggccgcactggagatgaacatcagcggtgctaaagggttgcaggaagtgatgaagaccaacctcgggccgaagggcacgctgaaaatgcttgtctccggttcgggtgaccttaaagtgactaaggacggcaatgttttactccatgaaatgcaaatccaacatccgactgcttcactgatcgccaaggcgtgcaccgcgcaaaacgacgtcaccggcgacgggaccacgtcgaccgttctgctgattggcgaactgctcaaacaggccgagaattacgtcagcgagggtgtccacccccatttggtcaccgagggtttccaattggcccatgaccatttgctccaactgttggccgtctccaaaaaggcgttgctcatcgaccggccgctgctcatcgaagtggccaggacgactttgcgcacaaaattggaccaaaagttggccgaccacgtcacggaatgtgttgtggacgccgttttggcaattcgtcgggatgaaaacgacacggagcccgacttgcacatgattgaaattcagcaaatggaacacgagatggagacggacacgcagctgatccgtggcctcgtgcttgaccacggcggccgacacccggacatgccgaagagtgtgcgaaacgtgcacattttgacatgcaatgtttcgttggagtttgagaaaactgaggtcaactcgggcctcttctacaagacggcagctgagcgtgaacgtttgctgcaggcggagcgcgaatacatcacacgacgagtgctgaaaattgtggagctgaaggggacggtctgtggcggcggagaccaaggctttgtggtgattaaccaaaagggcattgatccgccgtcgttggatttgttggcgcagcacggcattttggccctgcgacgtgccaagcgtcggaacatggaacggctgcagttggcctgcggcggcgaggcggtcaattcggtggacgacctgacgcccgatgtgctcggctgggcgggcagtgtttatgagcatgtgctgggcgaggacaaatacacttttgtggaggagtgcaaaagtcccaagtcggtcactttgctgctcaaagggccgaataggcacagcatcacgcagctgaaggacgccatttacgacggacagcgggcggttgccaatgcgttgaaggacggtgccgttttgcccggcgccggtgcatttgaaattgcgggatattgtgcactgaagaagcttgccgacaatgtgaaagggcgtgccaaactcggcgttttggcttttgctgaggctttgctggtcattccgaaaactttggcggtcaatgccggattcgacgcccaggaggccattgtcaagctggtggagacgttcagtgctgctgatgagctggtcggattggacttggagagcggagagccgtgtgttcctcagggcgtttgggacaatgtgtgcgtgaagcaggcgagtctgaacgcctgtcagaacatcgcctccaatctgctggaggtggacgaggtgatgcgtgccggcatgcgcgacttgaaggggggacagtga

SEQ ID NO: 1595 - DNA, 738 bp, Heterodera glycines
  cDNA sequence=SeqID_1377; peptide sequence=SeqID_1793
ggcaagttcaaggagccggtcgccgtattttactctgctgagatcgcctgcggattgttctacctgcattccaagggcatcatctacagggacttgaagctggacaacgtgatgttggagagggacggacacatcaaaatcaccgactttggcatgtgtaaggagggcattcagggcgacaccaccaccaaaacattctgtggcactccggattacatcgcaccggagataattctctatcaaccgtacggaaaatctgtcgattggtgggcttacggcgtccttctgttcgaaatgctcgctggacaaccgccgtttgacggggaggacgaggacgaattgttcacagcgatcaccgaacacaatgtctcttaccccaaatcgatgtcaaaggaatcggtgctgatttgtaaaggatttctgagcaaagcgccctccaaaaggttggggtgcagcgcggacggagaacggcaagtcaaagagcattgctttttccgtcggatcgattggcacaaaatcgaaactcgccaagtgcagccgccgttcaagcctaaaattcgatccgccgacgacacttccaatttcgactccgaattcactggcgaagcgcccaaattgacgccggtcgaccgattgttcctaatgaatttggaccagaacgaattcgaagggttcacttttgtcaacgcggaatttacgccccagggcgaaaataaaacggcggacaaaacaatttga

SEQ ID NO: 1596 - DNA, 2456 bp, Heterodera glycines
  cDNA sequence=SeqID_1378; peptide sequence=SeqID_1794
gaaatatgaaaatgaaggcggtcttcctgggcttgatgatcagacggctaatcgaagcggagaagggcgtttgcgaggcggacgatcgcgatttttacggaaacaaacgcattgagttggctggatctttgctttctctgttattcgaggaccttttcaaaaggttcaactccgaattgaaacgaattgccgacagtcacctcaaccgaaatatggccgctccgctggacatcgtacgacacatgcgccaagatttgataacaaatggtcttgtcaatgctcttgccactgggaattggacaattaggcgttttaaaatggaacggcatggcgtcacgcaagttttgtcacggttgtcttacatcagtgtgttgggaatgatgacgaggatcaattcgacgttcgaaaagacacgcaaagtgtcagggccacgttccctgcagtcttcgcaatggggaatgatttgtcccgccgatacgcccgagggcgaatcttgcggtttggtcaagaatttatcgttgctcagtcacataaccacggacagcgacgaagcgcccattttgcaacttctctacaatttcggtgtccaagacgttcgtccgttgaaatttagcgtcgttcatgaaagacgttatcacatcgttttcctcaatggttccattgtcggaattactgatgacgttgaaaaaatcattggcacggtgcgactgatgcgccgaagagggaatttgggtgcctttgtctcggtcagtttcaacacgtccacaaatgcgctgtatttggccagcgacgggggccgactctgtcgtccgtatgtcatcgttgaaaatggtcgtccatgtctcacgcagtcccaaattcaggaagtccgagacggtcagaaaacctttgaccatcttttggcggagggatgcatcgagtttttggacgtgaacgagttgaacagtacgcgcatcgctgtctatgagcaccaaattttgccgcagaccacccacttggagatcgaacccttttcgttgctcggcgtcgtctcgggactgatcccttacccacaccacaatcagagtccccgcaacacttaccaatgcgcaatgggcaaacaggcgatgggcaccatcggatacaatcagcagaagcgaattgattcgctgatgtatctgctcgtttaccctcaaaagcctttggtgaaaaccaaaacaattgaattgtcaaacttcgaaaagctccccgctggtcaaaatgcgattgtggcggtgatgtctttcagcggctacgacatcgaagacgcattggtactgaacaaagcgtcgttggaccggggttttggacgctgtttggtctaccgatttgccaagggcaccgcgcgaaagtacgccaatcaaacgtacgacaaaatcatgggaccgtcgctggacgcgacgacgcgcaagccgattgcgaaacatgccgttttggaccaggacggcattgtttttgttggggcgaagattatgccgagacatgtgctcatcaacaaatccatgcccataatgcaatccgaaatgcttcccgctggcaatgtcgccgggttcaaccacaattttgagacaaaggacgtgtcaattccctaccgcggctcaatgaatgccgtggcggagcgcgtgctattgacctgcaacgacgaggagcaatacttggccaaagtgttgatagcgcaatgccgaagacccgagttgggtgacaaattcagcagtcgacacggccagaaaggcgtttgcggactgatctcgccccaggaggacatgccatttgatcacaacggcactgtgcccgatttgatcatgaacccacacggttatccgagcagaatgacagtgggaaaactgatggaattgttgagtggcaaaaatgcgctgatgggcccgtgccaaaagtggcggttgcattacggcacagccttcggaggggaccaagtggaaactgtcagcaaacaattagccgcccacgggtacaacttccttggcaaggacatgctcacgtcgggcagcacgggacagcaaatggccgcctatgtctattttggcccaatttactaccagaaactgaagcacatggtcatggacaaaatgcacgcgcgagcgaaggggccccgcgctgttctgactcgacagcccaccgaagggagggccagggacggcggacttcgacttggtgaaatggaaagggactgtctgatagcgtatggcgcgtcgatgctgctgatggaacggctaatgatctcctccgatcaattcagtatggatgtttgtgccgagtgcggtttgatcggctacttgggatggtgccaaaattgcaagtcatccgccgccatggcaaagattaaaatcccttacgcgtgcaaattgctgtttcaagagttgcaagggatgaacattgtgccacggctaaagacagcaaaatacaccgacggactgtga

SEQ ID NO: 1597 - DNA, 2069 bp, Heterodera glycines
  cDNA sequence=SeqID_1379; peptide sequence=SeqID_1795
ggaaatggacaaatgtgacacttggccaagaagtgcaggttcagcccttttcgttcacacccggccaacggattatcacttcaatttcactgactgtcgattttcaaaagaaaccatcgaatccatccgaaccattggactcagatgcaatggcccgtgaatttctcatgcaattcgccaacatggtgttcaccgttacccaggaacttgtcttggagtatgtgcagcagaagcggagtaccggcggaggcgagaaagcgacggcgatgaacgcgacgacgtacacactgaaattggtggtgaaacggatggaaggcgccaatctgaactcgtcgccggaggagatttcgatcggtccgctcagtccgaatgccgtcgttatttttgatcggcccgaaaattcacagatcaatttgatcggtcgtagtaaaggaaagtccactcatcgttcgctgataaaccccgactgggacttccaacagatgggcattggcgggttggacaaggaattctcttccatttttcgacgcgccttcgcttctcgcgtttttccgcccgaattcatcgaacaattggcgatgaagcatgtccgtggcattcttctctacggacccccggggacgggcaaaacgctaatcgcgcgacagatcggcaaaatgctcaacgcacgcgaaccgaaaattgtcaatggccctgaaattctgaacaaatatgtcggcgaatcggaggcgaacatgcgcaaattgttctccgacgctgaggaggaatggcgccggtgcgggcccaactcgggactgcacataatcatttttgacgaaattgacgccatctgcaaacagagagggtccatggctggatcatcgactggagtccatgatacggtggtcaaccaactgctgaccaaaatggacggggtggagcagctgaacaacatcctcgtcattggaatgaccaatcggaaagacatgatcgacgaagcgttgctgagaccgggacggatggaagtgcaattggaaatatcattgccagatgagtacgggcgcgtccaaattctgaagatacacacggcacggatgagagaatataacaaattggacaccggcgtgaacgttgaggacatcgcaaagaggaccaagaacttctcgggtgccgagttggaagggttagtccgtgccgcccaatcgtccgcaatgaaccgattggttaaacccgggggcaaagtgcaggttgacgatgacgctattgacaaactgaaagtgacggcggaggactttgactatgcattggaaaacgacgtgaagccgtcctttggactcagtgacgaggaactgagtcggctgctgtacggcggactttgcctctggggtgacccggtcgcccgcgtgttggaggagggacgccttctgatcaaagagaccgcttctcccgacacgcgcggattcgtccgtgcattgttaacaggtcccccaaatactggcaagtcttatttggctgcacaaattgccaaggactcggaatttccattcatcaaagtttgtactcccgaagaaatggttgggtacagcgagacggcaaaatgtgccaaaattcggaaggttttcgaagacgcgtacaaatcgccccttagctgtgtgatcatcgacaacatcgagcgaatgatggattattccccgattgggccacgttattcgaactttgtgttgcaaacactccttgtactgctcggaaaacgaccacctcggaaccatcgtctgctcgtattggcaacaacgtcgaatgagcagtttttatccgaggccgacatgctcagcgtgttcagcaaagtgatccgagttgaacagttgcacagcgccaaacaagttctgacggtgctcgaggacgccaacgttttcagcgaggaggaaagtagacaaatagagggcgaactgcgaagctgcgaatacagcttttcaattgggatcaaacggatactcgaactgctggactttgtgaaacagagtgagcctgagtatcgagtgcagctgcttctggacggaatccgggacacgggcggggcgaaagacttttga

SEQ ID NO: 1598 - DNA, 1308 bp, Heterodera glycines
  cDNA sequence=SeqID_1380; peptide sequence=SeqID_1796
gaggcgtggcaaaataccttttttgggtctgacgatgaatcacttaatgcttcgcaatcgttcaaaaagtaccctcctctgctggccatccctctctattctctcctaccagtgaatttgcagaagaaaattttcaacgaaccgccagatgacgggtctagggtgtgtgtagtttctacaaatgttgcagaaacttcgttgacgattccaaatgtccgttacgtcatcgattctgggcgggaaaagaagagggaatatgacccgattacgggagtttctcggtttgtggtcggatggtgttcaaaggcgtctgcagaccaaagatccggtcgtgccggacgagttcagtccggatacgcattcagattgtattcttcggctgtttacgaagatatgcgcgatcattctactcctgagatccttaataaaccgatcgaccaattgattcttatgttgaaagcaatgaatttcacgaaaatcgacaattttcctttcccgactcctccaagattggaccaaatcaaatcttctgagctgagactttctcacataggggcgcttagagttcaagaagggctttataccatcacacaacttggacaatcacttgcgcagctgcctctcactccttcttttgcgaaggtcgtcatcagttcaattcgtggcggacttcttccttttgccgtcactttggtgtcggctctctccgttcgtgaaccattattgttcatttcaagcacaaaagaggacggaacggaagagagacgaaaaagaatgtccgaagtgattaagcaaagatttctttggtgtgctgttggcgaggctcgactctttggtgatttgacagtaattctgaacactgttggtgctgctgactatgaggaagagaacgctcacgcaatcgaagccctaggacttcgccctaaggccctaaaggaaatcaacaaacagagacatcagctgacgcttcttctgaacaaatccgattctgtggagaagttgcccgagaagttcagaatggatgcaccctcccaagaacaactgaggagattaaggcatataatggtgaaatgccatccggataaattggcaaagaaagttcagtcattggatgcaccaaagggcgcatataaaacacttattttggagggttacgtgttcattgaccaaagttcagtgcttcataaagaacagcccgattatgtcctgtaccaagaaatcgtacaaatggcacataaaaaatgtgtaagaaatgtcgcttctgttgaacccgagtggatttctgattttgttactttttcatcataa

SEQ ID NO: 1599 - DNA, 693 bp, Heterodera glycines
  cDNA sequence=SeqID_1381; peptide sequence=SeqID_1797
atgcaaatcttcgtcaaaactctcaccgggaagaccatcactcttgaagtcgaggcgagtgacaccatcgagaacgtgaaagcgaagatccaggacaaggagggcatcccgccggaccagcagcgcctcatcttcgctgggaaacaactcgaggacggacgcaccttggccgactacaacatccagaaggagtccactcttcacctcgtcctgcgccttcgtggagggatgcatatcttcgtcaagacgctcaccgggaagaccatcacccttgaagtcgaggcgagtgacaccatcgagaacgtgaaagcgaagatccaggacaaggagggcatcccgccggaccagcagcgcctcatcttcgctgggaaacaactcgaggacggacgcaccttggccgactacaacatccagaaggagtccactcttcacctcgtcctgcgccttcgtggagggatgcagatcttcgtcaagacgctcaccgggaagaccatcacccttgaagtcgaggcgagtgacaccatcgagaacgtgaaagcgaagatccaggacaaggagggcatcccgccggaccagcagcgcctcatcttcgctgggaaacaactcgaggacggacgcactctggccgactacaacatccagaaggaatcaactcttcatctcgtcttgcgccttcgtggtggaaagaactag

SEQ ID NO: 1600 - DNA, 738 bp, Heterodera glycines
  cDNA sequence=SeqID_1382; peptide sequence=SeqID_1896
gaagcgttgaagggcaccgacgccgagacgtacaaagcggcagagaaacattttgaggtcgcacttcgaaaggccccacaaaacggcgccgtcggcttcaaacaggaagtgaacaaatgggtcgtgctggtcaaattgctcatcggcgaaatccccgagcgcagtctcttccacacggccgaacttcgccacgtgttggcgccgtatttgctgctgacccaaactgtacgccttggcgacgtggccggcttcgaccagacgaagcgcgagcacgggcccatctttgtgaaggaccgcaccgctgcgcttgtcgagcgcatccatcagagcgtcattcggaccgcaattcgcaaaatttcgacgacatattcgcgcatttacgtgtccgacgtggccaccaaattgaattcgaccgagcaggaggcgcatcgcgagttggtcaaggcgatcaaagagggcattgttcgtgctcagttggtcgccggcgacccgttggcgggcgggcggcactacgtcaaatttgggaccaccgatgaccaatatcgcggggttgagccccgcagggaattcgacgcgcgggtcaacgaactgttggagctgtaccaccaggcggtgaaggcactgcggtacccggacatgcgcaacccggaggtggagaccattgacgagcagcgcaggcgtgaacagttggctctcgaaatggcagcagcggaagaggaggatgatgacgatttttga

SEQ ID NO: 1601 - DNA, 1632 bp, Heterodera glycines
  cDNA sequence=SeqID_1383; peptide sequence=SeqID_1798
atgcattttgctgacctgtccctaagtgaacgggaaaaagcgctgagtgttcgctatttgcaggagcgtgatgcgatgtttgagcgtttttcggagtggacggagcaggaccagacggacttctgcaaacaccttctgcagcgcatgtgtcaccaccaacacggccaaattgaccaatttttgggcccaatgcttcagcgggacttcattgcgttgttaccaaccggtttggcggagaatgtgcttcatttgttggacgccaagtcgttgtgcgcctcggagtttgtcagccgccggtggagtcgtgtcattgtcaacggattgctgtggcgcaagcacatcgagcgccaagtgcgcaacgacgcgctgtgggccggcctcgccatccgacggggatggaagaagtacttcttttgctccaaggaccaggcgacacgcgcaatttctcagtcgtggagacagccgaagaacggggaggacgcgttggagttccagcacaaattctaccgcgaactttacccaaaaatcactgctgacattcggcaaattgagcagaattggcgcgagggacgacatcgattggagcgcatcaattgccaatcggagaatagcaaaggtgtctactgtctccaatacgacgacgaaaagatcatctcgggactgcgcgacaacacaatcaaaatttggtcccggcccagcctcggctgtgtgcaaacactgagcgggcacaccggctccgtgctgtgcctgcagtacgacaaccagatgatcgccagtggcagcagtgacgcgacagtcagaatatgggacgtgaacacgggtgagcaactgaagacgctggtccaccattgtgaagctgttctccacctgagatttcaggacggcatgctggtcacatgctccaaggaccggtccatcgcggtttgggacatggcatcgcctcgtgacattgaagtgcgtcgggtgctcgttggccaccgggcggcggtcaacgtggtggactttgatcacaaatacattgtgtcggccagcggtgatcggacaataaaggtatggaatgccagcacgtgcgagttcgtgcgcacactgaacggccacaagcgtggcattgcctgtctgcagtaccgggaccgactcatcgtgtcaggctccagcgactattcaatcagactttgggacatcgaatgcggcaactgcttgcgcgtgttggaaggccacgaggagttggtgcggtgcattcgcttcgattccaaacgcattgtgtccggcgcttacgacggcaaaattatgatctgggacctggcggcggcacttgacccgatgacaccgcccaactccatctgtataaagacactttcgcaacacaccggacgcgtttttcggcttcaatttgacgagttccaaatcatcagcagctcccatgacgacaccattctcatctgggacttcctcaacacgggcccgtccgccgccgttgccgcgggcgctgcggcagcagccgcgcacaaccaggccgttcaacatcaccaagcagcacccgcagcccaaccggctgctgcagcgatgcccgggggcgctggtgccgcgccggccgccgctatcattccgttggcaccgccgccgtccccataa

SEQ ID NO: 1602 - DNA, 1074 bp, Heterodera glycines
  cDNA sequence=SeqID_1384; peptide sequence=SeqID_1799
gctgactgcgctgtgctggtggttgcttgtggaacgggagagtttgaagctggaatttcgaaaaacggccaaacgcgtgagcacgctttgcttgcgcagactttgggggtcaagcagctcatcgtcgcttgcaacaagatggacaccactgaaccgccattcgccgaggcccgttacacggaagtgatgactgaagtgtccaacttcatcaagaagatcggttacaacccagccactgttccattcgtcccaatctctggcttcaatggcgacaacatgttggagccgtctgacaggatgccgtggtttaaggggtgggcgatcgagcgcaaagatggcaatgcatctggcaaaactctgctcgaggctcttgactccattcttccgccgcaaagaccaactgacaagccattgcgtttgcctctccaggatgtgtataagattggaggtattgggacagtgccggttggccgtgtcgagactggtgttctcaagcctggaatggtggtcacttttgctccgcaaggcatttccactgaagtcaaatcagtggaaatgcaccacgagtccttgccagaagcgcttccaggagacaatgtgggcttcaacgtgaaaaacatctctgtgaaggacattcgccgtggttcggtcgcgtccgactcgaagaacgacccggcaaaggagaccaagagcttcacagctcaagtcatcatcatgaaccacccgggtcagatcgctgctggttatactcccgtgttggactgtcacaccgcgcacatcgcgtgcaaattcgccgaactcaaggagaaggttgaccgtcggtctggaaagaaagtggaggacaacccgaaggcgctgaaaaccggcgatgctgggatcgtcgatttgattccaaccaagccgatgtgtgtggaggcattcacggactacgctccgcttggtcgtttcgccgttcgtgacatgaggcaaaccgtcgctgtcggtgtgatcaaggcggtggagaagactgaaggcggtggaaaggttaccaagtcggcgcagaaggctgctgcccctggtgggaagaagaaatga

SEQ ID NO: 1603 - DNA, 2292 bp, Heterodera glycines
  cDNA sequence=SeqID_1385; peptide sequence=SeqID_1800
atgagtggcaaacaaatagtcgggttgatcattccaccgcccgacattcgaacaattgtggacaaaacggcgcttttcgtggctcgcaacggattggaatttgagatgaaaatcaaagagcgcgaggcttccaacatgcgtttcaactttctcaaccctaccgacccatattttgcctactatcgcaacaaggtcaatgaatttgagacgggcgttgcatcggcggacactcagtccaaagtgaagttgccggaggctgtccgtgagcatgtgcagcgggccgaatttattccgcggctgccgcccaaaccgttcgaattctgtgccgatcctttgacgctaaacgcattcgatttggatctcatccatttgaccgctttgtttgtggcgcggaacggccgtcaatttctcactcagctgatgaaccgtgaggtgcgaaacttccagtttgatttcttaaagcctcaacactccaacttccaatacttcaccaagctggtcgagcagtatacgaaggtgctgatcccgccaaaaacgattgtggatgatttacgtgcttcggtcactcaacacaaaatcttggaggacgtgcgttaccgcgtcggttgggaccgccaccaaaaagcgctgaaggaccgcgaggaccaagcggtggagaaggagcgcattgcgtacaatcaaatcgactggcacgaatttgtcgttgtccaaacggtggactttcagcccagcgaaacactaaatttgccgcccctgtgcacgccaaaggatgtcggggcacgaattctgttgcaacaacgtacggaagcggccaaagcggcggctgagagtgtggcgatggatgtcgagtcggacgaggagggcggcgccgagtcgggtgacgaggaaacggccaaagaacgagccgcaatcgaagcggcggaggatgcggctggcgaactgcaccaacgcttgaacatcggggcggagaagcaacacaccggctcaacgctgacgcaaccggcacccgcggcgccgaccgccggcagcgtaatcatccgcgactacgaccctaaaaaatcgcgtggtggtccggtgtccaaaactgcggctgcctccacggagaagtacataatttcgccgctgacaaacgaacgcattcctgcagacaaactgcacgagcatgtgcgttacaacaccgttgacccacagttcaaagagcaacgagaccgtgaacaaatggatcgccaggacgaagacttagtgatggcgcccggggcagaaattagtcgaaatattgccaaattggccgaacgtcgaacagacattttcggtattggtgaaaagggagccgaacaaacaatcatcggcaaaaagttgggggaggaggaacggcaaatgccgcgttcggacccgaagaccatttgggacggacaattgtcgacgattgatgctaccactcgcgcagcgcaacagagtgtttcgttagagcagcaaatcagcgaaatccagcgacagcatgggtatttgccgaacccagccgcagaacgaatggtgccgtcgatgccgcccccgacttcgacaccttcacaacaattcggcggtggacaaccgctgacttcacattcaatggctccacctcagcgccctccgcctcatcagtccaccggtggcattgcgtccaatgtgcagaaaattgtgccggttccccaacagccgccgcaaatgtctattccaccacagcaccagcaacaacaacaaatgcgtcctccgcagcaaatgccaccgcaatttatgcagccgccgggcggtcgcccgcatatgccacctccgcctcatatgggcatgccaccgcacggcgttatgggcgcaatgccaccgcacatgcaaccgggaatgcctcctcctggcatgatgcgtccaccgcatggctctttcatgcttcctcctccgccccccggcgcctctgttggcgatgagccgccaaacaaacgcccgcgcgaagaaacgctggaaccggaagaacgttggcttcaaaaggtccacggtcaaatcgctgtgcaaatcgctacgccgcaaaatgatgaatggaacctgaaggggaacacagtacaaattcagttggacatcagttcatcggtcactgcgttaaaatcgttaatccaagagcagatcggagttcctgcaaccaaacaaaaattagtctacgagggcattttcatgaaggacagtcagagtttggcctactacaattttatgccgaatgcttcagtgcaacttcagttgaaagaacgcggaggacgaaaaaaatga

SEQ ID NO: 1604 - DNA, 876 bp, Heterodera glycines
  cDNA sequence=SeqID_1386; peptide sequence=SeqID_1801
atgagtgcttatcaaacaattgaaaagggttctcttcatacccttaactatcgcgtattttttaaaaattcggatggaaaattgatttctccttggcatgacattcctctctatgcgtccgagtcaaacaaattgttcaacatggttgtcgagattccgcggtggactaacgctaaaatggagattgccactaaggaagtgatgtctccaattcgtcaagacgagaaaaagggtcttccccgcttcgtcaacaatattttcccgcaccgcggatacatttggaattacggagcgcttcctcaaacgtgggaagacccaggacataaggacgagaacactggcgaaaacggagacaatgatccaattgatgtgattgagattggaagcaaagtgcagaagaggggcgccgtcattcgggtcaaagttttgggagttttggcacttttggacgaaggcgaaacggattggaagttggtagcaatcgacgaaaatgatgagttggctccgaagttgaacggaattgaggatattgaaaagcatttgcctggactgctaagtgccactcacgaatggttccgcatttacaaaattccaacgggaaaacccgctaacaaattcgccttcaatggccaattcaaagaccggaacttcgcccacaaaataatcgaacaaacgcatcaattttggaaaaagcttgtcacttccgctagtccgcatccattgaacactgagtgtcacaaggaaggggctgttttcaaagcgaatctttcggattgggaaagctttatatcgaaacagccagagtttggtcatgcccagcaggtgccggaacatgtcgacaaatggcactttattagtagcgaacagaatcaatga

SEQ ID NO: 1605 - DNA, 786 bp, Heterodera glycines
  cDNA sequence=SeqID_1387; peptide sequence=SeqID_1802
gacgaccgactcgacctcgacagaccgaccaattggagggtcttcaacattttggccgtcttccacaatctttcgtttgaggaggcgaacacggcccttatgggcgaaagtcacgcgcttgtcaggtttttgctgctttgctccaaatgtcggtggcatttgctgcgtaaaattgcctatgatacactgagtaacatcgcaagaaatataaaattggtcgacaaattgtccaccgttttgctgaacaccgtccaaaagggtctccactcggacgacaaatgcaaagtgatgcgatccatggaaattgtggccggtttatgcgcaacgccaaccaacgagtcaattgtttgtgaattcttcgaagaatcgcaaatcataccgcggattttcgctcttttgtcactcaaggatattttgatgtgtatgtgtgccatggagtccgtgttggccatttccgagttgggacgggtcgcgtgcgaagccgtcgcccgctgtgaccgcgccgttgaaatgcttgtcggctttttgaccaccgatgccttttcttttggcaccgtcggtttggcggggatgcacgtggttgaggtgcacggacaccaaaccagaccttatgttgcgccaaacaaaaagaatcctcccccgccgcttaaacttcaacccgtacaaccgcccgttcaatatgcgcaacagcggcaccaaacgtcggcgagcagtacaacaacaacggcaccaccatttggtgaagcgatggaattttgcaataaatgctcgtacagatactcttga

SEQ ID NO: 1606 - DNA, 1422 bp, Heterodera glycines
  cDNA sequence=SeqID_1388; peptide sequence=SeqID_1803
atgggtgacttcgtgccaaaatttgagcgtaatttggacaacaaacctttgggcccgcgaccattgcccacggcaggcgcaattccagtaaaagatgagaaaggcagaattgtgatgaaaaaggtcaaagtgcagcgctacatggccggcaaaatcccagaatttgctcaagacttcgattctgatgaggacgcacaacaagcggaagaagaagtggagacggacctcagacagcacagagaagagaaaagagaacgcgaacgacgtgagaaggacgaacacagacacaacagaaaggatgggaaaaggcatcgcgaaagacgtgaccagcagctggacgagttcaaaaaggagctgaaggaggaagaggcattggcacttggggaggtggaggaggaagacgaacaaacgcgggaggagcggcaccaacgggcgatgttaaggcacagacggacggagcgggaggaagcgccgttggaacaggaggacttggaggaggaggctgacgaggatgaacggcagcggaggagggaattgctgaagcgaattcgccaaagacaagaggaagaggaactgctcgccaaacagcccgacgctggcgaagtcagcgaagagagcgaagaagagagttcggatgaggaagaggaggacagcgaggaggaaatgatgccacggctaaagccggtctttgtgccaagaaatgaccgtgtcactctcattgagctggagaaagagcaggcaaaattggaacagctgaaaatggaggaggaaaagcgcaaggaggagaagaagcgactgtcagcacggcttgtggaagagcaactgaagagagaagcggaccaggaaaaggcacggcgcgaggagggcgcccaattggatttgacggcggttaacacggacgacgagagcgacgaggtggcctatgaaatgtggaaagtgcgcgagatgaagcgcctcaagcgcaacagggaggagagagaagctttggcgcgtgaaaaggaggagatggagcgcattcacaatatgacggaggaggaaaggcgcaattacttacgaatgaacccaaaaatcatcaccaaccaacagaacaagggcaaatacaaattcctgcagaagtattaccatcgtggtgcctattttctggacaaagaggacgatgtgctgaggcgtaactttgccgaggcaacgggcgaagacgtttttgacaagtcggtgttgccgaaagtgatgcaggtgaaaaatttcggcaaagcgagtcgctccaaatggacccatttgacggcggaggacacaacggaccaccagggagtgtgggcaacgccgaccccactgagtgctaaatttgtggcaaaacacgcggcggggatgaaaaatgtattcgaaaagccatcagcaaaaaaacgaaagattggtggggattga

SEQ ID NO: 1607 - DNA, 2121 bp, Heterodera glycines
  cDNA sequence=SeqID_1389; peptide sequence=SeqID_1804
gcaacatggaaactaggcattttcatcaccgatatgaacatatcgcgagagttattcgttcgcggtgacatgaccatcggtagtctgatgatgcagttggtggggcaaattggcgagactcaggactggagtgaccattacatgtggtggcctgaccgccgtaagtggctgaaacacacgcgaagcacgttggaccaaattggaatcactgcagcgacttacttggaatttacaccgatgcataagcatgccaaggtccaactccccgatttgcagattatcgatgcccgactcgatttttccgtgcccattttgaaggtcacccaaaaaatctgccaagaacttgccatccgtcacccggaagaactgtcgctgaagcgtgatattccgccagatattttgcgaaaaggcgcatctgtcgaatcggaggctcagattcagccatacatgaagccgggcgaggagtccattggacccggcactctccgaacggccaaacccatccgcgcttcaactgtcaacctcactagcgggcgaggctcacctgcactttcgcaggcatctgcaatgggccccggtcacttgtttaacgcttctgaaattggcacactgccgaagatgggaacgattccgcgcggaatgagccccggtccagccgcatatcgcgaagtgcttggacgaacaccggagcccggttactctgaaggaggcggtctcgaatgtgaccagttcgacgaaaatttgataaactcaccgaaaataactccgggtcgtgaaacattcagaccccaaaattatttggagaaagccgcgttgaaccggggatggttggactcatcgaggtcgctgatggaacaaggcatttgcgaaggcgatgttgtgcttcttcgttttaaattcatgcagtttttcgacatgaatctgagatatgaccccgtccgtatcaatcaattgtatgaacaggccaaatggtccgtccttttggaggaggtcgaacacacggaggaggagtcatcattatttgcagcgctgcagttgcaagccgcgcttcagcgaaactctccggaccgcgaatctccggaacgtgacgaggtcgatgtactgcttgatgagttggaacagactttggacaccactgcctcactaagtcgccgtgatttaacatacgtgcctgagttgacagaatatctcaaatatttgaaacctaaaaaattgggttttaacaacttcaagagagcttactttacatttcgagacctttacttgagttattacaacacagctcaagatgcaaatgggcctccacttggtcactattatctcaaaggttgcgaggtcagccaggatttgagcgtctcgcaaggaaagttcaacataaaattgcaagtgccgagcagtgaagggatgtcggaactgatattgaagtgtgacacggagcaacagtttgccaaatggatggccgcttgtcgtttggcatctcgtggaaagacaatggccgattcttcgtacaattcggaggttgaatccattaagaaagtgctgcagatgcaagcaggaagggcagcggcagcgcaaaacggtgcacaaaacaagaagaaatcgcaaccggtgcagctgcccacggatttcaattcggaagagttcgtttgtcagcgatattggaagagatcggggaacaaaagcatgcaacagcgcatttcggatgcccattcaaacgtgaaaacattgagttgcaccgaagcgaagcttcagtacattcgcaattgggaggctctgcccgagcacggccttcactatttcatcgtcaaattcagaaatgggaagaaagctgaactcattgcggtggctcacaataggatgatgaaagtgaacagcgacaacggagaatcatcaaagacatggagattctctgggatgaaaaaatggcacgtgaactgggagataaggcacttaaagatacaattcgacaacgaggatgtcgaattcaaacctctgtcagcggactgcaaggttgttcatgagttcataggcggctacatttttctctcaatgcggagtaaagaccaaaaccaaacactggacgaggaagggttccatcgcctgactggaggatggggatag

SEQ ID NO: 1608 - DNA, 822 bp, Heterodera glycines
  cDNA sequence=SeqID_1390; peptide sequence=SeqID_1805
atggctcctgcaccagaaaaggaaaaaactgaagataagaaactgaaagacgggcaaaaaccaaatgtgaccacggatcacgcacactgtttgagcaatgtccaaccaaatcttcccgtcaataaagtggtggtgcatccgctcgttctgcttagtgtggtcgaccacttcaaccgcgtgaacaaaacgcacaaagtcaatcgagtggtcggtgttttgcttggttgtatgaagcacgacaaaacccttgacatcgcaaattgttttgctgtgccttatgacgaggactccgagaattcgaacattttctttcttgatgctgattttctggaggacatgtttgggatgttttacaaagtcgcggcacgtgaaagaattgtcggatggtatcactctgggccgcgtctttgcaagaatgacattctgatcaacgaagtcatcaaacgctttaccccgaaccccgtgctggtcataatccaagcttctcaaggccgacaggatttggcactgccgacggatgcttatgtggaagtccaggaagtgcacaatgatggttctcccccggtgaaaacctttgaacacgttcccagtgaaatcggagcagaagaagcggaagaggtcggagtggagcacttgctcagagacatcaaaaatcaaacagccggcaccctctcgcaacgaattgctaatcagttgacgggaattcgtggtctcgagaaccatttggctggttttacgagctatttgcatcgtgttgcgagtcgagaattgcccatcaaccacgctatcatatttctaatacaagtcgctgggaaattttga

SEQ ID NO: 1609 - DNA, 789 bp, Heterodera glycines
  cDNA sequence=SeqID_1391; peptide sequence=SeqID_1806
atgagcaatcttcgtctgcaaaagcgcttggctgcttcggtgttgaaatgtggtaaaggaaagatttggctcgacccaaatgaagtcaacgagatttcgaatgctaattctcgtcaaaatgttcgacgtcttgtcaaagacggtctcattatccgcaagccggggaaagtccattcacgttatcgcgctcgtgaacgtttggaagcacgcagaaagggccgtcacatggggttcggcaagcgtcatggtactcgcaatgcgcgtatgccagagaaagtgatttggatgcgtcgaatgcgtgtgcttcgtcatttattgaagcgttatcgtgatgctaaaaaaatcgacaaacacctttaccatgagctctacctcaaagcaaaaggaaatgcgttcaagaacaagcgcaacctcatggaatacatctttaagaaaaaaaccgaaaaccaacgttctaaacagcttgcagaacaggccgaggcacgtcgcaacaagaacaaggaaacccgcaaacgtcgcgaggagcgtttggttcagaagcgaaaggaacttttgcacaaaatttcggagagcgagaaagagaagacgcctcagcccctagtgacaaagccagccgagaaagagcaaccgaagccacaacctgtcgctgcacggaccgctgataaggaacagcccaagacacaacctgccgcggtaaaaactgcagagaaggagcagccgaagtcaaaaacggaaactgtgggcaaaagggaaactgttggtcccaagaaaaagaaaggaggcaagtaa

SEQ ID NO: 1610 - DNA, 1273 bp, Heterodera glycines
  cDNA sequence=SeqID_1392; peptide sequence=SeqID_1807
gtttgaggcaaatttcgaaccaatttttatttccgatggaatggtcggacaatgtgcggcacggaaggcagccggattgattgttcgcatgattaaagatggacaaattgcgggcagagctttgctaattgttggcgagccggggacgggcaaaacggcggtggccatgggaatttcgaagtcaattggcggcgatacgcccttcatttccatttcggccagtgaagtgttttccatggatctgagtaaacccgaagcattgactcagtcattccgaaaggcaattggagttcgaatcaaagaggagactgaggtcctttgcggtgaggtcgtacaactcgaaattgaccgtccccagtcgggtgccgggccacgagttgggaaattgactctgaaaacaacggacatggaagcaatttacgacattggaaacaaaatgactgaatccgtcatcaaagagcgaatcacggccggcgacgtcatccaaattgacaaggcaaccggtaagatttcgaaaattgggcggtcgcttgcccggtcaaaggatttcgacgcacttgggccccaggacaaattggtcgcctgtccgtcgggggaaattcagtcccgcgtggaaacggttaacacaatttcattgcacgacattgatgtgatcaattcgcgttcctccgggtatttggcggttttttcgggcgatacgggcgaaattaaaagcgaagtgagggagcaaattgacaaaaaggtgatggaatggcgggaggaaaacaaagcgcaaataatcccgggtgttctgttcgtcgacgaagtgcacatgttcgacctcgagtgcttctccttcatcaaccgttacatcgaatcggacctttcgcccattttggtgatggccaccaaccgcggcattgtgaacattcgtggcacttccgttgagtctccccacggtgtgcctttggacttattggaccgcagccttatcatcaggacgtcgagttacaaagaaaatgaaattggagagatactgaaaatccgtgcttctgatgaactcgttgaaatggaggatgccagcatcgcagtgctcgtccaaatagcattggaaacatcgatgcgttactgcatgcaactcatttcaactgccgacattttacgacaaagaagaaaaggcgaaaaggtcactgaagaagatgtgagaaaggcgagaagtcttttcatcgatgtgaagcggtgcagaaaagagatggaaaagcacggggacagtttcatcaacgatctcaactga

SEQ ID NO: 1611 - DNA, 490 bp, Heterodera glycines
  cDNA sequence=SeqID_1393; peptide sequence=SeqID_1808
gccttttcttcggatgacttatgcggaggcaattgaatggcttcaaaagaatgaagtgatgaacgaagaggggaaacccttccaattcggcgaggatatttccgaaggccctgagcgatttatgaccgacacaattggacaaccaattcttctcaatcgctttccgcatggaattaaggctttttatatgtcacgttgtgcagatcaaccggaattgaccgaatctgtggatttgctaatgccgggcgttggcgagatagtcggaggatcgatgaggatttggaaggaggacgaactgcttggggccttccaaaaagccgacatcgatcccaagccatactactggtacgtggaccagcggaaatacggaggttgcccccacggaggttttggacttggtctggagcggttcgtatgctggttggccaatcagcatcatatccgtgatgtgtgtctcttccctcggtacatcgggcggtgtgcgccgtag

SEQ ID NO: 1612 - DNA, 1668 bp, Heterodera glycines
  cDNA sequence=SeqID_1394; peptide sequence=SeqID_1809
atgagaatcaagaaaaagtttgcgagtggcactgcccgggtattcgtctcgcggaagaaggcgctgaagaagttgcagttgaatttgagggatttccgtcggctgtgcattttgaagggcatttacccgcgcgagccgagcagtgcgaagagggcgaacaaagggggcagcagcgagcacaaaatcttctaccacctcaaggacatcaactttttggcccaggaaccgttactcgaaaagttcagggagtacaaagcctttctgaagaaagtcacccgggcacgagccaagcgtgagcatttgaagttggagggactgctccgtgccaagcccaccttcagctatgaccatttggtgcgcgaaaggtatccgacttttgcgtccgctttgcgcgacttggacgacgcgctgtgcctttgttttgccttctccgcactgacacagtcaaaaattgcgcggccgcgaacaattggccaatgccggcgggcggtcaccgaattcatgcattttgtgattgaggcgaaggctttgcgaaaggtgttcatctccatcaagggagtgtattaccaagcggagattttgggcgaacgcgtcacttgggtggttggccacgaaagggccgtcggacgcgccaacgaattggacttttcggtgatggccaactttgtcgacttttacctctgcatgctttgcttcgtcaatttccgactttacaaaacgctcggccttttccatccgccgcaattgcgccgccagcaaatgccatcggaaaacgacttttcgtttgaccattcaaatgagcttgacgagcgcgtctattcgctggcgtttccgctcaaacgcaccgacaaaatggacgccgacagttgcggcgaaccgtccatcattgacacatttgcggaggacgacgccgaaggcggtgaatcgctggcggagaaaatgcgtcaagcggaagtgcagaaaacactgtttgccaaatgcaaattcttcctgaaccgggaagtgcccaaggaggcgcttgcctttgtcatccgctccggtgggggcttcgtctgttgggacggatgcgccccgaattcggttgacgaacacagcgaacagatcactcaccaaattgtggacagaaaagtggagaagaccaacattaacagagtgtacgtgcagccccagtgggtgttcgactgtttcaatgcgcggcgcattttaccgccggccaaatacgcgccgatggccacgctgccgccccatctttcgccctttgtcgatgcacaacatttggaagtcggcgccggtgcttatattcccttggagcgcattgaacacgcaaaacaacagaatggaacggatttggcagcatttttggatggcacaactccggcgaaaagtgccaaaaaggacagcgccaaagagaaaaatgaggcggcggacggcgaaggggcgaaaatgggcgtacgaaagtcgaaagtgttggcacgggaaagtcgacagaagcaaataaacgaagagggtcacaatttgaaactgcgcgagatgatggtggccaggaagcaccggcgcgtgtacggaaagatcaaatacgggctgaagaggaaggcgcgcgaggcgaacaaattggcggagaagcgggcgaagctaacgacagatgatggcaaagggacgaaagagtga

SEQ ID NO: 1613 - DNA, 1794 bp, Heterodera glycines
  cDNA sequence=SeqID_1395; peptide sequence=SeqID_1810
atgactacgacagcgcctattgcgacagaagagggtgaggatagtttgtaccctatcgctgtgcttattgatgagcttcgtaacgaagatgttcagcttcgtctcaactcaatccgtaaattgtcgacgattgctttggcattgggcgttgaacgaacgcgcaaagaattgattcaattccttacagacaccatttatgacgaggatgaagttctattggcattggccgaacaattggggaatttcactccgttggttggcggacctgagtatgtacactgtttgctgccgccacttgaaaatttggcgaacattgaggagactgtcgtgcgtgacaaagcggtggaatcgttgcaaaaaatagcagaaaaacacagtgcagctcaactcgaggaatatttcattccgatggttctgcgattgtcagctggtgattggtttacttcgcgcacctccgcttgcggattgttcagcgtggcatacgctcgtgccaatcctgctcaaaaaactgaattacgtgccgcattccggtgcctctgtcgcgacgatacaccgatggttcgccgtgctgccgcatccaaattgggcgactttgccaaagtgcaggaggaggactatttgaaaaatgaaatcacccaaatgtttgaggacttggccaaggacgaacaagactctgttcgactgctttcagttgaggctggcattgtgatcgttggtctgttgtccgaagactcggcaaaattggcccaagtgaaaccgatcgctgtttcgttggtgcaagacaaatcctggcgtgttcgttatatggcagctgataaaattgttcaaattcagcaagcattcggtaccaaaattggcattgaagaaattgtcggatggtacaccggacttttgaaggactgcgagggcgaagtacgcgatgcagcggcagagaaactacaatcattctgtgctgctctgtcggaggaaggccgaaaaaagggaatcattgaagaaattttgccagtgattcgaccactaacaactgacgcgaatcagcatgtcaaaattgcgttggctcaggttgtgatgggattggcgcctctgctcggcaaccaatgcaccattgagcatttgttgcctatttttttgtcaatgcttcgtgatgatacacccgaagttcgcttgaacatcatttcttcattggaaaaggtcagcgatgttattggtgcagatgagctccaatactcacttttgcccgccatcatcgacttagcacaagatggaaagtggcgagttcgcttggccatcgtggaatacatgccgttgcttgccaaacaacttggccagaaattttttgacgagaaattgcttaaactgtgcatgaattggttgacggatcacgtttatgccattcgcgaggctgccacaaacattttgaaggaattagcgcagaaattcggtgccgaatgggccgtcactatggttttgccccgtgtgattgaacttgcttctgacagcaactatctgcgtcggatgacttgtctcttctgtttcaacactttgtgtgaagcattgaacaacgacgcaattatgaaggaacttttcccaacgataaaagcgctttgccatgatcaggtgtcaaacgtgcgtttcaattgtgctaagacattggccagagtgggcaaagtggtggacacacaggtcatgaacacggagattaaaccactgattgtgaaaatgtgcgaagaccctgagtttgacgttcgctatttcgctgaagaaacaaaaatagaacttggaatggcagcttga

SEQ ID NO: 1614 - DNA, 818 bp, Heterodera glycines
  cDNA sequence=SeqID_1396; peptide sequence=SeqID_1811
gtttgttttttgtcattgaatttatccctggcggcgatttgatgtttcacatgcaacgtcagcaaaaattgcctgaagagcatgcgaggttttactctgcggaaatcattttggcgcttcattttctccattctcggggcatcatttaccgtgatttgaagttggataatgttctccttgacgccgaaggtcacatcaaactcactgatttcggcatgtgcaaagaaaacattggccctggcgatggcacttcaactttttgtggcactccgaattatatcgctccagaaattttgatgggcgaagagtacggttttagcgtcgatttttgggcccttggtgtgcttatgttcgaaatgatggccggaaggtcgccattccatctcccaacaacggaagaggacgaacaaactgctgaggaccttctctttaaaatgataatggaacatcaaattcgcattccacgccatttaagcgtgagggcagcgaatgtattgaagggatttctaaataaaagtccttctgagcgtttgggctgcaaaaccgacttggaggagggactggcagacattaaaatgaacagtttcttcaagtcgaacatcgactgggaattgcttgaacagcgacagatagcgcctccctataatccaaatgtgtccggagacagagacttacaacgatttgacacgagtttcaccaacggaaatccttccctaacaccggacagtccatctgtgatcgcgcggattgatcaatcggagttcgaagggttcgaatatgtgaacccattgatattcaacaaggaggatgccgtttaa

SEQ ID NO: 1615 - DNA, 1984 bp, Heterodera glycines
  cDNA sequence=SeqID_1397; peptide sequence=SeqID_1812
gttcaatattcctatcatttcctcggatcgtttgccaaaactgcgcaatgttctcgccggtgtcttctccattcaaaacacttacaaatataacgacaattatccgttggacggtgaaggaaatacaaaaggcttttgctttttggagtaccaaacaaaggaggcggccaacgcagttttggccatttgcgatggacatcgccttgacaaaaaccacacattttcagcgtatccattcaccgctattcgaagcatgaaggagccggaaaaggactggaagaaaccggagagacaaccttatgtcgatttgggtgacccatggtcttggctgcaaaaccccaagtgtttggatcagttcggtctcctctatgaatcgggccagggtggcactctccgtttggatgtgttttggaacgtcagaaatggcgagccaacgcccgtggacaatgcttctcgagaaaattggtccaatgaccttttcaaatggtctccccatgggacttatttggccacgatgaacaatgacaagcggaatcagcgactcggagccgtaatttggggcggcgaaaagttcgacagatttcaacgcttttcccacgagggcgtcaattaccttgacttttcgccaaatgagaaatttcttgttacttatgcttgcgatcagaacagcactcgtgacaatgagaattgtttgcgcattttcgaggtgttcactggcgaactgaagaaggccttttcgccctctctgcgctctgctggccgtctccacgattggccctttctgaaatggtcacacgacgagaaattctttgcattttgccgtctccgcggcaattgcgtgaacatctttagcacggacgacttcatgctctgtgagaacaaagcgattgaattggatggccttgtctcttgcgaatttaacccaacaaagaatttcttggcttattactgcgaagaaaggccgagtgcaaatgctcccgcagagattggtttgcttgacgttgaaacgcgggtgaaaatccgcgcgtcgcgcattttctccgtctcacagtccaacctttactggcaaaagtcgggctcttatttggcagcgcacactgaacgctaccagaaaatggtgaagaacaaagagggggaggtgaaatatacgggtaataattcgtacttggaaatattcgactgtacagacaaggaatatgcggtacagtccatccaattgcccgaacctttcgtcaatttggcatgtgagccaaaaggcaacaaattttgcgttttgatggctgtagggcaaaaggttacgccgctaatctatcgactcgaccacggaaaaccagcgccacaactcattggcaagatcgaaccggccaacggactgaacacggcgatgtgggccccgcagggcggttgggtggtggtgatgggggtgaacacgtccagcggaattgtgagcttcatcgacgcgacgggggcagaggcgaacaaagctaaaacgattgagcatacttcactcagtcagggttcttgggacccgaccgggcgatactttgccacgtgcactttcgcgggaaagagtcgctatgagacgggctatcgcattcactcgttccaaggacgtgagctgcgacgtaaggcggtagacgccctgctgcgattcaaatggcgtccgcggccacccgtttcattgtccgagcaaaaagtgcgggagactcgcaaatcgttgaagcaattgtcagcgaagtttgaggaggaggacaaaagggaaatgctcaaagtttcgaaggaaataattgaacagcgcaaaaaggcattggaactcttctcgaacattcgcgtcgctgctgctaaaacatacgaagaagaacgggaaaaacggactgagctcagaggtggcattgaccaggaaattggcgagaaggacctcgttgaagaaacaataacagtggcactaaacacggagaaggagaaaatcagagacgagagctaa

SEQ ID NO: 1616 - DNA, 1290 bp, Heterodera glycines
  cDNA sequence=SeqID_1398; peptide sequence=SeqID_1813
atgaagccagacttaaaagaccgggactttatgtacaaattaattgttggccaactcttttacgatggtcatcaacaattggcactgaacttggcacaaacgcttggtctttcgctacgaccgcctcctccatctgacaaactttttcgtcttgtggcaatagctaaacaatttgtggaagatcccgagtctaaagaacgggagacaatcttgcaggtcggtgggtttgagtctgctgggcttgacttggaattcgatgctgatgttgtcccgacaagccctgaaccaagtttgtacgaaactgtgtacctcaccacacacaaggccccgtgtcgggcggctgctttctctccagatggagctcttgtcgccacggcctccaatgattgttcaattaaaattttggatgtcgataaaatcatttccaggattgacgtgactctgagtgagtccggccccgacgcccatcacccggtcattcggaccctttatgaccacctcgatgaagtcacttgcgttgctttccatccccgcgagtccgtcctcctttcgggcagcaacgattttacgctgaaaatgttcgattattcaaaaactgcggttaaaagggcaatgaaaacgatcacggaggtcgagccgatcactgcggtcagttttcatccgagcggagagttttttctatgcgcaactcggcatccgaccttgcgtctttatagtgccgaaacacagcaatgctttgtttctccaataccgaaggaccaacattctgattccattacggatgtgtgctattcggaaaatgcgcgaatgtttgtcacgggaagtcgtgatgggaatgtaaaagtttgggacggagtttccaatcgatgcattgagacttttacccgcgcgcatgacggagccccgatttgcagtgctcagttcactcgtaatggaaagtacgttctcacagtaggaatggacagtgtgcccaaattatgggaattgtccaccaatcgctgtttgatcgcttacaccggcgcgggcaccacaggcgcacgtgaacatccgatgcaggcgcactttaaccacaccgaagactatgtaatgcttcccgatgaaaagtcgggttcgctatgttcgtgggatgcacggaactcggaccgcgagcggttgcttgcgctaggccacacagctccgactcgagcttttgtgcattcgccaagcatgccaatgttcgtcaccggatcagatgaccaccgcatccgattttggtacaggcggagacaatggggcgaaggcaaagcctag

SEQ ID NO: 1617 - DNA, 645 bp, Heterodera glycines
  cDNA sequence=SeqID_1399; peptide sequence=SeqID_1814
atgacttccagggatgacgaatatgactatttgtttaaggttgtattaatcggcgactcgggggtcggcaagtccaacctgttgtcccgcttcacgcgcaacgagttcaacctggaaagcaagtcgaccatcggagtggagtttgccacgcgaagcatccaggtcgactccaaaacggtgaaagcgcaaatttgggacacggcgggccaggagcgctaccgggccatcacttccgcgtactaccggggcgccgtcggtgcactgctcgtctacgacattgccaagcatgtgacctacgagaatgtggagcggtggctgaaagagttgcgcgaccattccgaccaaaacattgtgatcatgctggtgggcaacaagagcgacctgcgccatctgcgggcagtgccgaccgacgaggccaaggcgtacgcggaacgcaaccagctgtcattcattgagaccagcgcgttggacgccaccaatgtggaggacgcgttcaccaacattctgaccgaaatttatcgctctgtcagcacacgacaagtgccaccggaccggatggtgccaatcaacagccagcacaacatcacactgtcctcctccaccagtgccaacaaggagaagaaggcgtgctgttccgcctcctaa

SEQ ID NO: 1618 - DNA, 1545 bp, Heterodera glycines
  cDNA sequence=SeqID_1400; peptide sequence=SeqID_1815
atgtcccgttttgtgtgtgctatttctggaaatgagcctgaggtggctgtggcatcgcccgtctccggagaagtctttgagaaacggctgctcatcaagtacattgaagagaacggcaccgatccgatcaccggccacaaacttgacacttccaacttggtcgagctgaagcaggacccgggcattcgttctatgcaaaagtcattggccaccgcctcgttgccttcgttgcttaagcaattgcaagacgaatgggacgccaccatgctgaacaacttcacgctcagacaggagttgaaggcagcccgcgaggagttgacccacgcgctttaccagaatgacgcggcatgccgtgtgatcaaccgtctgagcagtgagctgcagtccgcgcgtcaaatcatcgcgacactgccgcacggacgacgcgctgccgcggagagtgagacggaggcgaccgatgttgagatgcgtccggaggaagtggaggagggcgctggtgcggacggtctgccgggcatcagcgaagagttggtcaattttttcaccgacaaatgccaagacttttccaccgcgcgtaagcagcgtggccgaaatttgcccgaggggttggcatcagtggaacaaattcaaaagtatgaggaggttgcgtgccacgatgcgctgcacagtgccagcgtgcccggcatcaccgcgttggatttgcagaaaaatctcatcgcaaccggcggaatggacaagaccatcgtgctgttcgactcggagacggagaccatcaagaacacgttcaaggggcaccagaagcgcatcagtgccgtccgtctccatcccaaccttcaaacaattgtctcgggctcttttgactcacagatacgaatttggaacgcggatgatcaaagtgccagaaatgttattggcatccacgaccgacccgtcactgacgtgtctctgcacccaaccggcgattatgtgctctgttcctctgaggattcgcattggtcgctcatcgacctcaatgctggacgtccgttgataaaagtgaaatccgacgacgacgatgtgccgggaatttgctgtggccagtttcaccccgacggactcatctttggcactggcggcaaaaacagcgtcgtcaaaatctgggatatcaaggagcagatcaacgtggcccaattcccgggccaccaggaggcggttgttgccatttcgttttccgaaaatggctactacttggccaccgggtcaacggacggcgaagtaaaaatttgggacctgcgcaaactgaagaatctaaagaatttgacactgtacgatgtgaagcaggcgatcaactgcctcacttttgaccagtctggcgcctatttggccgtcgggggcagcaacgtgcagattttccaggccaaaagttggaacaacattgcccagttcaacgcgcactctcagccagtcaccggcgtctgttttgccgacgatgccaagtccgtggtgtccgccagcatggacaagtccgtccgtgtccacgccgtgccgcccgtggcgaacgaatga

SEQ ID NO: 1619 - DNA, 268 bp, Heterodera glycines
  cDNA sequence=SeqID_1401; peptide sequence=SeqID_1816
tctcagtccgccctggggcgggcccgcctacctgcacagggaccgtccgtttgacctgctcgccgacatggagccgaacggagttgacattttccgcgtggcgaaaaaaatttcgccgaacattgtctactttttgccgaaaaacacccgcactgatcagttaattgcattggcaggccccggaggccgtgtggagttggagcaaacggtgcttaacgagaagatcaaggcgttgcatgcttattttggcctgttggcggccaattga

SEQ ID NO: 1620 - DNA, 561 bp, Heterodera glycines
  cDNA sequence=SeqID_1402; peptide sequence=SeqID_1817
atgggcaaaattcactactgcaagcgtccggacaacagcacaaagtcgtgcaaagctcgtggttcagatcttcgtgtccatttcaagaacacacatgagacggcgcgtgccatcaaacatatgccgttgaagcgtgccatccgctttctggagaatgtacgggagaagaaggagattgtgccgttccgccacttcaacggcggcgtgggacgcaaagcgcaggcgcaagcgtggggcacaacacagggacgttggccgaaaaagtccgccgagttccttctccaacttctcagaaatgcggagagtaatgccgaggtgaagggcctggacgtcgaccatttggtcattgaccacatcgtcgtgcaagcggccgccaaaatgcgtcggcgcacttaccgcgcgcacgggcgcatcaatccgtacatgagttcgccgtgtcacatcgaagtgattctgaccgagaaaaaggacgtcgttgcgaagccggccggcgcattggtcaaagtgaagaaagagtcgaagaagaagcagcgacggcaattggcacgtggcgaattctga

SEQ ID NO: 1621 - DNA, 546 bp, Heterodera glycines
  cDNA sequence=SeqID_1403; peptide sequence=SeqID_1818
atgggtttggccatttccggtctgttcagtcgacttttcggcaaaaaggaagtgcgcattttgatggttgggctggacgcggcgggaaagaccaccattctgtacaagctgaagttgggcgaaattgtcaccaccattccaacaattggcttcaacgtggaaactgtcgaatacaaaaacatttcattcaccgtctgggacgttggtggacaagacaaaattcgaccgttatggcgatactatttccaaaatacgcaaggactgatttttgtcgtggacagcaacgaccgcgagcgtgtgggcgaggcgcgtgaggaactgatgcgaatgctggcggaagacgaactgcgcgacgcggtgctgttgatttttgcgaacaaacaggatttgccaaatgctatgaacgccgcagaagtgacggacaaactcggactgcacaatcttcggaaccgcaactggtacatccaggccacctgtgccacgtcgggcgacggactttacgaaggcttggactggctgagcaatcagctgaagaacagaggatga

SEQ ID NO: 1622 - DNA, 1512 bp, Heterodera glycines
  cDNA sequence=SeqID_1404; peptide sequence=SeqID_1819
atggacccggcacttaacgccgaggtgaagacggacattcgcgacgaaaacgccgtgctaaagccaaattcgaagaatggacgctttgaactgtttttgctgtccgagacacaacagacgcactcgtccgcctccactctccccatccaaaagctacagcatgtcgatgccatccgtgcctctctcatggaaaaacggacaacggccaataattacattcttgacgggaggccaaaattcattgatgacagcagtagcagccccgaggaagacagcaccaatttgcgtttgtttggcgagtcaaattttgagggcattacggggagcatcgacgacagcgactctcagtacaccaccgactttacgagtgtttctcagcagaatccacacgtgccgaagcgcaaatttgccatggcggagcgatggtgcggggaaagttgtgacgatggcaaacatgggcatggccaacaacaacaaaggcaccgccatcgtctcgcctttgtgagtacgaacaaacgctacgacagcaacaacaaaccgtgttggacgcgcgagaagcggacgcgccgcaggtcattcacggcactttccagcacattcgaggacaccacggaagcatcaatgtccttggaaatgatcacggtgactttcaacttggacagtcgacgaccctttgggatgtccattgtgacgaagaacaaccgttccggatttgcagggatttatgtgcatgaagttaaccctggcggtcttgtggcgttggacggtcgaatcagacccggctttatcattctggaagtcaacgacatttctttggatgaccttagctcaaaggaggcgctcaatctgatcatctcttcggttcgaaatgctaccgaaaccagggggcaactcaaattggtctgtgctcccagcagtgagtctgttgaactcgcgcgaaacgttttccaccccattttggccgagcccgtacgaccgattgatcccaccgcgtggattcagcacgcaaacgccgccagggggttggaccaccaattgcagcactttccccctcccccgccaaccgctcattcgcaagggcaacagccgccgatttgttgtattatgccgccacaatgtcagccgaacgtggcgaaaccgatggccagcaaatcgtcaaccattccaaaaacaaaccctcagcaacagggaaaggtccatgaaaaacaacaccaatttgcgggtgctgcaaattgtgccgttgacggagacattcgaatgatccaaaacccatcgactgatattaccacgacagagtcgggcatttcctccgtggaatgctctattggccaattagagccctccacgaaagcgaaaggcgcatcaactggaaacagaaagaggagcaaaacgacggagacgaagaagcgaaggggaagcggaggcatcgggacggcactccgccgattggtgtgcattcggacgacgaaaagaggggggagagggaacagtggggaaaagaaaaatgggtaa

SEQ ID NO: 1623 - DNA, 1152 bp, Heterodera glycines
  cDNA sequence=SeqID_1405; peptide sequence=SeqID_1820
atggcaaatccttcgattaacgctaaggcggccgttttggtggacaatccgcgggttgaatttgtgcaactcgactcattggtggtcatgaaaattgtgaagcacggggacatcgaattctatgccggaatgtccaaaattgctggcgaaacgtgccaaggcattctcaccggactgatctccgtcgaggacaagcggcttgaagtcacgaattgtttctcgatcactcgtccggatgctctgcacgaaagtgaagagagtgccgctggtcccgagacgtccctttcagacgagaacaaacagggcgagattctcgacatgctgaagcgatttcgaatgatgaacatcgattacgagtcggtcggcttttaccaggcgcacccattcggcgcctgtttcagccacgaactgctcggttcattggtggactaccaatcggacatttcagacgccgttgtcattgtttacgacccggtcaaaacccgtcagggatgtctgacccttcgcgcttatcgcctctccaaaaaggcgttggatttggccatcacttgcgacgacagttggtctcctgaacagaccaaattggctggggtcaactttgccaatttcttcgaagaattgccaattgttgtgaagaacagccatctgatgaacgttctgttggccgagttggcactttccaccaaatgccaacgcgccgcttccatccgactcgaattgggcaccaaacagtcgctggagaggtccatgaaggcgttgattggcaccgtcgacgaactgaacaaagcggtgaatgcctacggcaaatacacggtggaaaagcaaaagtacgacacaatgtacaacaatctgatgcagaagagacaaacggagaacgaagcgcggcaatcgcgcggagaaccgccgctgacaatggaggacataaagcggcagctgaagcagccgcaaatgcagacaaagtacggaatgttggacttgctgctgaacgcgctggacaccgacgcattcacgacgtaccaaattcagacgaccaacgaaaacgtggccaaattgcacctttcccaagcggtctctgctcagcccgtcgtcgccgcctcttccgctgccattggcacttccgccgcaaatgcgcccaatttggaaaggaaataa

SEQ ID NO: 1624 - DNA, 645 bp, Heterodera glycines
  cDNA sequence=SeqID_1406; peptide sequence=SeqID_1821
atgggacgtcgtcccgctcgttgctatcgctacattaagaacaagccttatcccaagtctcgcttttgtcgcggtgtccctgacccgaagattcgcatttttgacttgggtaggaaacgcgcaactgttgacgagtttccatgctgtgtgcacatgatatcgaatgaaagggaacatttgtcgtctgaggctctcgaagctgctcgaatttgtgcgaacaaatacatggtgaagaattgcgggaaggacggctttcacatgcgcgtccgaatccacccgttccatgtgattcgcatcaacaaaatgttgtcctgcgctggtgctgaccgtcttcagacgggaatgcgcggcgcctttgggaaaccccaagggttggtggcgcgtgtcggcatcggtgatatgctgatgtcggttcgtgtccgtgaccagcatcaagcccacgctcttgaagcattccgtcgagcaaagttcaaattccccggccgtcaatacatcgtcatttcgcgcaaatggggcttcaccccttttgaccgcgaagtttacgagaagcaccgcaaggaagggcgagtcattccggacggagtcaactgccgattcctcaagcaacacggaccattgacggaatggctcaaaaatccaatctga

SEQ ID NO: 1625 - DNA, 402 bp, Heterodera glycines
  cDNA sequence=SeqID_1407; peptide sequence=SeqID_1822
atgaacatgaatcaacttttggttggccgttcgctgttcccaaaaatcatccgccctttctcgcacaccaaaccccttgccaagtctgaggctgacccggatgattacggctacttcccggacccaattgaacactcatggggtttggagaggaaaatgctcatcgctcgtctgaagggtgacgaccgctatgagccgaaggtgtatttccgcgctgaacataccacccgggactatccgaatttggtgccggtccatttgcaggacaaagtcgtcgggtgcctttgcgagccggacgcggagtacgtgaactattggcatattaggaaaggccagatgaagcgatgcgagtgcggacattggtttaagggcgtgcaagccgaccctgacagtttcgcctga

SEQ ID NO: 1626 - DNA, 495 bp, Heterodera glycines
  cDNA sequence=SeqID_1408; peptide sequence=SeqID_1823
atgacgattagcaagaacaacaagatgatggcgcacctcaactacaaaatgaaggtgatcgtccaggattcacgcgtttttatcggatacttcaaagcattcgataaacacatgaacataattctggccgactgtgaagagatgcgccgcattaagcccaaacaaggagctaagaagtcaaacgtcgaggaggaaaagcgcattcttggcctggtgttgctgcgaggggacaaaatcatctccatttcggtggaaggaccgcctcaaaaggaggattctggtgtgcagttgccaaaggctggcggactcggtgggcctggacaaggacgaggtgccggtcgaggaatgccgatgggtgtggtgccgccaatgggagctgttcctccgggtttgcagggcgccgttcgtggaattggtggtcctgggatgggtgggcccatgcagcccggatacatgcaagggatgccgcagggaatgccgccacgtccattttga

SEQ ID NO: 1627 - DNA, 546 bp, Heterodera glycines
  cDNA sequence=SeqID_1409; peptide sequence=SeqID_1824
atgtttaacctgcaagaccgttgtaagggcgttgaccaggaccgcgattaccacgcgactcgcatttcaattcgggacaaattgctcagccaagagaccaaagagttggaacagaaccttcgcgatttgcccacttgcaaattgattttcccctcaacgtcggcgctgcacgaaatggagctgacggttaagccgaacgtgggcctttacaaaggcggcgctttcaaattcagcatcaccgtcccaccggagtacaacaacgtgcctccaattgtgaagtgtctgacccgcgtttggcatccgaacattaacgaagacggaagcatttgcctgagtttgttaaggcaaaactcattggacggatatggttggatgcccacgcgccgcatccgtgacgtcatcctcggccttgaccaattgttcaccgatctcatagactttgacgacccgctcaatgcccaagcggcgcagcagtggcaaaccaacaaagatggatttgcccaaaaagtcaaggaatacatgaccaaatactgcccaagaaactga

SEQ ID NO: 1628 - DNA, 741 bp, Heterodera glycines
  cDNA sequence=SeqID_1410; peptide sequence=SeqID_1825
atggtcgcactccgtgcccaatttgaggcgagcaatgatgtcggagttttctgtaaactcaccaatgcttattgtctggtgggcattgcttcttccgaaaatttttacagtattgtggaggctgagttggccgacgtcatcccggtcatccattgcacagttgcgggctgtcggattgttggccgtgtgacggccggtaatcggcacggactgttggtgccgaacgcgaccacggaccaggaattgcagcacatccgcaacagtttgcctgactcggtccaaattcgaagggttgacgaacggttgtcagcgctgggcaatgtaattgcatgcaatgaccacatcgctgttgtccacgcggacataagcaaggaaacggaggcggcgctggccgaagtgctcaaagtggaagtgttccggctcagtctcggcgaaaatgcattggtgggctcttacgcagcgatgacctcaaacggtgcgttggtggcggcaaagacaccgccggaggtgcagcgcgagttcgcctcgctcgcccaagtgccggtggtcgccgggacggtcaaccgcggctcggaactgatcggtgccggctgttgcgtcaacgattggatcgcattcacaggcctcgacacgacctccgccgaactgtccgtgttggagtccatcttcaaattgggagacgcggcgccgagcgcaatttccaccgatttgcgcgatactttgatagaatcgatgctttga

SEQ ID NO: 1629 - DNA, 495 bp, Heterodera glycines
  cDNA sequence=SeqID_1411; peptide sequence=SeqID_1826
atggttttcgacccgaaatcgaaagacaaggcgcgggaacttggttcctaccgcgatatgcggttcgaggggtcgttgcccgaacaagaacgtcggcttgcacagtccaccactctctacattggtaatttgtcttactttacttctgaagaacaggtatgggagctgttccgccgcgctggagacgttcgtcgggtgattatgggcctggaccgttttaacaaaacgccatgcggtttctgttttgtcgagtattatacacgtgaagatgcagaaaatgcactgagatacataagcgggactcgccttgacgacagagttgtcagatgcgattgggacgcgggttttaaggaaggtcgccagttcggtcgtggtaaacatggcggacaagtcagggacgagtatcggcagaattttgattcgggaagaggcggatggaacaaaacaattcaaaaacgaaatgaccaattcacccagcgaaatatcaaagcctga

SEQ ID NO: 1630 - DNA, 662 bp, Heterodera glycines
  cDNA sequence=SeqID_1412; peptide sequence=SeqID_1827
cgggaattgaacttcacaaagagtcgcgttggtacgcgggatggaagacattcacagagtccaactcctattacaacaaaattattgactggaaaacacgcattgacgaaagcgagaatattttcgtccgaactgttcgtggtaccttcgaacgtgtccaactcgcatttgaatccaaagacaatgtgtcggaagtgctaacgcaaatatccaaaatcgaccccgaattcgacaagtcggaatggctccgtttttgcgaaaaagaaatgatcccgaacattcttgaatcaacttaccaaatgaacttcgaagtccttcgtgattggtgttacgagaaagcgttcaatttaatcgcaaattctatcaaagaatacgaaaagattggcttcaacacgagggattctcgcattatcgatgttagcaaagtggagttggtcacggggaatatgaccgaccaagggccgactttggtcatccaattccaagtattcatgacaaatgtggtgaagaacagcgaggggaaaattgtccaaggtgaccctgaaaaagcggttcgagtgagacacatttgggtaatatgccgagacatggaggagttcaacccggcaacagcttggaaactgcttgagctgcacatgataaaggaggatttatttgtttag

SEQ ID NO: 1631 - DNA, 1191 bp, Heterodera glycines
  cDNA sequence=SeqID_1413; peptide sequence=SeqID_1912
gtgatgcgttctccatcaccgaccgataatgacaaagcgcgttccttaaatgtgtacagacgtaaattggccgaatataaagaaattgagaatcggcttaaggaattgcggactaaggaacgcgaaagtcacaaattgttcgacaagtcggaaaatgagattaaatcgcttcaatcggtcggtcagattgttggcgaagtgcttaaacaattgacagaagagaaattcatagtcaaagcgaccaatgggccacgatatgtggtcggatgtcgtcggaccattgacaaggagaaactgaagcagggcacacgtgtggctttggacatgaccacgctgaccataatgcgccaacttccgcgcgaggtggacccgttggtgtacaaaatgagccacgaagaccctggcaacgtgagctatgccgaaattggaggtctctccgagcaaatcagagaactgagagaggttgttgaactgccgctgatcaatccggagttgttcaaacgcgtcggcataacaccgcccaagggctgtcttttgtacggaccgccgggcaccggaaaaacacttttggccagggcggtcgcttcgcagctcaactgtaactttctgaaggtcgtctcgtcggcgattgtggacaaatacattggagagtcggcacgaatgatccgcgaaatgttcaattacgcccgtgacaaccagccgtgcatcgtttttatggacgaaattgacgccatcggcggacgtcgtttttcggaggggacttcggccgaccgcgaaatccaacgcactttgatggagttgctgaatcagatggacgggttcgactcgcttggcaaagtcaaaatcatcatggccaccaatcgacccgacacgcttgacccggcactgctccgtccgggccgattagacagaaaaatcgaaattggactgcccaatggacagagtcgtcttgaggtgctgaagatccatgccaccaaagtgctgaaaaaagaagaaatcgattacgaagcggtggtcaaattgtccgagggattctcaggggcagacctgcgcaatgtgtgcacggaagctggactgaatgcgatccgaaaggagagggacggcgtggtacaggaggacttcatgaaggcagtccgtaaagttgcggacgccaaaaagttggagaccagtcttgactacaaacccgtgtga

SEQ ID NO: 1632 - DNA, 1023 bp, Heterodera glycines
  cDNA sequence=SeqID_1414; peptide sequence=SeqID_1828
atgttcgacttccatcaattcatgggtttgggcggtggtgctgtcgccacttattcagtgcaattgcgtgccttttctgcgccatttttccagcgacacgatgaacgaagaatcaacgaactcaattacggcggaaagattctgttgccaaattcgtgtctcgacaatttgatgcgtcgcaacattcagtacccgatgctcttcaaattgactaatgtcggcccggcccttcagaggggcacccatgccggtgtgctggagtttctggcggaagaaggccgctgctatttaccttcctggatgatggcccaactcgctctgagggagggcgacctcatcaccgtggagtacaaagcgctcccgaatgccacttacgccaagttcaagccgatgtccaccgacttttacaacatttcaaatccccgtgccatgctcgaggtcgaactgcgcaagttttcctgtctgaccaaaggcgatgtcatcgcagtgcagtacaacgaacaagtgtacgaattccaagtgaaggcactgaagccggaaaatgcggtgaccatcgtcgagtgtgacataaacattgaatttgacgctgcggaaggctacgtggagccgaacagaacgcatcaacaacggaatgagatggtcgcagcggaggaagagcagcagtcgcatccacccaacgtgttcaaaccgttctccgggtcagggtttcgtgtcgatgggaagaagccgcgatctgtctcaacaagttcacagcaggaggcgacgagcagctcatcctcttcggcatcttccgggcgacagccttcctctgggattgcttcgactgcgtccactgcgcgtgacgctttggaggcaattgctgtggacgaaaattacatccctggggagttgcgttttgtgcgtcgtccgtacaaaagcaaggcacaaagggacaaagaggcgcgcgaaaaggacaacggagggacgatgaagccattcggaggcgaagggaacacaatccgaccgacgcgaggcggacaatga

SEQ ID NO: 1633 - DNA, 706 bp, Heterodera glycines
  cDNA sequence=SeqID_1415; peptide sequence=SeqID_1913
gaaaattttctctttgcttctctctcctctgtttttcatttccttaaaagcggcaatgaccagtcgaattttgagctgcaatttgcgaaggtacttctccaagatgaaccaacacatcgagttcggcacaacgaagagcgcttcgtccgacaaacaatcgccgccttcccctacaaacaatcaaacgcaacacgagggaatgagtcaggaatgtcgggagcaaatcgagcagatggaaaagctgaagagcgacaacgaaatgctgaccgacaaatacaaaagaacacttgcggacatggaaaacttgcggaagagaacgcagcggcaaattgaggaggcaaaactttttgcaattcagccattttgcaaggatttgctggaggtggctgatgtgcttgacttggcgttgaattcgttggaaaaaatgaaaacggaggacggtgccgcctccttggacagtggagtgaacaaagggatcaaaatgacgaaggaagtgttgctgaagacgttcaaaaagcatgggcttgtaccggttcaacccgaaggacagaagttcgacccgaatttgcacgaagcggtgtatgaaataccgaaggaccagtcagataggcctgccggtcacattgcgcatgtgttgaacattgggtacagtttgcacgaccgtccgattcgaccagccaaagtgggcgttgtgaagatggaatga

SEQ ID NO: 1634 - DNA, 1041 bp, Heterodera glycines
  cDNA sequence=SeqID_1416; peptide sequence=SeqID_1829
atgggaaagacttcaaaggataaacgtgacatttattatcgacttgcgaaggaggaaggctggcgagctcgttccgcttataaattgcttcaaattgatgagatttgcaaaatcttcgacggtgtctttagggtggtcgatttatgtgctgcgcccggcagttggagtcaggttttgtccaaaaaattatatgtgagcgagaaggacgaagaaaaacggaagagagtgaaaattgttgcggtggatttgcagccaatggcgccattgccgggagttattcagctacaaggggacatcaccgaggttggcacagctcaacaaatcatttcttattttgatggttccctggcccaacttgtagtttgtgatggagctccggatgtcaccggtcttcacgcctttgatgaatacatgcaaagtcaactcgtttattcggccttcagcattacttctcatattctccaaaatggcggcacttttgtttcaaagatttttcgggctaaaaatgtgaatttgctctacgcccaaatgaaatgctttttcaaggaggtgtcgtgttgcaagcccaagagcagtcgactgagcagttgtgaggcgttcatcgtctgcaaaaactattcgcctcctgagggttacaaaccgaccctcgtcaacccaatcttggcatcagactacaatgaatgcttggctcagttggagggtccaatgaatgctgctctcgtccctttcatggcttgcggtgacctctccggattcgactcagaccgaacttacccacttaacttggaggagctgtccaacgaattcaagcaattcgactacaaatacagtcacaaagatgtgttgcaaccacccacagagccagcatataaaaaggcatgcgaaatgaagaggaactcggagttggagacaaacttggaccagcaacggcaaagaacgcaatcaaaaaaaccagcgaagaatagagaagcaaaggaagagttgcaaaatgatgtgattgccgaattagaagagggatgttttgaaagactgttgttgtga

SEQ ID NO: 1635 - DNA, 341 bp, Heterodera glycines
  cDNA sequence=SeqID_1417; peptide sequence=SeqID_1830
caattattgaagtgccactgaatccgacaaatcccagccaaccgaacatggaatttgtttacgaggctattgccactttattcaccactcatttcaaaaatttgacagagccgcaaattcgagtcacagtcaaagggttcttcagctttaaccgcacagttacaaagatgcgtgaacacatccgagacttcctcgtccagatcagggaagaagccggcgacgacactgcggaccttttcttggaagagaaagaggctgagatccagcgcattcaatcgttaaaacaagcgattcccggggttagaaatccgaacgaattgttggaggaggacatggtctga

SEQ ID NO: 1636 - DNA, 1998 bp, Heterodera glycines
  cDNA sequence=SeqID_1418; peptide sequence=SeqID_1831
atgaaattattgagattgcgctcttatcttcatttttcatgtaatttgcatgttcgcaatttgacgaatttatccaaatttggtacctacaatgagaaagccattcagcttatccagcagcactatgatgaagcgacgtcatcttcacatcaatttgtcgattctccatcccaagaagtcttccgaatggttttgccacctccgaatgtgacaggcaacttgcacattggccatgccatcactgtcgccctcgaagacgcaatatgtcgctaccagcgattactcgggaaaaaagttcgttggaccccaggctttgaccacgccggcatggccactgaacaagtggtgcaaaggcaactcgcgcaacgctttggaaaacaaacggacgaaatgtcgcaatcggagtttgtcgcacactgtgaagaatggaaagaggcaagaattcgggacatttctggtcaactccgctccatggcctgttctctggattggcccgatttgttctacacaatggaccaaaatttttcccgcgctgtccgtgtcgccttttgccgtttgcattcgcttggactgatcgttcgcgagacgcgtcccgtgttcactgctctctccgcggacgaggagaagaaagcgcccgaagcggtgatgatggaacaatggtttctgcacatggacggaatgaacggacagctgagaagcgatttggaggcgggaaagttcaatttcaaacctccgatgaacaaagggatcaccgaggagttcacaaaattcaaagaaccatggaatttgagccgtcagatcgtttggggacaccgaattccggcatatttcgtagagaagtccaaaagatggattgtggccgaatccgaggccgatgcgcgcgctcaattggcctctgatgaagcggactctccgcttctacaggacccggacgtgctcgacacgtggttcagttcctcgctgattcccattgtgattgccgggtggcccgaccgaccgatttgtggccaatcgttggaactgatggagactggctacgacattgttggccattgggtagccaaaatgatgatgatttgccattgcctcacgggtgagtatccgtttacgcgtgttctgttgcacggaatggtcagggacaaccgggaaagaaagatgagcaaatcgttgggcaatgtggtcgacccactcgacattatcagagggaccggcattgaagagatggtcgagcggatcaactcctccaatttaccatctgaagagaaagcggttgctgaggcggacttgcgcaaacgctttccgcgcggaatgcgtcacaatggggtggacgcgttccgtttctcactgcttcagcacgacctgaccaaggcggtgatacgcgtggatttcacattgccgctcactgaggcgcgcaatttctgtaaccgcgtgtggaacttgtgcaaattcacgcaacgcgtcttcaaagctgcgcatggatgttcccatccatgggcggaaaacgctgaacaaacgatggcgcacgatttagcggagatgacctttgagtcagaagacattgagctgaagcgacagttggcactcgccactcgcgcctaccattgccacatgcaatcgctgaacacaaaccaagcactgcacacgctgcgcacgttcattggcgaccgcgtaaacaacgaatatttggaacagatcaaatccgttctcaatgcgcagccggcggatgagcgtcggctgagggccattgcggaaacgttgcgcgaggtggtcgccacttcgctcggtctgctgctgcccttcctcccgcagctgtgcacttttctccaagacgcgctcgcgttggacgcgcaggcggcggccacgcgcgcactgcgcgacgccagggaatatgagaagcagcagaaaacggatgatgagggaaaagaaggggagaaattgggaggagaggaggaggaggaactgaggacgacggagaaggaacggagagaatttgcttaa

SEQ ID NO: 1637 - DNA, 388 bp, Heterodera glycines
  cDNA sequence=SeqID_1419; peptide sequence=SeqID_1832
gaaactcgcgtccattcgtcgcactttgctattaaactacgacacagaggacggactgatggagttcagacaatactccataaagtcagtgcccgcgggcgtttctcgttcggccaaaaaactgatgcagagcaaagtgccagacctgtccaagtacaaagacatcagtgacttcatgctcaaaccggagcagttgagtgacagcgaatttgaaggcgaacagacggaattggagctcacgcaggatattggcggacggggcaaaaaacgaggacagcaaaccaaattgaggttgatggaaattggaccacggatgacattacgtttgatgaaaattgaggaaggcgtcaacgcgggcactgctctttggacacactcttcaacataa

SEQ ID NO: 1638 - DNA, 771 bp, Heterodera glycines
  cDNA sequence=SeqID_1420; peptide sequence=SeqID_1833
atgaaagtcatcaacgagtttggctatcgtcaagatgcccgaacacccagccaaatccgcaacattgtctatcaaatgggagtttactcacatgcggacggctccgcttacattgagcagggcgagacgaaggtcctttgtgcggtttacggtccgcacgaatgtcgcttccgatcacgagccaaagaagacgaggccattgtcatttgccagtacagtcaggcaactttttcggttcctgacagaagaaacaggccgcgtggcgatcgtcgaggcaattccttttcccaccttttggagagggctttcgaatcagtcattttcacaaatttatatcctcgaagtcaaattgatatattcttcgaactccttgaggctgacggtgccaatttggccgcctgtgttaatgtcgccagtttggcactggctgatgccggcattcccctgcggggactgctgtccgccgtcgaatgtggtagtgctgatgggttgccttgtgcggatttgagttctcgtgaacatagtgaattggtaccacgcctcacaatggccaccgttggaggtaaagacgaaattgttcttatggacatgaaaaacctactccacaaaaatcatttgccgtctttgttacaaatgggcgtcaatgcgtgtgcccaagtacacatttgtctggagacagctgtttttagacatgtcgaagcatcgcatcggaaaaacacagaaagtggaaaacaaaattcgcttttgaacagaattgttgaaggtcgctaa

SEQ ID NO: 1639 - DNA, 626 bp, Heterodera glycines
  cDNA sequence=SeqID_1421; peptide sequence=SeqID_1834
caccgcaagacaaaggcggcgttattgtggcggtcgattcgcgtgcaacgggcggaacttacatcagctccaaaacggtagaaaaaatcattccgatcaacgaccaattggtcgcgacgatggcaggcggtgcagcggactgtcagtattggacgcgggtggtgagcaaatattgcaatcttttcgaacttcgcgagggtacgcaaatttcggtggctgcggccagtaaatattttgccaatgttatgtacgactatcgtggccaagagctgggcgttcactcgatggtttgcggggttgacaagttcggcccttccatttacatggtcgaagctgaagggactcgcgtgaagattgacaccatttgttcactcggttcgggcatgttacacgccatgtccattttggacaccaaatacaaggaggcgatgactgacgcggaagcgttggagttgggcagagaagccattgtgtacgcgacattccgcgacgcggcttccggtggccattgcaatttgtgtcatatcacttccgaaggaaagaccatatacccgccattcgatgtcagtgataagtattatgaattcatggcaaagagaggaactccgcttgtgcccgaattgtga

SEQ ID NO: 1640 - DNA, 789 bp, Heterodera glycines; identical to SEQ ID NO: 897
  cDNA sequence=SeqID_1422; peptide sequence=SeqID_1835

SEQ ID NO: 1641 - DNA, 540 bp, Heterodera glycines
  cDNA sequence=SeqID_1423; peptide sequence=SeqID_1836
atgggcattttaactgcttcgaaagtatgcactttgccacggctttcttccgctcgctctatgacttggtggtggggcccggagaaaaacaatgggcgcgaagttgttggccccactttccacggggatgaattttaccaagatcgtcttgaccgttggtacccgtccattcgatttcgcaaaaatgacgaagtgatcacgcccattcgccacaaggaattgggagattggaagaagttgagcattgaggagaagaagcttatctaccgctactccttccgtcaaactttggccgagtttgaggcactgacgccttatggctatctcacagtcactttgttcttttctatgcttgggcttactattctgtacgcttcgtttgttaggacttacgtgacaaaattcaatgaccgattgcctgacactttcgatgatgaatataaagaaagtcaggccgagcgccgtgtggtactggaaaggggcaatccttatggaccggcctactactacgattacgagaaaaatcgttggaaggactga

SEQ ID NO: 1642 - DNA, 2793 bp, Heterodera glycines
  cDNA sequence=SeqID_1424; peptide sequence=SeqID_1837
gtcccctttgacgttgaatatcaacagctaaaaaagaccaacaccccggcaaagctttacgagttcaaactcgacatgttccaaagccaggcactcaaatgcctggacaatcaacagtctgtgctggtctcggctcacacatcggccgggaaaactgttgttgccctctacgcaattgccatggcattgcgggacaaacagcgagtgatttacacgtccccaatcaaagcattgagcaaccaaaagtaccgtgaacttgttgaagagttcgaagacgttggccttgtcaccggggatgtgacactgaacccaaatgcatcatgtgttgtgatgaccaccgaaatactgcgttcaatgctttaccgaggctgtgaaattgtgagagaagtcggctgggtgatctttgatgagattcattacatgcgcgacaaagaacgtggcgtcgtctgggaagaaactctcattttattgcccaaaaccaccaatttggtgtttctttctgcaactattccaaatgccaagcaattcacagaatggatttgctatctgaagcacaaacagtgcaacatcatttacacggactatcggcctgttcccctccaacatttggtttattctgccgggtcggacggtctttgggaagttgtgaacataaagggcgagtttaaacaggacaactttgccaaggcgatgagctgtttggaggagcgccaaccgatgggcggcgaagtgcggcctcagcacggacggcggagtggcgcgaacgacgcgacgcagaagagcaacgttgtgaaaatcattagaaccattcgagagcgagacatgttgccatgcattatcttttcattcagccgaaaggagtgcgaggcgtacgcctccgaaatcaaagacattgattttaatacagaagaagagaagcgcgccatcaaattgatcttcaacaatgccattgacctgctttccgacgaagacaaaaagctgtcccaaattcggcacgtgcttccctatttaatgcgtggcattggcattcatcattcgggtcaattacccattatgaaggaagtggtcgagatccttttcggagagggtttgattaagacccttttcgccactgaaacatttgccatgggcataaatatgccggccaaaactgtccttttcacttcggcacgcaaatttgatggtgtcagtaacagatggataacaagtggcgaatacatccaaatgagcggaagggcggggagacggggcaaagacgagaagggactggtcattctgatggtggaccagcagatgagcgcggagacggccatgcaaataataaaaggcacgagcgatccactgaactcccaattccgactcacttacaatatggtgcttaatctgttgcgagtgccggacatcaatccgcagtttatgctcggcaattccttctatcagtggcagaattattcccgccttccggaccttctgcagaaacttaacaccaaaagacaacttttcctaagtgcgcatgtcgaccatttgtcggaattggaaggacttttcagattggagaagcaaattgagcagcagagaaatgccatcaaagctttggtactgaagccggcaaaagttatccgcttctttcagccaggccgaatgctcaaactcaaatgcttcgacaaggacttcggctggggcgtgctgttgaggtacaccaaaaagccgaacccactgaatccgttgtctcctgaaatgctctatttcctcgacgtggctgtgttcgtctcgcgcgaaagtgagaactgcgcgcaaaatctatgtgcggtgaaacctccgccgcccggggagaatggcgtggtggtggtgctgcccttcgctttcgactgtatccaagcagtgagcacaattcggctaaaaattcctcaagagctgaagagcaaggaggcattccaagcagtggccaagaccattctggaaacgaaaaaacgcttcgaccaactcattcccgaattggatcccatcgagcacatgaacatttccgacccgcagctgaaaaagtctttggaagagctaaaaaggtgcgaagagcggttcacggaacatccgctgagaaaccgacgcgacttcgatgaaatttgggaagcatttatgaagcggcaaaaactggaggacgaatacaaacaagccaagaaggaatttgacaacgggaaaaaactgtcgggtttggtcgaattaggctatcggaagagagtgctgcagcggttgggttacgcgacggaggaggacaccatcacggaaaagggccgtgttgcctgtgaattgagttcggccgacgaattgctgctcacagaaatgattttcactggcgctttcactgatctttcgccggccgatgccgcggctttgctttcgtgtttcgtttttcaagagagagcaccgattggcaaactaagcgattcgctaagtgaacatttgcgcactatgcagggcatggcaaagaaaatagcaaaaatctcgattgagtgcaaattggaactggacgaggaaaagtacgtggagtcgttctgtcccgcgatgatgaccgttgtctccaagtggtgttcaggcgccacattcgccgaaattctagaaacgtccgatatattcgagggcagtataatcagatgcatgcgacgtcttgaagaattactgcaagaaatggtgaacgcagcccggtccatgggtgaccggccactggaacaaaagtttgagcaggcccgatctctgcttaagagggacatcgttttctcagcgtccctttatctctaa

SEQ ID NO: 1643 - DNA, 957 bp, Heterodera glycines
  cDNA sequence=SeqID_1425; peptide sequence=SeqID_1838
atggctaacaaaatgaagaaaaagaagaaaaatgctgttgctactacaactgctggaccccaaaaggatggaggcaaatttaagcagaaagggatcaaattcaacacggaaaagggccaacacattctgaagaatcccggcgtggtccatgccatcgttgagaagtccgctgtcaagggcactgacactgtgctcgaggttggcccaggcaccggcaatttgtccatgaaattgttggaccgtgccggccgtctgattgcctacgaattggaccctaaaatggtggcagagctgcagaaacgtgtggtcggaacacccgtccaatacaaattgcgtatcattgctggcgatgtgatcaaagcagccgagtggcctccgtttgatgtgtgcgtctccaatttgccctaccaaatttcatcaccgtttatttttcgactattgctccaacggccattgcccaggtacgccgtgctgatgctgcagaaggaattcgccgatcgactgttggccaagccgggcagtaaggtgtattgtcggctgtccgtttctgtccaattattggccaccgttgagcatctgatgcgtgtgaagcgttccgaatttgtgccacctccaaaggtggactcggccgtcattcgcattcagccgcgcaatccgccgccggccatcaattacaaggaatgggatggaatgttgcgcattgcgtttatgcgcaaaaacaaaacactgtcggcgctgttcaagcagaagcaggtggtcgatgtgttgcgcaaaaattacgcagtcgtttgcggcacgaagggaaaggaagtgccaactgatttttgcatgacctcacacattgaacgggtgttggaagaagcacaatttgccaagcggcgtgcccggacaatgtcaattgaagactttttggcactaatgttaacatttaacaaggcggacattcatttttgttga

SEQ ID NO: 1644 - DNA, 1705 bp, Heterodera glycines
  cDNA sequence=SeqID_1426; peptide sequence=SeqID_1839
cgtagtcatcatgttgtctgatcttaccatgggagagatgaaaattttgcccaaagatgtacaactttgtgctgaggttgcgactggtgttgaacggatgggccaatatcagtaccaagacctggtgatgctggataaagaaacagttggagtaatcgttcgtttggaacgcgaaaatgtggaagttttgagtatgcatggcaaaatacttcgtgttaaccctcaaacgattgaatgcaaaaagaattcgcggttcgtcaaggcacttgattctcaaaagaatacaatccaagcgggagatacggtcaaagttgttgagggcttcctggcgcgaaagaaggaaactgaagaagaacgtcagggcgagatcaagcatcttttcagaaattgggccttcgttttttcacgtaaatatccacaaaacgggggaatgtttgtttgcaaagcgcggaatttggcattgattggtggaagcaaagcgtcggagtcacaaatcaacactactattttggataacagtcaacttatgagtcctcgtcctaatccgctcgaaagtcctcgcaccattcacggcggaatgactccccattccgggtcaagtgttgttggtgcacaatctgtccgtggcgatcatggttttaaagcaccaagtgtggtcgggagcatcgcaacatcagcaaccggagttggtcggcaacatgtacgtcggaacatggaaataatgggcaaaactgtgcgcgttctggctggtccaatgaagggttacattggaattgtgaaagatgcaacggaatcgactgtcaaggtggaactgcacaccatgccaaaaacggtcaattttgacatcaacaaagtgatggaggttggtggtgccgtcccgagggaattgatggacactgctggcgcaatgactccgggaacggccaccattggcgggcgaactccgatgtacggaggagcgcagacgccaatgtacggtggagcagcaacgcctatgcacgactcattcggtgctcgtactcctcattacggctctatgaccccggcttacgacggcagtcgaacgccttcgcaccaaccatcttcgtcttgggaccctgctttggccaatacgccggctcattcaactgctcattttgacaatgaatttgacacaatgggatttggcggaggagcatcaacgccggcaggttctgtgagaagccgacttgggggagcgaatactccaatgggccaaatgacaccgcgagatatgttcggcgattattcttcaagcccttaccccaacccaagcacaaatgcttcgctgcatccgtcgaaaacgcccattggtcagtcaccggcacttcaggaaataatgcccgattccgaaattcccactggttcatggtgtatggtcgacctgtgcgtcaatgttcttccgacatgtggaaaggaccaacttctcggtttagaaggctcaatacggtcaattagagagggcgaatgttgtttgtatttcgaggagcttgacgatgacttcactattgagcacgaacatgtggtgcccattcgaccggcaagtggagaccaggctaaggtcatttatgggcacgatcgtggggtgtctggctctttaatcaccacggaaggggaggatggtgtgctgcaggggccgaacggggcaaagctttattcgatgtccgttctttgtaaacttgtttga

SEQ ID NO: 1645 - DNA, 972 bp, Heterodera glycines
  cDNA sequence=SeqID_1427; peptide sequence=SeqID_1914
gaaatgtctaaaagagagaatcaccccgaaaaggaaagggaagaaaaccgcgccaaatttctccgctcgctcatcgatgatgcccatttaattttggcacatggaaacccaaaaatcatcgaccatcgcatttcacattctgaccgttgcgagtccttttggataagggccggttttctccctctgtacgagagtttgcccgtttgggaaatggaaaaagtgccgtccattcgaaaagtgaagttcaccggcgatgacagacgccgtcttggcgaactttcctttacaatgcgcgacaaacatacgatgcaagtgcggacgaaaagcccaatgaaaaggctcttcgattgggatgaacctgacaaactcgaggcaccagtgtttccgccgtcttttgacgttgcggatgaattgataatgtcacccatggtttataatcttctcgccgacacagagccattgtggcaatgcccaggctacgaatatgactcgggtgaaacgcataagtacggtcggttggctatcaaggacattactccgctgatcactcgtctggacactcattggcgttgcgacacggaacatgagcgaaaggaagtgctcagagaatgtttggccgcaacggcggtcgtatctctcttcaattggttgaatggacaagcgcattgtcttggacacactcaatacacagaaattgtcgccccgttgagttcccaattgatactttctgacggcttgcaattgttttatttcgctctcggtcaactcaacactctcgcaattaacattgatgttgaaggcttcaataatcagcggtccaatttttgttgtgttaatggacccttcaaactgtacgatgaattcgatccggcaacgaaaaccgtccgacacgtcgacccttcggatggcctttcgaaggacggactgaatcccctcgtgttgcaccgaatcctccaaatgtgtgttgtttaa

SEQ ID NO: 1646 - DNA, 1368 bp, Heterodera glycines
  cDNA sequence=SeqID_1428; peptide sequence=SeqID_1840
atggtagccgcgccagatgaagcgcaatttcatatttcgttttacactgacgaagaagagtgtaagaatttgttgcctgccgagtccatcaatgtgcccgcgtcttcgcactcggaccaactcaatgtgttgatcaaccaaatcgggtcgatgaacgatgacagttggaagcccgtccaattcgactttctgctccattccgtgctgttgcgctgctctctgctcgagttggtcgagcagcaacagttgtccctggagaatgtgctgcgcatcgaatgcattcgccagtcgcccgctccgcggccgaccgccgaactgaacgaagcgcaatgggtggccgatcttagaacattgagccacaattgtgttttgtccgtgaattttgccggtctgctgaatgtgtgggaattggccggtgaatggaccagagccgtcgtcaaacaattggacgacgaaccgttgaaatgcgtggacacattcactcgggacgacggaacaactttcgctttgagtggaggtcaaaaccaaactttgactttggtgcgactgcgggcgcagaatagggcggacgacgaagacgaaaatgaggcccaaagcagccgaggcaaagggaaatggcgcgcggagccgacggcaattttcaggggccaccagcgttctgttgaatgtgttgcgataaatgctcgaggaaatcgtgccatttccggttcattcgacaaatgcctgaaggtttgggacattgaaaacacaggtgatcagaatggaatgccaatggcgggcaaaaacacaacgagaatgaactcgacaaagcgtatgcgaatggacgtgccaaagattactccgatggtcactttggaatcgcatcgcgagcctgtggtcggctgcgcgtggcatccgtccaacttgagccaggcgatcactgcttcatgggaccatcagctgatgctgtgggacctccaattggcaggccccatctccacgctgacttcgaataaagccttttccgcactttccgtctgtccggccaatggccttgtgctgacctcctctgtcgattcgttggttcggctttgggattttcgttccagggatggctcaatggtcaaggcatcgttccatggtcatgttggcgttgtgtccgatgtctgttggcactcaaccgaccagcatttgtttgtttcggccagctttgacaacacagttaaaatgtgggacgtccgcagccccagggcggctctatatgatttgatgggccattcggaccgcgtgctgtgcgttgattggacagtgccgagccgtatttgcagcggttcggtggactcgacggtgaaagtgttctcacatgggaccgaagaaaatatctactag

SEQ ID NO: 1647 - DNA, 1797 bp, Heterodera glycines
  cDNA sequence=SeqID_1429; peptide sequence=SeqID_1841
ccgaagccgacactgcgttttgcggccgtccgaacgttgaaccgaatttccattgactaccctcaggcggtgatttcgtgcaacgtcgacttggagcagttgatcacggatagcaatcgttccattgccacattggccatcaccacgctgttgaagacgggtgccgaggcgagcgtggaacggctgatgaagcagattggcacttttgtcagcgagatcagcgacgaatttaagattgtcgtcatcgaggctatccgttcgctgtgccatcgctacccgcgcaaacacgccacactcatgaactttttggcctcaatgctgcgcgacgagggcggtttcgactacaaaaaggccattgtggacaccatcatcaccatcgtggaggacaaccccggcgccaaggacttgggcctgtcccatctttgcgagtttattgaggactgtgaacacgccgcattggccacccgtgtgctgcatttgctcggccgtgaaggaccgaccactgcgaacccgtcccgttacattcggttcatctacaatcgcgtcattttggagagcactcaggtccgtgccgccgctgtcactgcgctggccaaattcggcgcggagtgtgcacagctgcgcccgtccattctgattctgctccagcgctgtctgctggacacggacgacgaagtgcgcgaccgggccaccttttatttggtggtgctgcgcacggagaagccgcaactcatcctcaactacatcctggacacgctgaaggtgtccgttgtcggtttggaacgcgcgttggagcagtacacaagtgctgctcattttgatgctccatttgacctgaagcaagtgcctttatccaccgagccgttgaccgcttcaaccgatgaggtgaaaaagaaagcggcgatggtggacgatgcatcggcggccatgaaaaagcagaaggaggagaagaaaagcggcacttcccgacaggagcaatttgcacttcaattggcgtccatgccggactttgccgcctgcggtgccctgttcaagtcgtgtgccgcggttgagctcaccgaaaccatcactgaatacaatgtgtcatgtgtgaagcacattttcaacgacgactttgttcttctgcagtttgactgtcgcaacactttgaatgaccaactgttggaggaagtttttgtcgaaattgagccgcaggatgagggcgaagattgcccttggcatgtgcaaagtgttcacccgttggcccagttgcccttcggccagcccggcaccacttatgtgctgctcaaaatgccggaggacggacgcattgccggcacatttggcgccaaactgaagttcaaaatttgcgacgtcgacccggcaaccggcgagccggaaagcaacgatttgtacgacgaagtgtacgcgttggagcccatcgaagttggccttgccgactttctgttggccaccgcgccgaagggcgcttcatttaccaccgcgtgggacgcgctcaaggaggaggggcacgagacggaggagtcgtacgcgctgtccaatgtgcacacattggaagatgccgtctccaaactgctcaaatgcaccgcccttttcccttgtgagcattcgaatcgggtgccggagggcaagtcgtcccaccagctgttgctgtgcggcattttccgtggcggcatcgatgtgctgtgccgtgtccgcctggtcatggacccatccgaccagacggtgtccatgaacatggttgtcagatcaatggacgaaacagtcagtcaaatgatcgcaaacattgtcagctga

SEQ ID NO: 1648 - DNA, 625 bp, Heterodera glycines
  cDNA sequence=SeqID_1430; peptide sequence=SeqID_1915
ggcaatgtcatctgattttggaaaccctctgaagaagttcaaactcgtgtttcttggtgaacaaagcgttggaaagacttctcttatcaccagatttatgtatgacagctttgacaatacgtaccaggccacaattgggatagattttctgagcaaaactatgtatcttgaggacagaacggtcagacttcaactttgggatactgctggtcaagaacgctttcgttcgctcattccgtcgtacattagggactccacagttgctgttgttgtttacgacattacaaatgcgaattcctttcatcaaacgtccaaatggattgacgacgtgcgcaccgaacggggcagtgacgtcatcatcatgctcgtgggcaataaaactgatctcgcggacaaaagacaagtttcaacggaagagggcgagcagaaggcgaaggagctgaatgtgatgttcatcgagacatcggcaaaggctggttacaacgtgaagcagcttttccgacgaattgccagcgcacttcccggcattgaggtggaaaaggctgcggacgcaaaacaagtcgttgacattggcccgattaagccccgtcagattgtcactgaagagggttcctgttggtgttaa

SEQ ID NO: 1649 - DNA, 1314 bp, Heterodera glycines
  cDNA sequence=SeqID_1431; peptide sequence=SeqID_1842
atgtctgtgcctggctctcaacctccgcaacagggcgaggacgccgaggagcggctgatcaacgaggagtacaaaatctggaagaaaaactgcccgttcctttacgacatggtgatgactcatgcgttggaatggcccagtttgaccgtccaatggctgcccgacgtgcaacgacaggagggcgccgactacacaatccatcgcctcattttgggcacgcacacgtcggacgagcagaatcatttggtcatcgccaaactgttactgcccaacgacgacgcacagtttgacgcgtctcgctacgacactgaccgaggcgaatttggtggctttggcacagtgaccggcaaaattgaggtggaaatcaaaatgaaccacgagggcgaggtgaaccgggcccgatacatgccacagaatccggttctgattggcaccaaatcaccctcctcggaggtgtacgtctttgactacacgaagcatccgtccacgccggctgacgtggagtgcaagccgcagttgcgactgcgtggccacaccaaggagggatacggcttatcctggaacaacaatttgcctggtcatttgttgagtgcctccgacgacatgaccgtgtgcctgtgggacattcaagcggcgactgcgaatgccaactttttggacgcaaaatccattttcacagcacacactgcggttgttgaggacgtggcatggcacgttttacatgacacagtctttggttcggtcggcgacgatcacaaactgatggtgtgggacacgcgcacgaacagctccacaaagccaacccatgttgtggaggcacactcggccgaggtgaattgtctctccttcaacccgtactcggaattcattttggccaccggatcggcagacaaaactgttgcgttgtgggaccttcgtaatttgaaattgaagctgcattcatttgaatcgcacagagatgaaatatttcaagtccaatggtcgccccacaatgagaccattttggccagctcgggcaccgatcgccgtctgcacatttgggacctgagcaaaattggcgacgaacagtcgccagaggacgcggaggacggaccaccggaactgttgttcatccatggcgggcacacagccaaaatcagtgacttttcgtggaaccccaacgagccgtgggtgatctgttcagtgtcggaggacaacataatgcagatttggcagatggcggacaacatttacaacgaggaggagttggacccggcgatggtggaaagtgttgcggccgcaagcggcgccggtccgatgggccaacaacattga

SEQ ID NO: 1650 - DNA, 1743 bp, Heterodera glycines
  cDNA sequence=SeqID_1432; peptide sequence=SeqID_1843
atgtcggacgactatcgcagttcgattggcccacggcctgcgttcaaccgcaactcaacagcctattcaagtacgggcggacctgtctcgggcggcaaccgcgtgctgaaaattgtcacggagacaatgtcatcgagcaccagcggcggcggcggtggcatgtcaccgtttggcgccaacgcggcacaaatccgtgactcccgtgatcgcgagaagaaggagctgagtgatttgaacgatcgattagccaattacattgaaaaggtccgcttcctcgaggcccagaaccgcaagttgaaggcggacctggacatgctgcaaggacgccgcggcaaggacaccatcaccatcaagaccatgtacgagagcgagattcagacggccaaaaagctaatcgaagacacgggccgatcaaagcacgagttggagcaggacgtggccaaactgcaacgtgacttggacgagcagcgccgcaaatacgaggaagctgttcgctcacgggccggtgaccgtgaaaagttggacgatttgctggtccaattgagcaatttggaggccgaaatcagcctgttgaagcgtcgcattgccctgctggaggaggagctgagcaaactgcgcaaggagaactcacgactgcaggccgacctgcagcgcgtgcgtgccgagttggatcaggagacgctgaaccgcattgactaccaaaaccaagtgcagacactgctcgaggagatcgacttcatccgacgctcgcatgaccaggagatcaaggacttgcaggcgatggccgcccgcgacacgaccagcgaaaaccgcgagttcttccgcaacgaattggcatcggccatccgcgacattcgcaacgagtacgacgtgttgaacaacaaagaccgtaacgacattgagtcgtggtacaagctgaaggtgcaagagattgagacgcaaagtgcacgacagaacatggagcagggctaccagaaggatgagctgaagcggctgcgcgttcagctgacggatttgcgcggcaaattgtcggatttggaagcgcggaactcgctgttggagaagcagatccaggagctgaactaccagcttgaggatgaccagcgcgcttatgaggacgcgctgaatgcgaaggatgcccaaattcgaaagatgcgcgacgagtgccaagcgctgatggtcgagctgcaaatgctgcttgacaccaaacaaacgttggatgccgaaattgccatttaccgcaaaatgctggagggcgaaggggacgggcccggcctgaaacagttggtggagcaggtggtgcgcaccaccggcatcaacgaggtggcggacacagaaacgatgcgtgtcgtcaagggcgagacgtcctcccgccagtcgtaccaacggtcggccaagggcaatgtgtccattttggagacgtcgccggagggcaaatacgtggtgttggagaacacacaccgatcaaaggaggagaccattggagagtggaagctgaagcgtcgcattgatggcaagcgcgaaattgtgtacacattgcccgccaactttgtgctccgcccgatggcccgtctgaaggtgtgggcccgtaaccagggcggcctgcacgccccgccggatcagctgatcttcgatggcgaagaatcgttcggcgtcggctcaaacgtgcaaaccattctctataatgcgcaaggagaagaacgtgccacgcacatccaacgttcaagccagacagctgcctga

SEQ ID NO: 1651 - DNA, 504 bp, Heterodera glycines
  cDNA sequence=SeqID_1433; peptide sequence=SeqID_1844
gagaatttgaagttcaaaagagagagacgagaaaagttcagtcagtcggcggcgattccttcgaatttgcccccttcgacaagcaatggacaaatgggttcgcttcttctgcacgatgaaatggcgtccgcttccagcggttcttcgacctttgcgttggacatggataaattggagcaacagcgggtgcaggaacagaccactctactgctcgacgataccgaacagttccaccaatcccggttcaacgccatggaaagcattgaaagcagcatctctgagctgggcacgattttccgccagttggccactctcgtctcggaacaaggcgaaatgatcacgagaattgactcaaatgtggaggagagcagcctcaacgtggaggcagcacaccacgagttgctcaagtatttcaacaacatttcccgcaaccgttggctgattatcaaagtgttcggcgttctgatggcattctttgtgttctttgtgattttcctcacctga

SEQ ID NO: 1652 - DNA, 1032 bp, Heterodera glycines
  cDNA sequence=SeqID_1434; peptide sequence=SeqID_1845
atgggcaagggattccaaaattttatgtccaagaaggacttccatccaagtgcatggtggaacttaaaaaggaaatgggaagctgagcaaaagaatgacttggagaaaagaagacaggatgaattgcgtgtccaatatgagaaggagcaagaaattctcaacaataaggcacttcttggtgacgaaaaagcgaggttgggcctttctttcatgtacgatgcgcccgctggcattaacaaaaagaaggaggaagggccggaaccgaaattcgaatggcaaaggaaatacaatgcaccgcgtgaagaatgggcgaaaggaaatgaactcatccaggaccaacctttcggaattcaggtgcgaaacgttcgctgtgtcaaatgtcgcgcgtggggtcatttgaacacggaccgcgaatgcccactgtatggtatgagtggaaatgctgaagaccatggctatgcaaataatccctccgatatcattcgtgatttaaatgtcgaaaagaaaacaaagactgtctctgatgtcacgaccaatgagcagattgatataaaaccgaaaattgaggtgcgcaaaagccacgaagagaagaaaaagaagcgacgccattactcatcggaagaagaggaagaggggacggaagaagaagaaaagaagccggaaccgatcgatcaggaacaattgctggtgaacatgcgtgaggagcacaatttgaagttcaagaccggcattctgattggtcttcgagcggacgaacacataaaaaaaatgtcagcgatggttggaggaggagaggaaaaaacttttgaggcttttctgaaaggactggatgagaaaaaacgaagaaaattaatgaaaaaaatcatgaagactgaagtgagcgatgactccgatatcgagaaggacaaaaaacagcgaaggaagcaaaagaaggaggaaaagcgcaaggcggacaaaaaacacaaacatcgcaggtcgtcgagtcgggagaccagcagaaagcggaaggaggggaagcaccaccgccactga

SEQ ID NO: 1653 - DNA, 639 bp, Heterodera glycines
  cDNA sequence=SeqID_1435; peptide sequence=SeqID_1846
atggctccacgaggaaacaacatgcttcccaatgcccacttccacaagcattggcagcgtcgtatcaaaacttggttcaaccaaccggcacgcaaggaacgtcgccgcgctgcacgttccgccaaggcggcccgattggcaccgcgtccggccggcggtctgctgcgccctgttgtgcgttgcccaagcgttcgctacaacaagaaatgccgggtgggccgcggcttcacactggaggagttgaagcggtccggcatgggcaaataccaggccagatcgttgggcattgcggtcgacacacgccgtgttaaccgatccgttgaatccaccgagcgaaacgttgcgcgtctcaaggaatatcggtctcgtttgatcattttcccgaagaagatgaacaagccgaagaagggcgacagcagtccggaggagttgaagctggccgcacaaatgcccggctctgtggtgatgccgccggtggtcaaacagcgccggttgaaggccgagccgatcaccgaggcgatgaacaaattctccgcctattgtcaccagcgtcgcgtgcgggcggacaaacggttgaagggcaagcgagaaaagaaggccaaggaagcggcggacgaagggctgggcaaagggcgttga

SEQ ID NO: 1654 - DNA, 621 bp, Heterodera glycines
  cDNA sequence=SeqID_1436; peptide sequence=SeqID_1847
atggctgccatgaatcctgaatatgactatctcttcaaattgctgttgatcggcgattctggtgttggcaagtcgtgtctgttgcttaggtttgcggatgacacctacacagagtcgtacatttcgaccatcggcgttgatttcaaaattcgcaccattgagcttgaggggaagacgattaaacttcagatttgggacaccgccggacaggaacgcttccgcacgattacgtccagttattatcgcggagcacacggaatcattgttgtttacgacattacagaccaggactccttcaacaacgtcaagcaatggctccaggaaatcgaccgatacgcatcggagagtgtgaataaacttcttgtcgggaataaatgcgatttgaccaccaaacgtgcgatagagacgaatgttgccaaggagtatgccgaccaattgaacattccattccttgagacttctgccaaaaactccactaatgttgaacaggcgttcatcacaatggccactgaaatcaaaaatcgcatgggccctcttcaacaggccggtggcaatgcgtccgccgtgcgcattggtccgtctcagccggtgcaggacaaaaaaacgggcggatgttgctga

SEQ ID NO: 1655 - DNA, 1308 bp, Heterodera glycines
  cDNA sequence=SeqID_1437; peptide sequence=SeqID_1848
gtttgttcactttcgctgactgttacagctgcactgatggacaattacaaggtcaatccaaaggacattggctttctcgcggttggcaccgaaacattggtcgacaaaagcaaaagtgtgaagtcagtgttaatggatttgtttgccgattcgggcaacatggacttggagggcgccgacgagaaaaacgcgtgtttcggtgggactcaggcgttgttccatgccgtcgattggatgtacgctaattacgcaacagaaaaacgccttgccatcgttgtctgtgctgatgtggcagtttattcggctgggcccgcccgatgtacgggcggtgccggtgcagtggcctttctgattggaccaaatgcaccgattgcacttgaacgtggccttagggcatgccattctcaaaatgtttacgacttttacaagccaattggaggcgttagcacgcaattcccacgagtggacgggccaaacagtgtggagacctatttgaacgccgttgacatgtgttacgggcgattttgtgagaaatggaacaagaaattctgcacagggcccccttgctctctttcggattttgtcgctgtcattttccactcgccgtacgctcgtctcacccaaaaagccttttcttggctgtccttcgtcgactttaaacggggaatgatggacgatggtgtcacagctgatgatgatgatgtgtctgattgggatcaactcagcgcatacaaatcgaaatcactccatgagatttttgcggtggaacgcacaaaaactcgctcggacggcgatcgatttactgacaaaattttgcggatgagttcgcggacagcggatgccaaactgaatccatttttggagtttagtcgacgcattgggaacatgtacacgccgtcggtatatgctcagctgatcaacgtctttctgaacactgaactttccgataaatcgaacgggaaacggatcctcatattttcttatggcagcggttgtatcgccgcaatgtactcacttcgtttcaatttgtgcacggaaaaactgatggctgcctacggcgcaattaaacaaagcgcgaaaaaggcacacgcgcgattggaccagcggatccgacacagccccaaacagttcacagccgcattggagagaacggagcaaattgtcgctggaggggatacttacatcgaaactcccgatgatggcaaacgcagtgatggcattccaatgtttgccgggaccttttatttgcgagaaatcgactcaaaacagagacgcttttatggccaaattgatgatgccaatgagtga

SEQ ID NO: 1656 - DNA, 885 bp, Heterodera glycines
  cDNA sequence=SeqID_1438; peptide sequence=SeqID_1849
atggttttcgtcaaggccgtcaagaacaaggcttacttcaagcgctaccaggtcaagtaccgtcgtcgccgcgagggcaagaccgactactacgcccgcaagcgcctcgtgacccaggccaagaacaagtacaactcgcccaagtaccgccttgttgtgcgcatcaccaatgccgacgtcatctgccagatcgtctactccaagatccagggtgacttcgtcttgaccgctgcctacgctcacgagctcccccgctacggcgtcaaggttggtctcaccaactgggctgccgcctacgccaccggcttgctcgttgctcgtcgtgccctcaagaagttgtcgcttgacgacaagtacgagggtttcgtcaaccccgacggcaccatcgccgaggtcgagccccttgaggacggtccccgtcccttcaaggccttcctcgatgtcggtcttgctcgtaccaccactggtgccaaggtctttgcggccatgaagggtgcctcggacggcggtatcttcgtgccccactccgagcagcgtttccccggctacgaccgcgagtccaaggagctcgacactgatgtgctccgctcgtacatcttcggtggccacgttgccgagtacatgcgctacttgcaggaggaggatgaggagaagttcaagaagcagttctcgcgcttcattgccgagggtttggctgctgatgatctcgaggagatgtacgagaaggctcacgaggccatccgtgccaaccccgaggccgtcaagtcgactgtccagatcgacgtcgagaaggtcaagaagttcaagaagcagcgcctcaacctcaagcagcgtcgtgaccgcgtcaagcagaagaaggctgccttctttgcccagctcgagtaa

SEQ ID NO: 1657 - DNA, 510 bp, Heterodera glycines
  cDNA sequence=SeqID_1439; peptide sequence=SeqID_1850
atggccggtatcgcagcaggaagactgacggaggagcggaaagcctggcgcaaagaccacccattcggtttcatcgcacgacagtgcaaaaaggaggacggcacattggacctgtacaattggatctgtgccattcccgggcccaagtcgaccatttgggagggtggcctgtacaaattgcgcatgatcttcaaggacgacttcccatccactccgccaaaatgccgctttgagccgcctctcttccatccaaatgtttatccgtccgggacggtctgcttgagtctgttagacgagaacaaagactggaaaccgtccatcaccgtgaagcagttgctgctcggtatccaggaactgctggtgtcgcccaacccggaggacccggcacaggcggaggcgtaccaaatttatgtgcaaaatcggcccgagtatgagcgtcgagtgcgcaaacaggcccaacagttctcagaggaccaggtgctgaagcagttgttgacggacgacagctga

SEQ ID NO: 1658 - DNA, 420 bp, Heterodera glycines
  cDNA sequence=SeqID_1440; peptide sequence=SeqID_1851
atgatttaccaccgatttgttgagattggccgtgtcgtttacattgccaaggggaaggaccaaggcaaattggcagtcattgtgaatgtcatcgacggtaacaaggttttattggacggcccctcctcgggtgtgcctcgcggtgtttggaatttcaaagacttgcagttgacaaaattcaccctcccactgcgtatcggccaacgtacgaaaggagtgcgcgaggcttatgaaactgccaaaatcaacgagttatggcaaggcactgagtgggcaaagcgcattgatcggaaacagaagcgtgccgggctcaacgacttcgagcgcttcaaagtgttcaaagccaaacagcaccgaaaccgtttggtccgcgttgagatggctaaactgaaaaagatttcgaagccgacagcgaagtaa

SEQ ID NO: 1659 - DNA, 936 bp, Heterodera glycines; identical to SEQ ID NO: 988
  cDNA sequence=SeqID_1441; peptide sequence=SeqID_1852

SEQ ID NO: 1660 - DNA, 480 bp, Heterodera glycines
  cDNA sequence=SeqID_1442; peptide sequence=SeqID_1853
atgaagacagagacgtgcgtttattccggctacaaaatccacccgggccatggcaagcgagtggtgcgcgctgacggaaagatccaaatctacctgagcaagaaggcacagcgtggtgcagcactgaagcgcaacccgcgtgacgtgccgtggaccgtgctgtaccgacgaaagcacaagaagggagtacacgccgaggagggcacgcagcgaaagcgcgtgaagcgcaccgtccaaattgcttctcgacccatcgccgacctcaccgtggaggcactgttggcccagcgcaatcagaagcccgaattccgtaaacagcaacgcgaggcggccatcaaggctgccaaggagtccgcccgagtcaaaaaggacgagaccaagaagaagcagcagaagattgacaaaaaggcagcgccaacgaagacgaaggcggccaagcaggtgaaagcgccgaaacaatttgtgggcggaaagcgctga

SEQ ID NO: 1661 - DNA, 1611 bp, Heterodera glycines
  cDNA sequence=SeqID_1443; peptide sequence=SeqID_1854
atgggcacaccctccaggcgtggcaggaaaagaaagtctgaagtagtgcccgataaaagaacatcgacatcttcagcaagatcaaaacctttgatgccgcgcaaatcatttgtgccgttgtccattgaacagtttcggccaaccgcagttggcacacgcgtgctgagctgtggcgagggcgaacaattgggccatccaaatcggaacacaacgaaaaagccgcgtgccgttggcacattcccaaccgacatgacatttgttcaggtcgccgcgggcggtgttcactcgctggtgttgaccactgatggacgtgtgttcagttgtggcatcaacgagaagggcactgtgccggtccaaggcctggaggcggaaggcaccaccgacacattcagcgaaattgtgttcaccacggacatccaacggcttggcaaaattgtgcagataactgccggcgcgtcattttccgcagcgctcaccgaaaagggcagtgtcatcgcgtggggaaatttgagggatacccaaggggaagtcaatgtgcacgagacgctcacggacatacagaagaagccgatggtggtgatgcggcacaaaaacaaacagaattgtcacattgtcaagattgctgctggcgaaaaccatttggctatgctgtccaacgagggccaaattctgacatttggtgaaggctccatgggccaactgggccgctcggtgcgtaccgagcacattcgcgcaaggtatatggtcgatgaatcgggcgcctcgctgacactgcgcgtgttggagcacaaacagtttgtgcgcttcgtcaacatttgggcgcgcggcttttggaccattggccgggcggaggacgggcgtctgtttgtgtgcggcctcaacaattttggacagcttggcgtgccgccccaatcgccggcgcaccgcaagtccgccgctgggaccagcgacgaagatgacggtggaatcggtccgcccaagccaaagtcgccggccaccatcgccgctggccaagaggagtccaacaaggtagcactgctcacttgcgccaccgcgtttccagccgacaaacggtggacccatgtggcgggcgtgcagcatgtgatctgtcggagtggggacgacagccaaatttatgggattggcaagaacacggacaacgcgttgggcctcgacacgtggcagggcaaccatgacgaggagcactggcgctatgacacactgcagcacatcccattgccggacggagtgaacgccgtggccggcgtggacgcaacgctgggcgccaccatattttggacggatgatggtcgagtgttcggtttcggctgcgacacggttggccaactcgggctgggcatcaaggaagaggatgagaaggtggtgtcgaagccgcgtcagatcacttcggcacatttggacggatatcgagtgttgggcgtgtccattgccgacaatcatgcgctttttctcgccgcgtcgattgaccaacaaccgccgctgccatcagcttcaccaccaccaccacaacagcagaaggcccagcagcaccaacaactgcagaccaacggcaacggaatattggaaacaccgattgatggcaaagcttga

SEQ ID NO: 1662 - DNA, 1104 bp, Heterodera glycines
  cDNA sequence=SeqID_1444; peptide sequence=SeqID_1855
gtcggtgcaattgcagccacatcaattggtgaaccctccactcagatgacgctgaaaacctttcactttgctggcgttgcgtccatgaacatcacccaaggcgtgcccaggataaaagaaatcatcaacgcggtccgctccatttcaacgcctatcatcaccgtggcattggccgatgagcgggacgaaaagttggcacgacgggtgaaggcacggactgagaagaccacattgggcgatatcattgattatgtggagcaggtgtttttgccggatggcctttacgtactcgtcaaattgaacacccggcggatcagagaaatggaactggaggtgaccatggacaccatcatcgactcaatttgcgcctccaaattgcccgtgtcgcgcattctgtgcgaccagatccgctcggtgggcaagtccatgctgctggtcaggccggtcgagtcgtccaaatcgcggacaaagttcaacaattcattggtgattgccgaagtgttgggcattgaggcggcacggggctcaatcatttccgaaattttggccataatgggaaaacacggcattgagttggacagacagcacgtgttggccgatttgatgatttatcgcgacgaggctgccttctttggccaacaggaccgcatcttttgctttttggtgacatcagccgctttatatgcagcacaattgccgctgccacttcgtttaattgccttcacaacttgtcttaattttgctggggctcttcaaccaggacaaagtgaatggttctccaacgaccctctgacgcggttcatcaagaaggcgtggcaaccgcgcacgggaaaggattgcgagacggaaacggatggagagcagacaagaacaaaaatgttgaccggattgttttgcgtaagcgtgctcgccgctctcaaagtgatctttctgcacacttggccccgcatccgacgccgttttctgacatggattcgagagaaggaacaaatcgcgactcccacaaacggcagcaatttggtcggcttgcagaacctgatcaataagccgaacgcacagcacaccgaaattgctaacagcgagcaggccgttcaacatcactaa

SEQ ID NO: 1663 - DNA, 1098 bp, Heterodera glycines
  cDNA sequence=SeqID_1445; peptide sequence=SeqID_1856
atggactctgtcaagaaggcggccgtctccggatcactcacggcttcgggttccgccgcagcccgtgacgacgggtcgtcggttggccgtcccgctcgtacactcctgtcggatttggagttgagtgagcccatcttgaccgagaacaagaaccggtttgtcttgttccccatcaaataccaagatatctggcaaatgtacaaaaaggccgaggcctccttctggacggccgaggaagtggacctgtccaaggacttccacgactgggagaaccgtcttaacgacgacgagcgccacttcatctcgcacgtgcttgccttctttgccgcctcggacggcattgtcaacgaaaatctcgttgagcgcttctcgcaagaggtccaagtccccgaggctcgctgcttttacgggttccaaatcatgattgagaacattcactcggaaatgtactcgctgctcatcgatacctacattcgcgacccggcgcagcgcgattacttgttcaatgccattgacaacatcccatgcatccaaaagaaggccgactgggcgtgccggtggatcgaggaccgcaacacgtcgtttgccgagcgcctagttgcctttgccgccgtcgagggcatcttcttctccgggtcatttgcatccatcttttggctcaagaagcgcggcatgatgcccgggctcaccttctcgaacgaactcatttcgcgcgacgagggcctgcactgcgatttcgcgtgcctgctcttcaagcacctcaaccacaagccgtccgtgtcgaccgtgacgcaaatcatcaaggaggcggtcgagattgagcaagagtttttgacggacgcattgcccgtggcgctcattggcatgaactcgacgctcatgtcgcggtacattgagtttgtggccgaccggttattggtggcgctcgggtgcgacaaggtgtacgaggtcgagaacccgtttgatttcatggagctcatttcattgcagggcaagacaaacttctttgagaagaaggtcggcgagtaccagaaggccggcgtcatgtctggaaacggtgccgcaacgcactcgtttaccatggacgaggatttctaa

SEQ ID NO: 1664 - DNA, 621 bp, Heterodera glycines
  cDNA sequence=SeqID_1446; peptide sequence=SeqID_1857
atgccgaacattatgggattgcatggtggctccatgattgccatgagaagcaaagatagtgtggtgattgcatgtgatctgcgcttgggagagcaagccatgaaaaacattgctactaatgcgacgaagatccatcccatttctgacaacgtttttatcggattgaccgggtttaacgcggacgccaccactgtgcttaacaagttgcgcacacatcaggccatttatgagatgcgcgagcagcgtccaatgtctcccaaggcgttgacttcctatctcgcttggatgctctataagcgcaggttcggcccgttcctgatcgaacccatcattgtggggctgaatcaacaaaatgagccgttcatttcccacatggacgtggtcggtagcgtaagtgagcccgaagactacacggtcggtggcactggtggcgacttggcgatgtctctgtgtgaagctctctggcgacccgatatgacctccgaagaaatgacggtggcggtcggtcaggcgatgcttgcggtggtcgaacgcgacgcatccactggatggggcgttgtcatccacacgatcactgcggaaggagtgaccacaaaaatgattaaatcgcgcatggattga

SEQ ID NO: 1665 - DNA, 369 bp, Heterodera glycines; identical to SEQ ID NO: 993
  cDNA sequence=SeqID_1448; peptide sequence=SeqID_1858

SEQ ID NO: 1666 - DNA, 579 bp, Heterodera glycines
  cDNA sequence=SeqID_1449; peptide sequence=SeqID_1859
atgccaaagaaaaagaatggcaccaccgacgaaaagggttgccttctgatcacaaattatttcccaattcgtaggagcaagcgcataacaacgaaggaacttgaggacatcaaattgaaggagctcaaggagttgatcgacacagggttcaacgaggaccatttggaggtgtttcggtgttcggtgaaggggcgaagtgtccgtgcgtcgaaatgctttcaaaggggcgaatttgttgtggagtacaaaggcgacttaatcagtgtgaagacggcccaactccgcgaacaacggtatgccaaagatgagaacgtgggctccttcatgtactactttcggcaccgggacaatgtgttttgtatcgacgcgaccgatgaaacgccgtacaaaggccgactgatcaaccacagctatttgaagcccaacctcaagacgagggtggccgacttcggctgtgacggcttccatttggtgctcgtcgccatgcgcgacattgacaacggcgaggagttgttgtacgactacggggagcggcggccctccgtgctggcggttaacccgtggattttgggctcatag

SEQ ID NO: 1667 - DNA, 546 bp, Heterodera glycines
  cDNA sequence=SeqID_1450; peptide sequence=SeqID_1860
atgccaatcaaagcatccggagaaactttaagaaagtacatcgttgttggacgtaaactcccaactgcaaatgacccaaatccgacactgcatgaaatggttatttttgccagcaaccacgtcgttgctaagtctcgcttctggtacttcactagcatgttgcgtcgtgttaaaaaaacacacggagaaattatttcatgtcaagaggtcttcgagaaaaagcctggctccgtgaagaactttggcatttggctccgctacgattctcgtactggacaccacaacatgtaccgcgagtatcgcgatgtttgtgaagcgggtgctgttacgcagtgctatcgcgacatgggcgctcgtcaccgcgctcaagcggatcgcattcagatcatcaaagtgcaaaccatcagtgtggcggactgcaagcgagccggggtgaagcaatttcagaactccaagatcaaatttccgcttcctcaccgtgtgaattccaagcgacgcaatatgactcctttcacgacacagcgtccgagaactcattttgtgtag

SEQ ID NO: 1668 - DNA, 546 bp, Heterodera glycines
  cDNA sequence=SeqID_1451; peptide sequence=SeqID_1861
atgactgctccttgcattgatgttggcaatcttttactcattaatgttgagacggacgccgaagatttggccagtagcaactcagaacggattaacgaacttacaagcaaaaatgcccagcttttgttcaatgaaatatggaaattacccagaaaaattgtgcaagatgcgacttgttctcagcttcccgaatacacttatggccttcctcgtgaaaaacccattccaaaaccgaaagaaccaacgaaatgggagaagttcgcgagggctaaagggataacaaagaagaaagacaggaaagtctgggacaaaacgactcaggaatggaagccgaaatacggatacagacgagccgagaaccaatcgaaggaatggctcattgaaattcccgaccaaaaagacccatacaaagattattttgctgagaaggcggaggaaaagcgggaaaagaataacaagcaggagttgcaacggctgaagaacatttcccgcgcctctaacaaatccaaagttccaactgggaacagaaaggtgttcaaagattga

SEQ ID NO: 1669 - DNA, 942 bp, Heterodera glycines
  cDNA sequence=SeqID_1452; peptide sequence=SeqID_1862
atgtctcaagcggatgccggacgtatcattcacattgggaagcggcgagagcgtgccaaagaggacattgagagccaacgacaaaggcttgaggaagagcggcgaaatttggcggcgagcatcaaagcgaaattcactacaaatattgacgaacaagaagagaaattcaaagaacgaacggttggattggtaacacttgacgaagtgaaggagagacagaacgaaatattttacagtgggccatctttaaaattttcaaacgaagaccgacccaaatttgagaaagccattcaaaaaagagtgctttcgtttggcgcttttgacgacgacgacgacgaggaggacgaggcactgattccaatcaccaaaaagagacacggaatggacccaacggtggacacttcttttctgcctgaccgcgaaagggacgaacaattgcaacgtgagcgcgaacggatcgctaaagaatggcaagaaatgcaggagagggaaaagaatgaggagataaccgtggcattttgctattgggacgggtccagccatcggaaggactcaaaaacaaagaaagggacgacaattgctcaatttctgcagaaggcattggacacatttcgcaaagaattcctcgaattgaaattggcaacagtggataatctgatgttcgtgaaggaggacttaatcatcccgcacttttacacttttcaagacttcatcaaaacgcgtcaaatgggcaaaacgggtccgctgtggcagttcgaagctgttggcgaaattcgcgtgcggcaagatgccgcgttggacattggcgaatcgcacccggtgaaggtcattttgcgcagttggtatgagaaaaacaagcacatttacccggcttcgcgttgggagccatttgtgccggggaaagtgtacaaacggacaattgacgacttatccacgatttga

SEQ ID NO: 1670 - DNA, 674 bp, Heterodera glycines
  cDNA sequence=SeqID_1453; peptide sequence=SeqID_1897
tttccgacaacgatgtccaaaagcagcttcgccatatgatggcatttattgagcaggaagctaacgaaaaagcagaagaaatcgacgcaaaagcggaggaggagtttaacattgagaaggggaaattggtgcaacagcaaaggcagaaaatcatggaatattacgagaagaaagagaagcaagtggagctgcagcgcaagattcagaggtcgaatatgcaaaatcagagtcggttgaaatgtttgaaggcgcgggacgaccatttgaaaaatgtgttggaggaggcacgcgccaatctcagcaaaatttcggcggacagagagcgctatccggccattctcaaaggacttttgcttcagggccttttccaattgctcgaaagcaaagttgtgttgcgatgccgcaagaaagacgaggaaatggtggcgaggattttgcccgaatgtttggaggaatttcagcggacgtggggcaatcgaagcgaagtgaaaattgacaatgagtactttttgtccccggaaagtgcgggcggcgtcgaattgttggccaaagacggcaaaatccgcgtctcgtccactttggaagcgcgtctcgacctcattgccgacaaaatcactccccaagttcgcactgctctgttcggtcccaatcagaaccgccgcttcttcgactga

SEQ ID NO: 1671 - DNA, 759 bp, Heterodera glycines; identical to SEQ ID NO: 841
  cDNA sequence=SeqID_1454; peptide sequence=SeqID_1863

SEQ ID NO: 1672 - DNA, 567 bp, Heterodera glycines
  cDNA sequence=SeqID_1455; peptide sequence=SeqID_1864
atgaagctgattgaatccagcgacatcgtcaaattcccagacaatgtcactttcgcgctcaacaaccgtgttgtgactgtgaagggaccgcgcggtacgctcaagcgcgactttcgccacttaaacattgaaattatgcgagaaaacccgaagctgctccgtgtgcggaaatggtttggcatccgcaaagagttggcagccattcgcacagtgtgctcacacattgaaaacatgatcaaaggtgtgactgttggatttcggtacaaaatgcgctcagtctacgcgcattttccgattaacatcacgcttcaggagaacaacaccgtcgtcgagattcgaaacttcttgggcgagaaatttgtgcgccgtgtcggactaccgcaaggcgttagcgctgtaatgtcgaccaaacagaaggacgagttgatcattgacggtaccgacatccaaaaagtgtcccaggccgctgctcgcatccaacagtcgacgaccgtcaaaaacaaggacattcggaaattcctggacggcatttatgtgtcggagaaggtggccattgccgatgaatga

SEQ ID NO: 1673 - DNA, 447 bp, Heterodera glycines
  cDNA sequence=SeqID_1456; peptide sequence=SeqID_1865
atggctgacgcagctgctcaagaacaaaaaaagaaacgcacttttcgtaaatttgtctatcgcggagttgacttagaacagcttctggaaatgaatgagaagcaattcaaccaaatgattcccgcccgtcaacgtcggaagatgaaccgcggattgaaccgaaagcacaaatctttgctcgttcgtctgcgtaaggcaaaactcaattgtcccgagctgatgaaaccggagtgcgtgaagactcatttgcgtgatatgatcgtgctgccggagatggtcggctgtgtggttggcattcacagtgggaaggcatacaatcaggttgaaattcgagctgagatgattggatattacttgggcgaattttctattacgtacaagcctgtcaaacacggtcgtcccggaatcggcgcaacgcacagttcgcgtttcatcccactcaaatga

SEQ ID NO: 1674 - DNA, 526 bp, Heterodera glycines
  cDNA sequence=SeqID_1457; peptide sequence=SeqID_1916
gtttgagcattccttgatggttcgtcatgtgactgcctcctgctttcgtgcgccatggccttttgaaaaaaagggctcaactggatggcggaagaatgggccggttgttattgaatcgcacaaatggcccggtcaacaaaaggaattccccgagctctcgccaaaatttctaggagcaaactttaaacagctatggagatacaccggagtggcgcccacaggatttaatgaccccaaaactgacgattttgttcatgttcccgaaatggtgcccgaattggtcgtgccggacctagccaatttcgagctgaagccatacgtctcttacaaaacagatgcaaaaattgaagaaaggctacgcaattttgacaaaaaattgacaaaattcggtgggaatgagaaagcagcgattgccaattccaaagagacggaactatggccccctccgccaatcgacgcgaaaattctcttcgactttttctacgctgaaaaaattcgtcaggcatttgaaaaagggaagaagtaa

SEQ ID NO: 1675 - DNA, 529 bp, Heterodera glycines
  cDNA sequence=SeqID_1458; peptide sequence=SeqID_1866
ccgaaccgaagtgttggcacgggacgcggaaattgacggatttgacaccgccaaattcgttttcaccgacatttcattcgacgccacagatatggatcgcactgtcgttgtccgggagcaggacggaacgctacgaacggcgttgccggaagaacacgatcggatgaatcggctgttttttgtgcaacccaatcggcctgtcaacgaaccgccgctgtttgcaatgaccgacgaatggttacagaagacgctggaccgtgatgagcatgagtttgtgctggactgggcctgtcatttttacgagccggacgctcccaaatttgttgagctttgtaagtacatttttgaccacacattggaaaatgacaagttggacgtgctgtactccaccagacatttcggcacattggccttctatttggtgatcaacggcaaaatggacaaactgttggaattctatgagcagaagaacagaaatgacggcgtagatcaaacgcgacaactttggcagatactttcttgttattga

SEQ ID NO: 1676 - DNA, 571 bp, Heterodera glycines
  cDNA sequence=SeqID_1459; peptide sequence=SeqID_1867
agttcaaagtgtggcgatcagtcagaatggcgacttgtacatgacgaaacagccgacccacgggacggaagagtccgccatttggagatcacacatcgatcatccaatagcatgggaggaattttgctcgacattcgacgaatgtttccaatcactttgtgtttacgataatgaaacccttgcagtcgccgttgtttcatcgcctgttaatttatattcaaaacagtgcattaaatgggttgctacaaaagactgtcgaatcattgggtcattttccgctgccggcaaagacaatgggcaaatatttttcccgcgatgtttgcaaaagcatggtgactcattgctcattttggacaaaaccggaagaatacaaaaatttacacgggaagggcatttcgtagaaatatcagccaaaattgatgattatattgggaacggattcacaattcgagaggatgaggctgtgatcgcgtgcagtggtattgtgaaggatgaggaaggaaagaccatgtgcgacgattgggtggaaaacattcgcttggatgggtcgagatggacggaggaagcataa

SEQ ID NO: 1677 - DNA, 1250 bp, Heterodera glycines
  cDNA sequence=SeqID_1460; peptide sequence=SeqID_1868
cgctgattgccaaagtgaggccgtccagctacgggcaacggcgcaactactccagcattgacatttcggcggagaaatggttgatgcactacgacgccgactcgttggccaaactcgagaacccaccgtcactggcggacggaatcaatcgcgaattggagagggacattcgctatttgggctgtgaactgatacaatccggtgccattctgttacggttgagtcaaacatcagcggccaccgcacaaattctcttccaacgttattactacctcaaatcatttgtgcgctacaatttcgagcacatggtccaagcttgtctgctgttggcaagtaaaattgaagaagaacctcgaaaaccgcgtgacgtgctcaatgtgtacaatcgccttaagcaaatccatcatcggagaaatgcggtcgcatcacaacaccccgaagatttgcaaaagctgagcaaaaagtttgagcacttggagttgtgcagcaaaaggtaccaagaattgaagaacattgtgatcaaagcggaacgtcgactgcttaatgtgctcggatttgttgtgcacgttcaccacccgcacaaactcatctacatctatctgcacatccttgaccagctgaaaaatgatcaaaaaaagtacagtgcaagcgaaattcggaagagtcggcaactgttgcagaaggcttggagctttatgaacgacggtctgcggacggacatgtttttgcgctacaccccggagacaatcgcttgcgcatgcattcaactcgcggtccgaacagtggaccaaccaattgtgttgcccaccgaaccctttgcatggtttgaactgttcgatgccagtgaccgcgatgtgcgcgccatttcacagaccatttgggagctgtacacgcgcaaaaaggcaccaaatttgaaatgggtttcggaccatttggagcagttgtaccaaaaagcggtggttgagccggagaaggcgcgcaaggagaagacaatggtcgaaatgcgagacatcaaggaacagattctgcagcgcaaaagtgcgatgcttttcggagcaggaaaaaccgtcgctgacgacagatcgccaccgaaacgtcgtcgccgagacatggccggacaaaatgtcgccgagacaaaacgtcgccgggacagaacgccaccgagacaaaacgtcgccgagacaaagcgtcgccgggacaaaacatcgccgagacaaaatgtcgccgagaaaaaatattccaaaaattaa

SEQ ID NO: 1678 - DNA, 270 bp, Heterodera glycines
  cDNA sequence=SeqID_1461; peptide sequence=SeqID_1869
atgggcgacagaaaggcggtgattaaaaacgcggatatgaccgaagagatgcagcaggaggccattgagtgcgctacgcaggctttggagaagtataacattgagaaggacatcgctgcgtacatcaaaaaggagtttgacaagaagttcaacccgacatggcattgcatcgtcggacggaacttcggctcttacgtcacacacgagaccaaacacttcatttacttctacttgggccaagtggccattcttttgtttaagagcggctga

SEQ ID NO: 1679 - DNA, 1344 bp, Heterodera glycines
  cDNA sequence=SeqID_1462; peptide sequence=SeqID_1870
gctgattttgacggaaaagagatttggcttcgtggccgtctccacgactctcgcggaaaaggcaaaaattgttttgcgaaaattcggcagcggattcacagcgtacaggcggtgttattcgtgggagcagacattagcaaacaattcgttaaatttgtccaaaacattcccaaagaatcaattgtcgatgtttatgggcttgtggcgcgcacccctcagccggtcactgcttgcactcaaagcgatgttgagattaaagtgcacaaatttttcattgtctcgcaagcagagcctcggcttccgcttcaacttgaagacgcggttcggcccgacaacgaccaagaggaattggccgtagtcaaattggacactcgtttggacaacagagtgctcgacttgcgaacgccaacgagtcaggcaattttccgtttgcagggtggagtttgcgacgcctttcgcaagattttgtcctctcgcggtttcatggaaattcacactcccaaaatcatttctgctgccagtgaaggcggtgcaaacgtttttgaggtttcttacttcaaaggccatgcttttctggctcagtcgcctcaactttacaaacaaatggcaattgctggtgactttggccgcgtgtttaccattggctccgtttttcgggctgaagacagtaatacgcatcgtcatttgaccgagtttattggccttgatcttgagatggctttcaatttccattaccacgaagttcttcaaactattgctgagatgttcattgacctgttcaaatatttgcaaggcaattacattgctgaaattgaagcagtccgtcggcaatacccagccgagccgtttctctttacacaaagtccactcgttttgcaataccccgaagcggtggccatgttaaagaaagctggtgttgagcagggagatgaagaagacttgagcactccaaatgaaaagcttttgggtagattggtgcgtgagaaatatcaaacggatttctatgttctggacaaatacccattggctgtccgccctttctatacaatgcccgacccaaatgacaccaaatattccaatagttacgacatgttcatgagaggcgaagaaatcatttccggtgcccagcgtgttcacgactcggcaatgctcaccgaacgtgccaaactgcacgggatagacattgagaagattcagtcatacatcgacgccttcagatttggatgcccaccacatgcggggggaggaattggtttggaacgcgtgacgatgcttttccttgggttgcccaacgtgcgtttggccagtctttttccgcgcgacccgaaaagaataacgccatag

SEQ ID NO: 1680 - DNA, 193 bp, Heterodera glycines
  cDNA sequence=SeqID_1463; peptide sequence=SeqID_1898
ggttgggttcagcaatttggtctgcgggttggcagtaggaattgttggctctggggcggcacttgctgacgccgcgaacccagtgctttttgttaagattctgatcatcgaaatatttgctagcgctatcggactgttcggcatgatcataggcattgtgcagaccaacaaattcaacattggcaccacctga

SEQ ID NO: 1681 - DNA, 735 bp, Heterodera glycines
  cDNA sequence=SeqID_1464; peptide sequence=SeqID_1871
atgactttgcgtttgggttctaaattaaaattttccattttactccaaaatgttggaatcagaaaaaatccttttcgcaattcttataactatccgattacttttgaacacgtggttttcccgccaaataatcagtttaagttgccaacaatgcctcctgagcccatttatgacgagtcattgggagaaacgaagcacaaattgactaagcagtttattgaagcgaggggatttgagccaatccacacggagttgatccacaagcagtacggcttggtggcgatgagcggtggttttatcaaagccgaagactttgcatggattcagcaggaagtgaatgagaaattagtcgataagcaattcgccatttggcgcgttgacgccccgtggcttccgcgggtgcggcgtccgccatcaacaaaaaagggcggtgggaaggggcccatccatcactacgagacaccggtcagaaccggacgggtcattttggagctcggcgggtacatcactgaacaggaggctcgttctattttgatgcatctctatttgcatatgccattcccagtggaatttgtcagccaagaattgatggacaaacgcaagggattggagatgaaagtgcgtgcaaataacagaaacaaattcgattgggacacacttatcaaatacaacatgcagaattgcaaggcttggctgagtccgtacgatgtctattggaagtgccgatacaaatga

SEQ ID NO: 1682 - DNA, 267 bp, Heterodera glycines
  cDNA sequence=SeqID_1465; peptide sequence=SeqID_1872
gaaggagaaatcgtcggaatgatttcggtgaaacacgtatacgaaattgccaaagtcaaatctcaagacaaatctctcattggagtgccgttaaaagaaatttgtcaattggtcattgagagagcggattcgattggcatcaaagtgcaaaatgaagatttagacccggaagaatataggaaattcctggaacatcgtcaggaagttgtgcaaagacaattggaggaaatagcgaagcaagaagaggccaagctggccagaacatga

SEQ ID NO: 1683 - DNA, 249 bp, Heterodera glycines
  cDNA sequence=SeqID_1466; peptide sequence=SeqID_1873
atgtctgcgttaattccatttataattgttacactgttttgggctgtcattggtgcaggaggcccatttttggtaccaagtggtatgaacagagggatcattcaaacgatgatcgtactgaccgcagtctgctgttatatgttttggctgatcgtctaccttcaccagttgaaccctttgataggaccacaactgcccgtgaaaacgatttggtggattcacaacacttgggggaatgtgaagaattga

SEQ ID NO: 1684 - DNA, 678 bp, Heterodera glycines
  cDNA sequence=SeqID_1467; peptide sequence=SeqID_1874
atgttgccagcaataaaacctgcaaattccgatgggattgttttagacgcgcttccatatattgacgatcaacaatataccgatgaacatcgtcaattggcactgcaactgattcaggccgaatgcaaaaagtttcctatgacaaagaattacctgagaaatctgcctgaacctgactatgataagtttacaaccccgagaataatggaacaccaagcgaagatggccaacaaacaagaaattgagaaaatcgatttgttgcgatacgaagtgccatccccagcaaatacgagtcgatcgggcaataagaaagcgtggcttggtgccatcgataattgcagggcccaactgtcaaatcaatcgttacgcaaaatgaacttggaacttttggacgaatttggcccggaggcgtttttacggtcgaatcagcacctaaaaaagcaagttgagaaagaggaagccgaattgtttaagcttcgctcccaactctatgaattgaatgctcgccgaaaaagatcgcaattggatgctggagaaaggctggctgcgttgggacaaacatgggttgaactagtgacgaagaatgccgcgatggttgtcgccaatgacaaacttgagaccgaaattcgaacattggcgaaattatgtaaaatggactctggcatttgcaaaaaataa

SEQ ID NO: 1685 - DNA, 627 bp, Heterodera glycines
  cDNA sequence=SeqID_1468; peptide sequence=SeqID_1875
atgagtaccgcatccgaaagtggaagtgacaaaattgtgttccaaaagaatgttactgggcgaggtagccaggttttggatgacgccgagtttgttaaaatgtatgatcggtcgacttcgaaaaccttgaacacttcctcagccaatgacaacgcacagtcaaaccaacagaaagaacaggttcagaagtggaaagtcggtgatcaatgcatggcactctacgaagtggacggaaagtggtacccggccaaaatcgagcagatttcgcctgtaaaaaacacatgcactgtctcttacattggttacgaccaaaaggccattctgaagttggaggacattttgggtgaatccgatgttgaggctgccgatgaccatggcgatgagcgtgaagcggaagggacaagcggaacgactaagattgcggacaatgatgtgaaaaaagatgcatttccgatcccggatttatgtcctccaccaccgccatcgatgtttggaaagatagccgttgcgggcaatgagaaggaggcactgaccaacatgcttatgtcgtggtacatgtccggataccacaccggcttctaccagggtgttatgcatgaaaagacgacccgtcagaagccaaaatag

SEQ ID NO: 1686 - DNA, 555 bp, Heterodera glycines
  cDNA sequence=SeqID_1469; peptide sequence=SeqID_1876
atggttgtgctctcaaaacttggctcgccgcttcgtccgttttccaatgactatctcctttgccgcttccaggccttccgtaattatgcaatcaaaaaagaaaggccgccaccagcgaagattcaagtgccgccacccgcaaacgaaactggccattggaaatatgagcgtgactactcctatgacctgcgttattcaaacccgatcaacaaatactccagttttaccaggttcattacgctcaccgcaacaggccacaaagaattgtgggcacttttcgcccttctgatgctttcgtcatctctggcgataggaattgtgttctatagccttggcaagatcgaagtttgggttgatcgaagcacctcaactccgccgtgggattgggcgcgagtacgtgacaaatattggaaatttccgacggttctctatgacccgaccggcattactcatgttcgactcagcccgatggagaaacttcaggacgaaatgctggaagctgctaaagaacgtggaacccgcgatgctaagggctattgggttggaaagcaatag

SEQ ID NO: 1687 - DNA, 757 bp, Heterodera glycines
  cDNA sequence=SeqID_1470; peptide sequence=SeqID_1877
gcacgagggtttgaggggttattgttcccgtcggatcgaacggattcgaaaatcactgaagtttatgcattcgtataaatgtgcgcctaaaaggacagcaaaattcattgcgcgaaatgtttctgctgagttaatcggagatttaagatttctccaaattgccgtgttcgaagtcgaacgtaattgggcttacgcaatgcaaatgaaatttgagatgatcgatttgccactttctcgcaaaaaatttcacatgagacaaaaattgcgtcgggcagtgaaaagtgctcattttttacattcgcttattaatgacaatccgctggtccatgaggtcactcgtgttgaaactgtttcttacgtgtctttcatcttcggcagtttggaactcgaactgaaaaattggaaacgagccatcgaaacttttgacagagcaagaatcggttactccgaactgcttgaacaagtccgaaacagcgatctcagcgaaacttatgctacaaagtgtcgcgaggtcgaaaatctgctcattttgtgccgggctcagacaggagatgcgaatgttctgctttcaactgtcagttcagtaaatctcaatgcttctgaagatgaccggaagccttcgcccgagcaattgatagggaaggcaatcactgaaagcaccaaacagcagaagaaaaaagccaggatgatgaaagagccaaagccaatcaaacctttcttctacgatttggcagccaatttcaccgaagtatgttga

SEQ ID NO: 1688 - DNA, 1025 bp, Heterodera glycines
  cDNA sequence=SeqID_1471; peptide sequence=SeqID_1878
gcacgaggcgcattcaatccgttccgctaatcatcggccaattcctcgaagccgtcgattacgaccacgccatcgttggttccactactggctcgaattactacgtgcgtgtgctgtccattttggaccgtgaactgctgaaggccggctgcagcgtgtccttgcacaagtacagcaacgcgctggtcgacgtccttccgcccgagtccgactcgtccattcaaatgctgcgagcggacgaaaagccggacgttgtctactcagacatcggcgggctcgacacgcagaagcaggaagtgcgcgaggcggtggaattgccattgaccaatggcgagctttacgagcagatcggcattgaaccgccccggggagtgcttctctatgggccgccgggttgtgggaaaacgatgttggcgaaggcagtcgcaaagcacacaaaggcatcattcatccgagtggtgggcagcgaattcgtgcagaaatatcttggcgaagggcctcgaatggttcgcgacgtgtttcggctagcaaaggagaacagtccatgtatcattttcatcgacgaaattgacgccattgcgacgaaacgatttgacgcgcaaacgggcgcggaccgggaagtccagcgcattttgttggagttgctgaaccaaatggacggatttgaccaaacaaccagtgtcaaagttataatggcaacaaatcgtcaagacaccctcgacccggcgctgctccgtcccggacgattggacaggaaaattgagtttccaatgccggaccgtcgccagaagcggttggtgttcgccacagtgtcatcgaagatgaacttgagcgacgaagttgacttggaggattacgtggcacggcccgacaaaatatcttgtgccgacatcagttccatttgtcaagaggccggaatgtttgctgtccgagaaaatcgctacatggttctgaacaaagactttaacaaagcatataagcaagtggtgaagaaagacagcgacgagttcgctttctacaagtga

SEQ ID NO: 1689 - DNA, 1985 bp, Heterodera glycines
  cDNA sequence=SeqID_1472; peptide sequence=SeqID_1917
gttttatttctgaaatgaaaacttcaaagaacattaaaagcagaaaaactgcttcaacaaatgaagtgaaaaaggaatgcccagaaggcacagagaaccgcgaaaatgttgggacgtcgagcaggttaattgtgaagaatttgccgtgtggcaaaaagacgcgatgggacgaggccaaagttcgagcgcacttctccaaatttggcactttgacggacgttcggctgaaactcagcgaaaagaccggagcttgcaaatttgcctttgtcggcttttcatctgccgaacattgccaaaatgccatcaaagcgttggacggcgcgtacattggcggctcaaaacttacggtcgaagagtgtaaagcattgacaactgaccgaacggcgatcaccaaacaactttcgttgaacaaacgcaaaaaactgaggcaaaaaggcaaatgcgaagttgatgaggaggaggacaaagaagaagctgccgaagaggcggacgtcgactcactaattgaaaagcaaattttggacaccggacgacttttccttcgaaatttgccctttgtgtgctcggaagagcaaatacggcaacttttcgagccgtttggaccactcgccgagttggaatgtgtcgtggacaatgcgggcaaatgcaaagggtacgccctgtgcaccttcatcttcccggaacatgcggttgccgcgtggaaagcgttggacggcaccgtttttatgggccgaatgctgcacataatcgccggcgaagagaagagagtgcggacgaacggtgcagacgacgacagcacaaacgacggatgccaaagtgcgttccaacgcgaacggaacgaaaaacgcaaggcgaacgacgcggaaggggcgacagaggcggcgacaaacaatcgttgcacttggaacgcgctgtttcttggcactgacgcggtggcggagacattagcggaaaattatgaagtggagaagcgcgatttgctgctggttgacggcaaacagcagaacagtgccgcggtgcgcgtggcaatggccgaggcgcgtttggtgcgcgagacgcgcaaattcctgcttgacaacggcgttcggttggacgcgttcgcccagcggtggcaccttttgagcaatggtggcgacaacgtcgacggcactgaggacggaaccgcaaaaatgagacgttcaaagacgacaattttggtcaaaaatttagacgccacgagggaagggaaaaaggaatggctgcactctctgtttggacgctttggggtcgttaagacggtgctggtgccaccagtgcacggaatcactgcgatcgttgagatggcaaatgcccgtgacgcgaagtgcgcctttgaggcgttggcctactcgaagaaacacactccgagcgggggacgaccgctgtttttggaatgggcgccgtccaacgtttttgacgaggcgcaccccctcagagcaattggacattacggctatcagcaaaagggtcaaactgccgtcctttctgatgacccatcatcagttgggcatcagtccccggcggagacgaaaatggaaaaaacagacagagagagagggggagaagaggaaggcaaattggaggagaaaccgaagaaagaggagaaggaggacgagaagcacaccaaaatactcgtcagaaacgtgcctttccaggcgaatctcaaggagcttacgcagctgttttccgcatttggtgaactcaacttcatccgattaccaaaaaagcctggctccgaaggccaccgcggcttttgtttcgccgaatttctctccgtgagcgacgcgcaccgcgccatggacgcgctggtgcattccacgcatttgtacggtcgacggttggtgttggagtgggccaaaccgagcgaagaaagcgcggaggagaagcgacagcgaacgcaggacagaatggcaatggccgcgggcgttgccggggcgaagaaaaggccgaagatgcgatcattttag

SEQ ID NO: 1690 - DNA, 637 bp, Heterodera glycines
  cDNA sequence=SeqID_1473; peptide sequence=SeqID_1879
gcacgagggcacacagcgctcccgacaacagctgagctcatccgaggggttggccgagtccaccgcacgggaattgttggagcaacgggaaaagttggaacgggccgaacagaatttggacaccattcaccacaccactcagcacacacagcgcagcctgaacagcttgaagtcgtggtttggtgggctggtcagaaacaaactttcacgagcgccaaaagggttgggcacggcaaatgccaatgccaacaatcagcagcaacaactggaacagaccgtgcagcaacaacatcagcagcgtccgctgcatgcccatttggtgcagtcgtctgctgacgaatttgccggggccatcggtggcggaggcggcggcgttcagcccccgcaacagcactcgctgaactcctcgtcacgcgcgtacattcagggcactcgttgggaggcgatggacgacgaaattgacaacaatttggatctgatgagtgcccatttgggccgactgagaacgtttggcgtcgcgctgggcgacgaggtgcaggaccaaaatctgatgttggaccgcattcaaaagaagacggagcgcaacgacggcgtcatccgctcgcaggaggaccaaatgcggaagttgctcggctaa

SEQ ID NO: 1691 - DNA, 495 bp, Heterodera glycines
  cDNA sequence=SeqID_1474; peptide sequence=SeqID_1880
atgtccggtgacaattcggcactcattgcagcggagcaagcggcgtatggcccattttttggctcacttggcgtcactgcggcgatgattttcaccgcggccgggtcggcctacggcacggcaaaatccgggactggcattgcttgtatggctgtagcaaggcctgacctcgtgatgaaggcgatcattcccgtggtcatggccggcattgtggccatctacgggctggtggtggcggtgataatttccggccggctggaggcggccgggcccggctacaccatcgaccgcgggttcagccagttcgctgcaggcctcgtgtgcggtctgtgtgggttgggcgccggctatgccatcggcgtggtgggcgacgcgggcgtgcgcggcctgtcgcagcagccgcgcctgtttgtcggcatgattctgatgctgatcttctcggaggtgctcggtctctacggaatgattgtctcactgctgctaagttcttcctga

SEQ ID NO: 1692 - DNA, 1415 bp, Heterodera glycines
  cDNA sequence=SeqID_1475; peptide sequence=SeqID_1899
atggtttctatggtcgctgggagagtgcatcttttgccgcgcgccgcctcttttggcaaatcgtttctttcatcggatgcgactaaaaagcctgataagacttcctttggcaatttgaacgactctgatcggattttcactaatctttacggtcgacatgactatcgcctcaaaggcgctttggcgaggggcgattggttcaaaacaaaggaaattattctgaagggtcccaaatggattctcggcgaaattagcacttccgggctgcgcgggcgaggcggggccggctttcccagcggaatgaagtggggcttcatgggtaaaccgttcgacggtcggcccaaatatttggtggtaatgcagacgagggcgagcccggcacatgcaaagatagagagataatgagacacgaccctcacaaattgatcgaaggttgtcttatcgcgggcgttgcaatgggcgcgagagccgcttacatttacatccgaggcgaattttacaacgaggcgtgcattctgcaagaatcaattcacgaggcttacaaagcgggttacattggaaaggactgtcttggcaccggctacaacttcgacattttcgtccatcgcggagcgggcgcttatatctgtggggaggaaacggcactcattgagtcgttggaagggaagcagggaaagccccggctgaagccgccatttcccgcggacatcggattgttcggctgtcctacgaccgtaacaaatgttgaaactgtcgctgttgctcccgcaatttgtcgccgcggtggcgcatggtttgccagttttggcagggaaagaaaccgcgggacgaagttgtattgcatctccggccatgtcaatgatccgaccaccgttgaggaggaaatgtccatcccattgcgcgatttgatcgaaaggcacagtggtggagtgatcggtggttgggacaaccttttggccatcattcccggcggttcatctgtcccattgttaccgaagagcatttgtgacgatgttctaatggatttcgatgcgcttgtccaagtgaattcggggcttggcacagcggcggtcattgttatgaacaaacagtgtgacgttgtcaaatgcattgcgcgtcttgccgagttttacaaacacgaaagttgtggacagtgcacgccttgccgggaggggtgcaattggctgaacaaaataatgtggcgcttcgtccagggcaaaggagtgcccagcgaaattgacatgctgtgggaactgacaaagcaaatagaggggcacaccatttgcgctttgggagacgcagctgcttggccagtacagggactgatccgacattttcgtcctgaattggagaggcgcatggcgaaatatgcggagagtcatcccgaaataaaggaaactttagcgaccgcataa

SEQ ID NO: 1693 - DNA, 399 bp, Heterodera glycines
  cDNA sequence=SeqID_1476; peptide sequence=SeqID_1881
atgacgaaaaagagacgcaacaacggacgcaacaaaaagggacgcggccacgtgcagcccatccgttgcaccaactgcggccgctcatgtccaaaggacaaagccatcaaaaagtttgtcgtccgcaatattgtcgaggcggcagccgtccgcgacatcactgacgcgtcggtttacgatcaatacgcactgccgaaactctatcacaaattgcactattgtgtctcgtgtgccattcacagcaaagtcgtgcgcaatcgttcgcgtgaagcgcgtaaggaccgaaacccaccgccacgttttggccaacggtctgccgtcgatcgtccgcaacgtccggggggagcggcccctggaggccccggaggcgttgggatgatgcaagcgattcgaacttaa

SEQ ID NO: 1694 - DNA, 1266 bp, Heterodera glycines
  cDNA sequence=SeqID_1477; peptide sequence=SeqID_1882
ggcgttggcattttcgaatcggacaataagctgagcccccgcccgttcttcccatggacagagatcaaatgcatttcgttcaaaaacaaaatgttcaccatttgtactgcggacaaaagcaaaatcaagttcagggcacaggacatgtccatcaatcagtcacttctcgacctctgtgtgggcacgcataacctttacctgcgcagacgacagcccgacctgctcgaggtgcaacagatgaagcagcaggcagacgagcagcgaaggcgcagaatggaggagcaggtgcggttgcaccgcgagcgtgagcagcgcgcgcaggcggagcaggagagggaccgctaccgcgcagaactgaaccatctgtcggaacagttgagcgccatgcagaatgtgatcagaagtgccgaggagacgcaagtgttgatcgcggaacgggcgcgtctttccgagcaggaggccattgagcaggcacgtcgtgccagcgaagccgaggcggaagcgcaacgcgcaaaactatcccagctgagggcggaagagaccaaaatgttgttggagcgaaaaatacgcgagactgaaatggccgcacaacgaatggctgcgcttcagcaccaacaacagcaaaaacagcagcagcaacagaatggcatcacaacgcccgggacggcaacagttgcgcagcaacaacaacagcagcaacagatgcagcagccacctccgtaccaagaagtggtcgagaatcggcaacaaacgcagcagcagcaaatgccattggccaatggtgtcggcgccgcagcagtgccattgaacaggccgacgacggcacaatcgccgaagaacaacggcgggacaaccacacccaataacaacaacaacaacaacaacaacttgattgtcgtcacttcgcctcagcaaatggcgcctttgtatttcggcggctgtcaatatgaaatggccacgacaatgtccgactcgcgcacttccgtcgccgccgaattgcagcacattttcgctgagctggaaatgtccaggagtgagtacaacgagcggaatcagtcgctgcgcgaccgtttggccaatttccgtgccgagttggactcgctgaagcgcgagggcaccgacacggaaaatgatcggctgttcgcccaaaaagtgatggccggcgacgcattcgacaaattttccacgctgcgaaagagcatcatcgggtcgccaaagtcacgcgtaaaactattcgacgaattggctccaatgaatggacaatga

SEQ ID NO: 1695 - DNA, 744 bp, Heterodera glycines
  cDNA sequence=SeqID_1478; peptide sequence=SeqID_1918
gtccaattaagtgaaaattttacagcaattataaatatggacacaaccatggaacaaccggctgaagatgttgaggacgtacagttggatttggggaagaaaaagaagaagaaaaaggcgaagaccacagaactcaaattgtcagaagatgagcatgaggaggaaaaggaagtcactgcactcgccgaaggcgttggccgtacaaatttgctcgacgcaaaaaaccccgacgcgtggacggactacaactacgacgagatgctggacatggtcttcaacatcatgcgggagaagaacccagaaatggtttccggcaagaaaaagacatttgtgatgaaaccgccggaggtgcaaagggcgggcagcaaaaagacggcgttcacaaatttcactgaaatttgtcggctgctgaagcgtgacccgaagcatgtgctgcaatttcttatggccgagctgggaacgacgggctcaattgacggcaatcagtgtttaattgtcaagggcaagttccaacagaaacactttgagaatgtgctgcgcggttacatcaatgaatacgtccgctgtcacacgtgccgctcctcggacaccgagttgaccaaggatgtgtcccgcctgttcttcatccaatgcaaacggtgcgggagtcgtttcgcggtgtcctccataaagtcaggctacacggcaatggtgggcaaacgggcggcactccgtcgggcggccgaagcgacggcgggcaaatga

SEQ ID NO: 1696 - DNA, 318 bp, Heterodera glycines
  cDNA sequence=SeqID_1479; peptide sequence=SeqID_1883
atgcttctccgtttctccctcactgttcaacttttgctgcttttcttcgcttttgaagtttttggcgctgaaccgccagaaggtgcacaaaatgaagaaggccaacgagacagcaaaagattggaaatggccaggaaagggctgaacgttcacatgttttcctcccccaatttcgccccaatgtttggcattatcgccggcctttccgttgttcttatcattgccattgttttcattgtcgtcggattgctcagcatggaacccgcgaaggattcgattatctatcggatgacaacaactcgcctaaagaaggactga

SEQ ID NO: 1697 - DNA, 577 bp, Heterodera glycines
  cDNA sequence=SeqID_1480; peptide sequence=SeqID_1884
atgtcccttcgcttcttcggtttccacgattcggtcagcgaagggaaatttctgtgggagattctcacgcaactgagagggctcggagttggacggtgtgtgaccaaaagcgaatggatgcgcagatggcctgaccaaccgtcctacatgagaatagtcaaggctcgtccgacgatggaccgttggctgcaggagggaagcctttgggccgattggaccttccgcggcaaacatttgggcgtgtacgaattcggcacggacctgaacaggtccgactgggtgctgatccataagcacgaggagaagaagttcacggagaacaggcagcagatgggcacgctgaacattcccagcactttccctgtgcctcctttgcagcaattgctgtccaaaaaatgggccgagaaatgcggcggctccgaggcggcggtgcaccacaaaaaaagggcgccactggacgtctgtctcgacccgaactttgaaatgtatcgcaaattcatcaaacgggtggagccaaagaaaatgtccgtctcaatttacgacgaaattgaccctggcgtcttcctcgacctgtacg

SEQ ID NO: 1698 - DNA, 943 bp, Heterodera glycines
  cDNA sequence=SeqID_1481; peptide sequence=SeqID_1919
gtcacattttatggcgttaaataattgttttactgagaatagatatccaaatgaatgcattctttcctatggctcgatcgctgtttcggatccgctcgatgcgttcgtttgttgtcgtttttccatccatgaacaccaggagaacatctgcgcatttggcacagaatatggcagagtagtgatttgcgatgtgacagctccgattaagggcgaggattttatcaaacatcgatttgccactggaaaaaatgctgtgttcgacttatgtttcattcctgatcgccctaatttattactttctctttgtggtgcctcaaacctagagcttttggacatcgaacggtcgtcgtccatttttttgcttggtcatcgtgacacggtccgatgtgcttccgtgtggcctgaaaatcccttttgcgttttgactggttcaagggacggtgacattttgctttgggatttgcgtgaaaaaccattgaaaagagaaattggtcggaaaagtgtgtcaaattctgtttcttctcttcgacgatatcaaactgctcatgaggcaaccattgcaataacaggccttttgcacatgagcgagaattatttcatctcttcttcatcgtcatcttcaagtggtattagaatttgggatttgcgatatcaaatcgcttcttcgccaatccgctctcttttcgttccccagaagatgagcaaagaatcgggcgttgcctcaatgtgttgggaccgattccgttcttccttttttgcactttgcactgacaatgccatttacgaatatgtcccctctcttaacagttcatttccagtgcgaagtttgcggacaaattttgtcaattcattttttgtacaatgcgctgcttcacctttctctgaccatcttttatgtggctcctctttttcaaaggcttttatttgggatttacagttttag

SEQ ID NO: 1699 - DNA, 513 bp, Heterodera glycines
  cDNA sequence=SeqID_1482; peptide sequence=SeqID_1885
gcctcttcctctgcaatcaaaagggggagtgatttgacctccgacgaaatgttcaccggggaaggcttttcccagcaaggcttgcttaattacgctgtcggattcttcaaaaaaggtcgtctttttttgttaccggtggacaaaaccttcgaaatgcgaaagcccttgcgggggaccattgagcgcgagtcgacggcgcgtaccaccgcattaaagccgtcttcgtccgtcttctccacttcgacacgttccgttgccgctgattctgctccttccggcactgcgtccgcttcgtcgtcttccgtcgctgttgccgcgccgttgcgcattcgctttgcacgtgccgaaaatgacttgcaacgacgccgccgagagcagtcgtccttctacaagcagaagctggtggagcaggaccagtggattccgctcaaagtggagcatagagatttgttggaaatgtacgaaaaggacatcaacaaggtgctgctgtcttcagaatgtccgcccaagtag

SEQ ID NO: 1700 - DNA, 472 bp, Heterodera glycines
  cDNA sequence=SeqID_1483; peptide sequence=SeqID_1886
ggccgtggtaagccgaatgtggtatattggaaaggagacttgcaaattcttccacggtgctgtgaaagtcttttttgacccaaattggcaaatcccaaagaccaagcttgatccaagaatgcccgcctatccaacccaacttcatgaatggcttcgcatgttcccctggcgtcattactgggcttactacccaattctgcgcaatttttgctacgtcttcgcctcagcttttgtcgttacgagcattactcaaccgacaagcgttaaaatcaccaaagaacacgtgatcaaccacgaattgcatcacatcgaagcgaaaatgctccacgcgtacacccaacggaaggaggacctgaagtacttcaaggagaacgacgtcatggccaaactgcgcccgaaaaactttgccagggatttgtcaatgggcgacttcaattacttcccctgggggtattccttcggagcgcactga

SEQ ID NO: 1701 - DNA, 262 bp, Heterodera glycines
  misc_feature (165)..(165): n is a, c, g, or t
  cDNA sequence=SeqID_1484; peptide sequence=SeqID_1900
aacctgtacacttgcaagggacagctgcacttttctcctccctttatgctacgacgaatatctcctttatcgtcctcttttcgggctcgacgattcggccggcacgctgggtgcaatgactcccccaacgcccgcctcgctgcttttctccttttggcccgatanaccccatattccccctttcgaggctatcgttggaggtatctgccgcgtgctttacgacactctccgtccgctggtcgtccacaacccgcacctctaa

SEQ ID NO: 1702 - DNA, 489 bp, Heterodera glycines
  cDNA sequence=SeqID_1485; peptide sequence=SeqID_1887
atggcatttcgcgcactttctttcgcccgtcgtccgtttacaacttcgtccatttgccgtaaagaaattgacctggtcgccggtgtttatctgaacaaagttcgggaagtggttggcaaacaaagtgagattctcaattcgcctcagttgaagaagcagttggacgaccaactgaaccgtttggcccaaaaattccatttgccggatgccgacgcggttgccaagttgggccttcagtttaagggagcaagtgttgtcagttcggtggaccaattggttgatgggggacagtcggtggatgcccagcttaatgcgcttaatgacagtcgtgccaaatatgaagcggagcagaaggggaagagacaggctgaacaggagcggatcggcgcaatttctggtgatgcggactatgcaaaagagtttttcccaattccgccgcctcatatcgaagcccagcaattggccgccgccgccaaagctgcgcaatga

SEQ ID NO: 1703 - protein, 382 aa, Heterodera glycines
  cDNA sequence=SeqID_1309; coding sequence=SeqID_1488
MRTRQGTTRGREQALEIYEQYQEVRRGFAGQIGERRKQSEQLRSNEVNTSTTLQELGFGPDEDDDLHNASHFSQPTPANAMAASTSAGYDIPQRLKTLHNLVIQYAAQGRYEVAVPLCKQALEDLEKNNGHDHPDVATMLNILALVYRDQRKYKEAAALLNEALAIRERCLGEDHPAVAATLNNLAVLYGKRGKYKEAEPLCKRALEIREKVLGNDHPDVAKQLNNLALICQNQGMYDEVEKYYRRALEIYESKLGPDDSNVAKTKNNLSSAFLKQGKYKEAEMLYKQILTRAHERQYGRVTDENKPIWMIAEDREDSKQADSGIYHENLQVSMKVDKYSKSLWRMFGLRRFQKSSTLFTSSTPSLFESLRCSDLLVGRPSA

SEQ ID NO: 1704 - protein, 59 aa, Heterodera glycines
  cDNA sequence=SeqID_1317; coding sequence=SeqID_1490
MVNRLLDHGILVTRARYLLDKEKFCPKLTIKVSCRADLNGDELENLGQKLRLTFATLEF

SEQ ID NO: 1705 - protein, 486 aa, Heterodera glycines
  cDNA sequence=SeqID_1447; coding sequence=SeqID_1492
CALKANMIQAWRTHFVLEEGMLEVECTSLTPEYVLKASGHVDRFIDWMVKDKQTGACFRADHLVKNQAETLIRDKKTDEKTKSELMNVLVMLDGMSCDDLHEVIKKFNFKSPLTGGDLSEPVSFNLMFPTEIGPTCDQRAFLRPETAQGIFINFKRLLEFNQGRLPFAAAQVGSGFRNEISPRQGLIRVREFTMCEIEHFVDPTDKRHPKFEKIAHLELTLFPACNQMESKNPQKISIGNAVKLGIVNNETLGYYMARTHLFLLSVGISPDKLRFRQHLSNEMAHYAQDCWDAECFTSYGWIECVGNADRACYDLHQHQKASGVKLVAEKKLGAPKQIEVVEAVPNKQLLGKEFKSDSKQILAALDDLTEAQIEELEREIKSNGKYRLSLCEGKTFELNSSMVEVKRFEKTVHVEEVTPSVIEPSFGIGRILYAVLEHSFRQREGDEKRCYLELPPLIAPIKCSILPISSNERLDPIIFAVRDQLT

SEQ ID NO: 1706 - protein, 115 aa, Heterodera glycines; identical to SEQ ID NO: 1224
  cDNA sequence=SeqID_1269; coding sequence=SeqID_1493

SEQ ID NO: 1707 - protein, 147 aa, Heterodera glycines
  cDNA sequence=SeqID_1270; coding sequence=SeqID_1494
MALKRIQKELQDLGRDPPAQCSAGPVGDDLFHWQATIMGPPESPYQGGVFFLTIHFPADYPFKPPKVAFTTRIYHPNINSNGSICLDILRSQWSPALTISKVLLSICSLLCDPNPDDPLVPEIARIYKTDRERYNTLAREWTQKYAM

SEQ ID NO: 1708 - protein, 92 aa, Heterodera glycines
  cDNA sequence=SeqID_1271; coding sequence=SeqID_1495
MATSEAPNYALYEHAVGYTLFKIKEYEDIGQIQPEVQSAMTDAQRFQTIVQVHAFDPFRNTEAALENANSIAEGIIHVDLLNFLEANLPKKK

SEQ ID NO: 1709 - protein, 302 aa, Heterodera glycines
  cDNA sequence=SeqID_1272; coding sequence=SeqID_1496
MASNLTVKVHPIVYMSIVDAYERKSSSNINSRVGTVRSVETTENRALGTLLGFYEKNVVQVTSCYAVPFRETSDDIPEINDALNRQMWHMSKRTSPSEQIVGWFFTVPDLSEMCPHYHGYYTGLVNETPRKEPPPIILITMDFTFSGESADRLPIKAYAAREAGVPGKGATQATIFYPLKVEMDVFPGESVALSFIMRGLDSERREIKFANSQEQLLENGEQMVDWLEKMLGYVKRVLDGGETADPLMGRKLMEIVSLANTQLPAEKMKCLVEHSLRDYLMVSLLANLAKTQLALQEKVTSS

SEQ ID NO: 1710 - protein, 508 aa, Heterodera glycines
  cDNA sequence=SeqID_1273; coding sequence=SeqID_1497
MASYHVAIAADERQKYRSFWDQFSGRADNSAMMLNANADQIESLDRENILALLPSVKGKFVVDIGAGIGRFTTVFAQSEASKVVATDFVASFVDKNRQRNGAYANVVEWRVGDATGLQFDEGSVDLVFTNWLLMYLADQEAVQFVANALQWLRPDGYLHLRESCSEPSTKKSADHSTTTTTTSTSSSSSSSLHNNSKPNPTRYRFSSAYIQLLRSLRHTDVQSGTQWRFDVQWACSVGVYIERQSNWRQVHWLAKKVRVTSAENSIPKSIGSLATQFADQWPTEQRQFDGRMDEQKPGWMQNVLDKCVAGIKLSGDGIVFGFNGRQTIKEFGVDPQGLAKHFDRRVWVVEMDPFAYRNALSRANQYADRRVRHAWHSNFVSALDFWRNVGQRMPMFAAVIGTELLAQLQDEQVFGKFAQMLENGAQFATVEVLGTNQTQSIDDKKLKATLDLLRSHFDVVELEQMQQLENGINLLVIKATKHQSLASKIYEDGMMAHCQKRHLLMGGF

SEQ ID NO: 1711 - protein, 350 aa, Heterodera glycines
  cDNA sequence=SeqID_1274; coding sequence=SeqID_1498
MHIYKDPYAPPLAPKVPVDPPPWFPSWKEYKGRTEWWASLGYKDLDLKRGLTTGFYPFFEERDIRYVDSKVPDGTSMVGPQGKDSRYHQSKMVKWGIPGKFEDFQKQIRENCSQYKQIAEKWDLSDEHPGIAVNPSLDSIIRQKYRPIGTVFPLFPKILAWPRFWDKPMNEGCFEKGLALAKYSLPITWIAYAGALRGYDPPATNVGRFEAVEFIIQSFRGWLFSSRMILPAFYSFTFGLTSCTSATFRDEDDSWNWIAASAICGLAHATIRNNIPQGFALAAIGSLLGVSFQAVRISHNGFGMVHNRMTQGFLPFTGPLDWKHIPTDAVDVFFEFGAESFTFRHFLPKA

SEQ ID NO: 1712 - protein, 611 aa, Heterodera glycines
  cDNA sequence=SeqID_1277; coding sequence=SeqID_1501
MERLESVLSQTFQQMMTNGKKLVLEQIITTIASVADAAQDHFAKFYGNLMPPLKYIFENAKDDNLKLLRGKTIECISLIGMAVGAELFETDADSVMQVLLSSGVKFENNDDPQISYFISAWARICKILGKGFAKYLDMIMPAVLSAADFKPSVALVDGKDTDDNEDWDYMPIDENRSLGVHTAGLEDKVTACEMLCCFARELKDSFAAYVERVMQLMLPLLSFLFHDGVRSAAAECLPCLLVCVKGYGDEYVRQMWSVILSNYIIAIGKETDLEVLCEMLNGIAQCVEDFGGNDAIVTDQDVANIFCVIYQQIENFDKRRAEREKKSKEEEHDEEDQERLDEIIELETSVLARVSDIIHYLFLTKREAVIPHFDKMAQIFAALLNPRRPFHDRQWGLCIFDDVIEFGGELSMRYQNIFFQPMVTALADKYPEVRQAAAYGCGIMGLKGGQNYAKHCAQMLQPLINAIEKNGSRSTEEDTRATENAISAVAKILKYNATEVNFNEVVPRFVGWLPIWNDEEEVPYVFDFFCDLVESQHDAVREDPSRVFHIILNAFSHGAFEDDSAEEMRLVKSRMKGIMAHIRANEQLFTQIVQSLQLNTHQRTVLEQILA

SEQ ID NO: 1713 - protein, 474 aa, Heterodera glycines
  cDNA sequence=SeqID_1278; coding sequence=SeqID_1502
MVSTTNEQDEEQQNWLMKQDLQKLNPEKLTPLTEEVISRQATINIGTIGHVAHGKSTLVKAISGVHTVKFKNELERNITIKLGYANAKIFRCSNIKCPRPHCYRSAGSSTPDRFPCERPDCGGDFVCVRHVSFVDCPGHDILMATMLNGAAVMDAALLLVAGNEPCPQPQTSEHLAAVEIMKLKHLLILQNKIDLINESQAKDQHDQIKSFVEGTVADSAPIIPISAQLKYNIDVICEYLCKKVPIPPRDFSSDARLIVVRSFDVNKPGSEVEHLKGGVAGGSILKGILRVGQEIEVRPGIVTKSADGSVQCRPIYSRIVSLFAEQNQLQYAVPGGLIGVGTQIDPTICRGDRLVGHVLGAVGTLPDIFTDIEVSYHLLRRLLGVRTEAGKKAAKVSKLAKGEVLMVNIGSLSTGGRVIAVKGDAAKIALTDPICTESNQNIALSRRIEKHWRLIGWGTIRRGTTIAVPQPSIG

SEQ ID NO: 1714 - protein, 573 aa, Heterodera glycines
  cDNA sequence=SeqID_1279; coding sequence=SeqID_1503
HDDRVPAFTELTLIRHSPDSENIQMQFAAFFIYSGLGRLMRPVRNLLFDQIEQIGIFEQVYLSIIIDPEEAEPGVTMHQELHPSSLFSFAGNLIPFPDHNQSPRNVYQCQMGKQTMGVPVHAWQTRTDNKMYKLQTAQKPLLKLEAHDKYEMDEYPLGTNACVAVISYTGYDMEDAMVINKASYQRGFAHGTVVKVQRISLVDRSTGGFGQNKNAEMVFLGKPNERNYGIGADGLPIEGRLYQQGDCYYGTFNLVSGQFNEHKFTNSEPAYCGLVRIVQEADHKNKNVHVLIQWRIQRNPIIGDKFASRHGQKGINSFLWPPESMPFSESGMVPDIIFNPHGFPSRMTIGMMIESMAGKAAAMHGTSYDASPFVFNEQNTAIEHFGKLLAKSGYNYYGNETMYSGIDGREMKVQIFFGIVYYQRLRHMIADKFQVRSTGPVDPITLQPIKGRKKGGGIRFGEMERDALIAHGTAFCLQDRLFNCSDRDEAEICARCGSIVSVTRLRPHIAMSKYKTRPHQTQKFTRSHCSICLREDQVFQVQVPRVFRYLCAELGAVNVKVQLSLSHLRENRH

SEQ ID NO: 1715 - protein, 1082 aa, Heterodera glycines
  cDNA sequence=SeqID_1280; coding sequence=SeqID_1504
RKKVAELLKLEETIQKKWQKAKVFEKEAPEEDKSSTPKYVVTFPFPYMNGRLHLGHTFSLTKCEFSVGYHRLRGRRCLFPFAFHCTGMPIKACADKLLREIEQFGNPPVFGYQSSEEMSKNGTELAKQEEEVDQIIKDKSKGKKSKALAKTVAAKFQWQIMQSLGLNDAEIAEFSKSEHWLTYFPPKCMADLRKMGLAVDWRRAFITTEANAYFDSFVQWQFRKLRSENLIQFGKRYTIYSPKDGQPCMDHDRSTGEGVGPQEYTLIKMQILEPKPKVLSNVSASNGKPMFLVAATLRPETMYGQTNCFIHPDITYSVFFVGTNDEEIFIATERFIRAARNMAYQGMTAENGKIRFVPGVERVKGAELLGCALKAPLTSFERIYALPMLTIKDDKGTGIVTSVPSDAPDDFAALMDLKKKKPLREKYGILDEMVMPFEPIPILEIPEYGRLAAVHMCEKLGINSQNDRLKLEEAKKELYLKGFYQGVMLVGNYRDQKTEVVKKLIQTDMIRDGQACKYVEPEKKVISRSGDECVVALCDQWYLNYGDPAWKEATRKCLASLNTFSDEVRRNFEHTIEWLHEYACSRSFGLGTKLPWDPQYLIESLSDSTIYNAYYTVSHLLQNDIYGAETGELGILPPQLTDAVWDYIFMGIPYDSTKMPIEEAKLKRMRHEFEYWYPVDMRVSGKDLIQNHLTYYIFNHVAIWRKQPQFWPQGIRANGHLLLNNEKMSKNTGNFLTLFDAIELFSADGMRFTLADAGDGIEDANFMYEMADAGILRLYAFLSWASEMVEACAKGELRKDGIETFADKIFNNEMNRLILVTGDHFERTLFKEALKTGFFEYQLARDNYRQLCGSDQAMSAALVLRFIETQAIILSPICPHVSERAWELLGKPGLLVTDARWPVTAPAIPLLVDQSNFIHNTVHEFRLRRDAKLCPKKKDPKKQLQPPKSATIYIAKRYPSWRGKLILELGQMYTDNGTLPDNRTLLEKLSKPESAEEKKERMSFVQMFRDRIAQRGIFAVTSEEEFDQKAALSQISDFLLSTLQLEEVKFADSANAPSDVIRNSCCPGAPLIMYDFVETTNN

SEQ ID NO: 1716 - protein, 1049 aa, Heterodera glycines
  cDNA sequence=SeqID_1281; coding sequence=SeqID_1505
MGRIKLDGRIRAQIERGVANRWRSLFIIIGDKAKDQAVTLHHILAKATTGGRPSVLWCYKKETEFSSHRKKRIKELKKRKESGLFQSKEDNLFEQFILSTQISYCYYADSHRILGNTFGMAVLQDFEALTPNLLARTVETVEGGGLVVLLIQSVTSLKQLFTMSMDVHKRYRTEAHADVVGRFNERFILSLASCANCVVMDDCLNVLPISSSVLNMANLPPVVAQQKSAAGGDVSSELARLQQSLADTKPIGPLLHRCRTLCQAKALLRLLDLVTDKMSNSMCAITAARGRGKSAAMGLAVAGAVGCNLTNIFVTSPTPENVRTLFEFVLRGFDAIGYQEHADFDVVRSLDPQTDKCVTRVNIFRRHRQTIQYIHPSEFVKLGQAELLVIDEAAAIPMPLVKQLIHGNFLVFLASTTNGYEGTGRSLSLKLLEQLRRGGGGGERGTTTAATGAIGDAAETATTARRRPLFELTLEESIRYAMNDPVEDWLNQTLCLNSQQSLPTSLTGTPAPDKCELYYVNRDSLFSFHKAAEVFLANLMSIYAAAHYKNSPDDLQMLADAPAHHLFVLMAPVPADQSSVPQILAVVQLCLEGSISKQSVTNVRDKGKKRAAGDLIPWTLCQHFLDDEFPTLCGARIVRVAVHPNFQGMGYGSQAVRLLLNFYGRRPRHVSTTTAAAQCQNGEDKNGGNDREEDEEMSRVQLVDDGDLHQLLLHDEQISPRANLPPLLVRLADYRRHADQLDYVGVSFGLTLALLKFWKRLGFVPVYLRQNTNDLTGEHSCVMVRKIAIAAAGGGGGEHGEDDGNGRMDGEWRHHYGVLASAGVAASDATLNSDGTWLSAFFVEFRRRFVSLLGTSFSAFSPHLAFSLMFMDSASIIGCSVQQRQDEQQAENGLLDRAELRLRLSDLDLRRVAQYCRNLADLALISDLLPTIAGLYFTARVDTNRAPLDLSQAAVLLGVGLQRKMVETVANELALSTSQTHALLNKAIRRLSEYFDSICREALEQQQQQHNTNDRQQHIATEAEGKFGAKTKSDECPAIKKLKISHFVK

SEQ ID NO: 1717 - protein, 264 aa, Heterodera glycines
  cDNA sequence=SeqID_1282; coding sequence=SeqID_1506
MGKNKKPFIDRKSAVNYTLNNRELEETQRISDYKSFSFRSLDKRFEGIYEDYANEEEEGAEEMDDEEGQTGADSAIFRSLLADGQSQRSCEERFHRELPDSELKGAVLRYAKAMEIGKGRAEPTEDILVDSAKRSRWDCESILSMHSTLYNHPTEIREPMKVIGRRRGRTTKEKEMANLEETEVDGDQRDGPPAPSVRTRTSMVSVIRPKGETTEERRMRKIAVKEERRERRKEKKANKETFRAERLKLEAQRKTNQPKTRQIH

SEQ ID NO: 1718 - protein, 382 aa, Heterodera glycines
  cDNA sequence=SeqID_1283; coding sequence=SeqID_1507
FAGESAICCHHKSLNQTSSLRLTYSAFHGVGSKFVRRMFAEFGFPSENISYVKEQDKPDPDFGTVPFPNPEEGHRVLKLCIETANANDSTLLLVNDPDADRLQLAEKEANGEWRVFSGNEMGILLTWWAWTNWRAANPTADSSRVFVLHSAVSSQMVATMAKKEGFKAAHSLTGFKYIGNLAHKLRSEGNTVIAAWEESIGFTPGTTLDKDGVSSAAVFAEMANWLRTQKGVSLREQLFRLFSIYGFHLQRNSYWGVKSTEVTKKLFADLRSDYPETIGQNFDVKFVRDLTTGYDNAQPDDRAILPLSTSSEMVTFTLVDGSAVTLRASGTEPKVKYYIELRTEPGKEEKDLSSVLEQLDQLESDVVDTLLQPTKYGLISRI

SEQ ID NO: 1719 - protein, 436 aa, Heterodera glycines; identical to SEQ ID NO: 1100
  cDNA sequence=SeqID_1284; coding sequence=SeqID_1508

SEQ ID NO: 1720 - protein, 191 aa, Heterodera glycines
  cDNA sequence=SeqID_1287; coding sequence=SeqID_1511
MIPLNLQIAESALKVLQTKTPGGEIEQSATAGAHCTNNTCKKVFTGPESDAEECVFHPGNAVFHEGLKYWSCCGRKTTDFTTFLDQLGCTRGKHCWKKKEIVTNAREDWFQRGGQVHITIYCKGALPSETSAKSDGLTLEVTINGSTKRYELFGEIAPSESVVIISERKVEIVLKQVAKIGWPKLCYDPPN

SEQ ID NO: 1721 - protein, 650 aa, Heterodera glycines
  cDNA sequence=SeqID_1288; coding sequence=SeqID_1512
MPAKANAIGIDLGTTYSCVGVFQHGKVEIIANDQGNRTTPSYVAFTDTERLIGDAAKNQVAMNPSNTVFDAKRLIGRKSDDPAVQSDMKHWPFKVVQGEGARPKVMVEVKGEDKAFFPEEVSSMVLIKMKETAEAFLGQTVTDAVVTVPAYFNDSQRQATKDAGTIAGLNVLRIINEPTAAAIAYGLDKKGQGERHVLIFDLGGGTFDVSILTIEDGIFEVKSTAGDTHLGGEDFDNRMVNHFVAEFKRKHKKDLSSNPRALRRLRTACERAKRTLSGSTQASIEIDSLFDGIDFYTNITRARFEELCADLFRNTMDPVEKALRDAKMDKSQIHDIVLVGGSTRIPKVQKLLSDFFSGKELNKSINPDEAVAYGAAVQAAILSGDKSETVQDLLLLDVAPLSLGIETAGGVMTSLIKRNTTIPTKTSQTFTTYSDNQPGVLIQVYEGERAMTKDNNLLGKFELSGIPPAPRGVPQIEVTFDIDANGILNVSAQDKSTGKQNKITITNDKGRLSKEEIERMVQEAEKFSKEDEVQRDRVSAKNALESYCFNIKQTMEDSNLKDKISEDDKKKVLEKCGEVLAWLDANQAAEKEEFEHQQKELEGICNPIITKLYQAGGAMPGGPMPGGGMPGGGGAAGAGGAGGPTIEEVD

SEQ ID NO: 1722 - protein, 446 aa, Heterodera glycines
  cDNA sequence=SeqID_1289; coding sequence=SeqID_1513
MSAAVSSSRPMEDWKSELAMPDKDLRYKTSDVTATKGVEFEEFGLTRDLLKGIFEKGWEHPSPVQEASIGIALTGQDILARAKNGTGKTGAYCIPCIEKIDPSKEYIQAMIIVPTRELALQTSQICVELSKHLKIKIMVTTGGTDLRDDILRLNGIVHLVVATPGRILDLMEKGVANVAYCKTIVLDEADKLLSQDFQGVLDRLVQFLPKDRQIMLYSATFPRTVATFMEKHMSKPYEINLMEELTLLGITQFYAYVQEKQKVHCLNTLFRKLQINQSIIFCNSTQRVELLAKKITELGYSCYYIHSKMAQHHRNRVFHEFRQGHCRNLVCSDLLTRGIDIQAVNVVINFDFPRNSETYLHRIGRSGRFGHLGIAINLITFEDRYNLRRIEKELKTHIDPIPKEVDPKLYVAEFQMDHTKFDCGNVVDGAVLNNGVDQQQQPRASS

SEQ ID NO: 1723 - protein, 247 aa, Heterodera glycines
  cDNA sequence=SeqID_1290; coding sequence=SeqID_1514
MFRNQYDSDVTVFSPQGRLHQIDYAVEAMRQGSAAVAIRSKDYAVVVALMRAQNELSSYQQKVFKLDDHLGLSMSGLISDGRILARFMQSECAEFRWNYHNPISVELLNRKLGLKLQSNTQYYGRRPFGVGLLIIGYDDKGPHVVKAEPSGDVSEMFAASIGARSQSARTYLEKNLPEFETADRDALIRHAIRSLKETLQADAGSLDENNTFIAIIGLGQPFTFLGKDATRAHIRSVEEEAHREMDE

SEQ ID NO: 1724 - protein, 254 aa, Heterodera glycines
  cDNA sequence=SeqID_1292; coding sequence=SeqID_1515
MEHYDRAITIFSPDGRLFQVDYAQEAVKKGSTAVAVKGKNCVVIGVEKKSIPTLQDERTIRKIHALDSHVMVAFAGLSADARVLIDRARVECENYKLTLEDRVSVMHISRIIADIKQRYTQTTGRRPFGISMLVGGFDSDGTPHLFKTEPSGVYYELLAGSIGRNEKIVKEYLEKEYGNDNTADEESTLKLMLKSLAPVVQSGAQNIEIAVLKWVDGTNGEPGYCEQQILNVEAIGALLSQIGPIEQQKPMETS

SEQ ID NO: 1725 - protein, 251 aa, Heterodera glycines; identical to SEQ ID NO: 1040
  cDNA sequence=SeqID_1293; coding sequence=SeqID_1516

SEQ ID NO: 1726 - protein, 435 aa, Heterodera glycines
  cDNA sequence=SeqID_1294; coding sequence=SeqID_1517
MIGGLFVYNHKGEVLISRIYRDDVNRNAVDAFRVSVIHARQQIRSPVTNIARTSFFHIKRGNVWMCAVSRRNINASMVFEFLNRFADTMQSYFGKLNEENVKNNFVLIYEILDEILDFGYPQNTDPGVLKTFITQQGVRTASKEEQAQITSQVTGQIGWRREGIKYRRNELFLDVIEYVNLLMSQQGQVLSSHVAGKVAMKSYLSGMPECKFGINDKLTIEGKGRTGTDDPSKTSRASVAIDDCQFHQCVKLTKFDTEHAISFIPPDGEYELMRYRTTKDIQLPFRVIPLVREVSRNKMEVKVVIKSNFKPSLLAQKIEVIIPTPPNTSGVQLICMKGKAKYKAGENCICWKIKRMGGMKESQISAEVDLLNTGNAEKKKWNRPPVSMNFEVPFAPSGLKVRYLKVFEPKLNYSDHDVVKWVRYIGRSGLYETRC

SEQ ID NO: 1727 - protein, 383 aa, Heterodera glycines
  cDNA sequence=SeqID_1295; coding sequence=SeqID_1518
HEGLFGSSIGTSSPFGSKPSGGLFGAANTAVVQPSTSTTTQQDIEVPQAPDDTVQAMKFNPLVAGSPIFLAAGSWDNTCRIWQVNENGMVEPKAMQNVGAPILSLDWSEDGSKIFIAGADKQAFAWDLGSNQMAVVGTHNEPVRSCHWIATPQYSCLMTGSWDRTLRFWDMRQLPTQNSLATIQLPERVYCSDMVFPLMVVALADRHIKMYKLDGTPSEIQDVESQLKFQSRCIAIFKDKMTGQPNGFALGSTEGRVAIQCLQPKDPKDNFTFKCHRSAELINNYQEIYPVNDVAFHPTHQTLATAGADGKYSFWDKDARTKLKGSDALPMPITKCAIHSGGNIMAYAIGYDWSKGFEYSTANNVTKIFLHGCDEEMKPKPKK

SEQ ID NO: 1728 - protein, 212 aa, Heterodera glycines
  cDNA sequence=SeqID_1297; coding sequence=SeqID_1520
MVTEQNGATFAVDVEEIAAGHHVTPVDMTTATSKLQLEAAEVRNPANKPNWSSYLRSQLVPQNEYNFIIELEKAKNKQERDEALAKDKTNSARSIINLITEVAKDQLIRYVLTLFDDLLQEDKSRVEIFHDYARRQKRTIWSWFQGILTRNDSFIVNQMSAIFSKLACYGSVLMDGQELQAYFNFLQQEIKNSRLVLSQGRILQISITLAAA

SEQ ID NO: 1729 - protein, 254 aa, Heterodera glycines
  cDNA sequence=SeqID_1298; coding sequence=SeqID_1521
DTVGCCSLRCEHIKLHDDMDDLKYVVEFDFLGKDSIRYYNRVPVEKQVFKNLKLFMEEKDPGDDLFDRLDTSSLNQYLKELMDGLTAKVFRTYNASITLQEQLDKLTNPSDSVHEKMLSYNRANRQVAILCNHQRAVPKTHEKSMENLENKIKEKKQEYKELKDQLKKSKSVDEKMAKKYERLKEQIAKLNTQRTDKDENKQIALGTSKLNYLDPRISVAWCKKNDVPVEKIFSKTQRDKFRWALDMAKEDFIF

SEQ ID NO: 1730 - protein, 241 aa, Heterodera glycines
  cDNA sequence=SeqID_1299; coding sequence=SeqID_1522
EFGTRIAHTQMKLMKHRNKKAHIMEIQINGGTVAEKVDWAREHFEKQVPVEQVFEQDEMIDCIGVTRGKGFKGVTSRWHCKKLPRKTHKGLRKVACIGAWHPSRVSFTVARAGQKGYHHRTEINKKIYRIGKSCLTADGKKNGMTDFDITEKNINPMGGFPHYGLVNQDFLMIRGCCIGCKKRPITLRKTLIKQTKRFAFEKINLKFIDTSSKFGHGRFQTSAEKKTFMGKLKKDFLAESA

SEQ ID NO: 1731 - protein, 210 aa, Heterodera glycines
  cDNA sequence=SeqID_1300; coding sequence=SeqID_1523
MGISQDRWHKRRKTGGKRNPIHKKRKFEMGRPAANTKIGPKRIHLVRCRGGNIKHRGLRLDTGNFAWASEGCTRKTRIIDTMYNASNNELVRTKTLVKGMIVSIDAIPFRQWYEAHYALPLARKKGQKLTEDEEARIGGAQKRSKSTLKKYTERQKTAGVEPHLLEQFQAGRLLACISSRPGQSGRCDGYILEGKELEFYNKKLKAKKAK

SEQ ID NO: 1732 - protein, 1091 aa, Heterodera glycines
  cDNA sequence=SeqID_1302; coding sequence=SeqID_1525
MGVPAFFRWLSRKYVSIIVDAVEQRRREIDGVKIPIDATQPNENYQEFDNLYLDMNGIIHPCTHPEDRPAPKTEEEMFILIFEYIDRLFSIVRPRKLLYMAVDGVAPRAKMNQQRSRRFRAAQEAAEKRELIENVRKRLESEGIPLPPPRKEEEHFDSNCITPGTPFMARLSVALRYYVHKRITYDPAWQKIQVILSDANVPGEGEHKIMDYVRRQRASPAHDPNTVHCLCGADADLIMLGLATHESNFNIIREEFLPNQPRPCELCGQYGHEVEHCEGLARAETGPDQADPLKKEKNFIFIRLPVLREYLERELSMPNLPFPFDLERAIDDWVMMCFFVGNDFLPHLPSLEIRENAIDRLVKLYKDMVYQAGGWLTENGIVNIERVKKIMGGLGKVEDEIFKQRQLKELRFKESKKQRKQQQRQAMAKIMPYNANLIAPMPLGQQKRMSGEEMRRLAAGDRQEFVRLADVASSHKLQSLLTPVDRRKATDGGDRKRKLAPSSVDSPNGAPPAKSFKEGVAAASVSSETALKPEIKLVTPSGKTAPLAKGAVGALAYDSDEEEEVLDEIRLWESGWKDRYYRAKFQVSETDLEFRKKVACAYVEGLCWVLRYYYQGCASWKWYYPYHYAPFASDFELIADFQPDFNMPTKPFKPLEQLMGVFPAASRAHIPDGWRWLMTDSSSPIIDFYPETFEIDLNGKKYAWQGVALLPFVEEKRLLDALDSVYATLTTDEIARNATGPDRLFVGNKHNLFSLVYEVHSQKTTIPIKDELTNDDTKETSEGTRETEGEAEETQQAENGESEQIAKAEETTAQEEQANEEAISKPEQAPKQEFETEIEFVDDEEKKWVHIDAVKAYGMSGEVSYDVEALAFGEAHRSLFRNSLEFGDIKENTCIMVEFRDPQFPMHFIFKANRLDGIKELPRVLKPNDWDQRRHGSFQPQIGFSRDIPRANLSMAGHRTLNHHINDNRRSCPASLFSVQTSPPAHTLPWHMSTNSPQQQHQMQYQHQQQWQQGQFYNGQQQQQPVPLFSFGQMAMPPPPPLPPQNWITSHPPPQIQSHVPYGQPPPLISQPRNTQHHHRRNDNNRTYNRK

SEQ ID NO: 1733 - protein, 501 aa, Heterodera glycines; identical to SEQ ID NO: 1036
  cDNA sequence=SeqID_1303; coding sequence=SeqID_1526

SEQ ID NO: 1734 - protein, 570 aa, Heterodera glycines; identical to SEQ ID NO: 1042
  cDNA sequence=SeqID_1305; coding sequence=SeqID_1527

SEQ ID NO: 1735 - protein, 317 aa, Heterodera glycines
  cDNA sequence=SeqID_1306; coding sequence=SeqID_1528
MSFLVTLAGYLTIAIFLQKLFRSLYNVVFPYLFAVPQNIKVLAGAEWAVVTGSTDGIGKAYALELAKKNFNVVLISRSMDKLNAVAEEIKQKYPNVEVKCISFDFTNANLKDYEQTIFSQLSTIEVGMLVNNVGMSYEYPERLDRIEGGLQRVSDITVINTLPTTVLSAFVLKQMRERGRGVVVNLASSAAYFNWFYLAAYSASKKYVCWLSSILRMEYADTDIVIQTVCPMMVATKMAKIRKASFFTPSPEEFAAQALRSIGLVDETTGCLSHQIQAELMFGYVPAPLLNKFVRDNSLQTRKRALKKKEATVAKSE

SEQ ID NO: 1736 - protein, 216 aa, Heterodera glycines; identical to SEQ ID NO: 1045
  cDNA sequence=SeqID_1307; coding sequence=SeqID_1529

SEQ ID NO: 1737 - protein, 310 aa, Heterodera glycines
  cDNA sequence=SeqID_1310; coding sequence=SeqID_1531
TRHENVAPTDIEEGMRVGVDRNKYQIHLPLPAKIDASVTMMQVEDKPDVTYADIGGCEEQIKKLREVVEFPLLQPERFTSLGIEPPKGVLFFGPPGTGKTLCARAVANRTDACFIRVIGSELVKKYVGEGARMVRELFSLAKTKKACILFFDEVDAIGGARFDDGKGGDNEVQRTMLELVNQLDGFDSRGAIKVLMATNRPDTLDPALIRPGRIDRRIEFSLPDLKARGNILQIHTKRMSVDRNIRYELIARLCPNTTGADLRSVCTEAGMFALRARRKVITEQDFLKAVQKVVKSYAKFSSTPAYMTHN

SEQ ID NO: 1738 - protein, 190 aa, Heterodera glycines
  cDNA sequence=SeqID_1311; coding sequence=SeqID_1532
MQIFVKTLTGKTITLEVESSDTIDAVKAKIQDKEGIPPDQQRLIFAGKQLEDGRTLADYNIQKESTLHLVLRLRGGGKKKKKKTYTTPKKIKHVHKKVKLAILKFYKVDDNGKITRLRRECPAKTCGAGVFMAWHVDRQYCGKCGLTYKLDPATIKKNMAAAAKASKPAAAAKPAAEAAAAAGKGKGKKK

SEQ ID NO: 1739 - protein, 199 aa, Heterodera glycines
  cDNA sequence=SeqID_1313; coding sequence=SeqID_1534
HEGKIRGLAYVCKVTPSIASRMIDGAKKMLHGNISDIYITIDQRKGPQGGLSPGFGIFLTAETTEGVFFHGEAMSRPKGQNEDQTVPEEIGEQAARRLLDEIHMGGCADSSCQSLAATFMTLCDRDVSKFLLGPLTINSVHTLRNLQMFFEQMFKLEEWWKVMKEIVGKGGNAMKNGSEDKCLMTCVGVGFFNINKDQL

SEQ ID NO: 1740 - protein, 248 aa, Heterodera glycines
  cDNA sequence=SeqID_1314; coding sequence=SeqID_1535
RTPQIGDKFASRHGQKGTMGMMYRQEDMPFTCEGITPDIIINPHAVPSRMTIGHLIECLQGKLSANKGEIGDATPFNDTVNVQKISALLEGYGYQLRGNEIMYNGFTGQKLSTQVFLGPTYYQRLKHMVEDKIHSRARGPVQGMNRQPMEGRARDGGLRFGEMERDCQISHGAAQFLRERLFEVSDPYTVYVCNQCGLVVIFNQRTNTFECKACQNKTQVSAVRIPYACKLLFQELMSMSIAPRMMTK

SEQ ID NO: 1741 - protein, 542 aa, Heterodera glycines
  cDNA sequence=SeqID_1318; coding sequence=SeqID_1537
ARGSPSLSVANSNVSRQLGQPKVAGFKDKDKPESVRTSNIVAAKAVADAVRTSLGPRGMDKMIQSGNGEVTITNDGATILNQMSVVHPTAKMLVELSKAQDIEAGDGTTTVVVLAGSLLDAAEKLLAKGIHPTTISDSFQRAATFSEKVLEEMATPIDINDDDELVKLAMTSLNSKVVSQHSHLLAPMAVQAVKKLMSSPEDSSVNLKLIKVVKKLGETVEESQLIEGALIDQKSMGHGGPARVEKAKIGLIQFQISPPKPNMENQVVISDYAQMDRALKEERNYILELCKQIKKAGCNVLLIQKSILRDAINEMALHFFAKMKIMVIKDIERDDIEFYAKILGCRPVASVDHFVPESLGTADLVEEIETADGKVLKVTGLKQSGCAVSILVRGSSKLVLDEAERSLHDALCVIRCLVKKRALLSGGGAPEMEVSVRVRAAAQTKHGAEQYCWKAFADALEVVPYTLAENAGLSPIETVTEMRSQHAMGNKEHGVNVRMGAITDIREENVVQPLLVSSFAVKQAAECVRSILKIDDIVLSVR

SEQ ID NO: 1742 - protein, 318 aa, Heterodera glycines
  cDNA sequence=SeqID_1320; coding sequence=SeqID_1539
MDIVDDPLSEPCHVCGDKSTGTHYGTVSCNGCKGFFRRTILRSQKFTCRFNKQCVIDKNYRCACRFCRFQKCLSAGMKKEAIQFERDAIGSPLPLKRRRVADDGRADHSPSPTGGRTATDGIGTAVGRPVMAQGDGKGQMESPPEIYVDIIGTLVEMEQRVNYEMSLRYRSLCGAVFPSSVGTDNASFAGDASSVFNLSSGRGAALSVEELNELSRTTLLLMVEWAKGIEPFPGLSMEDKVILLKNYAPQHLILMPAFRSPDSTRLCLFNNSLLGNGAEGQAADGGEAPLGCSFAGLKTANIMQESSTKSCGQCGSSK

SEQ ID NO: 1743 - protein, 183 aa, Heterodera glycines
  cDNA sequence=SeqID_1321; coding sequence=SeqID_1540
MTEYKLVVVGDGGVGKSALTIQLIQGQFIEEYDPTIEDSYRKQVLIDGETCLLDILDTAGQEEYSAMRDQYMRTGEGFLLVFALNEYKSFENIHAYREQIRRVKDSDEVPMVLVGNKCDLAQRAMDQRSIQELARSFGIPFIETSAKTRRHVDEAFHALVREIRKHKDKHREKPKRRKRCAVL

SEQ ID NO: 1744 - protein, 438 aa, Heterodera glycines
  cDNA sequence=SeqID_1322; coding sequence=SeqID_1541
TRDFFTSFYQMLKEDEKTADLHKVEDAFVPLIKLRYDGIELDILFARLALKEIKEDQELSDDNLLKNLDEKSIRSLNGCRVADEILRLVPNRLNFILVLRAVKLWAKNHGIYSNVLGFLGGISWAILVARTCQLYPNATPSVLLQKFFLVFSAWDWPHPVILKDVDATPRIDIPYFIDMIWDPRTRASDRYHLMPIITPAFPEQNSTFNVTRSTRQVMTNEFKEGLDNMLEIFNGHATWKKLFEEVNFFTRYKHFIALLCLTENEEDHLNFCGLVESKIRHLVASFERNSCVNLCHVNPRQYKPAYKLELDIDYENPVCTLWFIGLDLNKQLTKKIDLTEELQGFTDTVYKSASVLKDFKETMRIHPSYTRQRNLIKWLSKEDLDRGRRAERRCSAAAASPRVSMLNNSLDSTGKSLDTSGSNSPASAEEPSLKKLRV

SEQ ID NO: 1745 - protein, 460 aa, Heterodera glycines
  cDNA sequence=SeqID_1323; coding sequence=SeqID_1542
SARGTTVVECLKDADISIKKRALELCFALMNQTNIASMSKEIIIFLETADSDFKAECSSKMYVATERFSPSLVWHLDTMINVLQLAANHVPDEVVSAMIQLISSQQELQHYATVQLFHASKREHIVNAQPLMQIAFWSIGEFGDLLVAPGNTEEANIKVSEDEVVELFELLMPHPQLTVPTREYGLTALAKLSTRFDSHAEQIHALIRQYSAHMNLELQQRSVEFSRLLSKDELRNGLLERMPAIEHNALHTAATPIEMDDNHQELIVAQKEHQSQKPKADEIDLLGLGNTDSPALVDILFGGVPNVQPLSRNIGKDPIDDLFSFESSNKNGALVEDDQLKTGQIVLNQRGIEMQLFVDSNGFDSNGLAQLRFQTVNNTPAGVEDFNLAVAVTKAYQIELLPANSTSLQANALSTISQKANLRRLANSKAPRLRLRISYRLAGALNTIDAEVTSIACLAS

SEQ ID NO: 1746 - protein, 184 aa, Heterodera glycines; identical to SEQ ID NO: 1166
  cDNA sequence=SeqID_1325; coding sequence=SeqID_1543

SEQ ID NO: 1747 - protein, 442 aa, Heterodera glycines
  cDNA sequence=SeqID_1326; coding sequence=SeqID_1544
MASKFVFSLRFSYPRLLTSSALNNKKSGPNFLQSRSIVTKFDLELPDDYPEPWPYKQWGFNQFMQHFDKTLKRWHINSKLIVFESNIGVGRSSIAKELADALGFYYMPAFKMDDILVDRYNNDMRDYYHLFPKRFRFPDINMFYKDPADDQTAVMQDLMYDCRWEQYLNAQAHLFNTGQGVVLERCVHADFVFANAMRAKDWISREYFNFYMYKRKQSLLFTRMYPHLIIYLDCPPEKCLENIQKRGNPAEVNAVDLEYLVNIQNSYKDFFREMRDECEILAYDWTTPQVLDVLLEDILEIDFETLDFYSSGKHRTWSLMGTDTNHCFWRHMVTTKDQLKERAMNKLGLLQTEVSELYIYPMDGIHHRNVIMHEVLKDRCTHGYTKKDPIQGLTRANYRNLEMPERWTEYFWKEEWIGSSCSLHTLFDPTAKDYDPEYLSKH

SEQ ID NO: 1748 - protein, 319 aa, Heterodera glycines
  cDNA sequence=SeqID_1327; coding sequence=SeqID_1545
ARGLKLKVPILLYCFVQCLSAVKVDNAEQSDQPTGDSSSGQFPISYPPIKYENDLAYVEKPSGNERCLFYAEGLSVVVFATKKSQSAWADYRSDTKESPKYTASIECQGNMNVGSSFDVYLKIDGKAEGVVRADIGKKDAKSVFTVEGAEFILNFNVTQVGFWQLVGATVERIEVKGSSDFLNKNLNVDKKWTLEPSVVPSTNINGFKDYSFACGQTNPIVWALKDSNDYAVGITLNNVQFQPFNATYTAGGKEADRLKFGWKVNDCQGLFSIGTWMGLVVATLLIGVLFFGFLMLNSVQTMDRFDDPKQKQLIISSKE

SEQ ID NO: 1749 - protein, 206 aa, Heterodera glycines
  cDNA sequence=SeqID_1328; coding sequence=SeqID_1546
MLIKRAFSFSSRALQQHSVVRPPVQVTGIEGKYASALYSSGIKEKKLENIEKELRQVKELYDTNKEFKSFIDNPILNKQKKKEAVEDVLKKQGVSQQVQNFFGLLAENGRINKLTGVVSSFETIMRAHRGELHVEVASAEPLDKKHEQSLNDALQKFATRGQKLNLTFTVKPDLVGGLVVNIGDKYIDLSMATRLKKMDAVVKGSI

SEQ ID NO: 1750 - protein, 137 aa, Heterodera glycines
HEVEESPLEAQKREEILRMYQSCKEALRIISDVNMATMATDLPPPVVSPANDFRNNSSPVPRPAPAPPGQIPTNRPAPQPPMGARPIGMVAGAQPIMPIQNRPLPGPPGQAPMPPIHANDLNKPRIPERPQIPSRPF

SEQ ID NO: 1751 - protein, 426 aa, Heterodera glycines
  cDNA sequence=SeqID_1330; coding sequence=SeqID_1548
PLFGIMSTDSADPLYWLRVIMASNRGTLMELGISPIVTSGLIMQLLAGAKIIEVGDTPKERALFNGAQKLFGMVITIGQAIVYVASGMYGNPHEIGAGICLLIVIQLVVAGLIVLLLDELLQKGYGLGSGISLFIATNICETIVWKAFSPATMNTGRGTEFEGAIIALFHLLATRNDKVRALREAFYRQNLPNLMNLLATVLVFAVVIYFQGFRVDLPIKSARYRGQHSSYPIKLFYTSNIPIILQSALVSNLYVISQMLAAKFGGNILVNLLGTWSDSSGTYRSFPTGGICYYLSPPESLSHILEDPIHCIIYIVFMLGSCAFFSKTWIDVSGSSAKDVAKQLKEQQMIMRGHREKSMIHELNRYIPTAAAFGGLCIGALSVTADFLGAIGSGTGILLAVTIIYQYFEIFVKEQQEMGGVAGLFF

SEQ ID NO: 1752 - protein, 130 aa, Heterodera glycines
  cDNA sequence=SeqID_1331; coding sequence=SeqID_1549
MTEGGEEVNPKAYPLADIQLSQKLLDLVQQATNYHQLKKGANEATKTLNRGIAEVIILAADAEPLEIILHLPLLCEDKNVPYVFVKSKAALGRACGVTRPVIATSIIQNEGSQLKSQIQKIKEDVEKLLI

SEQ ID NO: 1753 - protein, 130 aa, Heterodera glycines
  cDNA sequence=SeqID_1332; coding sequence=SeqID_1550
HEEITRELVTTILSRKPKMCAFLEYKDTKVVYKRYASLYFCCAIEQTDNELLCLEVIHRYVELLDRYFGSVCELDIIFNFEKAYFILDEFLLAGEIQETSKKQVLKAISAQDLLQDEETTQGLFEDNGLG

SEQ ID NO: 1754 - protein, 808 aa, Heterodera glycines
  cDNA sequence=SeqID_1334; coding sequence=SeqID_1552
MASVPTQKDEKTKRNEELATAILKKMPKPNRLIVDQSPKDDNSSVLMAQTKMDDLGLFRGDSILLKGKKRRETTSIVIASDTCPPEKILMNRVVRQNLRVKLGDVVSVSSASNTPNGLRIHVLPIDDTVEGLTGNLFEVFLKPYFLEAYRPVYKGDTFTVNAAMRTVEFKVIETDPAPACIVVPTTIIHCEGEPIKREDEENNLNDVGYDDIGGMRKQLAQIKEMVELPLRHPMLFKSIGIKPPRGMLLFGPPGTGKTLVARAVANETGAFFFLLNGPEIMSKLAGESESNLRKAFSECEKNSPAILFIDEIDAIAPKREKTHGEVERRIVSQLLTLMDGLKQRSNVIVIGATNRPNSIDPALRRFGRFDREIDIGIPDAIGRLEILRIHTKNMKLADDVDLEKIANECHGYVGADLAALCSEAAMQQIRQKMELIDLESENIDAEVLAQLAVTMDDFQFALGKNSPSALRETVVETPNVTWEDIGGLENVKRELQELVQYPVEHPEMFLKFGMQPSRGVLFYGPPGCGKTLLAKAIARECQANFISIKGPELLTMWFGESEANVRDVFDKARAAAPCVLFFDELDSIAKSRGGNVGDAGGAADRVINQVLTEMDGMGSKKNVFIIGATNRPDIIDSAILRPGRLDQLIYIPLPDEPSRLQIYRASLRKTPIAKDVELEYLAKVTVGFSGADITEICQRACKLAIRESIEKAVAIEKDRQAKEQRGEEVMDVAEDPVPQLTRKHFEDAMKFARRSVSDNDIRKYEMFAQTLQQQRGFGTSFKFPGEGKKSSSGRGGNEAGNDDDDLYS

SEQ ID NO: 1755 - protein, 514 aa, Heterodera glycines
  cDNA sequence=SeqID_1335; coding sequence=SeqID_1553
MAMLNASFDKFNISNSDKIRTQRLISMSESCEEWKTCTKRETYALLDQELNKLLTTSPPEKMEYWKKELDGFMDLFARFLRAKTTVEWSKIEPLPEGAITPYSKLEQTPRDRVRELLNGLVVVKLNGGLGTSMGCKGPKSIISVRNELTFLDLTLQQIQSLNREFEVNVPLVLMNSFNTDDDTKKLLKKYTNVRVEVHSFAQSRYPRIDRESFMPLAKDLKDMDLECWYPPGHGNFYESLINSGLLDNFLSEGKKHVFLSNIDNLGATVDPNILNYMVARKAEFIMEVTDKTRADVKGGTLIEYEGKLMLLEIAQVPPDYVDEFKSISKFRIFNTNNLWAELEAIKRVVLNKELNMEVIVNPKHLDRGANVIQLETAAGAACKCFRGACGINVPRSRFLPVKKTSDLLLLMSNLYDIENGYVTLSTLRSFPTTPLVKLGSSFDKVKEFVKRFQGIPDLLELDHLAVSGDVWFGRDVTLKGTVIIIANHGDRIDIPAGTILENKIVSGNLRILDH

SEQ ID NO: 1756 - protein, 132 aa, Heterodera glycines; identical to SEQ ID NO: 1209
  cDNA sequence=SeqID_1336; coding sequence=SeqID_1554

SEQ ID NO: 1757 - protein, 130 aa, Heterodera glycines; identical to SEQ ID NO: 1190
  cDNA sequence=SeqID_1337; coding sequence=SeqID_1555

SEQ ID NO: 1758 - protein, 256 aa, Heterodera glycines
  cDNA sequence=SeqID_1338; coding sequence=SeqID_1556
MANRTARDAHTIKGTNPQYLIEKIIRTRIYDSLYWKEQCFGLSAETVVDRATELRYIGGIYAGNIKPAQFLCLTLKLLQLQPDKDIIIEFIRQDDFKYVRALGAMYIRLVFNSVEVFKYLEPLYNDYRKLRYMNRMGKFELLYMDEFVDNLLREDHYCNIQLPRLQKRQALEEKDQLELYASALDEDLERLSTDSEDEQETRKARPNIVSRRRSRSRSRGRSRSKSRERRRRSLSTDVGFRPSGRTKCRERHRKRN

SEQ ID NO: 1759 - protein, 175 aa, Heterodera glycines
  cDNA sequence=SeqID_1339; coding sequence=SeqID_1557
MAPKEKEVGKGWSFAHFFWHLIKKETRNEKERHILANGRLALSFLAVAFAGFALLYDYFFPFPKSKIILAVCSISYFVMIMVLQAYQWYVEKLTFFQAEEKTTDNGEPRHWKWSSDMKRYDDKYVLIAEYSQGTRTGSMKVVKSVAAYITEDGEVLVPLIKREVDLLIKNLLKAD

SEQ ID NO: 1760 - protein, 372 aa, Heterodera glycines
  cDNA sequence=SeqID_1340; coding sequence=SeqID_1558
FQEVISPNIYNAKLWEQSGHWHHYAENMFRFEIEKEQFGLKPMNCPGHCLMFDYKPHAYNELPIRYADFGVLHRNEMSGALSGLTRVRRFQQDDAHIFCRKDQILSEISGCLDFLNFVYVEVFGFSFRLHLSTRPEEGYLGDLATWEAAETQLKQALDNSGLKWELNPGDGAFYGPKIDIQIKDALGRHWQCATIQLDFQLPQRFDLSYYDENKERLRPVMIHRAIYGSIERMVAILAENCGGKWPFWLSPRQAMIIVVHHSVSDYASKVFRRIFDAGFEVEFDEDSPDTLNKRIRNAQLAQFNFILVIGQQEKNNGTVNVRTRDNQVRGEIAVDALIQKFQIFRDTFAQDTESAGSFEGPKEQKEILDDKK

SEQ ID NO: 1761 - protein, 414 aa, Heterodera glycines
  cDNA sequence=SeqID_1341; coding sequence=SeqID_1559
RHSNYELATALLRRATTPPPVRRDSYFDDSAKVQNRVFRSLKLWSLYADIEESMGSLESCKAIYERMLELRIATPQIVINYALFLEDNQYFEDAFKAFEKGIGLFRWPLVFDIWNVYLTKFIQRYGGKKLERARDLFEQCLDKCPPKYAKNIYLLYAKLEEEHGLARHAMDIYNRATGAVEKEEMHLIYNVYVKKAMQFYGITKTRPIFESAIERLPEERSREISVRYAQMERNLGEIDRARAIYAHCAEICDPRVQSQFWESWKEFEVKHGNEDTIREMLRVKRSVQATYNTNVNYVSAQMMATLGSQTEMAGELSAADSMAQLEARAAQIAQEEALIAAKKVLPATDGRISFVRGEGRTTTEARAENPEEIDIDQIVDDERGEEEDDENAMDHGDGTAAKSADDGQRETAEA

SEQ ID NO: 1762 - protein, 286 aa, Heterodera glycines
  cDNA sequence=SeqID_1342; coding sequence=SeqID_1560
AMKYTIIVSATASDAAPLQFLAPYSGAAMGEFFRDNGKHALIIYDDLSKQAVAYRQMSLLLRRPPGREAYPGDVFYLHSRLLERAAKMNETHGGGSMTALPIIETQAGDVSAYIPTNVISITDGQIFLETELFYKGVRPAINVGLSVSRVGSAAQTKSMKQVAGSMKLELAQYREVAAFAQFGSDLDASTQQLLNRGVRLTELLKQGQYVPMAIEEQVAVIYAGVKGHLDKIDPSQITRFEREFLAHIRAHEQELLKVIREEGQLTTATDEKLKNLVTSFLGGFKA

SEQ ID NO: 1763 - protein, 185 aa, Heterodera glycines
  cDNA sequence=SeqID_1343; coding sequence=SeqID_1561
VQTLVKAASSAQQELVAQGRVADPGPANGSEEQQWTAGLVSAAKLVAAATNQLCEAANGLVQGHSTEEKLIAAAKQVASSTAHLLVACKVKCDLNSRAMQRLQSAGHAVKTATEHLVNAARQAITQEDCRGLVISEKIVTGITQMMDAHEEVLRKERELKEARNRLAQLNRSRYEKSPEPSPEKQ

SEQ ID NO: 1764 - protein, 292 aa, Heterodera glycines
  cDNA sequence=SeqID_1345; coding sequence=SeqID_1563
GFINYGSIVKMVDSVSGLALPMMRICKVEKCNGTDVVVINDGDSGEQVSQLHKCGFQMLSGAESRPLFMCFNGENIVQQDVGNDRSFVANDGQFMTDRRYPIRDGAQWTIISTDTIQYRFFEALRPVQNEVAPVPIVSSLDMHSTDPTSSSGAYVELNGHDFYPNLQAWLGSTPMPTTFVNKEMLRFTLLPLSQLNLQEGVDYVLGARCSLLSVPCPLSSPSHSPTTASSPPFLHFLNGTTTVSYDSDQELEFPLSLVRDDGVIYATQLSVSYTRPREQQFRTGIQGTQPNS

SEQ ID NO: 1765 - protein, 192 aa, Heterodera glycines
  cDNA sequence=SeqID_1346; coding sequence=SeqID_1564
ATFEKLVKTDGKAPDDLEKQVATALSELAHNSEIKAQLSELYFVGAQEYEFGNKKCILVWIPVPQLRDYQKIHPKLVRELEKKMSGCHVIFIAKRRILPKPQRGKNRKPLGQKRPRSRTLTAVHDSILADVVFPAEVVGKRTRVKLDGKQIIKVHLDKAQQTTVEHKVDTFSHLYKRLTGKDVVFEFPEPLF

SEQ ID NO: 1766 - protein, 429 aa, Heterodera glycines; identical to SEQ ID NO: 1184
  cDNA sequence=SeqID_1347; coding sequence=SeqID_1565

SEQ ID NO: 1767 - protein, 205 aa, Heterodera glycines; identical to SEQ ID NO: 1216
  cDNA sequence=SeqID_1348; coding sequence=SeqID_1566

SEQ ID NO: 1768 - protein, 212 aa, Heterodera glycines
  cDNA sequence=SeqID_1349; coding sequence=SeqID_1567
ARRKRIGHFGVRDSRRQSRKRKKFESPQAVPPAANTDFIQTARGAIRRQSLRDRSGMTLARLDSQREGSDLIRSWSKEDVSNEEMSAHHFGNGGPSTSHQPTANQQRRDSPPKRMQKQSQQKQKQMSPDEWLKKLEAESGGLRDEEEEQAEKDVLKGSAGESMRKGAKAQKGNGVIRRDQQQQQQHDMNGMNLKGSLGGQNRRRKKSCCCII

SEQ ID NO: 1769 - protein, 244 aa, Heterodera glycines
  cDNA sequence=SeqID_1350; coding sequence=SeqID_1568
MTEAKKLPEVPETLLKRRKIRAAQRAARAKNSLNTIKKAKAKKTEIFKRAEHYLVEYRQKQRQLVALKREAKKVGNYYVPDEPKLAFVVRIKGINKIHPRPRKVLQLLRLRQINNGVFVKLNKATIQMLRIADPYIAWGYPSQKIIRQLVYKRGYAKESGQRIPITDNAIVERNMGKSDVICVEDMIHQIWTVGPHFKQVTNFLWPFKLSNPVGGFKKKSNHFVEGGDYGNREDQINKLLEKMI

SEQ ID NO: 1770 - protein, 478 aa, Heterodera glycines
  cDNA sequence=SeqID_1351; coding sequence=SeqID_1569
EKGGDPEQIRKSQVGRFADVSLVDKVISADSEWRKERFFLDGLNRAIKVCSTAIGDKMKKKESAGDSDAIPEGQIKSLAELKMDDIKEMKISQIKTVKGMVDEEVRRTKLRMETLEGDRNEHLAKIGNLLHNSVPISDNEDENRVERTFGDCASRKSYSHVDLVVMCDGFDGERGTNVAGGRGYFLKGPLVFLEQALIALALQMLNKKGFTPLYTPFFMRKDVMQEVAQLSQFDEELYKVTTAKKTDAANEDGSPDEKYLIATSEQPIAAFHRDEWLNPSDLPIKYAGMSTCFRQEVGSHGRDTRGIFRVHQFEKIEQFVICSPFDNESWKHMDEMIDNAEEFCKVLGLPYRIVAIVSAELNNAAAKKLDLEAWFPGSGAFRELVSCSNCTDYQSRRLRIRYGQTKKMDGEVNYVHMLNATMCATTRVICAILENNQTEDGIVVPEPLRPFMPSQYSQRIPFVKPAPIEQEKVQKKKK

SEQ ID NO: 1771 - protein, 304 aa, Heterodera glycines
  cDNA sequence=SeqID_1352; coding sequence=SeqID_1570
WKLRRPTAVCQLRGHDEHVITCLKLRGDLIVTGSDDCTLRVWSAATGTCVHVLNGHIGGVWALQLSQDGKIAVSGSIKVWDIVAGQCIRTLFGHVAAVRCVKFDGSVIVSGAYDNNIHVWNAADGSLMHVLEGHTNRVYSIHFVSERKLLISGSLDTTIRVWNVDTGECLQTLVGHQSLTSGMKLRDNILVSANADSTIKVWNITDGTCVHTFAGPNKHASAVTGIRFLDNGMVATSGDDGIVKLWDVMEGTFVCDLLRLASQGAGGCVWRMKATPTLLMCAVGSRNGTEDTKLILMDFDAPYP

SEQ ID NO: 1772 - protein, 226 aa, Heterodera glycines; identical to SEQ ID NO: 1131
  cDNA sequence=SeqID_1353; coding sequence=SeqID_1571

SEQ ID NO: 1773 - protein, 338 aa, Heterodera glycines
  cDNA sequence=SeqID_1354; coding sequence=SeqID_1572
MADDKSCDGASSALPPCLIVLGMAGSGKSSFVQRLASHLHSKKVFPYLVNLDPAAATVPFPANIDIRDTVNYKKVMQEYGLGPNGAILTSLNLFCTRFNQVLDLLDRRKGSMPYAIFDTPGQIEVFTWSASGTVITDSLAASFPTVVAYVMDSARSTNPTTFMSNMLYACSILYRTKLPFFVVLNKSDVVDPAFAVEWMRDFEQFQTALDQSSSSFMNDLTRSLSLVLDSFYENLNWVSVSAKTGQGFDKVLELIEKCRLEYWEVYKPMCERVAQERAAETANDGTTDAMPTEKLANLEIRENDVPSDEKGQTEEAQITETNGEEHSTKPTEESEAQK

SEQ ID NO: 1774 - protein, 126 aa, Heterodera glycines
  cDNA sequence=SeqID_1355; coding sequence=SeqID_1573
MAKGVKFDHDNAFVRFCRYYLWHYCWSGRQYGLQFYDQAFEPHPVVQEALRRLRLKDPYQYDLRLQRILLASQLGSKNERLPKNMWTKWDDETFYLNPYFNEIEEEKLEREASTGMKPGYQLKEQI

SEQ ID NO: 1775 - protein, 268 aa, Heterodera glycines
  cDNA sequence=SeqID_1357; coding sequence=SeqID_1575
LGMPGFPGTKGEPGVPGRDGFPGMDGEKGDAGYPGPAGPALRDGFVVVTHSQTTQVPNCPQGTEKLWDGFSLLYIEGNERAHNQDLGDAGSCLPRFSTMPFLFCDFNDVCNYASRNDKSYWLSTGEALPMMPVNEREIQPYISRCSVCETPANVIAVHSQSIQIPNCPNGWSSLWIGYSFAMHTGAGAEGGGQSLSSSGSCLEDFRTTPFIECNGARGSCHFFANKFSFWLTTVDENQQFTIPQSQTVKAGAQRSRISRCQVCIRNVR

SEQ ID NO: 1776 - protein, 395 aa, Heterodera glycines
  cDNA sequence=SeqID_1358; coding sequence=SeqID_1576
QTSLSCPSKSRPEHLFCLTPEHLCDGVTHCANGEDEDSKTYCRAKCDDKKEFSCRVSEICLPKEVFCDGIKHCPFGDDELNCTECRGEAKRCGDHCLPKRKLCDGEVDCQVDGGSDEKDCDCPSCSGMNSALCDGEQKFCVDRRRLCDGRADCPGGEDENDCHGICPSLPKGASRTEDKNTDGMVKCSDGVTRLWAVACGGLFPECNKFCDRCNPQSAFQCVGSTKTSNDSNGNECIHRSLVCDDKMDCLDGSDESNCDCDDAFQCQDHGKGLPTGRCYSESQKCDGYTDCIGGEDERDCETCKNEAFLCQSERRCVSSMGRCDGHKDCEDASDEKECTCEECTRFSSHPMYMCKEARRCYPLDKVCRPSSLCPKVSKMDELYCAVRTQRGIELL

SEQ ID NO: 1777 - protein, 419 aa, Heterodera glycines
  cDNA sequence=SeqID_1359; coding sequence=SeqID_1577
ETLKATLDLDEIFGNENEGGKSAGSSSSSTSSSRSSSPDLTKSRSPSPEVKQEIKTRDEIIRCQLFRRKLAKFVHAPFFAKTVVGCFVRISIGPNKSDGKQVYRAAQVVEVVETAKVYEVEPNSDIRTNKGFRLKVSDGEPMRVYRLEFVSNSLIMESEFLFWFNKMRSSNTPMLTVDFVDRKRKEIVNALNYKYNEAEINLLIKEKQRFKRQPTNFAFQKSELLRMKEQAEQSGDVARVRDLQQQVNELEEKAKKIEHQRTKNLSAISAINQRNRDHMKQTFLGAGIVREEQEKDDDPFTRKSARMKVVSGSVKSKTAGEGSGANAELSVMDTMVSSLGSLSSSSESSPNKKVQLPSTHDLFNAHGIDINIDIKMPAVVGGSLRAPPITDSQAPRTQQKTSSSRTLTLEEYKKKRGLV

SEQ ID NO: 1778 - protein, 498 aa, Heterodera glycines
  cDNA sequence=SeqID_1360; coding sequence=SeqID_1578
VKTAFADVAGCEEAKIEIMEFVNFLKNPAQYKALGAKIPKGALLTGPPGTGKTLLAKATAGEANVPFITVSGSEFLEMFVGVGPSRVRDMFEMARKKAPCILFIDEIDAVGRKRGGKGAMGGHSEQENTLNQLLVEMDGFSTDESNVVVIAATNRVDILDPALMRPGRFDRQIFIPVPDIKGRASIFRVHLTPIKTTLDKIELSRKLAAHTPGFSGADIANVCNESALIAARDAHDEVTSKDFENAIERVIAGMEKKSQVLQPDEKKTVAYHEAGHAVAGWFLEFADPLLKVSIIPRGKGLGYAQYMPKDQYLYSKEQLLDRMCMTLGGRVSEEIFFGRITTGAQDDLRKITQIAYSQVVKFGMSEKVGPVSFDTPEPGEMAFDKPYSEATAQLIDQEVRDMVSAALRRTRELLMSKVEQIERVALRLLEKEILAREDMIELLGPRPFAEKHTYEEFVAGTGSMDEDTTLPKGLDSWNREREKEEKKDGEKEQKKEAA

SEQ ID NO: 1779 - protein, 277 aa, Heterodera glycines
  cDNA sequence=SeqID_1361; coding sequence=SeqID_1579
SVYGKSDELLQLRIELNMTTEKATKFVSDSRQLVVLPHPFQHSEKRTILAFAGTKEAQQEVMLNGADIAIGPEMVKKILKGQFNMDDYDFCIAHTDMAKHILPLRGVIKTRFPTKINGGIGDDLNEILESFLSGINLTVRRDPTNKEWGLSEPLIGRLSMSDEQIEENVAVIVDTLCKMRKAVLGPFINRASLITASAGPQQSFFPVDVSPWEALPTEEEIEKHEKTKKKKDQKKMKKKKETDELEEEEDEEEEAEEDGRIFPNLDRIDQKILMKLM

SEQ ID NO: 1780 - protein, 468 aa, Heterodera glycines
  cDNA sequence=SeqID_1362; coding sequence=SeqID_1580
MSSESDEQSADVNGLCSQSLRSDEKVCPDPDTIKMFIGQIPKAWDELQLKEYFEEFGPIYQLSVLRDKETASSRGCCFVTYYHRKDAISAQNELHNVRTFPGLSHPIQMKPADVENKNERKLFIGMLPKSMDEESVRALFKEFGQVEDCSILREDGKSKGCAFLTLVSRSCAQQAIRKMHHSQIFEGCSKPLVVKFADSCREKNAKKAPDVKNEEGPKPNGGKPTSNNQNSQLLTASGTETLANLVTLLQQPNVISLLEAARVIQSAQNVTSSADLLLKMDQNRQQNLFKMPTLLPPNLNQGALLGLSQGLLLQQSAVGASPLGHSALNLSVPSAIHSVLPTTPPNLPIISPSCSIVSRMTPANPSYPIDKYNRGPDGCNLFIYHLPQDFADTDLYSLFAHFGQILSAKVFIDKQTNLSKCFGFVSFSDESSAQNAISGMNGFQIGAKRLKVQLKRSDSKPYEKPIAY

SEQ ID NO: 1781 - protein, 412 aa, Heterodera glycines
  cDNA sequence=SeqID_1363; coding sequence=SeqID_1581
SEVQLVLQHLPQEYQRFEEKLERARAEMAQLQQNPQQPPYLPPDAMPPPQQIMPMPIRQDFYVRALFDNDPSRGDAVLPHRSLAFRYGDILHVTSVADDDWWTARRVAENGDEGPEGIIPSKKRVEKRERQRRKQVNFNAGSQSLGRNASMSAGGFGGGGGLDGRRGSRSQLSFSRKFPFVKSTEKLNEYPSDGGETGGGTIADEPIHSYVTVELRTVNYVRPVIVLGALKDRINDELVSRHPDRFSSCVPHTSRPPREGEVHGRNYYFVTKAEMERDVKSNLFIEAGQFQNNLYGTSVAAVMEVAESGRHCILDVSGNAIRRLQNTAHIYPVSVFVKPLNYQQLREWDSLLSEEDALKQFERCQRQEQNFGDLFTGMVTGHSPDDIFARVIHIINEQSRPEVWIPTNEQLP

SEQ ID NO: 1782 - protein, 616 aa, Heterodera glycines
  cDNA sequence=SeqID_1364; coding sequence=SeqID_1582
MKKSAKPEIQTAQTRIAIVNPDRCKPKNCGQPCKKNCPVVRTGKQCIVVEPTSKIAEISEILCIGCGICVKKCPYGAIQIINLPSNLERETTHRYSANSFKLHRLPTPRLGSVLGLVGTNGIGKSTALNILSNRLKPNLGSFKSPPDWPSILQYFRGSELQNYFTKLLENKFKAITKPQYVDQIPKFLEKQPLKKVGELLEKRAEKDNVGQIIKDMELTHLLDREVGQLSGGELQRFAIAIAAVQQADIYMFDEPSSYLDVKQRLTAARVIRELLTDQNYVIVVEHDLAVLDYLSDFICLLYGVPGAYGVVTLPSGVREGINQFLEGFIPAENMRFRDTALSFKVSEEKEEVKRSSYYEYPKMEYTVGGEGGKQQFQLNVCRGDFTDSEIVVLLGENGTGKTTFIRLLAGQLKPTSSDTEVPELSISYKPQKIAPKFEGTVRQLLQQKIPAMFIHPQFKTDVLNPLNIDKIIDFEVQNLSGGELQRVAITLCLGKVADVYLIDEPSAYLDSEQRLHAAKVIKRFILHSKKSGFIVEHDFIMSTYLADRVIVFDGQPAIKATANAPQPLVNGMNRFLSQLNITFRRDNESHRPRINKLNSQLDVDQKTSQNYFYLDN

SEQ ID NO: 1783 - protein, 198 aa, Heterodera glycines
  cDNA sequence=SeqID_1365; coding sequence=SeqID_1583
GWSRWFGWSSPTPEQLVNQTVQDELRALLVNNPEHKQSLLDDDLTVIRRNLETRNLPGPNELSAEMIRQQWRLIYRKHFLERMLQAGHDCQSFYQNYKLGVRSEDSDLDCQAVVFFYRINRMLDLSCNALRQQIVNTEQRRLEKEVKEVLNDWSADTDKKKQYLTGRQVELAEELAHVRFIQEKLEEFIIQLHQEKPW

SEQ ID NO: 1784 - protein, 181 aa, Heterodera glycines
  cDNA sequence=SeqID_1366; coding sequence=SeqID_1584
MGNMFANLFKGLFGKKEMRILMVGLDAAGKTTILYKLKLGEIVTTIPTIGFNVETVEYRNISFTVWDVGGQDKIRPLWRHYFQNTQGLIFVVDSNDRERVGEAREELMRMLAEDELRDAVLLVFANKQDLPNAMNAAEVTDRLGLHTLRNRNWYIQATCATSGDGLYEGLDWLSNQLKNRG

SEQ ID NO: 1785 - protein, 211 aa, Heterodera glycines
  cDNA sequence=SeqID_1367; coding sequence=SeqID_1585
LVLAGSADFKNELAQSDMFDQRLQAKIIKTVDISYGGENGFNQAIDLAADALADVKFIKEKKLISAFFDEISQDTNKAIYGVKETLTALEMGAIETLICWENLDLIRYAFRTTNGEKVVNLKPDEKDRSNFVDPETGTDYEIESSTPLLEWLANNYKRFGAALEIVTDKSQEGAQFVRGFGGLGGVLRYSVDIPQLDELENGVDEIDLSEY

SEQ ID NO: 1786 - protein, 307 aa, Heterodera glycines
  cDNA sequence=SeqID_1368; coding sequence=SeqID_1586
MSAVKGRREQDRKEWAAYWNIRWKEVENSFVGKYSYYTNRFLDWPVTWFRENIVERLHDKHKMPYYHRKISRVPEIDECGVNDRICLFEAEEQFRLDKLVDHYIRDILYQRFTQCVRAEGYDHLYKCAKHVDDYENAELNFFIKYGELGSEQTVVACYMKQKHRLIWERRHPEIMEERKRAHEEHTENMNKDKFNMHFWIKDNIYRKKQDYPPGLFFGPNWDGIKLPTEGDHPISRDWRYYQKLEEEPDFDKPNYPKKWNEMAKAAKEAKDQLKMANNGTNENNKNGGANGNGAANGNAKNGSGATE

SEQ ID NO: 1787 - protein, 275 aa, Heterodera glycines
  cDNA sequence=SeqID_1369; coding sequence=SeqID_1587
VRKLHAELDYARHFPKAYLDKAQRHVPMKVYDNRFGAPPVIRWAIRPDDWAMRTKRPWEYGEVKNVIRQEKMYQRQLFSTKFYRKNWNKMPIIPAENWTIFPGDTVQVMVGKHKGRKSNVSHVIKESNAVFVEGLHTKLVDKFNKDRMKEMGIGDVFFDQWEEQPLFLHKGEVQLVDPSDGEPCMAKWVLNDSKTEYQRISSRTGFLIPLPSRAFTTYDYVAPETYLEVPGKDTSAEAVLKRTYMPKLSTFEQEIEEEMKLEKRPEGDRMPTYWY

SEQ ID NO: 1788 - protein, 353 aa, Heterodera glycines
  cDNA sequence=SeqID_1370; coding sequence=SeqID_1588
MEAMEVDSKASGGGEPMNNNNNANSSSNPRTVLDESGGPKKMSHELSREFIKDIDEWIAQLYECKQLSETQVRLLCDKAREILKTESNVQEVKCPVTVCGDVHGQFHDLMELFKMGGKSPDTNYLFMGDYVDRGYYSVETVSLLVCLKVRYPERVTILRGNHESRQITQVYGFYDECLRKYGNSKVWNYFTDLFDYFPLTALVDGQIFCLHGGLSPSIDSLDHIRSLERLQEVPHEGPMCDLLWSDPDDRGGWGISPRGAGYTFGQDISETFNHANGISLISRAHQLVMEGYNWCHDRNVVTVFSAPNYCYRCGNQAAMVELDDELNYSFLQFDPAPRRGEPHVTRRTPDYFL

SEQ ID NO: 1789 - protein, 152 aa, Heterodera glycines
  cDNA sequence=SeqID_1371; coding sequence=SeqID_1589
MASGVKVDGECKQAYDELHNKHQFSFLIFRISDDDTTIIVEKKGEKNAPYSDFVEEMKKVVGDGKQCRYAAVDVHVEIQRQGTEGSSNLSKVVFVQYCPDEAPVRRRMLYASSVRALKATLGLESLLQIQAAELSDIDEKVVKHEVMGRQRT

SEQ ID NO: 1790 - protein, 598 aa, Heterodera glycines
  cDNA sequence=SeqID_1372; coding sequence=SeqID_1590
MHFVKRTPFAKKSEEQREAEEKKRAEKLQQFVDSRNLVFQKRKSGEYDDEVLTVCGELLKNNPDIYTLWNVRREAIEKRATKCEDESDEELAKRISELINGELKLTQSCLLRNPKSYSTWHHRYWSCLRHPTPPLRQELALCEKALGQDCRNFHCWDHRRSIARTAQLSAEEELRFSDTLVGRNPSNYSAWHYRGTLLPLMKPNTDRPEAVISDQCLVDEMQKILSVCGVNSEDQTGWTYCRWLTDLASAKNFDHNNDNLITFTHFDVDMALLVFSEAVDATSVMSLIGTTAHSLLAISPFSMAPQSSKWCRAKVWLASGGISFSPSAGVFRAGSPRFVNADFLTKYFSSSPSCTRTLPRKALTSLVSMCEELIAEENNPWEVSALTSARLALDGITQETFKLTEQNCEKLKQFDPQRSAMYDEMFDKVRIIHELTKNTSDTPEQSQLDLLMEAKSDRLNLNGIGLISLLHLRPLSGLVQELNLQNNRVTSDQITQLCSFAALTSLTLDGNPIDRLPLINPRWFPRLEFLSLAQTKIGQASVFCPSLPSGAFPALKRLVLCETPLAESEKERREMYALTEQRAKGTEDKIRLIMDWTR

SEQ ID NO: 1791 - protein, 193 aa, Heterodera glycines
  cDNA sequence=SeqID_1373; coding sequence=SeqID_1591
LLLLAVPLLVVDTKQEVSEAQQLIQICREYLVGLLLETARKELPRDSVEDAKRNLEMAAYFTHCDIQPVHKILTLRTAANLSFKNKQMRHCASFCRRCIELAPKPEIAAQMRKMLAVAERDNTNAFELNYDEHNPFVLCSRSFVPLYRGKPQTKCPFCGASYAPTFAGSVCDVCEVAEIGRETSSNLMISNFK

SEQ ID NO: 1792 - protein, 533 aa, Heterodera glycines
  cDNA sequence=SeqID_1376; coding sequence=SeqID_1594
MASIACLNPKAELARHAAALEMNISGAKGLQEVMKTNLGPKGTLKMLVSGSGDLKVTKDGNVLLHEMQIQHPTASLIAKACTAQNDVTGDGTTSTVLLIGELLKQAENYVSEGVHPHLVTEGFQLAHDHLLQLLAVSKKALLIDRPLLIEVARTTLRTKLDQKLADHVTECVVDAVLAIRRDENDTEPDLHMIEIQQMEHEMETDTQLIRGLVLDHGGRHPDMPKSVRNVHILTCNVSLEFEKTEVNSGLFYKTAAERERLLQAEREYITRRVLKIVELKGTVCGGGDQGFVVINQKGIDPPSLDLLAQHGILALRRAKRRNMERLQLACGGEAVNSVDDLTPDVLGWAGSVYEHVLGEDKYTFVEECKSPKSVTLLLKGPNRHSITQLKDAIYDGQRAVANALKDGAVLPGAGAFEIAGYCALKKLADNVKGRAKLGVLAFAEALLVIPKTLAVNAGFDAQEAIVKLVETFSAADELVGLDLESGEPCVPQGVWDNVCVKQASLNACQNIASNLLEVDEVMRAGMRDLKGGQ

SEQ ID NO: 1793 - protein, 245 aa, Heterodera glycines
  cDNA sequence=SeqID_1377; coding sequence=SeqID_1595
GKFKEPVAVFYSAEIACGLFYLHSKGIIYRDLKLDNVMLERDGHIKITDFGMCKEGIQGDTTTKTFCGTPDYIAPEIILYQPYGKSVDWWAYGVLLFEMLAGQPPFDGEDEDELFTAITEHNVSYPKSMSKESVLICKGFLSKAPSKRLGCSADGERQVKEHCFFRRIDWHKIETRQVQPPFKPKIRSADDTSNFDSEFTGEAPKLTPVDRLFLMNLDQNEFEGFTFVNAEFTPQGENKTADKTI

SEQ ID NO: 1794 - protein, 817 aa, Heterodera glycines
  cDNA sequence=SeqID_1378; coding sequence=SeqID_1596
NMKMKAVFLGLMIRRLIEAEKGVCEADDRDFYGNKRIELAGSLLSLLFEDLFKRFNSELKRIADSHLNRNMAAPLDIVRHMRQDLITNGLVNALATGNWTIRRFKMERHGVTQVLSRLSYISVLGMMTRINSTFEKTRKVSGPRSLQSSQWGMICPADTPEGESCGLVKNLSLLSHITTDSDEAPILQLLYNFGVQDVRPLKFSVVHERRYHIVFLNGSIVGITDDVEKIIGTVRLMRRRGNLGAFVSVSFNTSTNALYLASDGGRLCRPYVIVENGRPCLTQSQIQEVRDGQKTFDHLLAEGCIEFLDVNELNSTRIAVYEHQILPQTTHLEIEPFSLLGVVSGLIPYPHHNQSPRNTYQCAMGKQAMGTIGYNQQKRIDSLMYLLVYPQKPLVKTKTIELSNFEKLPAGQNAIVAVMSFSGYDIEDALVLNKASLDRGFGRCLVYRFAKGTARKYANQTYDKIMGPSLDATTRKPIAKHAVLDQDGIVFVGAKIMPRHVLINKSMPIMQSEMLPAGNVAGFNHNFETKDVSIPYRGSMNAVAERVLLTCNDEEQYLAKVLIAQCRRPELGDKFSSRHGQKGVCGLISPQEDMPFDHNGTVPDLIMNPHGYPSRMTVGKLMELLSGKNALMGPCQKWRLHYGTAFGGDQVETVSKQLAAHGYNFLGKDMLTSGSTGQQMAAYVYFGPIYYQKLKHMVMDKMHARAKGPRAVLTRQPTEGRARDGGLRLGEMERDCLIAYGASMLLMERLMISSDQFSMDVCAECGLIGYLGWCQNCKSSAAMAKIKIPYACKLLFQELQGMNIVPRLKTAKYTDGL

SEQ ID NO: 1795 - protein, 688 aa, Heterodera glycines
  cDNA sequence=SeqID_1379; coding sequence=SeqID_1597
KWTNVTLGQEVQVQPFSFTPGQRIITSISLTVDFQKKPSNPSEPLDSDAMAREFLMQFANMVFTVTQELVLEYVQQKRSTGGGEKATAMNATTYTLKLVVKRMEGANLNSSPEEISIGPLSPNAVVIFDRPENSQINLIGRSKGKSTHRSLINPDWDFQQMGIGGLDKEFSSIFRRAFASRVFPPEFIEQLAMKHVRGILLYGPPGTGKTLIARQIGKMLNAREPKIVNGPEILNKYVGESEANMRKLFSDAEEEWRRCGPNSGLHIIIFDEIDAICKQRGSMAGSSTGVHDTVVNQLLTKMDGVEQLNNILVIGMTNRKDMIDEALLRPGRMEVQLEISLPDEYGRVQILKIHTARMREYNKLDTGVNVEDIAKRTKNFSGAELEGLVRAAQSSAMNRLVKPGGKVQVDDDAIDKLKVTAEDFDYALENDVKPSFGLSDEELSRLLYGGLCLWGDPVARVLEEGRLLIKETASPDTRGFVRALLTGPPNTGKSYLAAQIAKDSEFPFIKVCTPEEMVGYSETAKCAKIRKVFEDAYKSPLSCVIIDNIERMMDYSPIGPRYSNFVLQTLLVLLGKRPPRNHRLLVLATTSNEQFLSEADMLSVFSKVIRVEQLHSAKQVLTVLEDANVFSEEESRQIEGELRSCEYSFSIGIKRILELLDFVKQSEPEYRVQLLLDGIRDTGGAKDF

SEQ ID NO: 1796 - protein, 435 aa, Heterodera glycines
  cDNA sequence=SeqID_1380; coding sequence=SeqID_1598
EAWQNTFFGSDDESLNASQSFKKYPPLLAIPLYSLLPVNLQKKIFNEPPDDGSRVCVVSTNVAETSLTIPNVRYVIDSGREKKREYDPITGVSRFVVGWCSKASADQRSGRAGRVQSGYAFRLYSSAVYEDMRDHSTPEILNKPIDQLILMLKAMNFTKIDNFPFPTPPRLDQIKSSELRLSHIGALRVQEGLYTITQLGQSLAQLPLTPSFAKVVISSIRGGLLPFAVTLVSALSVREPLLFISSTKEDGTEERRKRMSEVIKQRFLWCAVGEARLFGDLTVILNTVGAADYEEENAHAIEALGLRPKALKEINKQRHQLTLLLNKSDSVEKLPEKFRMDAPSQEQLRRLRHIMVKCHPDKLAKKVQSLDAPKGAYKTLILEGYVFIDQSSVLHKEQPDYVLYQEIVQMAHKKCVRNVASVEPEWISDFVTFSS

SEQ ID NO: 1797 - protein, 230 aa, Heterodera glycines
  cDNA sequence=SeqID_1381; coding sequence=SeqID_1599
MQIFVKTLTGKTITLEVEASDTIENVKAKIQDKEGIPPDQQRLIFAGKQLEDGRTLADYNIQKESTLHLVLRLRGGMHIFVKTLTGKTITLEVEASDTIENVKAKIQDKEGIPPDQQRLIFAGKQLEDGRTLADYNIQKESTLHLVLRLRGGMQIFVKTLTGKTITLEVEASDTIENVKAKIQDKEGIPPDQQRLIFAGKQLEDGRTLADYNIQKESTLHLVLRLRGGKN

SEQ ID NO: 1798 - protein, 543 aa, Heterodera glycines
  cDNA sequence=SeqID_1383; coding sequence=SeqID_1601
MHFADLSLSEREKALSVRYLQERDAMFERFSEWTEQDQTDFCKHLLQRMCHHQHGQIDQFLGPMLQRDFIALLPTGLAENVLHLLDAKSLCASEFVSRRWSRVIVNGLLWRKHIERQVRNDALWAGLAIRRGWKKYFFCSKDQATRAISQSWRQPKNGEDALEFQHKFYRELYPKITADIRQIEQNWREGRHRLERINCQSENSKGVYCLQYDDEKIISGLRDNTIKIWSRPSLGCVQTLSGHTGSVLCLQYDNQMIASGSSDATVRIWDVNTGEQLKTLVHHCEAVLHLRFQDGMLVTCSKDRSIAVWDMASPRDIEVRRVLVGHRAAVNVVDFDHKYIVSASGDRTIKVWNASTCEFVRTLNGHKRGIACLQYRDRLIVSGSSDYSIRLWDIECGNCLRVLEGHEELVRCIRFDSKRIVSGAYDGKIMIWDLAAALDPMTPPNSICIKTLSQHTGRVFRLQFDEFQIISSSHDDTILIWDFLNTGPSAAVAAGAAAAAAHNQAVQHHQAAPAAQPAAAAMPGGAGAAPAAAIIPLAPPPSP

SEQ ID NO: 1799 - protein, 357 aa, Heterodera glycines
  cDNA sequence=SeqID_1384; coding sequence=SeqID_1602
ADCAVLVVACGTGEFEAGISKNGQTREHALLAQTLGVKQLIVACNKMDTTEPPFAEARYTEVMTEVSNFIKKIGYNPATVPFVPISGFNGDNMLEPSDRMPWFKGWAIERKDGNASGKTLLEALDSILPPQRPTDKPLRLPLQDVYKIGGIGTVPVGRVETGVLKPGMVVTFAPQGISTEVKSVEMHHESLPEALPGDNVGFNVKNISVKDIRRGSVASDSKNDPAKETKSFTAQVIIMNHPGQIAAGYTPVLDCHTAHIACKFAELKEKVDRRSGKKVEDNPKALKTGDAGIVDLIPTKPMCVEAFTDYAPLGRFAVRDMRQTVAVGVIKAVEKTEGGGKVTKSAQKAAAPGGKKK

SEQ ID NO: 1800 - protein, 763 aa, Heterodera glycines
  cDNA sequence=SeqID_1385; coding sequence=SeqID_1603
MSGKQIVGLIIPPPDIRTIVDKTALFVARNGLEFEMKIKEREASNMRFNFLNPTDPYFAYYRNKVNEFETGVASADTQSKVKLPEAVREHVQRAEFIPRLPPKPFEFCADPLTLNAFDLDLIHLTALFVARNGRQFLTQLMNREVRNFQFDFLKPQHSNFQYFTKLVEQYTKVLIPPKTIVDDLRASVTQHKILEDVRYRVGWDRHQKALKDREDQAVEKERIAYNQIDWHEFVVVQTVDFQPSETLNLPPLCTPKDVGARILLQQRTEAAKAAAESVAMDVESDEEGGAESGDEETAKERAAIEAAEDAAGELHQRLNIGAEKQHTGSTLTQPAPAAPTAGSVIIRDYDPKKSRGGPVSKTAAASTEKYIISPLTNERIPADKLHEHVRYNTVDPQFKEQRDREQMDRQDEDLVMAPGAEISRNIAKLAERRTDIFGIGEKGAEQTIIGKKLGEEERQMPRSDPKTIWDGQLSTIDATTRAAQQSVSLEQQISEIQRQHGYLPNPAAERMVPSMPPPTSTPSQQFGGGQPLTSHSMAPPQRPPPHQSTGGIASNVQKIVPVPQQPPQMSIPPQHQQQQQMRPPQQMPPQFMQPPGGRPHMPPPPHMGMPPHGVMGAMPPHMQPGMPPPGMMRPPHGSFMLPPPPPGASVGDEPPNKRPREETLEPEERWLQKVHGQIAVQIATPQNDEWNLKGNTVQIQLDISSSVTALKSLIQEQIGVPATKQKLVYEGIFMKDSQSLAYYNFMPNASVQLQLKERGGRKK

SEQ ID NO: 1801 - protein, 291 aa, Heterodera glycines
  cDNA sequence=SeqID_1386; coding sequence=SeqID_1604
MSAYQTIEKGSLHTLNYRVFFKNSDGKLISPWHDIPLYASESNKLFNMVVEIPRWTNAKMEIATKEVMSPIRQDEKKGLPRFVNNIFPHRGYIWNYGALPQTWEDPGHKDENTGENGDNDPIDVIEIGSKVQKRGAVIRVKVLGVLALLDEGETDWKLVAIDENDELAPKLNGIEDIEKHLPGLLSATHEWFRIYKIPTGKPANKFAFNGQFKDRNFAHKIIEQTHQFWKKLVTSASPHPLNTECHKEGAVFKANLSDWESFISKQPEFGHAQQVPEHVDKWHFISSEQNQ

SEQ ID NO: 1802 - protein, 261 aa, Heterodera glycines
  cDNA sequence=SeqID_1387; coding sequence=SeqID_1605
DDRLDLDRPTNWRVFNILAVFHNLSFEEANTALMGESHALVRFLLLCSKCRWHLLRKIAYDTLSNIARNIKLVDKLSTVLLNTVQKGLHSDDKCKVMRSMEIVAGLCATPTNESIVCEFFEESQIIPRIFALLSLKDILMCMCAMESVLAISELGRVACEAVARCDRAVEMLVGFLTTDAFSFGTVGLAGMHVVEVHGHQTRPYVAPNKKNPPPPLKLQPVQPPVQYAQQRHQTSASSTTTTAPPFGEAMEFCNKCSYRYS

SEQ ID NO: 1803 - protein, 473 aa, Heterodera glycines
  cDNA sequence=SeqID_1388; coding sequence=SeqID_1606
MGDFVPKFERNLDNKPLGPRPLPTAGAIPVKDEKGRIVMKKVKVQRYMAGKIPEFAQDFDSDEDAQQAEEEVETDLRQHREEKRERERREKDEHRHNRKDGKRHRERRDQQLDEFKKELKEEEALALGEVEEEDEQTREERHQRAMLRHRRTEREEAPLEQEDLEEEADEDERQRRRELLKRIRQRQEEEELLAKQPDAGEVSEESEEESSDEEEEDSEEEMMPRLKPVFVPRNDRVTLIELEKEQAKLEQLKMEEEKRKEEKKRLSARLVEEQLKREADQEKARREEGAQLDLTAVNTDDESDEVAYEMWKVREMKRLKRNREEREALAREKEEMERIHNMTEEERRNYLRMNPKIITNQQNKGKYKFLQKYYHRGAYFLDKEDDVLRRNFAEATGEDVFDKSVLPKVMQVKNFGKASRSKWTHLTAEDTTDHQGVWATPTPLSAKFVAKHAAGMKNVFEKPSAKKRKIGGD

SEQ ID NO: 1804 - protein, 706 aa, Heterodera glycines
  cDNA sequence=SeqID_1389; coding sequence=SeqID_1607
ATWKLGIFITDMNISRELFVRGDMTIGSLMMQLVGQIGETQDWSDHYMWWPDRRKWLKHTRSTLDQIGITAATYLEFTPMHKHAKVQLPDLQIIDARLDFSVPILKVTQKICQELAIRHPEELSLKRDIPPDILRKGASVESEAQIQPYMKPGEESIGPGTLRTAKPIRASTVNLTSGRGSPALSQASAMGPGHLFNASEIGTLPKMGTIPRGMSPGPAAYREVLGRTPEPGYSEGGGLECDQFDENLINSPKITPGRETFRPQNYLEKAALNRGWLDSSRSLMEQGICEGDVVLLRFKFMQFFDMNLRYDPVRINQLYEQAKWSVLLEEVEHTEEESSLFAALQLQAALQRNSPDRESPERDEVDVLLDELEQTLDTTASLSRRDLTYVPELTEYLKYLKPKKLGFNNFKRAYFTFRDLYLSYYNTAQDANGPPLGHYYLKGCEVSQDLSVSQGKFNIKLQVPSSEGMSELILKCDTEQQFAKWMAACRLASRGKTMADSSYNSEVESIKKVLQMQAGRAAAAQNGAQNKKKSQPVQLPTDFNSEEFVCQRYWKRSGNKSMQQRISDAHSNVKTLSCTEAKLQYIRNWEALPEHGLHYFIVKFRNGKKAELIAVAHNRMMKVNSDNGESSKTWRFSGMKKWHVNWEIRHLKIQFDNEDVEFKPLSADCKVVHEFIGGYIFLSMRSKDQNQTLDEEGFHRLTGGWG

SEQ ID NO: 1805 - protein, 273 aa, Heterodera glycines
  cDNA sequence=SeqID_1390; coding sequence=SeqID_1608
MAPAPEKEKTEDKKLKDGQKPNVTTDHAHCLSNVQPNLPVNKVVVHPLVLLSVVDHFNRVNKTHKVNRVVGVLLGCMKHDKTLDIANCFAVPYDEDSENSNIFFLDADFLEDMFGMFYKVAARERIVGWYHSGPRLCKNDILINEVIKRFTPNPVLVIIQASQGRQDLALPTDAYVEVQEVHNDGSPPVKTFEHVPSEIGAEEAEEVGVEHLLRDIKNQTAGTLSQRIANQLTGIRGLENHLAGFTSYLHRVASRELPINHAIIFLIQVAGKF

SEQ ID NO: 1806 - protein, 262 aa, Heterodera glycines; identical to SEQ ID NO: 1133
  cDNA sequence=SeqID_1391; coding sequence=SeqID_1609

SEQ ID NO: 1807 - protein, 423 aa, Heterodera glycines
  cDNA sequence=SeqID_1392; coding sequence=SeqID_1610
FEANFEPIFISDGMVGQCAARKAAGLIVRMIKDGQIAGRALLIVGEPGTGKTAVAMGISKSIGGDTPFISISASEVFSMDLSKPEALTQSFRKAIGVRIKEETEVLCGEVVQLEIDRPQSGAGPRVGKLTLKTTDMEAIYDIGNKMTESVIKERITAGDVIQIDKATGKISKIGRSLARSKDFDALGPQDKLVACPSGEIQSRVETVNTISLHDIDVINSRSSGYLAVFSGDTGEIKSEVREQIDKKVMEWREENKAQIIPGVLFVDEVHMFDLECFSFINRYIESDLSPILVMATNRGIVNIRGTSVESPHGVPLDLLDRSLIIRTSSYKENEIGEILKIRASDELVEMEDASIAVLVQIALETSMRYCMQLISTADILRQRRKGEKVTEEDVRKARSLFIDVKRCRKEMEKHGDSFINDLN

SEQ ID NO: 1808 - protein, 162 aa, Heterodera glycines
  cDNA sequence=SeqID_1393; coding sequence=SeqID_1611
PFLRMTYAEAIEWLQKNEVMNEEGKPFQFGEDISEGPERFMTDTIGQPILLNRFPHGIKAFYMSRCADQPELTESVDLLMPGVGEIVGGSMRIWKEDELLGAFQKADIDPKPYYWYVDQRKYGGCPHGGFGLGLERFVCWLANQHHIRDVCLFPRYIGRCAP

SEQ ID NO: 1809 - protein, 555 aa, Heterodera glycines
  cDNA sequence=SeqID_1394; coding sequence=SeqID_1612
MRIKKKFASGTARVFVSRKKALKKLQLNLRDFRRLCILKGIYPREPSSAKRANKGGSSEHKIFYHLKDINFLAQEPLLEKFREYKAFLKKVTRARAKREHLKLEGLLRAKPTFSYDHLVRERYPTFASALRDLDDALCLCFAFSALTQSKIARPRTIGQCRRAVTEFMHFVIEAKALRKVFISIKGVYYQAEILGERVTWVVGHERAVGRANELDFSVMANFVDFYLCMLCFVNFRLYKTLGLFHPPQLRRQQMPSENDFSFDHSNELDERVYSLAFPLKRTDKMDADSCGEPSIIDTFAEDDAEGGESLAEKMRQAEVQKTLFAKCKFFLNREVPKEALAFVIRSGGGFVCWDGCAPNSVDEHSEQITHQIVDRKVEKTNINRVYVQPQWVFDCFNARRILPPAKYAPMATLPPHLSPFVDAQHLEVGAGAYIPLERIEHAKQQNGTDLAAFLDGTTPAKSAKKDSAKEKNEAADGEGAKMGVRKSKVLARESRQKQINEEGHNLKLREMMVARKHRRVYGKIKYGLKRKAREANKLAEKRAKLTTDDGKGTKE

SEQ ID NO: 1810 - protein, 597 aa, Heterodera glycines
  cDNA sequence=SeqID_1395; coding sequence=SeqID_1613
MTTTAPIATEEGEDSLYPIAVLIDELRNEDVQLRLNSIRKLSTIALALGVERTRKELIQFLTDTIYDEDEVLLALAEQLGNFTPLVGGPEYVHCLLPPLENLANIEETVVRDKAVESLQKIAEKHSAAQLEEYFIPMVLRLSAGDWFTSRTSACGLFSVAYARANPAQKTELRAAFRCLCRDDTPMVRRAAASKLGDFAKVQEEDYLKNEITQMFEDLAKDEQDSVRLLSVEAGIVIVGLLSEDSAKLAQVKPIAVSLVQDKSWRVRYMAADKIVQIQQAFGTKIGIEEIVGWYTGLLKDCEGEVRDAAAEKLQSFCAALSEEGRKKGIIEEILPVIRPLTTDANQHVKIALAQVVMGLAPLLGNQCTIEHLLPIFLSMLRDDTPEVRLNIISSLEKVSDVIGADELQYSLLPAIIDLAQDGKWRVRLAIVEYMPLLAKQLGQKFFDEKLLKLCMNWLTDHVYAIREAATNILKELAQKFGAEWAVTMVLPRVIELASDSNYLRRMTCLFCFNTLCEALNNDAIMKELFPTIKALCHDQVSNVRFNCAKTLARVGKVVDTQVMNTEIKPLIVKMCEDPEFDVRYFAEETKIELGMAA

SEQ ID NO: 1811 - protein, 271 aa, Heterodera glycines
  cDNA sequence=SeqID_1396; coding sequence=SeqID_1614
LFFVIEFIPGGDLMFHMQRQQKLPEEHARFYSAEIILALHFLHSRGIIYRDLKLDNVLLDAEGHIKLTDFGMCKENIGPGDGTSTFCGTPNYIAPEILMGEEYGFSVDFWALGVLMFEMMAGRSPFHLPTTEEDEQTAEDLLFKMIMEHQIRIPRHLSVRAANVLKGFLNKSPSERLGCKTDLEEGLADIKMNSFFKSNIDWELLEQRQIAPPYNPNVSGDRDLQRFDTSFTNGNPSLTPDSPSVIARIDQSEFEGFEYVNPLIFNKEDAV

SEQ ID NO: 1812 - protein, 660 aa, Heterodera glycines
  cDNA sequence=SeqID_1397; coding sequence=SeqID_1615
FNIPIISSDRLPKLRNVLAGVFSIQNTYKYNDNYPLDGEGNTKGFCFLEYQTKEAANAVLAICDGHRLDKNHTFSAYPFTAIRSMKEPEKDWKKPERQPYVDLGDPWSWLQNPKCLDQFGLLYESGQGGTLRLDVFWNVRNGEPTPVDNASRENWSNDLFKWSPHGTYLATMNNDKRNQRLGAVIWGGEKFDRFQRFSHEGVNYLDFSPNEKFLVTYACDQNSTRDNENCLRIFEVFTGELKKAFSPSLRSAGRLHDWPFLKWSHDEKFFAFCRLRGNCVNIFSTDDFMLCENKAIELDGLVSCEFNPTKNFLAYYCEERPSANAPAEIGLLDVETRVKIRASRIFSVSQSNLYWQKSGSYLAAHTERYQKMVKNKEGEVKYTGNNSYLEIFDCTDKEYAVQSIQLPEPFVNLACEPKGNKFCVLMAVGQKVTPLIYRLDHGKPAPQLIGKIEPANGLNTAMWAPQGGWVVVMGVNTSSGIVSFIDATGAEANKAKTIEHTSLSQGSWDPTGRYFATCTFAGKSRYETGYRIHSFQGRELRRKAVDALLRFKWRPRPPVSLSEQKVRETRKSLKQLSAKFEEEDKREMLKVSKEIIEQRKKALELFSNIRVAAAKTYEEEREKRTELRGGIDQEIGEKDLVEETITVALNTEKEKIRDES

SEQ ID NO: 1813 - protein, 429 aa, Heterodera glycines
  cDNA sequence=SeqID_1398; coding sequence=SeqID_1616
MKPDLKDRDFMYKLIVGQLFYDGHQQLALNLAQTLGLSLRPPPPSDKLFRLVAIAKQFVEDPESKERETILQVGGFESAGLDLEFDADVVPTSPEPSLYETVYLTTHKAPCRAAAFSPDGALVATASNDCSIKILDVDKIISRIDVTLSESGPDAHHPVIRTLYDHLDEVTCVAFHPRESVLLSGSNDFTLKMFDYSKTAVKRAMKTITEVEPITAVSFHPSGEFFLCATRHPTLRLYSAETQQCFVSPIPKDQHSDSITDVCYSENARMFVTGSRDGNVKVWDGVSNRCIETFTRAHDGAPICSAQFTRNGKYVLTVGMDSVPKLWELSTNRCLIAYTGAGTTGAREHPMQAHFNHTEDYVMLPDEKSGSLCSWDARNSDRERLLALGHTAPTRAFVHSPSMPMFVTGSDDHRIRFWYRRRQWGEGKA

SEQ ID NO: 1814 - protein, 214 aa, Heterodera glycines
  cDNA sequence=SeqID_1399; coding sequence=SeqID_1617
MTSRDDEYDYLFKVVLIGDSGVGKSNLLSRFTRNEFNLESKSTIGVEFATRSIQVDSKTVKAQIWDTAGQERYRAITSAYYRGAVGALLVYDIAKHVTYENVERWLKELRDHSDQNIVIMLVGNKSDLRHLRAVPTDEAKAYAERNQLSFIETSALDATNVEDAFTNILTEIYRSVSTRQVPPDRMVPINSQHNITLSSSTSANKEKKACCSAS

SEQ ID NO: 1815 - protein, 514 aa, Heterodera glycines
  cDNA sequence=SeqID_1400; coding sequence=SeqID_1618
MSRFVCAISGNEPEVAVASPVSGEVFEKRLLIKYIEENGTDPITGHKLDTSNLVELKQDPGIRSMQKSLATASLPSLLKQLQDEWDATMLNNFTLRQELKAAREELTHALYQNDAACRVINRLSSELQSARQIIATLPHGRRAAAESETEATDVEMRPEEVEEGAGADGLPGISEELVNFFTDKCQDFSTARKQRGRNLPEGLASVEQIQKYEEVACHDALHSASVPGITALDLQKNLIATGGMDKTIVLFDSETETIKNTFKGHQKRISAVRLHPNLQTIVSGSFDSQIRIWNADDQSARNVIGIHDRPVTDVSLHPTGDYVLCSSEDSHWSLIDLNAGRPLIKVKSDDDDVPGICCGQFHPDGLIFGTGGKNSVVKIWDIKEQINVAQFPGHQEAVVAISFSENGYYLATGSTDGEVKIWDLRKLKNLKNLTLYDVKQAINCLTFDQSGAYLAVGGSNVQIFQAKSWNNIAQFNAHSQPVTGVCFADDAKSVVSASMDKSVRVHAVPPVANE

SEQ ID NO: 1816 - protein, 88 aa, Heterodera glycines
  cDNA sequence=SeqID_1401; coding sequence=SeqID_1619
LSPPWGGPAYLHRDRPFDLLADMEPNGVDIFRVAKKISPNIVYFLPKNTRTDQLIALAGPGGRVELEQTVLNEKIKALHAYFGLLAAN

SEQ ID NO: 1817 - protein, 186 aa, Heterodera glycines
  cDNA sequence=SeqID_1402; coding sequence=SeqID_1620
MGKIHYCKRPDNSTKSCKARGSDLRVHFKNTHETARAIKHMPLKRAIRFLENVREKKEIVPFRHFNGGVGRKAQAQAWGTTQGRWPKKSAEFLLQLLRNAESNAEVKGLDVDHLVIDHIVVQAAAKMRRRTYRAHGRINPYMSSPCHIEVILTEKKDVVAKPAGALVKVKKESKKKQRRQLARGEF

SEQ ID NO: 1818 - protein, 181 aa, Heterodera glycines
  cDNA sequence=SeqID_1403; coding sequence=SeqID_1621
MGLAISGLFSRLFGKKEVRILMVGLDAAGKTTILYKLKLGEIVTTIPTIGFNVETVEYKNISFTVWDVGGQDKIRPLWRYYFQNTQGLIFVVDSNDRERVGEAREELMRMLAEDELRDAVLLIFANKQDLPNAMNAAEVTDKLGLHNLRNRNWYIQATCATSGDGLYEGLDWLSNQLKNRG

SEQ ID NO: 1819 - protein, 503 aa, Heterodera glycines
  cDNA sequence=SeqID_1404; coding sequence=SeqID_1622
MDPALNAEVKTDIRDENAVLKPNSKNGRFELFLLSETQQTHSSASTLPIQKLQHVDAIRASLMEKRTTANNYILDGRPKFIDDSSSSPEEDSTNLRLFGESNFEGITGSIDDSDSQYTTDFTSVSQQNPHVPKRKFAMAERWCGESCDDGKHGHGQQQQRHRHRLAFVSTNKRYDSNNKPCWTREKRTRRRSFTALSSTFEDTTEASMSLEMITVTFNLDSRRPFGMSIVTKNNRSGFAGIYVHEVNPGGLVALDGRIRPGFIILEVNDISLDDLSSKEALNLIISSVRNATETRGQLKLVCAPSSESVELARNVFHPILAEPVRPIDPTAWIQHANAARGLDHQLQHFPPPPPTAHSQGQQPPICCIMPPQCQPNVAKPMASKSSTIPKTNPQQQGKVHEKQHQFAGAANCAVDGDIRMIQNPSTDITTTESGISSVECSIGQLEPSTKAKGASTGNRKRSKTTETKKRRGSGGIGTALRRLVCIRTTKRGGRGNSGEKKNG

SEQ ID NO: 1820 - protein, 383 aa, Heterodera glycines
  cDNA sequence=SeqID_1405; coding sequence=SeqID_1623
MANPSINAKAAVLVDNPRVEFVQLDSLVVMKIVKHGDIEFYAGMSKIAGETCQGILTGLISVEDKRLEVTNCFSITRPDALHESEESAAGPETSLSDENKQGEILDMLKRFRMMNIDYESVGFYQAHPFGACFSHELLGSLVDYQSDISDAVVIVYDPVKTRQGCLTLRAYRLSKKALDLAITCDDSWSPEQTKLAGVNFANFFEELPIVVKNSHLMNVLLAELALSTKCQRAASIRLELGTKQSLERSMKALIGTVDELNKAVNAYGKYTVEKQKYDTMYNNLMQKRQTENEARQSRGEPPLTMEDIKRQLKQPQMQTKYGMLDLLLNALDTDAFTTYQIQTTNENVAKLHLSQAVSAQPVVAASSAAIGTSAANAPNLERK

SEQ ID NO: 1821 - protein, 214 aa, Heterodera glycines; identical to SEQ ID NO: 1147
  cDNA sequence=SeqID_1406; coding sequence=SeqID_1624

SEQ ID NO: 1822 - protein, 133 aa, Heterodera glycines; identical to SEQ ID NO: 1214
  cDNA sequence=SeqID_1407; coding sequence=SeqID_1625

SEQ ID NO: 1823 - protein, 164 aa, Heterodera glycines
  cDNA sequence=SeqID_1408; coding sequence=SeqID_1626
MTISKNNKMMAHLNYKMKVIVQDSRVFIGYFKAFDKHMNIILADCEEMRRIKPKQGAKKSNVEEEKRILGLVLLRGDKIISISVEGPPQKEDSGVQLPKAGGLGGPGQGRGAGRGMPMGVVPPMGAVPPGLQGAVRGIGGPGMGGPMQPGYMQGMPQGMPPRPF

SEQ ID NO: 1824 - protein, 181 aa, Heterodera glycines
  cDNA sequence=SeqID_1409; coding sequence=SeqID_1627
MFNLQDRCKGVDQDRDYHATRISIRDKLLSQETKELEQNLRDLPTCKLIFPSTSALHEMELTVKPNVGLYKGGAFKFSITVPPEYNNVPPIVKCLTRVWHPNINEDGSICLSLLRQNSLDGYGWMPTRRIRDVILGLDQLFTDLIDFDDPLNAQAAQQWQTNKDGFAQKVKEYMTKYCPRN

SEQ ID NO: 1825 - protein, 246 aa, Heterodera glycines; identical to SEQ ID NO: 1188
  cDNA sequence=SeqID_1410; coding sequence=SeqID_1628

SEQ ID NO: 1826 - protein, 164 aa, Heterodera glycines
  cDNA sequence=SeqID_1411; coding sequence=SeqID_1629
MVFDPKSKDKARELGSYRDMRFEGSLPEQERRLAQSTTLYIGNLSYFTSEEQVWELFRRAGDVRRVIMGLDRFNKTPCGFCFVEYYTREDAENALRYISGTRLDDRVVRCDWDAGFKEGRQFGRGKHGGQVRDEYRQNFDSGRGGWNKTIQKRNDQFTQRNIKA

SEQ ID NO: 1827 - protein, 219 aa, Heterodera glycines
  cDNA sequence=SeqID_1412; coding sequence=SeqID_1630
GIELHKESRWYAGWKTFTESNSYYNKIIDWKTRIDESENIFVRTVRGTFERVQLAFESKDNVSEVLTQISKIDPEFDKSEWLRFCEKEMIPNILESTYQMNFEVLRDWCYEKAFNLIANSIKEYEKIGFNTRDSRIIDVSKVELVTGNMTDQGPTLVIQFQVFMTNVVKNSEGKIVQGDPEKAVRVRHIWVICRDMEEFNPATAWKLLELHMIKEDLFV

SEQ ID NO: 1828 - protein, 340 aa, Heterodera glycines
  cDNA sequence=SeqID_1414; coding sequence=SeqID_1632
MFDFHQFMGLGGGAVATYSVQLRAFSAPFFQRHDERRINELNYGGKILLPNSCLDNLMRRNIQYPMLFKLTNVGPALQRGTHAGVLEFLAEEGRCYLPSWMMAQLALREGDLITVEYKALPNATYAKFKPMSTDFYNISNPRAMLEVELRKFSCLTKGDVIAVQYNEQVYEFQVKALKPENAVTIVECDINIEFDAAEGYVEPNRTHQQRNEMVAAEEEQQSHPPNVFKPFSGSGFRVDGKKPRSVSTSSQQEATSSSSSSASSGRQPSSGIASTASTARDALEAIAVDENYIPGELRFVRRPYKSKAQRDKEAREKDNGGTMKPFGGEGNTIRPTRGGQ

SEQ ID NO: 1829 - protein, 346 aa, Heterodera glycines
  cDNA sequence=SeqID_1416; coding sequence=SeqID_1634
MGKTSKDKRDIYYRLAKEEGWRARSAYKLLQIDEICKIFDGVFRVVDLCAAPGSWSQVLSKKLYVSEKDEEKRKRVKIVAVDLQPMAPLPGVIQLQGDITEVGTAQQIISYFDGSLAQLVVCDGAPDVTGLHAFDEYMQSQLVYSAFSITSHILQNGGTFVSKIFRAKNVNLLYAQMKCFFKEVSCCKPKSSRLSSCEAFIVCKNYSPPEGYKPTLVNPILASDYNECLAQLEGPMNAALVPFMACGDLSGFDSDRTYPLNLEELSNEFKQFDYKYSHKDVLQPPTEPAYKKACEMKRNSELETNLDQQRQRTQSKKPAKNREAKEELQNDVIAELEEGCFERLLL

SEQ ID NO: 1830 - protein, 112 aa, Heterodera glycines
  cDNA sequence=SeqID_1417; coding sequence=SeqID_1635
IIEVPLNPTNPSQPNMEFVYEAIATLFTTHFKNLTEPQIRVTVKGFFSFNRTVTKMREHIRDFLVQIREEAGDDTADLFLEEKEAEIQRIQSLKQAIPGVRNPNELLEEDMV

SEQ ID NO: 1831 - protein, 665 aa, Heterodera glycines
  cDNA sequence=SeqID_1418; coding sequence=SeqID_1636
MKLLRLRSYLHFSCNLHVRNLTNLSKFGTYNEKAIQLIQQHYDEATSSSHQFVDSPSQEVFRMVLPPPNVTGNLHIGHAITVALEDAICRYQRLLGKKVRWTPGFDHAGMATEQVVQRQLAQRFGKQTDEMSQSEFVAHCEEWKEARIRDISGQLRSMACSLDWPDLFYTMDQNFSRAVRVAFCRLHSLGLIVRETRPVFTALSADEEKKAPEAVMMEQWFLHMDGMNGQLRSDLEAGKFNFKPPMNKGITEEFTKFKEPWNLSRQIVWGHRIPAYFVEKSKRWIVAESEADARAQLASDEADSPLLQDPDVLDTWFSSSLIPIVIAGWPDRPICGQSLELMETGYDIVGHWVAKMMMICHCLTGEYPFTRVLLHGMVRDNRERKMSKSLGNVVDPLDIIRGTGIEEMVERINSSNLPSEEKAVAEADLRKRFPRGMRHNGVDAFRFSLLQHDLTKAVIRVDFTLPLTEARNFCNRVWNLCKFTQRVFKAAHGCSHPWAENAEQTMAHDLAEMTFESEDIELKRQLALATRAYHCHMQSLNTNQALHTLRTFIGDRVNNEYLEQIKSVLNAQPADERRLRAIAETLREVVATSLGLLLPFLPQLCTFLQDALALDAQAAATRALRDAREYEKQQKTDDEGKEGEKLGGEEEEELRTTEKERREFA

SEQ ID NO: 1832 - protein, 128 aa, Heterodera glycines
  cDNA sequence=SeqID_1419; coding sequence=SeqID_1637
KLASIRRTLLLNYDTEDGLMEFRQYSIKSVPAGVSRSAKKLMQSKVPDLSKYKDISDFMLKPEQLSDSEFEGEQTELELTQDIGGRGKKRGQQTKLRLMEIGPRMTLRLMKIEEGVNAGTALWTHSST

SEQ ID NO: 1833 - protein, 256 aa, Heterodera glycines
  cDNA sequence=SeqID_1420; coding sequence=SeqID_1638
MKVINEFGYRQDARTPSQIRNIVYQMGVYSHADGSAYIEQGETKVLCAVYGPHECRFRSRAKEDEAIVICQYSQATFSVPDRRNRPRGDRRGNSFSHLLERAFESVIFTNLYPRSQIDIFFELLEADGANLAACVNVASLALADAGIPLRGLLSAVECGSADGLPCADLSSREHSELVPRLTMATVGGKDEIVLMDMKNLLHKNHLPSLLQMGVNACAQVHICLETAVFRHVEASHRKNTESGKQNSLLNRIVEGR

SEQ ID NO: 1834 - protein, 207 aa, Heterodera glycines
  cDNA sequence=SeqID_1421; coding sequence=SeqID_1639
PQDKGGVIVAVDSRATGGTYISSKTVEKIIPINDQLVATMAGGAADCQYWTRVVSKYCNLFELREGTQISVAAASKYFANVMYDYRGQELGVHSMVCGVDKFGPSIYMVEAEGTRVKIDTICSLGSGMLHAMSILDTKYKEAMTDAEALELGREAIVYATFRDAASGGHCNLCHITSEGKTIYPPFDVSDKYYEFMAKRGTPLVPEL

SEQ ID NO: 1835 - protein, 262 aa, Heterodera glycines; identical to SEQ ID NO: 1125
  cDNA sequence=SeqID_1422; coding sequence=SeqID_1640

SEQ ID NO: 1836 - protein, 179 aa, Heterodera glycines
  cDNA sequence=SeqID_1423; coding sequence=SeqID_1641
MGILTASKVCTLPRLSSARSMTWWWGPEKNNGREVVGPTFHGDEFYQDRLDRWYPSIRFRKNDEVITPIRHKELGDWKKLSIEEKKLIYRYSFRQTLAEFEALTPYGYLTVTLFFSMLGLTILYASFVRTYVTKFNDRLPDTFDDEYKESQAERRVVLERGNPYGPAYYYDYEKNRWKD

SEQ ID NO: 1837 - protein, 930 aa, Heterodera glycines
  cDNA sequence=SeqID_1424; coding sequence=SeqID_1642
VPFDVEYQQLKKTNTPAKLYEFKLDMFQSQALKCLDNQQSVLVSAHTSAGKTVVALYAIAMALRDKQRVIYTSPIKALSNQKYRELVEEFEDVGLVTGDVTLNPNASCVVMTTEILRSMLYRGCEIVREVGWVIFDEIHYMRDKERGVVWEETLILLPKTTNLVFLSATIPNAKQFTEWICYLKHKQCNIIYTDYRPVPLQHLVYSAGSDGLWEVVNIKGEFKQDNFAKAMSCLEERQPMGGEVRPQHGRRSGANDATQKSNVVKIIRTIRERDMLPCIIFSFSRKECEAYASEIKDIDFNTEEEKRAIKLIFNNAIDLLSDEDKKLSQIRHVLPYLMRGIGIHHSGQLPIMKEVVEILFGEGLIKTLFATETFAMGINMPAKTVLFTSARKFDGVSNRWITSGEYIQMSGRAGRRGKDEKGLVILMVDQQMSAETAMQIIKGTSDPLNSQFRLTYNMVLNLLRVPDINPQFMLGNSFYQWQNYSRLPDLLQKLNTKRQLFLSAHVDHLSELEGLFRLEKQIEQQRNAIKALVLKPAKVIRFFQPGRMLKLKCFDKDFGWGVLLRYTKKPNPLNPLSPEMLYFLDVAVFVSRESENCAQNLCAVKPPPPGENGVVVVLPFAFDCIQAVSTIRLKIPQELKSKEAFQAVAKTILETKKRFDQLIPELDPIEHMNISDPQLKKSLEELKRCEERFTEHPLRNRRDFDEIWEAFMKRQKLEDEYKQAKKEFDNGKKLSGLVELGYRKRVLQRLGYATEEDTITEKGRVACELSSADELLLTEMIFTGAFTDLSPADAAALLSCFVFQERAPIGKLSDSLSEHLRTMQGMAKKIAKISIECKLELDEEKYVESFCPAMMTVVSKWCSGATFAEILETSDIFEGSIIRCMRRLEELLQEMVNAARSMGDRPLEQKFEQARSLLKRDIVFSASLYL

SEQ ID NO: 1838 - protein, 318 aa, Heterodera glycines
  cDNA sequence=SeqID_1425; coding sequence=SeqID_1643
MANKMKKKKKNAVATTTAGPQKDGGKFKQKGIKFNTEKGQHILKNPGVVHAIVEKSAVKGTDTVLEVGPGTGNLSMKLLDRAGRLIAYELDPKMVAELQKRVVGTPVQYKLRIIAGDVIKAAEWPPFDVCVSNLPYQISSPFIFRLLLQRPLPRYAVLMLQKEFADRLLAKPGSKVYCRLSVSVQLLATVEHLMRVKRSEFVPPPKVDSAVIRIQPRNPPPAINYKEWDGMLRIAFMRKNKTLSALFKQKQVVDVLRKNYAVVCGTKGKEVPTDFCMTSHIERVLEEAQFAKRRARTMSIEDFLALMLTFNKADIHFC

SEQ ID NO: 1839 - protein, 567 aa, Heterodera glycines
  cDNA sequence=SeqID_1426; coding sequence=SeqID_1644
VVIMLSDLTMGEMKILPKDVQLCAEVATGVERMGQYQYQDLVMLDKETVGVIVRLERENVEVLSMHGKILRVNPQTIECKKNSRFVKALDSQKNTIQAGDTVKVVEGFLARKKETEEERQGEIKHLFRNWAFVFSRKYPQNGGMFVCKARNLALIGGSKASESQINTTILDNSQLMSPRPNPLESPRTIHGGMTPHSGSSVVGAQSVRGDHGFKAPSVVGSIATSATGVGRQHVRRNMEIMGKTVRVLAGPMKGYIGIVKDATESTVKVELHTMPKTVNFDINKVMEVGGAVPRELMDTAGAMTPGTATIGGRTPMYGGAQTPMYGGAATPMHDSFGARTPHYGSMTPAYDGSRTPSHQPSSSWDPALANTPAHSTAHFDNEFDTMGFGGGASTPAGSVRSRLGGANTPMGQMTPRDMFGDYSSSPYPNPSTNASLHPSKTPIGQSPALQEIMPDSEIPTGSWCMVDLCVNVLPTCGKDQLLGLEGSIRSIREGECCLYFEELDDDFTIEHEHVVPIRPASGDQAKVIYGHDRGVSGSLITTEGEDGVLQGPNGAKLYSMSVLCKLV

SEQ ID NO: 1840 - protein, 455 aa, Heterodera glycines
  cDNA sequence=SeqID_1428; coding sequence=SeqID_1646
MVAAPDEAQFHISFYTDEEECKNLLPAESINVPASSHSDQLNVLINQIGSMNDDSWKPVQFDFLLHSVLLRCSLLELVEQQQLSLENVLRIECIRQSPAPRPTAELNEAQWVADLRTLSHNCVLSVNFAGLLNVWELAGEWTRAVVKQLDDEPLKCVDTFTRDDGTTFALSGGQNQTLTLVRLRAQNRADDEDENEAQSSRGKGKWRAEPTAIFRGHQRSVECVAINARGNRAISGSFDKCLKVWDIENTGDQNGMPMAGKNTTRMNSTKRMRMDVPKITPMVTLESHREPVVGCAWHPSNLSQAITASWDHQLMLWDLQLAGPISTLTSNKAFSALSVCPANGLVLTSSVDSLVRLWDFRSRDGSMVKASFHGHVGVVSDVCWHSTDQHLFVSASFDNTVKMWDVRSPRAALYDLMGHSDRVLCVDWTVPSRICSGSVDSTVKVFSHGTEENIY

SEQ ID NO: 1841 - protein, 598 aa, Heterodera glycines
  cDNA sequence=SeqID_1429; coding sequence=SeqID_1647
PKPTLRFAAVRTLNRISIDYPQAVISCNVDLEQLITDSNRSIATLAITTLLKTGAEASVERLMKQIGTFVSEISDEFKIVVIEAIRSLCHRYPRKHATLMNFLASMLRDEGGFDYKKAIVDTIITIVEDNPGAKDLGLSHLCEFIEDCEHAALATRVLHLLGREGPTTANPSRYIRFIYNRVILESTQVRAAAVTALAKFGAECAQLRPSILILLQRCLLDTDDEVRDRATFYLVVLRTEKPQLILNYILDTLKVSVVGLERALEQYTSAAHFDAPFDLKQVPLSTEPLTASTDEVKKKAAMVDDASAAMKKQKEEKKSGTSRQEQFALQLASMPDFAACGALFKSCAAVELTETITEYNVSCVKHIFNDDFVLLQFDCRNTLNDQLLEEVFVEIEPQDEGEDCPWHVQSVHPLAQLPFGQPGTTYVLLKMPEDGRIAGTFGAKLKFKICDVDPATGEPESNDLYDEVYALEPIEVGLADFLLATAPKGASFTTAWDALKEEGHETEESYALSNVHTLEDAVSKLLKCTALFPCEHSNRVPEGKSSHQLLLCGIFRGGIDVLCRVRLVMDPSDQTVSMNMVVRSMDETVSQMIANIVS

SEQ ID NO: 1842 - protein, 437 aa, Heterodera glycines
  cDNA sequence=SeqID_1431; coding sequence=SeqID_1649
MSVPGSQPPQQGEDAEERLINEEYKIWKKNCPFLYDMVMTHALEWPSLTVQWLPDVQRQEGADYTIHRLILGTHTSDEQNHLVIAKLLLPNDDAQFDASRYDTDRGEFGGFGTVTGKIEVEIKMNHEGEVNRARYMPQNPVLIGTKSPSSEVYVFDYTKHPSTPADVECKPQLRLRGHTKEGYGLSWNNNLPGHLLSASDDMTVCLWDIQAATANANFLDAKSIFTAHTAVVEDVAWHVLHDTVFGSVGDDHKLMVWDTRTNSSTKPTHVVEAHSAEVNCLSFNPYSEFILATGSADKTVALWDLRNLKLKLHSFESHRDEIFQVQWSPHNETILASSGTDRRLHIWDLSKIGDEQSPEDAEDGPPELLFIHGGHTAKISDFSWNPNEPWVICSVSEDNIMQIWQMADNIYNEEELDPAMVESVAAASGAGPMGQQH

SEQ ID NO: 1843 - protein, 580 aa, Heterodera glycines
  cDNA sequence=SeqID_1432; coding sequence=SeqID_1650
MSDDYRSSIGPRPAFNRNSTAYSSTGGPVSGGNRVLKIVTETMSSSTSGGGGGMSPFGANAAQIRDSRDREKKELSDLNDRLANYIEKVRFLEAQNRKLKADLDMLQGRRGKDTITIKTMYESEIQTAKKLIEDTGRSKHELEQDVAKLQRDLDEQRRKYEEAVRSRAGDREKLDDLLVQLSNLEAEISLLKRRIALLEEELSKLRKENSRLQADLQRVRAELDQETLNRIDYQNQVQTLLEEIDFIRRSHDQEIKDLQAMAARDTTSENREFFRNELASAIRDIRNEYDVLNNKDRNDIESWYKLKVQEIETQSARQNMEQGYQKDELKRLRVQLTDLRGKLSDLEARNSLLEKQIQELNYQLEDDQRAYEDALNAKDAQIRKMRDECQALMVELQMLLDTKQTLDAEIAIYRKMLEGEGDGPGLKQLVEQVVRTTGINEVADTETMRVVKGETSSRQSYQRSAKGNVSILETSPEGKYVVLENTHRSKEETIGEWKLKRRIDGKREIVYTLPANFVLRPMARLKVWARNQGGLHAPPDQLIFDGEESFGVGSNVQTILYNAQGEERATHIQRSSQTAA

SEQ ID NO: 1844 - protein, 167 aa, Heterodera glycines
  cDNA sequence=SeqID_1433; coding sequence=SeqID_1651
ENLKFKRERREKFSQSAAIPSNLPPSTSNGQMGSLLLHDEMASASSGSSTFALDMDKLEQQRVQEQTTLLLDDTEQFHQSRFNAMESIESSISELGTIFRQLATLVSEQGEMITRIDSNVEESSLNVEAAHHELLKYFNNISRNRWLIIKVFGVLMAFFVFFVIFLT

SEQ ID NO: 1845 - protein, 343 aa, Heterodera glycines
  cDNA sequence=SeqID_1434; coding sequence=SeqID_1652
MGKGFQNFMSKKDFHPSAWWNLKRKWEAEQKNDLEKRRQDELRVQYEKEQEILNNKALLGDEKARLGLSFMYDAPAGINKKKEEGPEPKFEWQRKYNAPREEWAKGNELIQDQPFGIQVRNVRCVKCRAWGHLNTDRECPLYGMSGNAEDHGYANNPSDIIRDLNVEKKTKTVSDVTTNEQIDIKPKIEVRKSHEEKKKKRRHYSSEEEEEGTEEEEKKPEPIDQEQLLVNMREEHNLKFKTGILIGLRADEHIKKMSAMVGGGEEKTFEAFLKGLDEKKRRKLMKKIMKTEVSDDSDIEKDKKQRRKQKKEEKRKADKKHKHRRSSSRETSRKRKEGKHHRH

SEQ ID NO: 1846 - protein, 212 aa, Heterodera glycines
  cDNA sequence=SeqID_1435; coding sequence=SeqID_1653
MAPRGNNMLPNAHFHKHWQRRIKTWFNQPARKERRRAARSAKAARLAPRPAGGLLRPVVRCPSVRYNKKCRVGRGFTLEELKRSGMGKYQARSLGIAVDTRRVNRSVESTERNVARLKEYRSRLIIFPKKMNKPKKGDSSPEELKLAAQMPGSVVMPPVVKQRRLKAEPITEAMNKFSAYCHQRRVRADKRLKGKREKKAKEAADEGLGKGR

SEQ ID NO: 1847 - protein, 206 aa, Heterodera glycines
  cDNA sequence=SeqID_1436; coding sequence=SeqID_1654
MAAMNPEYDYLFKLLLIGDSGVGKSCLLLRFADDTYTESYISTIGVDFKIRTIELEGKTIKLQIWDTAGQERFRTITSSYYRGAHGIIVVYDITDQDSFNNVKQWLQEIDRYASESVNKLLVGNKCDLTTKRAIETNVAKEYADQLNIPFLETSAKNSTNVEQAFITMATEIKNRMGPLQQAGGNASAVRIGPSQPVQDKKTGGCC

SEQ ID NO: 1848 - protein, 435 aa, Heterodera glycines
  cDNA sequence=SeqID_1437; coding sequence=SeqID_1655
VCSLSLTVTAALMDNYKVNPKDIGFLAVGTETLVDKSKSVKSVLMDLFADSGNMDLEGADEKNACFGGTQALFHAVDWMYANYATEKRLAIVVCADVAVYSAGPARCTGGAGAVAFLIGPNAPIALERGLRACHSQNVYDFYKPIGGVSTQFPRVDGPNSVETYLNAVDMCYGRFCEKWNKKFCTGPPCSLSDFVAVIFHSPYARLTQKAFSWLSFVDFKRGMMDDGVTADDDDVSDWDQLSAYKSKSLHEIFAVERTKTRSDGDRFTDKILRMSSRTADAKLNPFLEFSRRIGNMYTPSVYAQLINVFLNTELSDKSNGKRILIFSYGSGCIAAMYSLRFNLCTEKLMAAYGAIKQSAKKAHARLDQRIRHSPKQFTAALERTEQIVAGGDTYIETPDDGKRSDGIPMFAGTFYLREIDSKQRRFYGQIDDANE

SEQ ID NO: 1849 - protein, 294 aa, Heterodera glycines
  cDNA sequence=SeqID_1438; coding sequence=SeqID_1656
MVFVKAVKNKAYFKRYQVKYRRRREGKTDYYARKRLVTQAKNKYNSPKYRLVVRITNADVICQIVYSKIQGDFVLTAAYAHELPRYGVKVGLTNWAAAYATGLLVARRALKKLSLDDKYEGFVNPDGTIAEVEPLEDGPRPFKAFLDVGLARTTTGAKVFAAMKGASDGGIFVPHSEQRFPGYDRESKELDTDVLRSYIFGGHVAEYMRYLQEEDEEKFKKQFSRFIAEGLAADDLEEMYEKAHEAIRANPEAVKSTVQIDVEKVKKFKKQRLNLKQRRDRVKQKKAAFFAQLE

SEQ ID NO: 1850 - protein, 169 aa, Heterodera glycines; identical to SEQ ID NO: 1162
  cDNA sequence=SeqID_1439; coding sequence=SeqID_1657

SEQ ID NO: 1851 - protein, 139 aa, Heterodera glycines
  cDNA sequence=SeqID_1440; coding sequence=SeqID_1658
MIYHRFVEIGRVVYIAKGKDQGKLAVIVNVIDGNKVLLDGPSSGVPRGVWNFKDLQLTKFTLPLRIGQRTKGVREAYETAKINELWQGTEWAKRIDRKQKRAGLNDFERFKVFKAKQHRNRLVRVEMAKLKKISKPTAK

SEQ ID NO: 1852 - protein, 311 aa, Heterodera glycines; identical to SEQ ID NO: 1203
  cDNA sequence=SeqID_1441; coding sequence=SeqID_1659

SEQ ID NO: 1853 - protein, 159 aa, Heterodera glycines
  cDNA sequence=SeqID_1442; coding sequence=SeqID_1660
MKTETCVYSGYKIHPGHGKRVVRADGKIQIYLSKKAQRGAALKRNPRDVPWTVLYRRKHKKGVHAEEGTQRKRVKRTVQIASRPIADLTVEALLAQRNQKPEFRKQQREAAIKAAKESARVKKDETKKKQQKIDKKAAPTKTKAAKQVKAPKQFVGGKR

SEQ ID NO: 1854 - protein, 536 aa, Heterodera glycines
  cDNA sequence=SeqID_1443; coding sequence=SeqID_1661
MGTPSRRGRKRKSEVVPDKRTSTSSARSKPLMPRKSFVPLSIEQFRPTAVGTRVLSCGEGEQLGHPNRNTTKKPRAVGTFPTDMTFVQVAAGGVHSLVLTTDGRVFSCGINEKGTVPVQGLEAEGTTDTFSEIVFTTDIQRLGKIVQITAGASFSAALTEKGSVIAWGNLRDTQGEVNVHETLTDIQKKPMVVMRHKNKQNCHIVKIAAGENHLAMLSNEGQILTFGEGSMGQLGRSVRTEHIRARYMVDESGASLTLRVLEHKQFVRFVNIWARGFWTIGRAEDGRLFVCGLNNFGQLGVPPQSPAHRKSAAGTSDEDDGGIGPPKPKSPATIAAGQEESNKVALLTCATAFPADKRWTHVAGVQHVICRSGDDSQIYGIGKNTDNALGLDTWQGNHDEEHWRYDTLQHIPLPDGVNAVAGVDATLGATIFWTDDGRVFGFGCDTVGQLGLGIKEEDEKVVSKPRQITSAHLDGYRVLGVSIADNHALFLAASIDQQPPLPSASPPPPQQQKAQQHQQLQTNGNGILETPIDGKA

SEQ ID NO: 1855 - protein, 367 aa, Heterodera glycines
  cDNA sequence=SeqID_1444; coding sequence=SeqID_1662
VGAIAATSIGEPSTQMTLKTFHFAGVASMNITQGVPRIKEIINAVRSISTPIITVALADERDEKLARRVKARTEKTTLGDIIDYVEQVFLPDGLYVLVKLNTRRIREMELEVTMDTIIDSICASKLPVSRILCDQIRSVGKSMLLVRPVESSKSRTKFNNSLVIAEVLGIEAARGSIISEILAIMGKHGIELDRQHVLADLMIYRDEAAFFGQQDRIFCFLVTSAALYAAQLPLPLRLIAFTTCLNFAGALQPGQSEWFSNDPLTRFIKKAWQPRTGKDCETETDGEQTRTKMLTGLFCVSVLAALKVIFLHTWPRIRRRFLTWIREKEQIATPTNGSNLVGLQNLINKPNAQHTEIANSEQAVQHH

SEQ ID NO: 1856 - protein, 365 aa, Heterodera glycines
  cDNA sequence=SeqID_1445; coding sequence=SeqID_1663
MDSVKKAAVSGSLTASGSAAARDDGSSVGRPARTLLSDLELSEPILTENKNRFVLFPIKYQDIWQMYKKAEASFWTAEEVDLSKDFHDWENRLNDDERHFISHVLAFFAASDGIVNENLVERFSQEVQVPEARCFYGFQIMIENIHSEMYSLLIDTYIRDPAQRDYLFNAIDNIPCIQKKADWACRWIEDRNTSFAERLVAFAAVEGIFFSGSFASIFWLKKRGMMPGLTFSNELISRDEGLHCDFACLLFKHLNHKPSVSTVTQIIKEAVEIEQEFLTDALPVALIGMNSTLMSRYIEFVADRLLVALGCDKVYEVENPFDFMELISLQGKTNFFEKKVGEYQKAGVMSGNGAATHSFTMDEDF

SEQ ID NO: 1857 - protein, 206 aa, Heterodera glycines
  cDNA sequence=SeqID_1446; coding sequence=SeqID_1664
MPNIMGLHGGSMIAMRSKDSVVIACDLRLGEQAMKNIATNATKIHPISDNVFIGLTGFNADATTVLNKLRTHQAIYEMREQRPMSPKALTSYLAWMLYKRRFGPFLIEPIIVGLNQQNEPFISHMDVVGSVSEPEDYTVGGTGGDLAMSLCEALWRPDMTSEEMTVAVGQAMLAVVERDASTGWGVVIHTITAEGVTTKMIKSRMD

SEQ ID NO: 1858 - protein, 122 aa, Heterodera glycines; identical to SEQ ID NO: 1207
  cDNA sequence=SeqID_1448; coding sequence=SeqID_1665

SEQ ID NO: 1859 - protein, 192 aa, Heterodera glycines
  cDNA sequence=SeqID_1449; coding sequence=SeqID_1666
MPKKKNGTTDEKGCLLITNYFPIRRSKRITTKELEDIKLKELKELIDTGFNEDHLEVFRCSVKGRSVRASKCFQRGEFVVEYKGDLISVKTAQLREQRYAKDENVGSFMYYFRHRDNVFCIDATDETPYKGRLINHSYLKPNLKTRVADFGCDGFHLVLVAMRDIDNGEELLYDYGERRPSVLAVNPWILGS

SEQ ID NO: 1860 - protein, 181 aa, Heterodera glycines
  cDNA sequence=SeqID_1450; coding sequence=SeqID_1667
MPIKASGETLRKYIVVGRKLPTANDPNPTLHEMVIFASNHVVAKSRFWYFTSMLRRVKKTHGEIISCQEVFEKKPGSVKNFGIWLRYDSRTGHHNMYREYRDVCEAGAVTQCYRDMGARHRAQADRIQIIKVQTISVADCKRAGVKQFQNSKIKFPLPHRVNSKRRNMTPFTTQRPRTHFV

SEQ ID NO: 1861 - protein, 181 aa, Heterodera glycines
  cDNA sequence=SeqID_1451; coding sequence=SeqID_1668
MTAPCIDVGNLLLINVETDAEDLASSNSERINELTSKNAQLLFNEIWKLPRKIVQDATCSQLPEYTYGLPREKPIPKPKEPTKWEKFARAKGITKKKDRKVWDKTTQEWKPKYGYRRAENQSKEWLIEIPDQKDPYKDYFAEKAEEKREKNNKQELQRLKNISRASNKSKVPTGNRKVFKD

SEQ ID NO: 1862 - protein, 313 aa, Heterodera glycines
  cDNA sequence=SeqID_1452; coding sequence=SeqID_1669
MSQADAGRIIHIGKRRERAKEDIESQRQRLEEERRNLAASIKAKFTTNIDEQEEKFKERTVGLVTLDEVKERQNEIFYSGPSLKFSNEDRPKFEKAIQKRVLSFGAFDDDDDEEDEALIPITKKRHGMDPTVDTSFLPDRERDEQLQRERERIAKEWQEMQEREKNEEITVAFCYWDGSSHRKDSKTKKGTTIAQFLQKALDTFRKEFLELKLATVDNLMFVKEDLIIPHFYTFQDFIKTRQMGKTGPLWQFEAVGEIRVRQDAALDIGESHPVKVILRSWYEKNKHIYPASRWEPFVPGKVYKRTIDDLSTI

SEQ ID NO: 1863 - protein, 252 aa, Heterodera glycines; identical to SEQ ID NO: 1080
  cDNA sequence=SeqID_1454; coding sequence=SeqID_1671

SEQ ID NO: 1864 - protein, 188 aa, Heterodera glycines; identical to SEQ ID NO: 1156
  cDNA sequence=SeqID_1455; coding sequence=SeqID_1672

SEQ ID NO: 1865 - protein, 148 aa, Heterodera glycines
  cDNA sequence=SeqID_1456; coding sequence=SeqID_1673
MADAAAQEQKKKRTFRKFVYRGVDLEQLLEMNEKQFNQMIPARQRRKMNRGLNRKHKSLLVRLRKAKLNCPELMKPECVKTHLRDMIVLPEMVGCVVGIHSGKAYNQVEIRAEMIGYYLGEFSITYKPVKHGRPGIGATHSSRFIPLK

SEQ ID NO: 1866 - protein, 175 aa, Heterodera glycines
  cDNA sequence=SeqID_1458; coding sequence=SeqID_1675
RTEVLARDAEIDGFDTAKFVFTDISFDATDMDRTVVVREQDGTLRTALPEEHDRMNRLFFVQPNRPVNEPPLFAMTDEWLQKTLDRDEHEFVLDWACHFYEPDAPKFVELCKYIFDHTLENDKLDVLYSTRHFGTLAFYLVINGKMDKLLEFYEQKNRNDGVDQTRQLWQILSCY

SEQ ID NO: 1867 - protein, 189 aa, Heterodera glycines
  cDNA sequence=SeqID_1459; coding sequence=SeqID_1676
VQSVAISQNGDLYMTKQPTHGTEESAIWRSHIDHPIAWEEFCSTFDECFQSLCVYDNETLAVAVVSSPVNLYSKQCIKWVATKDCRIIGSFSAAGKDNGQIFFPRCLQKHGDSLLILDKTGRIQKFTREGHFVEISAKIDDYIGNGFTIREDEAVIACSGIVKDEEGKTMCDDWVENIRLDGSRWTEEA

SEQ ID NO: 1868 - protein, 415 aa, Heterodera glycines
  cDNA sequence=SeqID_1460; coding sequence=SeqID_1677
LIAKVRPSSYGQRRNYSSIDISAEKWLMHYDADSLAKLENPPSLADGINRELERDIRYLGCELIQSGAILLRLSQTSAATAQILFQRYYYLKSFVRYNFEHMVQACLLLASKIEEEPRKPRDVLNVYNRLKQIHHRRNAVASQHPEDLQKLSKKFEHLELCSKRYQELKNIVIKAERRLLNVLGFVVHVHHPHKLIYIYLHILDQLKNDQKKYSASEIRKSRQLLQKAWSFMNDGLRTDMFLRYTPETIACACIQLAVRTVDQPIVLPTEPFAWFELFDASDRDVRAISQTIWELYTRKKAPNLKWVSDHLEQLYQKAVVEPEKARKEKTMVEMRDIKEQILQRKSAMLFGAGKTVADDRSPPKRRRRDMAGQNVAETKRRRDRTPPRQNVAETKRRRDKTSPRQNVAEKKYSKN

SEQ ID NO: 1869 - protein, 89 aa, Heterodera glycines
  cDNA sequence=SeqID_1461; coding sequence=SeqID_1678
MGDRKAVIKNADMTEEMQQEAIECATQALEKYNIEKDIAAYIKKEFDKKFNPTWHCIVGRNFGSYVTHETKHFIYFYLGQVAILLFKSG

SEQ ID NO: 1870 - protein, 447 aa, Heterodera glycines
  cDNA sequence=SeqID_1462; coding sequence=SeqID_1679
ADFDGKEIWLRGRLHDSRGKGKNCFAKIRQRIHSVQAVLFVGADISKQFVKFVQNIPKESIVDVYGLVARTPQPVTACTQSDVEIKVHKFFIVSQAEPRLPLQLEDAVRPDNDQEELAVVKLDTRLDNRVLDLRTPTSQAIFRLQGGVCDAFRKILSSRGFMEIHTPKIISAASEGGANVFEVSYFKGHAFLAQSPQLYKQMAIAGDFGRVFTIGSVFRAEDSNTHRHLTEFIGLDLEMAFNFHYHEVLQTIAEMFIDLFKYLQGNYIAEIEAVRRQYPAEPFLFTQSPLVLQYPEAVAMLKKAGVEQGDEEDLSTPNEKLLGRLVREKYQTDFYVLDKYPLAVRPFYTMPDPNDTKYSNSYDMFMRGEEIISGAQRVHDSAMLTERAKLHGIDIEKIQSYIDAFRFGCPPHAGGGIGLERVTMLFLGLPNVRLASLFPRDPKRITP

SEQ ID NO: 1871 - protein, 244 aa, Heterodera glycines
  cDNA sequence=SeqID_1464; coding sequence=SeqID_1681
MTLRLGSKLKFSILLQNVGIRKNPFRNSYNYPITFEHVVFPPNNQFKLPTMPPEPIYDESLGETKHKLTKQFIEARGFEPIHTELIHKQYGLVAMSGGFIKAEDFAWIQQEVNEKLVDKQFAIWRVDAPWLPRVRRPPSTKKGGGKGPIHHYETPVRTGRVILELGGYITEQEARSILMHLYLHMPFPVEFVSQELMDKRKGLEMKVRANNRNKFDWDTLIKYNMQNCKAWLSPYDVYWKCRYK

SEQ ID NO: 1872 - protein, 88 aa, Heterodera glycines
  cDNA sequence=SeqID_1465; coding sequence=SeqID_1682
EGEIVGMISVKHVYEIAKVKSQDKSLIGVPLKEICQLVIERADSIGIKVQNEDLDPEEYRKFLEHRQEVVQRQLEEIAKQEEAKLART

SEQ ID NO: 1873 - protein, 82 aa, Heterodera glycines
  cDNA sequence=SeqID_1466; coding sequence=SeqID_1683
MSALIPFIIVTLFWAVIGAGGPFLVPSGMNRGIIQTMIVLTAVCCYMFWLIVYLHQLNPLIGPQLPVKTIWWIHNTWGNVKN

SEQ ID NO: 1874 - protein, 225 aa, Heterodera glycines
  cDNA sequence=SeqID_1467; coding sequence=SeqID_1684
MLPAIKPANSDGIVLDALPYIDDQQYTDEHRQLALQLIQAECKKFPMTKNYLRNLPEPDYDKFTTPRIMEHQAKMANKQEIEKIDLLRYEVPSPANTSRSGNKKAWLGAIDNCRAQLSNQSLRKMNLELLDEFGPEAFLRSNQHLKKQVEKEEAELFKLRSQLYELNARRKRSQLDAGERLAALGQTWVELVTKNAAMVVANDKLETEIRTLAKLCKMDSGICKK

SEQ ID NO: 1875 - protein, 208 aa, Heterodera glycines
  cDNA sequence=SeqID_1468; coding sequence=SeqID_1685
MSTASESGSDKIVFQKNVTGRGSQVLDDAEFVKMYDRSTSKTLNTSSANDNAQSNQQKEQVQKWKVGDQCMALYEVDGKWYPAKIEQISPVKNTCTVSYIGYDQKAILKLEDILGESDVEAADDHGDEREAEGTSGTTKIADNDVKKDAFPIPDLCPPPPPSMFGKIAVAGNEKEALTNMLMSWYMSGYHTGFYQGVMHEKTTRQKPK

SEQ ID NO: 1876 - protein, 184 aa, Heterodera glycines
  cDNA sequence=SeqID_1469; coding sequence=SeqID_1686
MVVLSKLGSPLRPFSNDYLLCRFQAFRNYAIKKERPPPAKIQVPPPANETGHWKYERDYSYDLRYSNPINKYSSFTRFITLTATGHKELWALFALLMLSSSLAIGIVFYSLGKIEVWVDRSTSTPPWDWARVRDKYWKFPTVLYDPTGITHVRLSPMEKLQDEMLEAAKERGTRDAKGYWVGKQ

SEQ ID NO: 1877 - protein, 251 aa, Heterodera glycines
  cDNA sequence=SeqID_1470; coding sequence=SeqID_1687
HEGLRGYCSRRIERIRKSLKFMHSYKCAPKRTAKFIARNVSAELIGDLRFLQIAVFEVERNWAYAMQMKFEMIDLPLSRKKFHMRQKLRRAVKSAHFLHSLINDNPLVHEVTRVETVSYVSFIFGSLELELKNWKRAIETFDRARIGYSELLEQVRNSDLSETYATKCREVENLLILCRAQTGDANVLLSTVSSVNLNASEDDRKPSPEQLIGKAITESTKQQKKKARMMKEPKPIKPFFYDLAANFTEVC

SEQ ID NO: 1878 - protein, 340 aa, Heterodera glycines
  cDNA sequence=SeqID_1471; coding sequence=SeqID_1688
TRRIQSVPLIIGQFLEAVDYDHAIVGSTTGSNYYVRVLSILDRELLKAGCSVSLHKYSNALVDVLPPESDSSIQMLRADEKPDVVYSDIGGLDTQKQEVREAVELPLTNGELYEQIGIEPPRGVLLYGPPGCGKTMLAKAVAKHTKASFIRVVGSEFVQKYLGEGPRMVRDVFRLAKENSPCIIFIDEIDAIATKRFDAQTGADREVQRILLELLNQMDGFDQTTSVKVIMATNRQDTLDPALLRPGRLDRKIEFPMPDRRQKRLVFATVSSKMNLSDEVDLEDYVARPDKISCADISSICQEAGMFAVRENRYMVLNKDFNKAYKQVVKKDSDEFAFYK

SEQ ID NO: 1879 - protein, 211 aa, Heterodera glycines
  cDNA sequence=SeqID_1473; coding sequence=SeqID_1690
HEGTQRSRQQLSSSEGLAESTARELLEQREKLERAEQNLDTIHHTTQHTQRSLNSLKSWFGGLVRNKLSRAPKGLGTANANANNQQQQLEQTVQQQHQQRPLHAHLVQSSADEFAGAIGGGGGGVQPPQQHSLNSSSRAYIQGTRWEAMDDEIDNNLDLMSAHLGRLRTFGVALGDEVQDQNLMLDRIQKKTERNDGVIRSQEDQMRKLLG

SEQ ID NO: 1880 - protein, 164 aa, Heterodera glycines
  cDNA sequence=SeqID_1474; coding sequence=SeqID_1691
MSGDNSALIAAEQAAYGPFFGSLGVTAAMIFTAAGSAYGTAKSGTGIACMAVARPDLVMKAIIPVVMAGIVAIYGLVVAVIISGRLEAAGPGYTIDRGFSQFAAGLVCGLCGLGAGYAIGVVGDAGVRGLSQQPRLFVGMILMLIFSEVLGLYGMIVSLLLSSS

SEQ ID NO: 1881 - protein, 132 aa, Heterodera glycines
  cDNA sequence=SeqID_1476; coding sequence=SeqID_1693
MTKKRRNNGRNKKGRGHVQPIRCTNCGRSCPKDKAIKKFVVRNIVEAAAVRDITDASVYDQYALPKLYHKLHYCVSCAIHSKVVRNRSREARKDRNPPPRFGQRSAVDRPQRPGGAAPGGPGGVGMMQAIRT

SEQ ID NO: 1882 - protein, 421 aa, Heterodera glycines
  cDNA sequence=SeqID_1477; coding sequence=SeqID_1694
GVGIFESDNKLSPRPFFPWTEIKCISFKNKMFTICTADKSKIKFRAQDMSINQSLLDLCVGTHNLYLRRRQPDLLEVQQMKQQADEQRRRRMEEQVRLHREREQRAQAEQERDRYRAELNHLSEQLSAMQNVIRSAEETQVLIAERARLSEQEAIEQARRASEAEAEAQRAKLSQLRAEETKMLLERKIRETEMAAQRMAALQHQQQQKQQQQQNGITTPGTATVAQQQQQQQQMQQPPPYQEVVENRQQTQQQQMPLANGVGAAAVPLNRPTTAQSPKNNGGTTTPNNNNNNNNNLIVVTSPQQMAPLYFGGCQYEMATTMSDSRTSVAAELQHIFAELEMSRSEYNERNQSLRDRLANFRAELDSLKREGTDTENDRLFAQKVMAGDAFDKFSTLRKSIIGSPKSRVKLFDELAPMNGQ

SEQ ID NO: 1883 - protein, 105 aa, Heterodera glycines
  cDNA sequence=SeqID_1479; coding sequence=SeqID_1696
MLLRFSLTVQLLLLFFAFEVFGAEPPEGAQNEEGQRDSKRLEMARKGLNVHMFSSPNFAPMFGIIAGLSVVLIIAIVFIVVGLLSMEPAKDSIIYRMTTTRLKKD

SEQ ID NO: 1884 - protein, 192 aa, Heterodera glycines
  cDNA sequence=SeqID_1480; coding sequence=SeqID_1697
MSLRFFGFHDSVSEGKFLWEILTQLRGLGVGRCVTKSEWMRRWPDQPSYMRIVKARPTMDRWLQEGSLWADWTFRGKHLGVYEFGTDLNRSDWVLIHKHEEKKFTENRQQMGTLNIPSTFPVPPLQQLLSKKWAEKCGGSEAAVHHKKRAPLDVCLDPNFEMYRKFIKRVEPKKMSVSIYDEIDPGVFLDLY

SEQ ID NO: 1885 - protein, 170 aa, Heterodera glycines
  cDNA sequence=SeqID_1482; coding sequence=SeqID_1699
ASSSAIKRGSDLTSDEMFTGEGFSQQGLLNYAVGFFKKGRLFLLPVDKTFEMRKPLRGTIERESTARTTALKPSSSVFSTSTRSVAADSAPSGTASASSSSVAVAAPLRIRFARAENDLQRRRREQSSFYKQKLVEQDQWIPLKVEHRDLLEMYEKDINKVLLSSECPPK

SEQ ID NO: 1886 - protein, 156 aa, Heterodera glycines
  cDNA sequence=SeqID_1483; coding sequence=SeqID_1700
AVVSRMWYIGKETCKFFHGAVKVFFDPNWQIPKTKLDPRMPAYPTQLHEWLRMFPWRHYWAYYPILRNFCYVFASAFVVTSITQPTSVKITKEHVINHELHHIEAKMLHAYTQRKEDLKYFKENDVMAKLRPKNFARDLSMGDFNYFPWGYSFGAH

SEQ ID NO: 1887 - protein, 162 aa, Heterodera glycines
  cDNA sequence=SeqID_1485; coding sequence=SeqID_1702
MAFRALSFARRPFTTSSICRKEIDLVAGVYLNKVREVVGKQSEILNSPQLKKQLDDQLNRLAQKFHLPDADAVAKLGLQFKGASVVSSVDQLVDGGQSVDAQLNALNDSRAKYEAEQKGKRQAEQERIGAISGDADYAKEFFPIPPPHIEAQQLAAAAKAAQ

SEQ ID NO: 1888 - protein, 280 aa, Heterodera glycines
  cDNA sequence=SeqID_1291; coding sequence=SeqID_1486
HEDNQEPVTKRGFCQFVLDPIFKVFDAVMNIKKDEVAKLVEKLNIKLTLEEKEQEGKPLLKTMMRKWLPAGDTMLQMIVMHLPSPVTAQRYRMEMLYEGPHDDEAAVAMKNCDPNGPLMMYISKMVPTSDKGRFYAFGRVFAGRVATGMKARIQGPNYVVGKKEDLYEKTIQRTILMMGRYIEPIEDIPAGNIAGLVGVDQYLVKGGTITTYKDAHNMRVMKFSVSPVVRVAVEPKNAGDLPKLVEGLKRLAKSDPMVQCIFEESGEHIIAGAGEMKARI

SEQ ID NO: 1889 - protein, 273 aa, Heterodera glycines
  cDNA sequence=SeqID_1304; coding sequence=SeqID_1487
TRREYLPKVLGSSFAATIGPYRGYDPNIDPTVANEFTSQAYRFGHGMIQEFYPRLDSAGRTIPSGGFAFVDGTLHSDHFIFQGGPDPIIRGMMSQQLKRPQRLTRTITEQMFGTTDLGTINIQRGRDHGVPSYMRFRQLCGLSTATTFDQLSREIMSVEARQNLQRIYGTPDRIDLFVGGMLEDPVVRGLVGPTVACIIGPQFARTRDGDRFYFENPGIFTRAQLAEIRRSSLARVICDNGDDFRTVPREAFRTGPIVQCTEIPQMDLSKWKE

SEQ ID NO: 1890 - protein, 391 aa, Heterodera glycines
  cDNA sequence=SeqID_1316; coding sequence=SeqID_1489
HEAEIVATLFFAEMRYDVKDPRSASADRFILSKGHACPILYAAWEEAGLLSRDQVLSLRKIDSDIEGHPTPRLNFIDVATGSLGQGLSCAAGMAYTGKYVDHSSYRVYCLMGDGESAEGSVWEAAAFASFYKLDNLVAIVDVNRLGQSQETQLQHDIEAYVQRFAAFGWNAIGLEDGHDITALLNAYANAKNVTGKPTAIIAKTLKGKGIDGVADLNNQHGKPVSKDKAEPIRALLKSDKPANWTIPAPIRDAPAVDLGIGAIAMSAPPQYKMGEKVATRQAYGNALLKLAEANKRVIALDGDISNSTFSNLVQKKLPEQFVQCYIAEQNMVGVGVGMACRGRVLPHVSTFAAFFTRAGDQIRMGAVSFTNVKFTGSHCGVSIGEDGPSQM

SEQ ID NO: 1891 - protein, 298 aa, Heterodera glycines
  cDNA sequence=SeqID_1276; coding sequence=SeqID_1500
RPPVDEDYRPIRVLGQGAYGEVWLVTSKENEREQFAMKKIPVKATEEGIPQSVVREVASLVALKQMKHPNILRLHDAFIRRKGGTISLNIVCEKCDWDLCDFLRKIPKNMCDAQCKYFARQIMTGIDFLHANSIIHRDLKPQNILVNKDHTLRIADFGLSRNYGLHATFTTEVVTLWYRSPELLLQCKYGTAVDLWSAGCILAELYTRDALFRGDTEAEQLRIIFEKLGTPSVSVWPADAIVPHSFYAENSPHITPPFANQMPQYLPASGVELLTAILQFNPHERPTAVECLQHKYFV

SEQ ID NO: 1892 - protein, 483 aa, Heterodera glycines
  misc_feature (294)..(294): Xaa can be any naturally occurring amino acid
  cDNA sequence=SeqID_1296; coding sequence=SeqID_1519
MAADNFDAQRILNILAERDNFQSNELADQLSIDHQRLIGAIKSLQVKEGLVCTSEVKIKRIELTAEGEEIIQKGSHEFNVFKIVGEKGISKSEIEKTSFGPIGLGKAMQCGWVGMDTRDGVPLVVRKVANAEDGAKEQLKLVKNGKGDQLTAQCVAQLKKRKWIMESAIKALSVAKGPNFTTTVQKQELDLTSEMIASGSWRGKQFKQYNFSAMGVPPPSGHLHPLLKVRAEFRDIFFQMGFSEMPTNRFVESSFWNFDALFQPQQHPARDSHDTFFLSRPALSTEFPEDYLEXYRYDWKLEEAQKNLLRTHTTAVSARQLYLLAQKPFQPSKMFSIDRVFRNETLDATHLAEFHQVEGVVAERNLSLAHVIGLFTEFFRKCGIENLRFKPTYNPYTEPSMEIYAFHTGLNKWVEIGNSGMFRPEMLLPMGLPEDVAVAGFGLSLERPTMIRYGISNIRELFGHKIDLEMIYRNPLCRLEQKN

SEQ ID NO: 1893 - protein, 340 aa, Heterodera glycines
  cDNA sequence=SeqID_1308; coding sequence=SeqID_1530
HEARHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGLVLDSGDGVTHTVPIYEGYALPHAILRLDLAGRDLTDYLMKILTERGYSFVTTAEREIVRDIKEKLCYVALDFEQEMATAASSSSLEKSYELPDGQVITVGNERFRCPEALFQPSFIGMESAGIHESTYNSIMKCDIDIRKDLYANNVLSGGTTMYPGIADRMQKEMTALAPSTMKIKIIAPPERKYSVWIGGSILASLSTFQQMWISKQEYDESGPSIVHRKCF

SEQ ID NO: 1894 - protein, 229 aa, Heterodera glycines
  cDNA sequence=SeqID_1319; coding sequence=SeqID_1538
HEVNIGIQPPKGVLMYGPPGTGKTMLARAVAAQTKSTFLKLAGPQLVQMFIGDGAKLVRDAFALAKEKAPSIIFIDELDAIGTKRFSSEKAGDREVQRTMLELLNQLDGFQPNDDIKVIAATNRVDVLDPALLRSGRLDRKIELPAPNEKARAHIVRIHSRNMNVDKDVNFDELARCTDDFNGAQCKAVCVEAGMIALRRESHIILHEDFMDAILEVQAKKKTSLNYYA

SEQ ID NO: 1895 - protein, 470 aa, Heterodera glycines
  cDNA sequence=SeqID_1356; coding sequence=SeqID_1574
MKIGHRTPPRQKRATDPPPQFDSSDLGSPQKVWSLLCEKDEKLRRDPHVFSRQKKINAKMRAMLLDWLMDVCADKQLHRETFHLCIDYIDRFIALSDHQMQPQRLQLFGSTALVIASKVEEIYPPKIAEIAEYTDGCCSEADIRGIEEIMLEKLDWTCYPVTAVHWLALFMQLMSTDEVIPAQRVVISAGKRPLDTPSLNGDSSFVIGKPSLEVSIESALPNDENNQPDDAQRAESRPSVPSVSSPCPSPSSCAVGEDVQLEVSSVVFAGASRVRRISFSCAYPRMQLCHIGSSPRVLLHTTRADISYVGHNSYSSGHIYPDQRCTVPKLMRGEFVRMAAILDLAMLDSGCLRFRYSELATAVVLCCYEPEHLICQLTGFSPEKVRDARAYIEPFVRVFDLSEPTGTAIPCLADVPHGDRHNIQTYTSKCLEHLETVQQIRKETESRRKAVELRVAARVRKRKFGSAMNL

SEQ ID NO: 1896 - protein, 245 aa, Heterodera glycines
  cDNA sequence=SeqID_1382; coding sequence=SeqID_1600
EALKGTDAETYKAAEKHFEVALRKAPQNGAVGFKQEVNKWVVLVKLLIGEIPERSLFHTAELRHVLAPYLLLTQTVRLGDVAGFDQTKREHGPIFVKDRTAALVERIHQSVIRTAIRKISTTYSRIYVSDVATKLNSTEQEAHRELVKAIKEGIVRAQLVAGDPLAGGRHYVKFGTTDDQYRGVEPRREFDARVNELLELYHQAVKALRYPDMRNPEVETIDEQRRREQLALEMAAAEEEDDDDF

SEQ ID NO: 1897 - protein, 223 aa, Heterodera glycines
  cDNA sequence=SeqID_1453; coding sequence=SeqID_1670
SDNDVQKQLRHMMAFIEQEANEKAEEIDAKAEEEFNIEKGKLVQQQRQKIMEYYEKKEKQVELQRKIQRSNMQNQSRLKCLKARDDHLKNVLEEARANLSKISADRERYPAILKGLLLQGLFQLLESKVVLRCRKKDEEMVARILPECLEEFQRTWGNRSEVKIDNEYFLSPESAGGVELLAKDGKIRVSSTLEARLDLIADKITPQVRTALFGPNQNRRFFD

SEQ ID NO: 1898 - protein, 63 aa, Heterodera glycines
  cDNA sequence=SeqID_1463; coding sequence=SeqID_1680
VGFSNLVCGLAVGIVGSGAALADAANPVLFVKILIIEIFASAIGLFGMIIGIVQTNKFNIGTT

SEQ ID NO: 1899 - protein, 471 aa, Heterodera glycines
  misc_feature (119)..(119): Xaa can be any naturally occurring amino acid
  cDNA sequence=SeqID_1475; coding sequence=SeqID_1692
MVSMVAGRVHLLPRAASFGKSFLSSDATKKPDKTSFGNLNDSDRIFTNLYGRHDYRLKGALARGDWFKTKEIILKGPKWILGEISTSGLRGRGGAGFPSGMKWGFMGKPFDGRPKYLVXNADEGEPGTCKDREIMRHDPHKLIEGCLIAGVAMGARAAYIYIRGEFYNEACILQESIHEAYKAGYIGKDCLGTGYNFDIFVHRGAGAYICGEETALIESLEGKQGKPRLKPPFPADIGLFGCPTTVTNVETVAVAPAICRRGGAWFASFGRERNRGTKLYCISGHVNDPTTVEEEMSIPLRDLIERHSGGVIGGWDNLLAIIPGGSSVPLLPKSICDDVLMDFDALVQVNSGLGTAAVIVMNKQCDVVKCIARLAEFYKHESCGQCTPCREGCNWLNKIMWRFVQGKGVPSEIDMLWELTKQIEGHTICALGDAAAWPVQGLIRHFRPELERRMAKYAESHPEIKETLATA

SEQ ID NO: 1900 - protein, 86 aa, Heterodera glycines
  misc_feature (55)..(55): Xaa can be any naturally occurring amino acid
  cDNA sequence=SeqID_1484; coding sequence=SeqID_1701
TCTLARDSCTFLLPLCYDEYLLYRPLFGLDDSAGTLGAMTPPTPASLLFSFWPDXPHIPPFEAIVGGICRVLYDTLRPLVVHNPHL

SEQ ID NO: 1901 - protein, 527 aa, Heterodera glycines
  cDNA sequence=SeqID_1324; coding sequence=SeqID_1491
TRDDSHIRDQAISMRAQLAEADTLVLGLRDRLQQIDTNAAVIEQQLGQFSTDKETTHKELSVGVNYVQTQGEQHLAKAQEAFDRYGEKSQQLSEIAGESKQLSDTQEQRRREILSLAEQIRKESRQSLSDANEAIFGASSTSLQISALLTEVHELEQRLKAIQQMATEQSLETNQTHDGAAFILSGVDSIRLPNVFSDELMEKVKRAQEEGLEALSKTRSEAEKQAELVEKVDKLVEEAREQLRNAQQKQMSVDNSFDEAESFNARTQTAFELATKTWNDAKDSHDALSDFHSKIEQSRAEATEEMTNLADIEKEIEEAQAMTKEAEDAVGDASQNAKEAAEVAEEAKMKAQNLAMEAANLTDATEQTMAGATETKSALDTLSSELDSVLTTTKDFENQAISDAERSNEVAKKATLSEATANSLQEKLSDSDTKLTEALAQLSSLDNVDDAQLDTVEKLLKEAENRFDSSGNEVKMRERIIQAETKAVKQKREIDTLAKELENLRQIRDSLPTRCYNYVNLEQEGQR

SEQ ID NO: 1902 - protein, 461 aa, Heterodera glycines
  cDNA sequence=SeqID_1275; coding sequence=SeqID_1499
FLNIMKKFDYLVIGGGSGGIASARRAAEFKVKVGLIESERLGGTCVNLGCVPKKVMYNTAIHAEFLRDHADYGFDSMNVKFNWSKIKNSRDEYIRRLNSMYQTNLENSKVEIVRGRAKFNKDGSVEVSRSDGSKETCQGTHTLIAVGGAPRIPKDVPGAKYGTSSDGFFGFEQMPNKTVVVGAGYIAVELASILADLGSETHLLIRYDRVLRNFDDTMSQALTDALIAGPVNLKQKTLVSKVERSETTGKLTVHMTDESKLEDVDKLIWAIGRDPLTAELNLADVGVKLIAGDYIKVDDYQNTTKEGIYAVGDVCTPKFELTPVAIAAGRRLAHRLFNKEAENRLTYENIPTVVFSHPPLATTGLSEKEAVERFGRDQVKTYNAGFTNMYFAMTQHKEKTHMKIVCHGKDEKVIGLHILGMGADEMLQGFAVCVKAGLTKKDFDNCVAIHPTASEELVTMR

SEQ ID NO: 1903 - protein, 385 aa, Heterodera glycines
  cDNA sequence=SeqID_1285; coding sequence=SeqID_1509
KMNPDLEIAQKFFLCKENKKDVATIFLELLKSITDNEMAPFYEYAAPQLGVPIDKAKLQTLKALNEQKLDEFDRKIKDAEENLGESEVRQSHLAKAEYLCKIGDKERALAAFQLTFDKTVGIGYRIDLVFNVIRLGFFFMDHQIITENIEKAKSLMEKGGDWDRKNRLRSYEALYKMAIREMRGAALLFLEAVPTFDAYELMSYEDLTFYTVICCVYALDRPDLKEKVVNCSEIQQQLNAEPTDKNRHLPLAKQLLTTFYRSEYAQFFTALAELEQYMKQDRYLRPHYQFYSRAMRVRAYQQFLSPYKTVGLDVMAKCFGVSKEFIDKELFMFISLGALKCRIDTVKDVVEMGQADNKFYQYKKLLHDGDILLNRVQKLSRVINV

SEQ ID NO: 1904 - protein, 387 aa, Heterodera glycines
  cDNA sequence=SeqID_1286; coding sequence=SeqID_1510
NPVKFGLYIGPSKTEAICISSKSSDSGNGPSLGTSPTMSFSPVLTISEENLASEFAKGNVTIADRRPSNAMDFELFEEKAKEKRSLRLSRDQLDLLNLNYGSNDARFSITTKYQGTAWCSCHIYLLKWYDKLVISDIDGTITKSDVLGHVIPAIGGTWAHSGVAELYTGIKKNGYQMVYLSSRAIGQSHYTKTYLQNFAQGSRTLPDGPVLLSPSSILMAFRKEVIERKPEEFKIACLTDLKSLFPVGQPFFAGFGNRETDVKSYLAVQIPPERIMIIDPQGSLRRADNKAGGYVSDYPTLAMDSVDYVFPPRVDMDGIDIRTKEDGILSEFVAWRTDAEQFDALVDAELEQYEERSKRAKAIVAGTTDGRGADGKKKMYRNGRRAK

SEQ ID NO: 1905 - protein, 325 aa, Heterodera glycines
  cDNA sequence=SeqID_1301; coding sequence=SeqID_1524
TRDCVMWFIDENTGKFSDRFSDDQFSLFDAIHQPRPLVKNNVREIIDMANNRRLTVVEAEDANILRMRVGRFIELNGRTEMSLHDAYQLKLVQKPQTLAEVIDSGSLDNNGRFIDGVKPRTLLEAICSGMLDPDVAHIKAGPGDELISIGEALKRGRLTPKGEIVLTLGEVGIHRGEKINLFMAHERGLLTSRVRHTIFDVKGVRNAADGSIMSFKEARDAGILQLQFDGLETRLSEASARGEINSGLAEILVAPCSLSNNGLPLSLVRAFLKGRVDDVNGEVIDPATGLGKSILEAYNIGSVFSTLRAAMRLAALLDVHPSLCQ

SEQ ID NO: 1906 - protein, 353 aa, Heterodera glycines
  misc_feature (262)..(262): Xaa can be any naturally occurring amino acid
  cDNA sequence=SeqID_1312; coding sequence=SeqID_1533
GAFGCGKTVISQSLSKYSNSDAIIYVGCGERGNEMSEVLRDFPELTMEVDGVTTSIMERTALVANTSNMPVAAREASIYTGITLAEYFRDMGLNVAMMADSTSRWAEALREISGRLGEMPADSGYPAYLAARLASFYERAGKVKCFGSPEREGSVTIVGAVSPPGGDFADPVTSATLGIVQVFWGLDKKLAQRKHFPSINWLISYSKYMRALDDYYEKNFAEFVPLRTKCKEILQEEEDLSEIVQLVGKASLAEADKITLEXYDRFCPFYKTVGMLKNMIGFYDFARHSVETTAQSDNKITWNQIRDHLGDIIHELSSMKFEDPSEKTEDQIKKDYEELYERMQNKFRALEDE

SEQ ID NO: 1907 - protein, 655 aa, Heterodera glycines
  cDNA sequence=SeqID_1315; coding sequence=SeqID_1536
TRQNFPSFPVFVMASTHNHCYIESLRTRQTASLKQLLNLNQPLNVSLAVEPVWKLLIFDRYCQDIISPLLSVKQLRELGVTLHLSVDSPREILPDVPAVYFVSPTEQNVQTICADLKRAMYDSFYLNMVRPIPRPLLEQLAESAVAGGATQQVQKLTDQFLSFISLEDDLFMLSRYTKSSPFSFYAINDPSITTDQIDALVADIANGLFAVCVTLGVVPVIKCPKNNAAERVAEKLDQKIRDNLRDARNNLFVQENIRAGHLSIHRPVLVIADRTTDLSTMLHHTWTYQAMIADILEMELNRVRMKDKNGRQKDYEFGTEDKLWANYKGSPFPLVAEAIQEDLEAYRRNEDEIKRLKESMGLSDGDSAEMAVDIFGTAATAKLSTAVGSLPELLEKKRLIDLHTNVATALLDNIKTRKLDVLYETEEKLLTGQEIPVIETLRDCPDKDDILRLILIALCSRNMPTAEQRELQAFIDERAISSDALHFVRQLRAFSHLGAEAEQHQGAGTKTVSMFSKLLSHSSRFVMEGVKNLVPKKHNLPLTKVVDQLTTDVKMGVGVAGITGSSSDFDPDQFRLFDPKLLQGSAVNRDVRPTQAAADVIVFVIGGGNYVEYQNVQEWAKARGLQRCTYGCTEMVNPKQFVEQLTDLGAKSRAM

SEQ ID NO: 1908 - protein, 569 aa, Heterodera glycines
  cDNA sequence=SeqID_1333; coding sequence=SeqID_1551
HEGLRHLFRASLNAYSNGPVIAENIINSLKRNREMGKEQQKQQNKEKKVAAQQQQNTGDEAGTKKQTRLGLDVTKTENYSEWYSQVIVKAELIEYYDVSGCYVIRPWAYSVWEHIQAFFDAEIKKLGVKNCYFPMFVSAAALEREKTHVADFAPEVAWVTKAGNSDLAVPIAIRPTSETVMYPTFAKWCKSHRDLPIKINQWCNVVRWEFKHPTPFLRTREFLWQEGHTAYATKEEAEEEVYDILNLYARVYTDLLAIPVVKGRKSEKEKFAGADFTTTVEAYVPVNGRGIQGGTSHHLGQNFSKMFNIEFDSLVKGQVEFVHQNSWGLSTRTIGAMVMIHGDDTGLVLPPRVADIQVVVIPVGITVKLSDEKRVELIEKSEALVKMLKEEHGVRAVLDQRDNVSPGWKFNHWELKGVPIRLELGPKDLAKEQALAVIRHSGQKVPLPLSNLGESIKQLLDTIHGEMYKKVEQIRDEHMVICLDLEEMTPLLDKKCVVLAPFCGRIECETSIKDFTVREEPADLGTAQMGAKTLCIPLEQPKDVQLPEQCINPRCSQKTQFFALFGRSY

SEQ ID NO: 1909 - protein, 232 aa, Heterodera glycines
  cDNA sequence=SeqID_1344; coding sequence=SeqID_1562
SDFLKMSLTGGTVIALAYKGGVAMATDRTVFASGVHRFQNNTRQYRLNNYCLISFSGDFAEFQWLQNLLERRQMELQIDAGMDHMKPKMVHAFLTSLFYQRRSKMNPFLNTMVVCGMQPVEFHAGEIKPFIGVIDMRGNAYEVDHVATEIGKYLLRQMLETRQTQANGAEQMSKEEALRMVAAALEVSVSRNSRTGQMFDVSTVDANGVKFHDQFQIIGKWDEIEVCDGTYK

SEQ ID NO: 1910 - protein, 255 aa, Heterodera glycines
  cDNA sequence=SeqID_1374; coding sequence=SeqID_1592
LCTLNMVPGESVYGEKRISSQQTENAPIAAITPKTEETTNGSNGVSAPTAAAAGPAPPVEYRVWNPFRSKLAAAVMAGIEDTHIYPGARVLYLGAASGTSVSHVSDIVGPEGMVYAVEFSHRSGRDLLGMAKKRSNVVPIVDDARHPHKYSMMIGIVDTIFSDVAQPDQARIVAHNAHKFLKNNGHVVISIKANCVDSTAEPEAVFAGEVNKLREEQFKPIEQVTLEPYERDHAVVVAEYRAAKKKVKKEKMEEE

SEQ ID NO: 1911 - protein, 724 aa, Heterodera glycines
  cDNA sequence=SeqID_1375; coding sequence=SeqID_1593
ELEVGIEQLEQKLRALNFDPQLDHQLEQERVQLARERGQCAQELDRFEARNFKLRFDYTMPYNGFDRNKVKGVVAKLFKMNEQRYATALEVVAGGRLFHVVIDKVKTGEDLLKAGLPRRVTMLPLDKISANVLDQRLIGQAKRMVGEENVFFPGELIEYEREIELAILSVFGNCLICGDMDQAKQLTFDRAINCRTVTLSGEDFKPTGVLTGGFRKPDASILTALNEISGQYERIRELDHRIGAIERELARLRPLRQQYDQFNGQLTAQRKRLYAINEQLRNSPGEVIRAEIAQLETEVGEANATIETAKPEIEKLTKRVKEFEERKTNERAFQERERKTAQQELANAQKELEQLKGTFSGIKESLAGLREEINALENSIGQDEEEIVQMNERIEEISTEIAKSNAFVMEAKEKVRKAQQKLETYNNEVRSQEKQIRVKTAEIEDLKKRVRHLEAKIESKTRDREEALKNAKDFEKRAQQLEKAHNWIAEERKHFAVEGTAYDFRNYSFEMGKREYDERKTRSKDLLRTVNPKAMESLATAEKELNELLSKRQQLELDKKKLFDAIEQLDDKKRTELLAAHKQISEDFRSIYSTLLPGASATLEPPSGAENCLSGLEVRVAFNGKHKDSLAELSGGQRSLVALSLILAMLKYKPAPFYILDEIDAALDISHTENIGKMIKKHFCQSQFIVVSLKQGFFDNANVVYRVNFRDGRSVVTRTENRHN

SEQ ID NO: 1912 - protein, 396 aa, Heterodera glycines
  cDNA sequence=SeqID_1413; coding sequence=SeqID_1631
VMRSPSPTDNDKARSLNVYRRKLAEYKEIENRLKELRTKERESHKLFDKSENEIKSLQSVGQIVGEVLKQLTEEKFIVKATNGPRYVVGCRRTIDKEKLKQGTRVALDMTTLTIMRQLPREVDPLVYKMSHEDPGNVSYAEIGGLSEQIRELREVVELPLINPELFKRVGITPPKGCLLYGPPGTGKTLLARAVASQLNCNFLKVVSSAIVDKYIGESARMIREMFNYARDNQPCIVFMDEIDAIGGRRFSEGTSADREIQRTLMELLNQMDGFDSLGKVKIIMATNRPDTLDPALLRPGRLDRKIEIGLPNGQSRLEVLKIHATKVLKKEEIDYEAVVKLSEGFSGADLRNVCTEAGLNAIRKERDGVVQEDFMKAVRKVADAKKLETSLDYKPV

SEQ ID NO: 1913 - protein, 234 aa, Heterodera glycines
  cDNA sequence=SeqID_1415; coding sequence=SeqID_1633
KIFSLLLSPLFFISLKAAMTSRILSCNLRRYFSKMNQHIEFGTTKSASSDKQSPPSPTNNQTQHEGMSQECREQIEQMEKLKSDNEMLTDKYKRTLADMENLRKRTQRQIEEAKLFAIQPFCKDLLEVADVLDLALNSLEKMKTEDGAASLDSGVNKGIKMTKEVLLKTFKKHGLVPVQPEGQKFDPNLHEAVYEIPKDQSDRPAGHIAHVLNIGYSLHDRPIRPAKVGVVKME

SEQ ID NO: 1914 - protein, 323 aa, Heterodera glycines
  cDNA sequence=SeqID_1427; coding sequence=SeqID_1645
EMSKRENHPEKEREENRAKFLRSLIDDAHLILAHGNPKIIDHRISHSDRCESFWIRAGFLPLYESLPVWEMEKVPSIRKVKFTGDDRRRLGELSFTMRDKHTMQVRTKSPMKRLFDWDEPDKLEAPVFPPSFDVADELIMSPMVYNLLADTEPLWQCPGYEYDSGETHKYGRLAIKDITPLITRLDTHWRCDTEHERKEVLRECLAATAVVSLFNWLNGQAHCLGHTQYTEIVAPLSSQLILSDGLQLFYFALGQLNTLAINIDVEGFNNQRSNFCCVNGPFKLYDEFDPATKTVRHVDPSDGLSKDGLNPLVLHRILQMCVV

SEQ ID NO: 1915 - protein, 207 aa, Heterodera glycines
  cDNA sequence=SeqID_1430; coding sequence=SeqID_1648
AMSSDFGNPLKKFKLVFLGEQSVGKTSLITRFMYDSFDNTYQATIGIDFLSKTMYLEDRTVRLQLWDTAGQERFRSLIPSYIRDSTVAVVVYDITNANSFHQTSKWIDDVRTERGSDVIIMLVGNKTDLADKRQVSTEEGEQKAKELNVMFIETSAKAGYNVKQLFRRIASALPGIEVEKAADAKQVVDIGPIKPRQIVTEEGSCWC

SEQ ID NO: 1916 - protein, 174 aa, Heterodera glycines
  cDNA sequence=SeqID_1457; coding sequence=SeqID_1674
FEHSLMVRHVTASCFRAPWPFEKKGSTGWRKNGPVVIESHKWPGQQKEFPELSPKFLGANFKQLWRYTGVAPTGFNDPKTDDFVHVPEMVPELVVPDLANFELKPYVSYKTDAKIEERLRNFDKKLTKFGGNEKAAIANSKETELWPPPPIDAKILFDFFYAEKIRQAFEKGKK

SEQ ID NO: 1917 - protein, 660 aa, Heterodera glycines
  cDNA sequence=SeqID_1472; coding sequence=SeqID_1689
FISEMKTSKNIKSRKTASTNEVKKECPEGTENRENVGTSSRLIVKNLPCGKKTRWDEAKVRAHFSKFGTLTDVRLKLSEKTGACKFAFVGFSSAEHCQNAIKALDGAYIGGSKLTVEECKALTTDRTAITKQLSLNKRKKLRQKGKCEVDEEEDKEEAAEEADVDSLIEKQILDTGRLFLRNLPFVCSEEQIRQLFEPFGPLAELECVVDNAGKCKGYALCTFIFPEHAVAAWKALDGTVFMGRMLHIIAGEEKRVRTNGADDDSTNDGCQSAFQRERNEKRKANDAEGATEAATNNRCTWNALFLGTDAVAETLAENYEVEKRDLLLVDGKQQNSAAVRVAMAEARLVRETRKFLLDNGVRLDAFAQRWHLLSNGGDNVDGTEDGTAKMRRSKTTILVKNLDATREGKKEWLHSLFGRFGVVKTVLVPPVHGITAIVEMANARDAKCAFEALAYSKKHTPSGGRPLFLEWAPSNVFDEAHPLRAIGHYGYQQKGQTAVLSDDPSSVGHQSPAETKMEKTDRERGGEEEGKLEEKPKKEEKEDEKHTKILVRNVPFQANLKELTQLFSAFGELNFIRLPKKPGSEGHRGFCFAEFLSVSDAHRAMDALVHSTHLYGRRLVLEWAKPSEESAEEKRQRTQDRMAMAAGVAGAKKRPKMRSF

SEQ ID NO: 1918 - protein, 247 aa, Heterodera glycines
  cDNA sequence=SeqID_1478; coding sequence=SeqID_1695
VQLSENFTAIINMDTTMEQPAEDVEDVQLDLGKKKKKKKAKTTELKLSEDEHEEEKEVTALAEGVGRTNLLDAKNPDAWTDYNYDEMLDMVFNIMREKNPEMVSGKKKTFVMKPPEVQRAGSKKTAFTNFTEICRLLKRDPKHVLQFLMAELGTTGSIDGNQCLIVKGKFQQKHFENVLRGYINEYVRCHTCRSSDTELTKDVSRLFFIQCKRCGSRFAVSSIKSGYTAMVGKRAALRRAAEATAGK

SEQ ID NO: 1919 - protein, 313 aa, Heterodera glycines
  cDNA sequence=SeqID_1481; coding sequence=SeqID_1698
SHFMALNNCFTENRYPNECILSYGSIAVSDPLDAFVCCRFSIHEHQENICAFGTEYGRVVICDVTAPIKGEDFIKHRFATGKNAVFDLCFIPDRPNLLLSLCGASNLELLDIERSSSIFLLGHRDTVRCASVWPENPFCVLTGSRDGDILLWDLREKPLKREIGRKSVSNSVSSLRRYQTAHEATIAITGLLHMSENYFISSSSSSSSGIRIWDLRYQIASSPIRSLFVPQKMSKESGVASMCWDRFRSSFFALCTDNAIYEYVPSLNSSFPVRSLRTNFVNSFFVQCAASPFSDHLLCGSSFSKAFIWDLQF

SEQ ID NO: 1920 - DNA, 2335 bp, Heterodera glycines
  coding sequence=SeqID_1925; coordinates=5-2335
  peptide sequence=SeqID_1930
gaatatggcaatgatggctgaggcaaatggagagaccccactgttgaatggtggtgacctaatggactcgaattcaagtcaagaagggtcctccattggcacgggcaccgaaaacggattgtccaattcctcatctgaagctgctgttattaacaatgagcaccagcaaaatggtgggaacaatgttcctgcaccaaaaggaggacaaagtgaggggaccgacttggacaatgttccatggggcgaacggatacgcgacaccacggggaaacgaaaagaagaaaccagcaatgagaagaaaaaggggaaaaaagctgaggaagttatgccgaaaaagtcgaaggaatcgacctcaaaaagtcgaaaaaagaacgaaagcagcggagaggaagaagactttgacgacgactccgacggggaagaggaggaatatcagccaaagaaaaagaaacaaaagtcggacccatccccggcgaagaaaagcgacagcaaaaagtcaacgaaaacaacaaaagttaccaaggtggaggtcaaggaagagagcggcgctggggttgagcacaagaaacggaagacaacgaaagttgaagtgaaggaagagccctcctcttcccagggaagtccgtccaagaaacgtgtgaagaaacaggaggaagaagaggaagtgtggcgctggtgggaggaggacgagtcgaacgcgggcgcctccgatgggtccatcaaatggcaaacgcttgtccacaaagggcccgtctttgcaccggcctatgtgccattgccaaaacacatcaagttcaaatacgacggaaaggagatggatttgtctttgccggccgaagaagtggcttccttttacgcgaaaatgctcgaccacgactacacgtcaaaaccggtgttcaaccagaactttttcaaggattgggtcaaagtgatgacaaaggcggagcgagccgaaattaaagatttggccaaatgcgattttaggcaaatgcacgctttttacgtgtcggagtcggagaagcgcaaagcgcgcagcaaagaggagaaaaaggcggagaaagaggagaaggaaggcgaggcaaaggtgtacgggttcgccatgttggacggatacaaacagaaaattggcaacttccgaatagaaccgccgggactattcagggggagaggtgaccatccaaagatgggttctctgaagaaacgggtccagccggaggatgtggtcatcaactgctcaagaggactgaagattatgccgccggaggggcacaaatggaaggaaatccgtcatgataacactgtcacttggctgtgttcatggaccgaaaatgtgttgggcagcaacaagtacataatgctgaatccgtccagcaaactcaaaggccaaaaggattgggagaagtttgagaaggcgagaaagttaaaaggacatgtcggtcaaatccgccagcagtacctcgccgactttaagtctaaggaaatgcgtatccgtcagcgtgccgtggcactatattttatcgacaaattggcacttcgtgcgggcaatgaaaaagacaccgacgaagcggccgacacggtcggttgttgctcgttgcgttgtgagcacatcaaattgcacgatgatatggacgacctgaagtatgttgtggaattcgacttcctcggcaaagactccatccgctattacaaccgtgtgccggtggaaaagcaagtgttcaaaaatctgaagctttttatggaggagaaagacccgggggacgatttgttcgaccgattggatacgagttcgttgaaccaatacctgaaggaactgatggacggactgaccgcgaaagtgtttcgtacgtataacgcgtcgatcactctccaagaacagctggacaaactgacaaatccttccgattccgtccacgagaaaatgctttcctacaatcgtgcaaatcgtcaggtggccatcctttgtaaccatcaaagggcagtgccaaaaacgcacgaaaagtcgatggaaaatttggagaataaaataaaagagaagaagcaggagtacaaggagttgaaggatcagctgaagaagagcaaatcggtggacgagaaaatggcaaaaaaatacgaaagattgaaggaacagatcgccaaactgaacacacagcgcacggacaaggatgaaaacaaacaaattgcactgggaacctcaaaactgaactacttggatccgaggatttcggttgcatggtgcaaaaagaatgacgtgcccgttgagaaaatattcagcaaaacgcaacgcgacaaattccgctgggctctcgacatggcgaaggaggacttcattttttga

SEQ ID NO: 1921 - DNA, 1263 bp, Heterodera glycines
  coding sequence=SeqID_1926; coordinates=255-1214
  peptide sequence=SeqID_1931
atggagtgcatgagaatgttgattgtccgtctccgtggtgagtttgagaaacgcgtccgtttcctccgtccgtccgatgtttgcattttccatcgaattgaatgaaaaattccgcggatctgctgagggggcgctaaggctaacatttcggggtcgatttgcgcgaccgcttctcttcggctgtgcaaacctcgctttctcccatcccaactttgcctttgcccaatccctcatttgtccctaattatttcaaaatgcaacggttcgcttctcaaaaggaaactatccattccgtgccggatgacgacgacactttggaggagccgccccgactgccccagggcaatcgccgtcggttgggcgtgtcggcggaggtgccggacgaaaatgaggcggccaattaccagcgagtggtcatcccgaaagacgacgacgtgcaaaaggctttgcgagcggcgatgtgcaaaaatgtgctgtttgcgcatttggacttggacgaggaaaaggccattttcgacgccatgtttccggtggagaaacacctcggggagacaatcattgagcagggtgaagagggcgacaatttttatgtgattgacagtggcgaggtcgatgtgttcgtcaatggcgagttcgtgttgagcattaaggagggaggttcatttggcgagttggcactgatttatggcactccgcgcgcagccaccgtagtcgcgaagacgaacacggtcaaactgtgggssatcgaccgcatcacttaccgcgccattcttatggggtcgacgatgcgaaagcggaaaatgtacgacgaattcctgagcaaagttcagactcttgccgacttagacaaatgggaaagggccaatgtggcggatgcgttggaacagtgccaattcccctcgggcacccacgtggtggagcaaggacatcctggggacgaattcttcatcattgtggagggcgaagctgaggtgctgcagagaccgaacgacgacgcgcccttcgaagtggtcggaaaattgggaccctctgactatttcggggaaatcgccctccttctcgatcgccctcgtgccgccaccgtcgtggccaaaactctgctgaaatgtctgaaattggaccgggcacgatttgagcgcgtgatgggtccggtgcgtgagattctcaagcgcgacgtgtccaattacaattcgtacgtgaagctgatgacttgacgagccggcagatctttggcggccaaagaattgatcgccgatcactcta

SEQ ID NO: 1922 - DNA, 1845 bp, Heterodera glycines
  coding sequence=SeqID_1927; coordinates=1-1845
  peptide sequence=SeqID_1932
atgccaccgacgacaagagaacacattaaggaatcccaatatggctttgtttacggcgtttcgggaccggtggtaactgctgagaaaatgtccggtgctgcaatgtacgaactcgtcagagtcggccattccgaattggtgggcgaaatcatccgattggaaggcgactacgccacgattcaagtctacgaggagacttcgtccgtcacaatcggtgaccccgtgctgcggacggggcagcctttgtctgttgagcttggcccgggcattatgggctccatttttgacggaatacaacggccattgcacgacatttcagaaatgaccaaatccatttacattccgaagggggtcaatgtgaaggcattaaaccgtgcaaaacgatgggaatttatgccgaggaaagatttgcgagttggggaccacgtgacgggcggagatatcatcggaatggtgcacgaaagtgcgttggtcaagcacaaaattatggtggagccgaaggcgtgcggaactgtcaaattcatcgccccgcaaggccaatacaccgtcgaagacaccattttggaagtcgaattcgctggacacacccaaaagcttacgatgatgcacatttggccagtcagaaacccccgcccgtccgccgaaaaattagcggccaatttccctctcctctgtgggcagcgcgtgttggacgcgctctttccgtgtgtccagggcggcacaacggcaattcctggtgcctttggctgtggtaaaactgtcatttcgcagtcgttgtccaaatattccaactccgatgccattatttacgtgggctgtggcgagcgtagcaacgaaatgtcggaagtgttgcgcgactttcccgaactgacgatggaagtggatggagtgaccacgtccatcatggagaggacggcgctggtggccaacacttcgaatatgcccgtggcggcgcgtgaagcgtccatttacacgggaattactctggccgaatacttccgcgacatgggtctgaacgtggccatgatggccgactcgacctcccgatgggccgaggcgctccgtgagatttcgggccgtctcggggaaatgccggctgactcgggttaccccgcctatttggccgcacggctcgcttccttctacgaaagggcgggaaaagtgaaatgttttgggtcgcctgaacgcgaagggtccgtcactattgtcggcgcagtgtcgccgcccggcggagacttcgccgaccccgtcacatcggcaaccctcggcattgtccaagtgttttggggactcgacaaaaaattggcccaacgaaagcacttcccttcaatcaattggctcatttcctacagcaaatatatgcgtgcgttggacgattattacgagaagaattttgccgaatttgttccactgagaacgaaatgcaaagaaattttgcaggaagaggaagatttgtcagaaattgtccaattggtcggcaaagcatcgcttgccgaggccgacaaaatcgctttggaggtggccaaactgatcaaggacgatttccttcagcaaaatggctattccagctatgatcgcttctgtcccttctacaaaactgttgggatgctcaaaaatatgattggcttttacgactttgcccggcactcggtggaaacgactgcacaatcggacaacaaaatcacgtggaatcagatcagagatcacctcggggacatcattcacgaactttcttcgatgaaatttgaggacccatccgaaaaaacggaagatcagatcaaaaaggattacgaagaactgtatgaacggatgcagaacaaattccgagcgttagaggatgaatga

SEQ ID NO: 1923 - DNA, 3557 bp, Heterodera glycines
  coding sequence=SeqID_1928; coordinates=263-3433
  peptide sequence=SeqID_1933
aaatttttcgttgactgattttgtaataaaaagaacacaataaagtggtttttgctcacattccaattctttcttttagtytgctccgttgaatttttattctcatttattggcggtggtcaatagccytacaattagagccgaatattagccgtttgattgaataacattcggagttattttgatgatttttgacccaataattgctcggatgcaattggccactgaaaattagattcgttttttccatttccagtggtttatgcagtcatctgaccttattattgaggaaccagcaacgaaaaaggcaaaaatcatctgtgaactgccgaactccgaggcatcagaaaacgcaccaaagagtaacggagaacaaatggcggccatcgacaccaatttgtactctcggcagatttatgcgcttggacattccgccatggaacacttgcgcaaggcgtcggttctcgtcagtggcctcggctccgtgggcgtggaggtggcgaagaatctgatccttggcggtgttcgctcggtgactcttcacgacacaaaagcgttggcgttcaaagatttgtcggcgcatttctacgccaaggaaagcgacgtgggaacgaaccgtgccaaagtttgcttcgacaaattggcggagctcaacgacactgtgaactgtgcattgtctgtggaaaatctgtcggaggatttcgtcaaacaattcgacttggtcgttctcaccgacgcgtccttttccactcagacggaagtgaacggttggatgcgcaaccatcgcaaaatgttcatctcggcagacgcgcgcggacttttttcttatgcatttgtggacttgggcgacgaattcgttgtgaacgattccgacggggagacgtgcaaagaggtgctcgttgagtacatcgactgcgaaagcggcgacatgacgacactcgaaggcgcatttcaccagttggaggacggggaccacgttgtgttcaccgactttgagcacgccgaactgaacgaacttccaccagtgccagtcactttgaagggaagcaaagtcttcaacattggaaatgctctcgcggccttttctggcgcagttcaaggccccgtttcgcgtggacgtgttcagcaagtcaaagtgcccaagaaaatgtccttcaagccattgtctctcgcactcgccgagcccgactttatgatttgggactttgccaagttcgacgaacctgcgcaacttcacgccctttggcaggctttgtacagttttgaggagatgaaaaactacagccctttgccccgttccgatgccgacgcaaaattgttaaaggaaatgctgccaaaagatgcgcccgaaatgccggactcactgctcttcaacttctcttaccaggcgtgtggaaatctccaacccatcgcttcgctcatcggcggtttggtggcccaagaggcgatgaaggcagtgacgcaccacacgactcccctcaagcagtttctgtacaccgattctcttgaggcgttgccgggcgcagattcgacctttgacgccgccaagttggagaagaacgattgtgcaccgcgcaacaatcgctacgacggacaggcggccgttttcgggtgggcctttcaggaggcgctgcagcaacagaaatggttcattgttggcgccggagcgattggctgtgagctgctgaagaacatggcgatgatgggcttgggctgtggcaacaatggctcgctgaccatcaccgaccccgacaccatcgaagtgtccaatttgaaccgccagtttctgtttcgtcgtcctgatgttgggaaaaagaagtccgaagtcgccgcccgttccgtcaaagcgtttaactcgaccattcacatcaatccgatgtctgagatcgtcgccgagtcgaccgagcacatcttcggcgacgacttcttcgcccgtctgaacggcgtctgtaatgcgctggacaatgtcgaagcacgccgttacgttgaccgccgctgcgtgtactatcagcttccgctgctcgagtccggcacaatgggcgcaaagggcaacacgcaagtggtcttcccgcacttgacggagtcttacggctccacgtccgacccgcccgagaaggagacgcccatctgcacgctgcgcaatttcccctaccaaatccatcacaccattcaatgggcgcgagcgaagttcaccgactatttcacttcggttgcggagacggtcaaccaatacttggacaatgtgaacgactttttgcaccgagtgaaccaaatgactttttctcagcggatcgaagtgctcagtacgcttgagcatgcgttggtcgtcgaatacccaaaaaatgcggaagaatgtgtgagttgggcccgtgaactattcgacacgctttaccacaacgacattgcccaaatgctgcacaatttcccttccagcatgcttactgcccaaggcgacaaattttggagtggaaccaaacgctgtccgcacactttgaacttcgacgttaacaaccctgaacacttcgagttcgtcttctccgcttccattttgcgtgcccaatcttacagtttggctccgatcactgaccgcaaaaaagtggcacaattggccatggcgtactgctccaagccgttgagaccacaagagggagtgcgcatcgctgtgaccgacgccgaggcgacggccaatgatggaaacacagcaaatggcgatgcagacgaaactgaacttcggctgaacgatctgaacgtgaaattggccaggctgaagttggagaacattcgccgcatgacgcccattgactttgagaaggacgacgactccaaccaccacgtcgacttcgtgacgagtgcctccaatttgcgagccgataattacgacatcgaaaaggctgatcggatgaaaacaaaacaaattgcgggcaaaatcatcccggcgttggccaccacaactgcgctcgtctcagggctcgtctgcatcgaactctacaaaaccattgaggcggacggaaagcgctcgacgactccgatcgaacacttcaaaaatgcatttatcaacttggctacgcctttcattgcgttcagcgagccgggcaaagcgcagaagaagaagtacctcgacattgacttcactctttgggaccgtttcgaagttgacggaccgatgacattggggcaattgattgattcggttgagagtaagagtggcctcaccgtttcaatgatttcttccggcgtctcccttttgtatgcgttctttcagcccgcaaaaaaagttgccgagcgcaaggacatggatcttattgcggttttcgaggaagtgtctcgtggcaaagtgccggaccatcgccgagcgatcgttcttgaggcgttgacccagaatgaggaaaacgaagacgttgatatcccattcattaaatataatttccgttaaatcattgtttgagtacgccggtatattggatattgttgtgtccatataagtgattgtctgttccttcgttctcgaaataataaactcagtcagctaaaaaaaaaaaaaaaaaaaaaaaaaaaaa

SEQ ID NO: 1924 - DNA, 2165 bp, Heterodera glycines
  coding sequence=SeqID_1929; coordinates=51-1916
  peptide sequence=SeqID_1934
gtccgaccaaattttccactcattttgcgtccaaaacattccatccaaaaatgaccatttctgcgcccgctgacgttgacaagctccaggatgcggccaaccgaatgcgcatttcgtccattgagcagacgtgcgccgccaactcgggccacccgaccagcagttgcagcgcagcggaaattgtggccactctgttctttgccgaaatgcgttatgacgtgaaggacccgcgcagcgcatccgccgaccgtttcattctgtccaagggtcacgcttgcccaattctgtacgccgcttgggaagaggcgggcctgctcagccgtgaccaagtgctctccctgcgcaagattgactccgacattgagggacatccgaccccgcggctcaacttcatcgacgtggccaccggctcgctgggccagggtctgtcatgcgctgccggcatggcgtacactggcaaatatgtggaccattcgtcctaccgcgtgtactgtttgatgggcgacggagagagtgcggaaggctccgtgtgggaggcggcagcatttgcaagtttctacaagttggacaatctggtggccattgtggacgttaaccgacttggacaaagtcaggagacccaactgcagcacgacattgaagcgtatgtgcaacggtttgccgcgttcggttggaatgccatcggattggaggacggacacgacattacggcacttttgaatgcttacgccaatgccaagaacgtgactggcaaacccacggcaatcatcgccaaaacgctcaagggcaagggcattgacggcgttgccgacctgaacaaccagcacgggaagccggtgtcgaaggacaaggcggagcccatccgggcattgctcaaaagtgacaaaccggcaaattggaccatcccggcaccgattcgggacgcaccggcggtcgacttaggcatcggtgccatcgcaatgagtgcaccgccgcagtacaaaatgggcgaaaaggtggccactcgacaggcgtacggaaacgccttgctgaagctggcggaggccaacaaacgcgtcattgccttagacggtgacatctccaactccaccttctccaacctggtgcaaaagaagctacccgagcagtttgtccagtgttacattgctgagcagaacatggtcggtgttggagttggcatggcgtgccgtgggcgtgtgcttccgcatgtcagcacttttgccgccttcttcacccgtgccggtgaccaaattcgcatgggcgccgtgtccttcacaaatgtcaaattcaccggctctcactgcggcgtttccatcggcgaggacggtcccagtcaaatggccctcgaggacttggccctgttcagcgctttgcccgccagtgccgtcctctacccatccgacgcggtgtcggccgaacgtgcgactgagttggccgccaattacacgggcatcgcttacacgcgcgtctctcgacccgccaccccagtgctctacacaagtgacgagaagttcgagctgggcaagtgcaaggtggttcgcgagaaccccgcggacaccgttttgttggttggcgccggcgtgactctgtacgagtgtttaactgcacacgatttgctcagtgcccaaggcattcgtgtggcggtcattgaccttttctcagtgaaaccaattgacgctgaaacgttggcccaacaggcgaagcgtgtcggcggcaaagtgctcacggtggaggaccattacgaggcgggaggcgtcggctcggcggtgtgcgttgcgcttgcggacattgcgaatgtgcgcgtgcgctccctttgcgtgcgagaattgccacgttccggcccgcccgaggcgctgatggaattgtacggcatttcggccaatgccatcgtcaaagcggtgaagaacttccaataattgtgccaaaaatgaagcagagggaatttggcagacataagaaagacacttattaattgttttaaattttaattgaaagatattttatagtttctcattttgttattttgacctattattatatttttaattatttggccctgctctgttgaccttctttattattattatattgccgctatccatttttatacaaaatatgaagtgcactttttgtcaaaaaaaaaaaaaaaaaaaaaaaaaaaaaaa

SEQ ID NO: 1925 - DNA, 2331 bp, Heterodera glycines
  cDNA sequence=SeqID_1920; peptide sequence=SeqID_1930
atggcaatgatggctgaggcaaatggagagaccccactgttgaatggtggtgacctaatggactcgaattcaagtcaagaagggtcctccattggcacgggcaccgaaaacggattgtccaattcctcatctgaagctgctgttattaacaatgagcaccagcaaaatggtgggaacaatgttcctgcaccaaaaggaggacaaagtgaggggaccgacttggacaatgttccatggggcgaacggatacgcgacaccacggggaaacgaaaagaagaaaccagcaatgagaagaaaaaggggaaaaaagctgaggaagttatgccgaaaaagtcgaaggaatcgacctcaaaaagtcgaaaaaagaacgaaagcagcggagaggaagaagactttgacgacgactccgacggggaagaggaggaatatcagccaaagaaaaagaaacaaaagtcggacccatccccggcgaagaaaagcgacagcaaaaagtcaacgaaaacaacaaaagttaccaaggtggaggtcaaggaagagagcggcgctggggttgagcacaagaaacggaagacaacgaaagttgaagtgaaggaagagccctcctcttcccagggaagtccgtccaagaaacgtgtgaagaaacaggaggaagaagaggaagtgtggcgctggtgggaggaggacgagtcgaacgcgggcgcctccgatgggtccatcaaatggcaaacgcttgtccacaaagggcccgtctttgcaccggcctatgtgccattgccaaaacacatcaagttcaaatacgacggaaaggagatggatttgtctttgccggccgaagaagtggcttccttttacgcgaaaatgctcgaccacgactacacgtcaaaaccggtgttcaaccagaactttttcaaggattgggtcaaagtgatgacaaaggcggagcgagccgaaattaaagatttggccaaatgcgattttaggcaaatgcacgctttttacgtgtcggagtcggagaagcgcaaagcgcgcagcaaagaggagaaaaaggcggagaaagaggagaaggaaggcgaggcaaaggtgtacgggttcgccatgttggacggatacaaacagaaaattggcaacttccgaatagaaccgccgggactattcagggggagaggtgaccatccaaagatgggttctctgaagaaacgggtccagccggaggatgtggtcatcaactgctcaagaggactgaagattatgccgccggaggggcacaaatggaaggaaatccgtcatgataacactgtcacttggctgtgttcatggaccgaaaatgtgttgggcagcaacaagtacataatgctgaatccgtccagcaaactcaaaggccaaaaggattgggagaagtttgagaaggcgagaaagttaaaaggacatgtcggtcaaatccgccagcagtacctcgccgactttaagtctaaggaaatgcgtatccgtcagcgtgccgtggcactatattttatcgacaaattggcacttcgtgcgggcaatgaaaaagacaccgacgaagcggccgacacggtcggttgttgctcgttgcgttgtgagcacatcaaattgcacgatgatatggacgacctgaagtatgttgtggaattcgacttcctcggcaaagactccatccgctattacaaccgtgtgccggtggaaaagcaagtgttcaaaaatctgaagctttttatggaggagaaagacccgggggacgatttgttcgaccgattggatacgagttcgttgaaccaatacctgaaggaactgatggacggactgaccgcgaaagtgtttcgtacgtataacgcgtcgatcactctccaagaacagctggacaaactgacaaatccttccgattccgtccacgagaaaatgctttcctacaatcgtgcaaatcgtcaggtggccatcctttgtaaccatcaaagggcagtgccaaaaacgcacgaaaagtcgatggaaaatttggagaataaaataaaagagaagaagcaggagtacaaggagttgaaggatcagctgaagaagagcaaatcggtggacgagaaaatggcaaaaaaatacgaaagattgaaggaacagatcgccaaactgaacacacagcgcacggacaaggatgaaaacaaacaaattgcactgggaacctcaaaactgaactacttggatccgaggatttcggttgcatggtgcaaaaagaatgacgtgcccgttgagaaaatattcagcaaaacgcaacgcgacaaattccgctgggctctcgacatggcgaaggaggacttcattttttga

SEQ ID NO: 1926 - DNA, 960 bp, Heterodera glycines
  cDNA sequence=SeqID_1921; peptide sequence=SeqID_1931
atgcaacggttcgcttctcaaaaggaaactatccattccgtgccggatgacgacgacactttggaggagccgccccgactgccccagggcaatcgccgtcggttgggcgtgtcggcggaggtgccggacgaaaatgaggcggccaattaccagcgagtggtcatcccgaaagacgacgacgtgcaaaaggctttgcgagcggcgatgtgcaaaaatgtgctgtttgcgcatttggacttggacgaggaaaaggccattttcgacgccatgtttccggtggagaaacacctcggggagacaatcattgagcagggtgaagagggcgacaatttttatgtgattgacagtggcgaggtcgatgtgttcgtcaatggcgagttcgtgttgagcattaaggagggaggttcatttggcgagttggcactgatttatggcactccgcgcgcagccaccgtagtcgcgaagacgaacacggtcaaactgtgggssatcgaccgcatcacttaccgcgccattcttatggggtcgacgatgcgaaagcggaaaatgtacgacgaattcctgagcaaagttcagactcttgccgacttagacaaatgggaaagggccaatgtggcggatgcgttggaacagtgccaattcccctcgggcacccacgtggtggagcaaggacatcctggggacgaattcttcatcattgtggagggcgaagctgaggtgctgcagagaccgaacgacgacgcgcccttcgaagtggtcggaaaattgggaccctctgactatttcggggaaatcgccctccttctcgatcgccctcgtgccgccaccgtcgtggccaaaactctgctgaaatgtctgaaattggaccgggcacgatttgagcgcgtgatgggtccggtgcgtgagattctcaagcgcgacgtgtccaattacaattcgtacgtgaagctgatgacttga

SEQ ID NO: 1927 - DNA, 1845 bp, Heterodera glycines; identical to SEQ ID NO: 1922
  cDNA sequence=SeqID_1922; peptide sequence=SeqID_1932

SEQ ID NO: 1928 - DNA, 3171 bp, Heterodera glycines
  cDNA sequence=SeqID_1923; peptide sequence=SeqID_1933
atgcagtcatctgaccttattattgaggaaccagcaacgaaaaaggcaaaaatcatctgtgaactgccgaactccgaggcatcagaaaacgcaccaaagagtaacggagaacaaatggcggccatcgacaccaatttgtactctcggcagatttatgcgcttggacattccgccatggaacacttgcgcaaggcgtcggttctcgtcagtggcctcggctccgtgggcgtggaggtggcgaagaatctgatccttggcggtgttcgctcggtgactcttcacgacacaaaagcgttggcgttcaaagatttgtcggcgcatttctacgccaaggaaagcgacgtgggaacgaaccgtgccaaagtttgcttcgacaaattggcggagctcaacgacactgtgaactgtgcattgtctgtggaaaatctgtcggaggatttcgtcaaacaattcgacttggtcgttctcaccgacgcgtccttttccactcagacggaagtgaacggttggatgcgcaaccatcgcaaaatgttcatctcggcagacgcgcgcggacttttttcttatgcatttgtggacttgggcgacgaattcgttgtgaacgattccgacggggagacgtgcaaagaggtgctcgttgagtacatcgactgcgaaagcggcgacatgacgacactcgaaggcgcatttcaccagttggaggacggggaccacgttgtgttcaccgactttgagcacgccgaactgaacgaacttccaccagtgccagtcactttgaagggaagcaaagtcttcaacattggaaatgctctcgcggccttttctggcgcagttcaaggccccgtttcgcgtggacgtgttcagcaagtcaaagtgcccaagaaaatgtccttcaagccattgtctctcgcactcgccgagcccgactttatgatttgggactttgccaagttcgacgaacctgcgcaacttcacgccctttggcaggctttgtacagttttgaggagatgaaaaactacagccctttgccccgttccgatgccgacgcaaaattgttaaaggaaatgctgccaaaagatgcgcccgaaatgccggactcactgctcttcaacttctcttaccaggcgtgtggaaatctccaacccatcgcttcgctcatcggcggtttggtggcccaagaggcgatgaaggcagtgacgcaccacacgactcccctcaagcagtttctgtacaccgattctcttgaggcgttgccgggcgcagattcgacctttgacgccgccaagttggagaagaacgattgtgcaccgcgcaacaatcgctacgacggacaggcggccgttttcgggtgggcctttcaggaggcgctgcagcaacagaaatggttcattgttggcgccggagcgattggctgtgagctgctgaagaacatggcgatgatgggcttgggctgtggcaacaatggctcgctgaccatcaccgaccccgacaccatcgaagtgtccaatttgaaccgccagtttctgtttcgtcgtcctgatgttgggaaaaagaagtccgaagtcgccgcccgttccgtcaaagcgtttaactcgaccattcacatcaatccgatgtctgagatcgtcgccgagtcgaccgagcacatcttcggcgacgacttcttcgcccgtctgaacggcgtctgtaatgcgctggacaatgtcgaagcacgccgttacgttgaccgccgctgcgtgtactatcagcttccgctgctcgagtccggcacaatgggcgcaaagggcaacacgcaagtggtcttcccgcacttgacggagtcttacggctccacgtccgacccgcccgagaaggagacgcccatctgcacgctgcgcaatttcccctaccaaatccatcacaccattcaatgggcgcgagcgaagttcaccgactatttcacttcggttgcggagacggtcaaccaatacttggacaatgtgaacgactttttgcaccgagtgaaccaaatgactttttctcagcggatcgaagtgctcagtacgcttgagcatgcgttggtcgtcgaatacccaaaaaatgcggaagaatgtgtgagttgggcccgtgaactattcgacacgctttaccacaacgacattgcccaaatgctgcacaatttcccttccagcatgcttactgcccaaggcgacaaattttggagtggaaccaaacgctgtccgcacactttgaacttcgacgttaacaaccctgaacacttcgagttcgtcttctccgcttccattttgcgtgcccaatcttacagtttggctccgatcactgaccgcaaaaaagtggcacaattggccatggcgtactgctccaagccgttgagaccacaagagggagtgcgcatcgctgtgaccgacgccgaggcgacggccaatgatggaaacacagcaaatggcgatgcagacgaaactgaacttcggctgaacgatctgaacgtgaaattggccaggctgaagttggagaacattcgccgcatgacgcccattgactttgagaaggacgacgactccaaccaccacgtcgacttcgtgacgagtgcctccaatttgcgagccgataattacgacatcgaaaaggctgatcggatgaaaacaaaacaaattgcgggcaaaatcatcccggcgttggccaccacaactgcgctcgtctcagggctcgtctgcatcgaactctacaaaaccattgaggcggacggaaagcgctcgacgactccgatcgaacacttcaaaaatgcatttatcaacttggctacgcctttcattgcgttcagcgagccgggcaaagcgcagaagaagaagtacctcgacattgacttcactctttgggaccgtttcgaagttgacggaccgatgacattggggcaattgattgattcggttgagagtaagagtggcctcaccgtttcaatgatttcttccggcgtctcccttttgtatgcgttctttcagcccgcaaaaaaagttgccgagcgcaaggacatggatcttattgcggttttcgaggaagtgtctcgtggcaaagtgccggaccatcgccgagcgatcgttcttgaggcgttgacccagaatgaggaaaacgaagacgttgatatcccattcattaaatataatttccgttaa

SEQ ID NO: 1929 - DNA, 1866 bp, Heterodera glycines
  cDNA sequence=SeqID_1924; peptide sequence=SeqID_1934
atgaccatttctgcgcccgctgacgttgacaagctccaggatgcggccaaccgaatgcgcatttcgtccattgagcagacgtgcgccgccaactcgggccacccgaccagcagttgcagcgcagcggaaattgtggccactctgttctttgccgaaatgcgttatgacgtgaaggacccgcgcagcgcatccgccgaccgtttcattctgtccaagggtcacgcttgcccaattctgtacgccgcttgggaagaggcgggcctgctcagccgtgaccaagtgctctccctgcgcaagattgactccgacattgagggacatccgaccccgcggctcaacttcatcgacgtggccaccggctcgctgggccagggtctgtcatgcgctgccggcatggcgtacactggcaaatatgtggaccattcgtcctaccgcgtgtactgtttgatgggcgacggagagagtgcggaaggctccgtgtgggaggcggcagcatttgcaagtttctacaagttggacaatctggtggccattgtggacgttaaccgacttggacaaagtcaggagacccaactgcagcacgacattgaagcgtatgtgcaacggtttgccgcgttcggttggaatgccatcggattggaggacggacacgacattacggcacttttgaatgcttacgccaatgccaagaacgtgactggcaaacccacggcaatcatcgccaaaacgctcaagggcaagggcattgacggcgttgccgacctgaacaaccagcacgggaagccggtgtcgaaggacaaggcggagcccatccgggcattgctcaaaagtgacaaaccggcaaattggaccatcccggcaccgattcgggacgcaccggcggtcgacttaggcatcggtgccatcgcaatgagtgcaccgccgcagtacaaaatgggcgaaaaggtggccactcgacaggcgtacggaaacgccttgctgaagctggcggaggccaacaaacgcgtcattgccttagacggtgacatctccaactccaccttctccaacctggtgcaaaagaagctacccgagcagtttgtccagtgttacattgctgagcagaacatggtcggtgttggagttggcatggcgtgccgtgggcgtgtgcttccgcatgtcagcacttttgccgccttcttcacccgtgccggtgaccaaattcgcatgggcgccgtgtccttcacaaatgtcaaattcaccggctctcactgcggcgtttccatcggcgaggacggtcccagtcaaatggccctcgaggacttggccctgttcagcgctttgcccgccagtgccgtcctctacccatccgacgcggtgtcggccgaacgtgcgactgagttggccgccaattacacgggcatcgcttacacgcgcgtctctcgacccgccaccccagtgctctacacaagtgacgagaagttcgagctgggcaagtgcaaggtggttcgcgagaaccccgcggacaccgttttgttggttggcgccggcgtgactctgtacgagtgtttaactgcacacgatttgctcagtgcccaaggcattcgtgtggcggtcattgaccttttctcagtgaaaccaattgacgctgaaacgttggcccaacaggcgaagcgtgtcggcggcaaagtgctcacggtggaggaccattacgaggcgggaggcgtcggctcggcggtgtgcgttgcgcttgcggacattgcgaatgtgcgcgtgcgctccctttgcgtgcgagaattgccacgttccggcccgcccgaggcgctgatggaattgtacggcatttcggccaatgccatcgtcaaagcggtgaagaacttccaataa

SEQ ID NO: 1930 - protein, 776 aa, Heterodera glycines
  cDNA sequence=SeqID_1920; coding sequence=SeqID_1925
MAMMAEANGETPLLNGGDLMDSNSSQEGSSIGTGTENGLSNSSSEAAVINNEHQQNGGNNVPAPKGGQSEGTDLDNVPWGERIRDTTGKRKEETSNEKKKGKKAEEVMPKKSKESTSKSRKKNESSGEEEDFDDDSDGEEEEYQPKKKKQKSDPSPAKKSDSKKSTKTTKVTKVEVKEESGAGVEHKKRKTTKVEVKEEPSSSQGSPSKKRVKKQEEEEEVWRWWEEDESNAGASDGSIKWQTLVHKGPVFAPAYVPLPKHIKFKYDGKEMDLSLPAEEVASFYAKMLDHDYTSKPVFNQNFFKDWVKVMTKAERAEIKDLAKCDFRQMHAFYVSESEKRKARSKEEKKAEKEEKEGEAKVYGFAMLDGYKQKIGNFRIEPPGLFRGRGDHPKMGSLKKRVQPEDVVINCSRGLKIMPPEGHKWKEIRHDNTVTWLCSWTENVLGSNKYIMLNPSSKLKGQKDWEKFEKARKLKGHVGQIRQQYLADFKSKEMRIRQRAVALYFIDKLALRAGNEKDTDEAADTVGCCSLRCEHIKLHDDMDDLKYVVEFDFLGKDSIRYYNRVPVEKQVFKNLKLFMEEKDPGDDLFDRLDTSSLNQYLKELMDGLTAKVFRTYNASITLQEQLDKLTNPSDSVHEKMLSYNRANRQVAILCNHQRAVPKTHEKSMENLENKIKEKKQEYKELKDQLKKSKSVDEKMAKKYERLKEQIAKLNTQRTDKDENKQIALGTSKLNYLDPRISVAWCKKNDVPVEKIFSKTQRDKFRWALDMAKEDFIF

SEQ ID NO: 1931 - protein, 319 aa, Heterodera glycines
  cDNA sequence=SeqID_1921; coding sequence=SeqID_1926
  misc_feature (163)..(163): Xaa can be any naturally occurring amino acid
MQRFASQKETIHSVPDDDDTLEEPPRLPQGNRRRLGVSAEVPDENEAANYQRVVIPKDDDVQKALRAAMCKNVLFAHLDLDEEKAIFDAMFPVEKHLGETIIEQGEEGDNFYVIDSGEVDVFVNGEFVLSIKEGGSFGELALIYGTPRAATVVAKTNTVKLWXIDRITYRAILMGSTMRKRKMYDEFLSKVQTLADLDKWERANVADALEQCQFPSGTHVVEQGHPGDEFFIIVEGEAEVLQRPNDDAPFEVVGKLGPSDYFGEIALLLDRPRAATVVAKTLLKCLKLDRARFERVMGPVREILKRDVSNYNSYVKLMT

SEQ ID NO: 1932 - protein, 614 aa, Heterodera glycines
  cDNA sequence=SeqID_1922; coding sequence=SeqID_1927
MPPTTREHIKESQYGFVYGVSGPVVTAEKMSGAAMYELVRVGHSELVGEIIRLEGDYATIQVYEETSSVTIGDPVLRTGQPLSVELGPGIMGSIFDGIQRPLHDISEMTKSIYIPKGVNVKALNRAKRWEFMPRKDLRVGDHVTGGDIIGMVHESALVKHKIMVEPKACGTVKFIAPQGQYTVEDTILEVEFAGHTQKLTMMHIWPVRNPRPSAEKLAANFPLLCGQRVLDALFPCVQGGTTAIPGAFGCGKTVISQSLSKYSNSDAIIYVGCGERSNEMSEVLRDFPELTMEVDGVTTSIMERTALVANTSNMPVAAREASIYTGITLAEYFRDMGLNVAMMADSTSRWAEALREISGRLGEMPADSGYPAYLAARLASFYERAGKVKCFGSPEREGSVTIVGAVSPPGGDFADPVTSATLGIVQVFWGLDKKLAQRKHFPSINWLISYSKYMRALDDYYEKNFAEFVPLRTKCKEILQEEEDLSEIVQLVGKASLAEADKIALEVAKLIKDDFLQQNGYSSYDRFCPFYKTVGMLKNMIGFYDFARHSVETTAQSDNKITWNQIRDHLGDIIHELSSMKFEDPSEKTEDQIKKDYEELYERMQNKFRALEDE

SEQ ID NO: 1933 - protein, 1056 aa, Heterodera glycines
  cDNA sequence=SeqID_1923; coding sequence=SeqID_1928
MQSSDLIIEEPATKKAKIICELPNSEASENAPKSNGEQMAAIDTNLYSRQIYALGHSAMEHLRKASVLVSGLGSVGVEVAKNLILGGVRSVTLHDTKALAFKDLSAHFYAKESDVGTNRAKVCFDKLAELNDTVNCALSVENLSEDFVKQFDLVVLTDASFSTQTEVNGWMRNHRKMFISADARGLFSYAFVDLGDEFVVNDSDGETCKEVLVEYIDCESGDMTTLEGAFHQLEDGDHVVFTDFEHAELNELPPVPVTLKGSKVFNIGNALAAFSGAVQGPVSRGRVQQVKVPKKMSFKPLSLALAEPDFMIWDFAKFDEPAQLHALWQALYSFEEMKNYSPLPRSDADAKLLKEMLPKDAPEMPDSLLFNFSYQACGNLQPIASLIGGLVAQEAMKAVTHHTTPLKQFLYTDSLEALPGADSTFDAAKLEKNDCAPRNNRYDGQAAVFGWAFQEALQQQKWFIVGAGAIGCELLKNMAMMGLGCGNNGSLTITDPDTIEVSNLNRQFLFRRPDVGKKKSEVAARSVKAFNSTIHINPMSEIVAESTEHIFGDDFFARLNGVCNALDNVEARRYVDRRCVYYQLPLLESGTMGAKGNTQVVFPHLTESYGSTSDPPEKETPICTLRNFPYQIHHTIQWARAKFTDYFTSVAETVNQYLDNVNDFLHRVNQMTFSQRIEVLSTLEHALVVEYPKNAEECVSWARELFDTLYHNDIAQMLHNFPSSMLTAQGDKFWSGTKRCPHTLNFDVNNPEHFEFVFSASILRAQSYSLAPITDRKKVAQLAMAYCSKPLRPQEGVRIAVTDAEATANDGNTANGDADETELRLNDLNVKLARLKLENIRRMTPIDFEKDDDSNHHVDFVTSASNLRADNYDIEKADRMKTKQIAGKIIPALATTTALVSGLVCIELYKTIEADGKRSTTPIEHFKNAFINLATPFIAFSEPGKAQKKKYLDIDFTLWDRFEVDGPMTLGQLIDSVESKSGLTVSMISSGVSLLYAFFQPAKKVAERKDMDLIAVFEEVSRGKVPDHRRAIVLEALTQNEENEDVDIPFIKYNFR

SEQ ID NO: 1934 - protein, 621 aa, Heterodera glycines
  cDNA sequence=SeqID_1924; coding sequence=SeqID_1929
MTISAPADVDKLQDAANRMRISSIEQTCAANSGHPTSSCSAAEIVATLFFAEMRYDVKDPRSASADRFILSKGHACPILYAAWEEAGLLSRDQVLSLRKIDSDIEGHPTPRLNFIDVATGSLGQGLSCAAGMAYTGKYVDHSSYRVYCLMGDGESAEGSVWEAAAFASFYKLDNLVAIVDVNRLGQSQETQLQHDIEAYVQRFAAFGWNAIGLEDGHDITALLNAYANAKNVTGKPTAIIAKTLKGKGIDGVADLNNQHGKPVSKDKAEPIRALLKSDKPANWTIPAPIRDAPAVDLGIGAIAMSAPPQYKMGEKVATRQAYGNALLKLAEANKRVIALDGDISNSTFSNLVQKKLPEQFVQCYIAEQNMVGVGVGMACRGRVLPHVSTFAAFFTRAGDQIRMGAVSFTNVKFTGSHCGVSIGEDGPSQMALEDLALFSALPASAVLYPSDAVSAERATELAANYTGIAYTRVSRPATPVLYTSDEKFELGKCKVVRENPADTVLLVGAGVTLYECLTAHDLLSAQGIRVAVIDLFSVKPIDAETLAQQAKRVGGKVLTVEDHYEAGGVGSAVCVALADIANVRVRSLCVRELPRSGPPEALMELYGISANAIVKAVKNFQ

What is claimed is:

1. A method for controlling a plant-parasitic nematode population comprising providing an agent comprising a double stranded ribonucleotide sequence that functions upon being taken up by the nematode to inhibit a biological function of Cgh-1 within said nematode, wherein the agent comprises all or a part of the nucleotide sequence of SEQ ID NO:1289 or SEQ ID NO:1513.

2. A method for controlling a plant-parasitic nematode population comprising providing an agent comprising a first polynucleotide sequence that functions upon being taken up by the pathogen to inhibit a biological function of Cgh-1 within said nematode, wherein said polynucleotide sequence exhibits from about 95 to about 100% nucleotide sequence identity along at least from about 19 to about 25 contiguous nucleotides to a coding sequence derived from said nematode, the agent comprising a second polynucleotide sequence hybridized thereto that is complementary to said first polynucleotide sequence, and wherein said coding sequence derived from said nematode is selected from the group consisting of SEQ ID NO:1289, SEQ ID NO:1513, and the complements thereof.

3. The method of claim 2, wherein said nematode is *Heterodera glycines*.

4. A method of controlling plant nematode pest infestation in a plant comprising providing in the diet of a plant nematode pest a dsRNA comprising:
   a) a sense nucleotide sequence; and
   b) an antisense nucleotide sequence complementary to said sense nucleotide sequence,
   and wherein the sense and antisense nucleotide sequence comprise:
   (i) a fragment of at least 21 contiguous nucleotides of a nucleic acid sequence of any of SEQ ID NO:1289 and SEQ ID NO:1513, wherein uptake by a plant nematode pest of a double stranded ribonucleotide sequence comprising at least one strand that is complementary to said fragment to inhibits a biological function of Cgh-1 and inhibits the growth of said nematode; and
   (ii) the complement of the sequence of (i).

5. The method of claim 4, wherein said diet comprises a plant cell transformed to express said sense and said antisense nucleotide sequence.

6. The method of claim 1, wherein the double stranded ribonucleotide sequence comprises at least 21 contiguous nucleotides of SEQ ID NO:1289.

7. The method of claim 1, wherein the double stranded ribonucleotide sequence comprises at least 60 contiguous nucleotides of SEQ ID NO:1289.

8. The method of claim 1, wherein the double stranded ribonucleotide sequence comprises at least 21 contiguous nucleotides of SEQ ID NO:1513.

9. The method of claim 1, wherein the double stranded ribonucleotide sequence comprises at least 60 contiguous nucleotides of SEQ ID NO:1513.

10. The method of claim 2, wherein the first or second polynucleotide sequence comprises at least 21 contiguous nucleotides of SEQ ID NO:1289.

11. The method of claim 2, wherein the first or second polynucleotide sequence comprises at least 60 contiguous nucleotides of SEQ ID NO:1289.

12. The method of claim 2, wherein the first or second polynucleotide sequence comprises at least 21 contiguous nucleotides of SEQ ID NO:1513.

13. The method of claim 2, wherein the first or second polynucleotide sequence comprises at least 60 contiguous nucleotides of SEQ ID NO:1513.

14. The method of claim 4, wherein the sense and antisense nucleotide sequence comprises at least 21 contiguous nucleotides of SEQ ID NO:1289 and the complement thereof.

15. The method of claim 4, wherein the sense and antisense nucleotide sequence comprises at least 60 contiguous nucleotides of SEQ ID NO:1289 and the complement thereof.

16. The method of claim 4, wherein the sense and antisense nucleotide sequence comprises at least 21 contiguous nucleotides of SEQ ID NO:1513 and the complement thereof.

17. The method of claim 4, wherein the sense and antisense nucleotide sequence comprises at least 60 contiguous nucleotides of SEQ ID NO:1513 and the complement thereof.

* * * * *

UNITED STATES PATENT AND TRADEMARK OFFICE
CERTIFICATE OF CORRECTION

PATENT NO.       : 8,519,225 B2                                        Page 1 of 1
APPLICATION NO.  : 11/673351
DATED            : August 27, 2013
INVENTOR(S)      : Boukharov et al.

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 1397 days.

Signed and Sealed this
Seventeenth Day of February, 2015

Michelle K. Lee
*Deputy Director of the United States Patent and Trademark Office*